United States Patent 10,760,088 (ISOLATED POLYNUCLEOTIDES AND POLYPEPTIDES AND METHODS OF USING SAME FOR INCREASING PLANT YIELD, BIOMASS, GROWTH RATE, VIGOR, OIL CONTENT, ABIOTIC STRESS TOLERANCE OF PLANTS AND NITROGEN USE EFFICIENCY) - sequence listing, part 4

SEQ ID NO: 6780 - DNA, 1417 bp, Glycyrrhiza uralensis
accaaatcatcatttcaattccaatctggtcaaaaacttcgaccgctttatcctacgcactactcgctgctcgctgcttatcctgcgcatatttcgccggttgcggagccgacatcttcacctaccacctcggcgccctcacctcctcaactacacactattcccattgaatttcagaaaaatcatgagttgtttcagctgttgtgaagaagatgactaccacaagactgctgaaagtggaggaccatatgtggtgaaaaactcaggaaatgatggaaattatcatgcttctgaaactgcaaaacagggtgcccaaactgttaaaattcagcccattgaagttcctgaaataccggtagatgaactcaaagaaattacagataactttggagaaagttctctgattggagagggatcttatggaagagtatattatggtgttcttaaaagtgggcaggctgcagcaatcaagaaattagatgccagtaaacagcctgatgaggaatttttagcccaggtttcaatggtttcacggctgaagcatgacaattttgttcaattgcttggttattgtgttgatggcaattcccgagttcttgcttatgagtttgcatctaatgggtctcttcatgatattttacatggaagaaaaggtgttaaaggagcacagcctggtcctgttctgacatgggcacagagagtcaaaattgctgtaggcgctgcaaaagggcttgagtacttgcatgagagggctaatccccacattatccaccgggacatcaagtcaagcaacgtactgatctttgatgacgatgtggctaaaattgcagattttgatttatcaaatcaggctccggacatggcagcacgtcttcattccacccgtgtccttggaacctttggttatcatgcaccagaatatgcaatgactggacaattgaatgctaagagtgatgtatacagctttggtgttgtccttctggaacttttgactggaaggaaacctgttgatcatacactaccacgtggacagcagagtctggttacttgggctacaccaaaactcagcgaggataaagtcaggcagtgtgttgatacaagactgggaggagaatacccgccgaaagctgttgctaagatggctgccgttgctgcactatgtgtgcaatatgaagctgatttcagaccaaacatgagcatcgtagtcaaagcacttcaacctttgttgactgctcgacctggacctgctggtgaaacagcaaactaatttctctgttatctctttctatatctgtgagtatgtgcacaagtgtgcttgcaaagtataaaagactgcttcaggagctggtggtaaattgcttggacatggctttttgtcccaaagtttacactgcattcattttgttcataatccatg

SEQ ID NO: 6781 - DNA, 1667 bp, Lotus japonicus
aatcgataatcatagctgtactgctctagacagaagaaaatccctgtaaccgcaagcaataattctactttcgattccatttcaaaagcgagtcaagcactgcttcgatccgcccctttatcctacgcactcctccctgcttatcctgcgcacccttcacaccgtcgccgcaccaccgcgcctcgctcttgactctcttctccgcaatttcgctcttccgtttcgtttcagtgggaaagaatcatgagctgtttcaattgttgcgaagaggatgatttccacaagactgctgaaagcggaggaccgtatgttgtaaaaaatccgtcagggaatgatggaaatcatcatgcttctgaaactgcaaagcagggtggtcagactgttaaaccccaacccattgaagttcctaatatatcagaagatgagctaaaagaagttacagataactttgggcaagattctcttattggtgagggatcctatggaagagtctattatggtgtacttaaaaatggtcaggctgcagcaatcaagaagttagatgctagtaaacagcctgatgaggaattcttagctcaggtttcaatggtatcaaggctgaagcatgaaaattttgttcagttgcttggatattcagttgatggaaattcccgtattcttgtttatgagtttgcatctaatgggtctcttcatgatattttacatggcagaaaaggtgttaaaggagcacagcctggtcctgttttgacatgggcacagagagtgaaaattgccgtcggggctgcaagagggcttgaatacttgcatgagaaggctgatccccacattatccaccgggacatcaagtcaagcaatgtgctaatctttgatgatgatgttgctaaaattgcagattttgatttatcgaatcaggctccggacatggctgcacgtcttcattctactcgtgtccttgggacctttggttatcatgcaccagaatatgctatgaccggacaattgaatgctaagagtgatgtgtacagttttggtgttgtccttctggaactcttgactggaaggaaaccagttgatcataccctaccacgtggacagcagagtcttgttacttgggctacaccgaaactaagtgaagataaagtcaggcagtgtgttgatacaagactaggaggagaatacccaccgaaagctgttgctaagatggctgctgttgctgcactatgtgtgcaatatgaagctgatttcagacccaacatgagcattgtagtcaaagctcttcaaccattgttgactgcacgacctggacctgctggtgaaacagcaaattaatctctctgtatctctttctctctatatctctatatctgtgagtatgtgcacaattgtgcatgcaaaatataagagactgcttcagatgctggtggtaaattactcgaacaaggctttttgtcctactctgcattcattttgttcataatctatgaggtcctttgaggttttcttgcttctattcttttaaatgttatttgttttctctattttttattgccattttagttttgtgaaaaattgcaaaagagaaatgagtatattcttttcttagcaaatagctagtcattggactactttattggagacaattatagtgacaaaagccttttattact

SEQ ID NO: 6782 - DNA, 1852 bp, Zea mays
cgcgttctgagtttctgaagagacgaccagcgccacacggagaagacggagggccggcagacagtagactcgctgagcagcagcagtatataagctcacggctcacccaccgctgggggccgcacagccagctgctcagctccgtccggcggaactcggaagccctacgctacgcctaccctcgctgtactactagctgccttcctacccgcttcccctctcctcccgacgccgtctccctccctccctccgcctccgccgtcgccgccgggacacgcgaagcttcaaggtcttgtctttgggtagaacatgtcgtgctttgcgtgctgtggtgatgaagatacccaagtaccagacaccagggctcaatacccaggacaccatccagcgagggccgatgcataccgcccttctgatcaacctcccaagggtcctcagcctgtgaaaatgcaaccaatcgcagtccctgctattcctgtggatgagattagggaggtgaccaagggttttggtgatgaagctttgattggtgagggatcctttggcagagtatacttgggtgttctaagaaatggtaggagtgccgcggtcaaaaagttggattctaacaagcagccagaccaagagttcttggcccaggtgtctatggtgtcaaggctgaagcatgaaaatgttgtcgagttgcttggttactgtgctgatgggacactccgcgtccttgcttatgagttcgctacaatgggttcccttcatgatatgcttcatggaaggaaaggggttaaaggggctcaacccggtccagtcttatcgtggtcgcaacgtgtgaagatagcggttggggcagcgaaaggcctcgagtatcttcatgagaaagcgcagccccatatcatacaccgagacatcaagtctagcaacgtccttcttttcgatgacgatgtagctaagatcgctgactttgatctgtcgaaccaagctcctgacatggcagctcggcttcactcaactagggttctcggaacattcggataccatgcgcctgagtatgcgatgactgggcaactcagctctaagagtgatgtatatagttttggggttgttcttcttgagctgttgactgggaggaaacctgtcgaccatacattgccaaggggacagcagagtcttgtgacctgggctacaccaagacttagcgaagacaaggttagacagtgtgttgactcaagacttggaggggactatcctcctaaagctgttgcgaagtttgcggctgtcgccgccttgtgtgttcaatacgaagcggacttccggccgaacatgagcattgttgtcaaggcgctacaacccctgctgaatgcgcatgcgcgggcgactaaccctggagaacatgctgggtcataagctttgcgtttgcttctctccctcttgttcttgtatgataggtaaggtatatgactcgtcgatgtcgttgttgcggacatgtggctggcagcgtgtaatgtctgtgattattcttcccctgagctgtaaacaagattcttgtatccccacagtatttgattctttctattggtgccgtttttacctatctcaaggcgcaactgctcaagcaatcatccaaacaggccctacaagtcaagttgagcaaattgcgggtaaaaggaatctaatttttttaaattcctctgaacagaatgcctccaggctccggtgaataatcatattcatttgatttgagggtgttcaacaacaccatatatttctaattcaagctgggcttgcgtcatactccgtttcgttttagttgtcgctggatagtgcaaaattgaactatccagcgacaactaaaaagaaa

SEQ ID NO: 6783 - DNA, 1758 bp, Zea mays
ggcaacaggcacatggttgggcgggcggtttgccttttgcccgtttctcacacacgcattctgagtttctgacgagacgaccaacaccacacggagaagacggaggacagtagagtcgtcgaagcagctgtacgccggaaggcctacccccgctatactatctgccttcctactcgcttccctccccgagtccccgtcctcctcagctgccttccgccgccgtgcagcacccgcgcagcctccactccggcgtcgtctccctccctcctccgccatcgccaccgggacacgcaaagcttccaggtcttgtctttgggtagaacatgtcgtgctttgcatgctgtggtgatgaagatacacaagtaccagacaccaggactcaatacccaggacatcatccagcaagagccgacgcataccgccctgctgatcaacctcccaagggttcccaacctgtgaaaatgcaaccgattgcagtccctgccattcctgtggatgagcttagggaggtgactaagggttttggtgatgaagccttgattggtgagggctcctttggtagagtatacttaggtgttctaagaaatggcaggagtgccgcggtcaaaaagttggattctaataagcagccagaccaagaattcttggcgcaggtgtctatggtgtcaaggctgaagcacgaaaatgttgttgagttgcttggttactgtgctgatgggacactccgcgtccttgcctacgagtttgctactatgggttcccttcatgatatgcttcatggaaggaaaggtgttaaaggggctcaacccggcccggtcttatcatggttgcagcgtgtgaagatagctgttggggcagcaaaaggcctcgagtatcttcacgagaaggcgcagcctcatatcatgcaccgagacatcaagtctagcaacgttcttcttttcgatgacgacgtagctaagatcgctgacttcgatttgtcaaaccaagctccggacatggcagcccgacttcactcgactagggttcttggaacgttcggataccatgcgcctgagtatgcaatgaccgggcaactcagctccaagagcgatgtatatagttttggagtcgttcttctcgagctattgaccggaaggaaacctgtggaccatacattaccaaggggacagcagagtcttgtgacttgggctaccccaagacttagcgaagacaaggttagacaatgcgttgactcgaggcttggaggggactaccctcctaaagctgttgcgaagtttgcagctgttgccgcgctgtgtgttcagtacgaagcggacttccggccaaacatgagcattgttgtcaaggcgctacagcccctgctgaatgcgcatgcgcgggcgaccaacccttgagaaaaatgctagctcaaaagcttcgcattgctcctctccgccctcttgtatgatagataagtaagatacgagtcgccgatgtcgttcttgcggacacatggctggcagcgtgtgacatttgtgattatttgtcccctgaattgtaaacaagattcttgtatccccacaacacttgattctttctatcggttgcaagatgacctgccgttttcttcttaagaagtcaccttagcaaaactcacaaactttattactccctctgttcaattataggatgctttgattttgtctagtcgtatagtttttgttatataaatatcttacaatttggaatggtattgactattgagggcttgtttggatc

SEQ ID NO: 6784 - DNA, 850 bp, Pennisetum glaucum
cgcgccctcagcggcgagggctcctacgcccgcgtctacaacgccacgctcagcgacggccgcgccgccgtcatcaagaagctcgacaccagcgcgtcgcaggactccgactccgactttgccgcgcagatagcgatggtctccaagctcaagaacgaatacttcctagagctcgtgtgcttggaggatggcaaccgcatgctggcctatcagtttgccaccatgggttctttgcataacatcctacacgggaagaaaggagttcagggtgccgagcccggtccggtcctcaactggttgcagcgagtgaagatagcttatggagcggcgagagggctagagtacctccacgagaaagtccagccgtcgattgttcatcgagatattcgatccagcaacgttcttatattcgacgatttcaactccaagattgctgatttcaacctgaccaaccaggggaccgacaccgctgcccgtttgcactcgacccgtgtgctaggaacatttggataccatgccccagaatacgctatgacgggccaaatcaaccaaaagagcgatgtctacagttttggtgtgatcctcctagagctactgacaggaaggaaaccggtcgatcacaccatgccgaaagggcagcaaagtcttgtcacttgggccactccaaggttgagtgaagataaagtgaagcagtgtgttgatcccaagctcaacaacgactaccctcccaaggctgtcgcaaagctggcagctgttgcagcgttgtgcgttcagtatgaatccgatttccgaccgaacatgaccatcgtcgtgaaggcaatccagcctcttctaaatgctcctaaaccag

SEQ ID NO: 6785 - DNA, 1664 bp, Mimulus guttatus
aacgcaaccagtcgtcaaaataaataaataaatatagaagataatctcatcactttctggtttgttttccaaccatcttcaacaacagttactacaattggaggaggcgtttctcagatttaggtctgacttttttttattcatcaattcttttcgatcttcttctgggtcatttttatgtcctctcatcccaagcttttccacttcacacattcctaagataccatatcatgagttgctttggttgttgtgaggatgatgacatgcacaaggctgctggtaatggaccatacatgacaaccaactatgcaggcaaccctgcaggcaattatgcagcagaaacagcacaaaaggagaaacaggctgttgcaatgcagccaattgctgtacctgcaatttcagtagacgagttgaaggacattacagataattttggttcaaagtgtttgattggtgagggatcctatggaagagtgtaccatggcgtcctcaaaaccggacaggctgctgcaattaaaaagttggattctagcaagcaaccacaccaagaatttttagcacaggtctctatggtatcaagactgaaacatgaaaatgtggttgagctactcggttattgtgtagatggtggtcttcgggtcctggcttatgagtatgctccaaacgggtccctacatgacattcttcatggcagaaaaggtgtgaaaggtgcacaacctggtccagttctatcgtgggcccagagagtaaaaatagctgttggggctgcaaagggactggagtacttgcacgagaagtcacagcctcatattattcaccgtgacataaagtcgagcaatgttttactttttgatgatgatgttgctatgattgccgattttgatttgtcaaatcaagcccctgacatggcagctcgtcttcattccactcgtgttcttggaactttcggttatcatgccccagaatatgcaatgactgggcaactaagttcaaagagcgatgtatacagctttggtgtggtactcttagaactattgacgggccgtaaaccagttgatcatacactgcctaggggacagcagagtcttgtaacatgggcaacaccaaagttaagcgaagacaaggtaaagcagtgcgtggatggtagactgaatggagaataccctcctaaggctgttgcaaagatggctgcagttgctgcgttgtgtgtgcaatatgaagctgattttaggccaaacatgagcattgtagtaaaagctctccagcctctcttgaatactcgatctggacctcctactactgaaacaccaaactattgaaacaataaacttgttatcagtgctacaagacgaaagtggctgttatttattactattattattattattattattgtttatcttttgatggtattgagagttttgaatgcctaccaaatcttgagctgttgataagtttatcaagacctgtttcaagtgtaggggaacaaagtaaaaagaactattgaatgtagattacaaatagcattcttttgtggacctggttgttttgttgattcttgtaaaagtactttgaattgattgtgaggaatattggatgaaacattgtacattactagttgtatatttgttacaatgttattactgtataatcagtgtcttgta

SEQ ID NO: 6786 - DNA, 1406 bp, Nicotiana benthamiana
gatcgatagtttaagaatagctcaagggtataggaagaaggaaaactatgggctgcttcggttgttgtgatgatgatgacatgcacaaagctgctgatcatggaccattcatgaccaacaattcagcaggctacaatgcagggcagcgtgcaacagaaagtgcacagaaggagacacagaccgttaacatccagcccattgctgttccttctatagctgttgatgagttaaaggacatcacagacaactttggtacaaaagccttgataggtgagggatcatatggaagggtataccatggtgtcctgaaaagtgggcgggctgcagccattaaaaagttagactcgagtaagcagcctgatcgagaatttttggcgcaggtttctatggtgtcaagattaaaacatgacaatgtggttgaattactcggttattctgtggacggcggtcttcgtgtcttggcctatgagtatgccccaaatggatctcttcatgacattcttcatggacgaaaaggtgtgaaaggtgcacagccaggtccagtattgtcatgggcacaacgggttaaaattgctgttggggctgcaaaagggctagagtacttgcatgaaaaagcacagccgcatatcatccatcgtgatattaagtctagcaatgttttactctttgatgatgatgttgctaaaattgcggattttgacttatcaaatcaagctcctgatatggcagcacgtcttcactctacacgtgttcttggaacctttggttatcatgctcctgaatatgcaatgactggtcagctgagttcaaagagtgatgtttacagctttggtgttgtacttcttgaactcctcactggccgtaaacctgttgatcatacattgccacgtggccaacagagtcttgtgacatgggcaacaccaagacttagtgaagataaagtgaagcaatgtgttgatgctagactgggtacagattaccctcctaaagcagttgcaaagatggctgctgttgctgctttgtgtgtgcaatatgaagctgattttcggccaaatatgagcattgtggtaaaagcgcttcaacctttgttgcatgctcgatctgcacctagtgaaacatcaaacgtgtgaattctctcctttcccgcagccactactgcatgaaatgattaacgtttaagatttgttttgttgagttgaagatgatattatactacgagtagtagttatttgggaaatcagcggacatactatgatttcccttgcttccctggtcgattgaatgtgtataatttttataaatgcactaatagaagtaggtttgcctattctttcatggattgttattgatgtcttgacccttgtggctcgacccttccgcggacccgcgcgtagcaggagcttagt

SEQ ID NO: 6787 - DNA, 1404 bp, Cajanus cajan
acgctcacctaataataatcatttcaattccaatattagtcaaaaacttggactgctttatcgtacgccctcgtcgccgcttatcctgcgcatatttcgccggtttctaggctgagatcttcaactatctcctcgccgctctcactctcttagctacactatttctattcgattccagcggaaagaatcatgagttgtttcagctgttgtgaagaagatgacttccagaagactgctgaaagcggaggacaacatctgatcaaaaacacaacaggaagtgatggaaacggtcgtgcctctgaaactgcaaagcagggtactcaaactgttaaaattcagcccattgaagttcctgaattatcggtggatgaactcaaagaaattacagatagttttggagaaagttctttgattggagagggatcctatggaagagtatattatggtgttctgaggagtgggcaggctgcggcaatcaagaaattagatgccagtaaacagcctgatgaggaatttttggcccaggtttcaatggtttcaaggctgaagaatgaaaattttgttcaattgcttggttattgcattgatggaaactcccgtgttcttgcttatgagtttgcatccaatgggtctcttcatgatattttacatggcagaaaaggcgttaaaggagcacagcctggtcctgttctaacatggacacaaagagttaaaattgctgtaggggctgctaaagggcttgagtacttgcatgagaaagctgatccccacattatccacagggacatcaagtcaagcaatgtactaatctttgatgatgatgtggctaaaatcgcagattttgatttgtcaaatcaggctcctgacatggcggcacgtctccattccacccgtgtccttggaacctttggttatcatgcaccagagtatgcaatgactggtcaattgaatgctaagagtgatgtatacagctttggcgttgtccttctggaacttttgactggaaggaagcctgtagatcatacactaccacgtgggcagcagagcctggttacttgggctacaccaagactcagtgaggataaagtcagacagtgtgtagatggaagactcggaggagaatacccgcccaaagctgttgctaagatggccgctgttgctgctctgtgcgtgcaatatgaagctgatttcagacctaacatgagcattgtagtgaaagctcttcaacctttgttgaacgcaagacatggacctgctggtgaaacttcaaactaatctgtgtctatatttctgtctatctgtatcaatgagtatgtgctcaagtgtgcacgcgagatataagaaagtgactgcttcagatggaaatttgcttgaacatgtttatatatctcattgtttaccctg

SEQ ID NO: 6788 - DNA, 1467 bp, Cajanus cajan
ttccacccttttatcctgcgcacccctcccccgtttatcctgcgcatctttcgccgctttcggaactgagatcctctcctccacatcctcagttccgccatttcagtgggaaaaaatcatgagttgttttggctgttgcgaagatgatgacctcaacaaggctgctgaaaacggaggaccctatgttgtaaaaaacccagctggaaatgatgggaattaccatgcttctgaaactgcaaagcagggcgctcagcctgttaaagctcagcccattgaagttcctaatatacaagcagatgaactaaaagaagttacggataactttggtcaagattctctgattggagagggatcctatggaagagtatattatggttctcttaaaagtgggcaggctgcagcaatcaagaagttggatgctagtaaacagcctgacgaggaatttctagcccaagtttcaatggtatcaaggctgaggcatgaaaattttgttcagttgcttggatattgcattgatggaagctcccgtattcttgcttacgagtttgcatctaatgggtctcttcatgatattttacatggcagaaaaggtgttaaaggagcacagcctggtccagttttgacatgggcacaacgagtaaaaattgctgtaggggctgcaagaggacttgaatacttgcatgagaaggctgatccccacataatccatcgggacatcaagtcaagcaatgtgctaatctttgatgatgatgttgctaaaattgcagattttgatttatcaaatcaggctccagacatggctgcacgtcttcattctactcgtgtccttggaacctttggttatcatgctccagaatatgcaatgactgggcaattgaatgccaagagtgatgtatacagttttggtgttgtccttctggaacttctgactggaaggaaacctgttgatcatacactaccacgtggacagcagagtctggttacttgggctacaccaaaacttagcgaggataaagtcaggcagtgtgttgatacacgactaggaggagaatacccacccaaagctgttgccaagatggctgctgttgctgcactgtgtgtgcaatatgaagctgatttcagaccaaacatgagcattgtagttaaagctcttcaacctttgttgactgcacgacctggacctgccggtgaaacaccaaattaatctctctgtatctctttccctctatatttgagagtatgtgcacaagagtgcttgcaaaacataagagactacttcagaagctggtggtaaattgctcaaggatgactttatatctcattgtttacactgcattcattttgttcataatccatgatggtctgccatttccttgcttttattcattttaatgtatttgttttctcctacttttccccccccttttacctcgctgctgggttgattgccatctttacaatgaagtg

SEQ ID NO: 6789 - DNA, 1772 bp, Populus trichocarpa
gtatcaacttgaactcaatctaacaaagtaaaaaaggaaaaattctctctttcctcactcaatctcgccttatcctgcgcaccagccggcttccacctctcagatcctcctgctctcctacacactctctctgtactcaccgatcaatcatagtaatcgtcagttatttagtgggatttataaaggttttgaatcatgagctgcttcggttgttgtgaagaagatgacgtccagaaagctgctgacaatggaggtccatatgcagttaaaagctcagcaggccatgtcggaaattatcatgcatcagaaacagctcccaggggacctcaggctgttaaaatccagcctattgaagtccctgcaatatcagtggatgaactaaaggaagttacagttaactttgggacagattctttgataggagaaggatcatatggaagagtatattatggtgttcttaaaagtgagcaggctgcagcaataaaaaaattagatgccagcaaacaacctgatgatgaattcttagcccaggtctccatggtttcaaggttgaagcatgaaaatttcgtacaattgcttgggtattgtgtagatggaggttcccgcgtactcgcatatgaatttgcttctaacggatctcttcatgatattcttcatgggaggaaaggtgttaaaggagcacaacctggtcctgtccttacatggccacagcgtgtaaaaattgctgttggtgctgcaaaagggcttgaatacttgcatgagaaggctgatcctcgcatcattcatcgtgacattaagtccagcaatgttcttattttcgatgatgatgttgcaaaaattgccgactttgatttgtcaaatcaagctcctgatatggcagcacgtcttcattccactcgagttctgggaacatttggttatcatgctcccgaatatgcaatgactggacaattgaatgcaaagagtgatgtgtacagttttggtgttgtcctgcttgagcttctgactgggaggaaacctgttgatcacactttaccacgtggacagcagagtctagtgacatgggctacaccaaaactcagtgaggacaaggttaagcagtgtgttgatgcaagattacaaggagagtgcccactcaaggcagttgcaaagatggctgctgttgctgccttgtgtgtgcaatacgaagctgatttccggccaaacatgagcattgtggttaaagccctccagcccctgctaaatgcccggccaggacctgctggagaatcagtaggcatgtaattctttctccacagcctcagtgtatgatagtgcatgtaaaagcgcgcatccatatgcaagcgtaatatatcaaggttttgttacttgcgtatgtagcaaaacatttggacacctttccctgtgctcccattatttgacatgcatttgatttttttttatgtgtgaagctgcccatcttgtcatatgattttacctcctttcttttttatttttgctttcccagttagtcatattatatcctctcttactcttaaagttgttacatgtttactagttccttttttttataccatctctcagaggtgaagtaagaggatattcttatccagcttgtaaatgagattgtttacgtgaaaaatatgcctcggcagaagtcaaaacaattgaagttatttgggctaggtttaatttgtattttgactccatacgggctgagttgtctgagccttgatgtttctgggttttcattatatgggcatctccttttc

SEQ ID NO: 6790 - DNA, 1416 bp, Solanum tuberosum
atctttcagttcacagatcaaaacctccacactttcaagaagattttgttgattgagctatgagctgcttcagttgttgtgatgatgatgatatgcacagagctgctgataatgggccattcatggcacacaattcagcaggcaacaatggaggtcagcatgccacagaaagtgcacaaagagagacacagactgtgaatatccagcccattgctgttccttccatcgctgttgatgagttaaaggatatcactgacaactttggttcaaaagcattgataggcgagggatcatatggaagggtataccatggtgtcttgaaaagtggacgtgctgcagccattaaaaaattagactcgagtaagcagcctgatcgagaatttttagctcaggtctcaatggtctcaagactaaaagatgataatgtggttgaattactcggttattgtgtggatggcggttttcgtgtgctagcctatgagtatgccccgaatggatctcttcatgacatccttcatggaagaaaaggtgtgaaaggtgcacagccaggtccagtattgtcatgggctcaacgagttaaaattgcggttggggctgcaaaaggactggagtacttgcatgaaaaagcgcagcctcatatcattcatcgtgatattaagtctagcaacattttactctttgatgacgatgttgctaaaatcgcagattttgatttatcaaatcaagcccctgatatggcagcacgtcttcattccacccgtgttcttgggacctttggttatcatgcaccagaatatgcaatgactggtcagttgagttcaaagagtgatgtttatagctttggcgttgtgctcctggaactacttactggccgtaaacctgttgatcatactttgccacgtgggcaacagagtcttgtaacttgggcaacgccaagacttagtgaagataaagtgaagcagtgtgttgatgctagattaaatacagattaccctccgaaggcaattgcaaagatggctgcagttgctgccttgtgtgtgcaatatgaagccgacttccggccaaacatgagcattgttgtaaaggctctgcagcctctgttgcctcgacctgtaccaagttaaacatcaagcttgtgaattttctccttacccctgcctttacgtcatgaaatgagaaagattgatagtgacattgacattggtacgagtcacaagaggatcgtgtatacgtgatactggtgctcacctggacaactactccacaacaatgtcacctccaccccccttttttttcttcctgtcgattgaatgccaaagaaattgtatattcgttgcaatggaaattgctttgcagattgattttcatggatttgtgttgagattttgaaattctaccaagccacagttgtattag

SEQ ID NO: 6791 - DNA, 1271 bp, Solanum phureja
gaacaatatgatttgctgtggaggcgcagaagaagacagttatatcagcggtccaccggttaatcaaaatacagcacctccgagagccggcatggtggtggaacgggtggtggtagtgaaagaggagagccaaggagtgctgctaagagtggagctcctcagaaagttttacctattgaggtaccagaaatgtccttggttgagctaaacagacttactggcaactttggaaagaaaactctcattggagagggatcttatggccgcgtttttggtgctaaattaagcaacggccaacaagcagcaataaagaaattggatactacttcttcaccagaaccagattctgacttcaccgcccagttatcaatggtttcaagacttaagcacgagcattttgtaacactgttaggatgttgcctcgcagcaaacaatcggatcttggtttatgagtttgcaactatgggctcgctgcatgatgtattacatggcagaaaaggagtacaaggtgctgagcctggtccagttcttacctggaatcagagagttaaaattgcttatggtgcagctagaggacttgaatatctacacgaaaaagttcaaccgccaattaagcatcgggatgtaagatccagcaatgtactactctttgatgattttactgcaaagattgctgatttcaacttgacaaaccagtgttcggacacagcagcacgtctgcattcaactagagtactggggacatttggctaccatgctccagagtatgctatgacaggacagataacacagaaaagtgatgtttatagttttggagttgttctgttagaactcttgacaggaaggaaaccagtagatcatacaatgccaaaagggcaacagagtcttgtcacatgggcgactccacgactaagtgaagataaagtaaagcagtgtgtagatcctaagctaaataatgagtaccctccaaaggcaattgctaagatggcagctgttgcagcactttgtgttcaatacgaggcagatttccgcccaaacatgacaattgtcgtcaaggcactgcaaccactactcaatgcaaaaccagcaggagcagagccgcatgcatagatagaacactatattcttcattgaaacaaagcagaaccaacaactatttcagctattgtgttagttgttttgttttttcttttgatccactctgtttcaagattttgcctttaaacaagaattttcttaattaactaggctcattgccacatgagctatat

SEQ ID NO: 6792 - DNA, 1501 bp, Solanum phureja
gcgtattgatttgagttttttgattattctctttccttttgttgctctttcagttcacagatcaaaaccctccacactttcaagaagattttgttgattgagctatgagctgcttcagttgttgtgatgatgatgatatgcacagagctgctgataatgggccattcatggcacacaattcagcaggcaacaatggaggtcagcatgccacagaaagtgcacaaagagagacacagactgtgaatatccagcccattgctgtcccttccattgctgttgatgagttaaaggatatcactgacaactttggttcaaaagcattgataggcgagggatcatatggaagggtataccatggtgtcttgaaaagtggacgtgctgcagccattaaaaaattagactcgagtaagcagcctgatcgagaatttttagctcaggtctcaatggtctcaagactaaaagatgataatgtggttgaattactcggttattgtgtggatggcggttttcgtgtgctagcctatgagtatgccccgaatggatctcttcatgacatccttcatggaagaaaaggtgtgaaaggtgcacagccaggtccagtattgtcatgggctcaacgagttaaaattgcggttggggctgcaaaaggactggagtacttgcatgaaaaagcgcagcctcatatcattcatcgtgatattaagtctagcaacattttactctttgatgatgatgttgctaagatcgcagattttgatttatcgaatcaagcccctgatatggcagcacgtcttcattccacacgtgttcttgggacctttggttatcatgcaccagaatatgcaatgactggtcagttgagttcaaagagtgatgtttatagctttggcgttgtgctcctggaactacttactggccgtaaacctgttgaccatacattgccacgtgggcaacaaagtcttgtaacttgggcaacaccaagacttagtgaagataaagtgaagcagtgtgttgatgctagactaaatacagattaccctccgaaggcaattgcaaagatggctgcagttgctgccttgtgtgtgcaatatgaagctgacttccggccaaacatgagcattgttgtaaaggctctgcagcctctgttgcctcgacctgtaccaagttaaacatcaagcttgtgaattttctccttacccctgcctttacgtcatgaaatgagaaagattgatattgacattgacattgacattggtacgagtcacaagaggatcgtgtatacgtgatactggtgctcacctggacaactactccacaacaatgtcacctccaccccccttttttttcttcctgtcgattgaatgccaaagaaattgtatattcgctgtaatggaaattgctttgcagattgattttcatggatttgtgttgagattttgaaattctaccaagccacagttatattagtagattgtagaagttgtagtttttgttgttactg

SEQ ID NO: 6793 - DNA, 1501 bp, Sorghum bicolor
cgggacgaagccaacgacgagctcagcagcgccgacgccgcaacaagagcacccgctctgtcgagattaaaaggtagcaatgtggcgccgttgttgctgcaattgccaagtggatgaatccgatcagcgtgaaaatgatcttgtcaaggccacaactaacaacattgatggggcaacaaaggggtttaaagattctgctactggaaaagtcgagtcgcacaatgctgctccccctatcgatatccctgttctgtccttggatgaactgatagaaaaaactgatgacttcggttcaacagctttgataggtgaaggttcttatgggagagtgtactatgcggttcttgataatggaacaaaaatggcagtaaaaaaacttgattctactgaaaatgaacccactaccaaattcttgacctaggtttcattggtttcaaggttgaaacatgaaaactttgtagatatgttggggtactgtatggagcgtaatcttcgcatagtaacctatgaatttgccaccatgggttctctgcatgatgttctacatggaagaaaaggagttcaaggtgctcaaccgggcccagcacttgattggattcaacgagtgcaaattgctgttggtgctgcaaaaggacttgaatatcttcatgagaaagttaagccttccattgtccatagggatattagatcaagtaatatcctcttgtttgaagactttaaggcaaagatagcagactttaatatctcaaatcaagcaccagatatggctgcccggttgcatttaactcgtgtcttgggaaccttcggatatcatgccccagagtatgcaatgactggtcaactaacccagaaaagtgacgtatatagctttggagtagttcttttggagcttttgacaggtagaaagccagtagaccatacaagcctagaggacagcaaagcctggtaacttgggccacaccaaggttaactgaagacaaggtgaagcagtgtgtagatccacggttgatgggtgaatatccagcaaaaggactcgccaagctcgctgctgtagcggctttgtgcgtgcaatattaagctgaattccgcccaaatatgggcattgtggtcaaggctttgtctccactacttgtaacaaagcagactccacctgctgttgacagttgatgtacagaattaacgtaagttgcaaatatgagcggcaacagcttggatactacggacatttgatcgattcacctcaaagatgtcaatcactaactgcatggaggacgtctactgcagtaacaactttgcatctgcggttctacagcatgccaacaatgttcatattcatgtctcaggaaatgccagtattaaggactagtgaaatattcagtgatcaacatggactgttattgcaaatatgcagaattgaagaaaacccttcttttagtgtcacaaacagtaatggaatcacccaatgattcgtgcatgctcgacgcaaaaaccgtaacggtaa

SEQ ID NO: 6794 - DNA, 1790 bp, Sorghum bicolor
gcattcggagttttctgacgagacgaccaacgccacacggagacgagacgacggaggagacagtagactcgctgaaggcaggcaaagctgctgtatataaagctcgctcacggctcaccgctggtgaccgcacagccagcagctccgtccgcctccgcccgtcggaactcggagaaggcctgcctaccccagctgcccttcctactcccttcccttcgccgtcctcctcccgccgccgtctcgcatcgccgccccgcctcgctcccgtcgttcctggccgccggggggcttccttcttctctgtcgctggctacgcgcgtgacgagggagggaggaggagccgtagcgcgtggatccagggccagcggcgtccatcccgcgtgacaagggacaaggagacggttttgtctttgggtagaacatgtcgtgctttgcatgctgcggtgatgaagatacccaagtaccagacaccaggactcaatacccaggacaccatccagcaaggacagatgcataccgccctgctgatcaacctcccaagggtcctcagcctgtgaaaatgcagccaattgcagtccctgctattcctgtagatgagattcgggaggtgactaagggttttggtgatgaagccttgattggtgagggctcctttggcagagtatacttcggtgttttgagaaatggtaggagcgccgcggtcaaaaagttggattctaataagcagccagaccaagaattcttggcgcaggtgtctatggtatcaaggctgaagcatgaaaatgttgttgagttgcttggttactgtgctgatgggacactccgcgtccttgcttatgagtttgctactatgggttctcttcatgatatgcttcatggaaggaaaggtgttaaaggggctcaacccggtccagtcttatcatggtcacaacgtgtgaagatagctgtgggggcagcaaaaggcctcgagtatcttcatgagaaagcacaaccccatatcatacacagagatattaagtctagcaatgttcttctttttgatgatgatgtagctaagatagctgactttgatttgtcaaaccaagctcctgacatggcagctcggcttcactcaactagggttcttggaactttcggatatcatgctcctgagtatgcaatgactgggcaactcagctctaagagcgatgtatatagtttcggagttgttcttcttgagctattgactggaaggaaacctgtcgaccatacattaccaaggggacagcagagtcttgtgacttgggctacaccaagacttagcgaagacaaggttagacaatgtgttgactcaagacttggaggggactatcctccgaaagctgttgcaaagtttgcagctgttgccgccttgtgtgttcaatacgaagcagacttccggccaaacatgagcattgttgtcaaggcgctacaacccctgctgaatgcgcatgcgcgggcgactaacccaggagaaaatgctgggtcataagctttgcttctctcccccgcctcttgtatgatagataagtaagatatatgagtcgtcgatgtcgttcttgcggacatgtggctggcagcgtgtaacatttgtgattattcttcccctgagttgtaaacaagattcttgtatcccccacaatatttgattctttctatcggttgcaagatgacctgtttattggtgctgttttttctttaagagatacctaagaaaaacttgcaagctttattactcactctattcaaaattgtatgatgttttgactttt

SEQ ID NO: 6795 - DNA, 1790 bp, Sorghum bicolor
gcattcggagttttctgacgagacgaccaacgccacacggagacgagacgacggaggagacagtagactcgctgaaggcaggcaaagctgctgtatataaagctcgctcacggctcaccgctggtgaccgcacagccagcagctccgtccgcctccgcccgtcggaactcggagaaggcctgcctaccccagctgcccttcctactcccttcccctcgccgtcctcctcccgccgccgtctcgcatcgccgccccgcctcgctcccgtcgttcctggccgccggggggcttccttcttctctgtcgctggctacgcgcgtgacgagggagggaggaggagccgtagcgcgtggatccagggccagcggcgtccatcccgcgtgacaagggacaaggagacggttttgtctttgggtagaacatgtcgtgctttgcatgctgcggtgatgaagatacccaagtaccagacaccaggactcaatacccaggacaccatccagcaaggacagatgcataccgccctgctgatcaacctcccaagggtcctcagcctgtgaaaatgcagccaattgcagtccctgctattcctgtagatgagattcgggaggtgactaagggttttggtgatgaagccttgattggtgagggctcctttggcagagtatacttcggtgttttgagaaatggtaggagcgccgcggtcaaaaagttggattctaataagcagccagaccaagaattcttggcgcaggtgtctatggtatcaaggctgaagcatgaaaatgttgttgagttgcttggttactgtgctgatgggacactccgcgtccttgcttatgagtttgctactatgggttctcttcatgatatgcttcatggaaggaaaggtgttaaaggggctcaacccggtccagtcttatcatggtcacaacgtgtgaagatagctgtgggggcagcaaaaggcctcgagtatcttcatgagaaagcacaaccccatatcatacacagagatattaagtctagcaatgttcttctttttgatgatgatgtagctaagatagctgactttgatttgtcaaaccaagctcctgacatggcagctcggcttcactcaactagggttcttggaactttcggatatcatgctcctgagtatgcaatgactgggcaactcagctctaagagcgatgtatatagtttcggagttgttcttcttgagctattgactggaaggaaacctgtcgaccatacattaccaaggggacagcagagtcttgtgacttgggctacaccaagacttagcgaagacaaggttagacaatgtgttgactcaagacttggaggggactatcctccgaaagctgttgcaaagtttgcagctgttgccgccttgtgtgttcaatacgaagcagacttccggccaaacatgagcattgttgtcaaggcgctacaacccctgctgaatgcgcatgcgcgggcgactaacccaggagaaaatgctgggtcataagctttgcttctctcccccgcctcttgtatgatagataagtaagatatatgagtcgtcgatgtcgttcttgcggacatgtggctggcagcgtgtaacatttgtgattattcttcccctgagttgtaaacaagattcttgtatcccccacaatatttgattctttctatcggttgcaagatgacctgtttattggtgctgttttttctttaagagatacctaagaaaaacttgcaagctttattactcactctattcaaaattgtatgatgttttgactttt

SEQ ID NO: 6796 - DNA, 1892 bp, Glycine max
atacttattagttgttgataaaaataaaaatcattgtaactcatgtctaataatgcactaataactctgtaacaccaccttcataattccgattccagttcaaagcgactcaagcacttgttcgactcttttatcctacgcactcctccctgcttatcctgcgcatctttcacctagatcctccccttcactccttcactttcctatttcagtgggaaagaatcatgagttgtttcagctgttgcgaagaggatgacctccataaggctgctgaaagtggaggaccctatgttgtaaaaaatccagcagggaatgatggaaattatcatgcttctcaaactgcaaagcagggcactcagcctgttaaacctcagcccattgaagttcctaatatatcagcagatgaactgaaagaagttacggataactttggtcaagattctctgattggagagggatcctatggaagagtatattatggtgttcttaaaagtgggcaggctgcagcaatcaagaatttggatgccagtaaacagcctgatgaggaatttttagcccaggtttcaatggtatcaaggctgaagcatgaaaattttgttcagttgcttggatattgcattgatggaacctcccgtattcttgcttatcagtttgcatctaatgggtctcttcatgatattttacacggcagaaaaggtgttaaaggagcacagcctggtccagttttgacatgggcacaaagagtaaaaattgctgtaggggctgcaagaggacttgaatacttgcatgagaaggctgatccacacattattcaccgggacatcaagtcaagcaatgtgctaatctttgatgatgatgttgctaaaattgcagattttgatttatcaaatcaggctcccgacatggctgcacgtcttcattctactcgtgtccttggaacctttggttatcatgctccggaatatgcaatgactggacaattgaatgctaagagtgatgtatacagttttggcgttgtccttctggaacttctgactggaaggaaacccgttgatcatacactaccacgtggacaacagagtctggttacttgggctacaccaaaactcagtgaggataaagtcaggcagtgtgttgatacaagactaggaggagaatacccacccaaagctgttgctaagatggccgctgttgctgcactgtgtgtgcaatatgaagctgatttcagaccaaacatgagcattgtagtcaaagctcttcaacctttgttgactgcacgacctggacctgccggtgaaacaccaaattaatctttgtatcactttctctctatatttgtgagtatgtgcacaagtgtgcatgcaaaatataagagactgcttcagaagctggtggtaaattgctcagacatgactctatatcccattgtttacactgcattcattttgttcataatccatgaggttctttgcggttttcttgcttttattcattttattgtatttgctttctctattttttcccccttctatccttttacttctgggatgattgtcatctttacgatgaagtgttgggaaaaactacaaaacagaattgtgtatactcaaagctaagagcaagtcaatggactatctctactggaaacagttattcaccaagagccgttcttatcagattgattcttttaattttttcttaaactgtttgtcaaattgagacttgtataaattactcataatttcaattccaatgttttaggaaaaaaaagaaaatatcgtttcactgctgaatgttgtggttgttgtttcgtttgtatttaattttttaatcatatagattttttatgctcgaatgatttgtgttatcttgcaatgcaaagtgttttagga

SEQ ID NO: 6797 - DNA, 2056 bp, Glycine max
acaatacaccatgatacttattatttgttctagagaagataaataaataaataaacaaatcattgtaagttgtaactaataataatgcactagtagtaactcattcatcattccgtttccagttcaagaacttgttctactcttttatcctacgcactcctcccttcttatcctgcgcatctttcaccgagatcctccccttcgcatcttcactttccaccatttcagcttggactttagttgtactttgctctgattggctgaaaccgtttcgatccgtttccttttggattgagattttgctgaccaaagcgttgagcttacattagtattgtctgatttcacggcagtgaagttttcacgcatcgtttgttgtccaaggatgatggaattatgcaaataaaaatttagaattgggaaagaatcatgagttgtttcagctgttgcgaagaggatgacctccacaaggctgctgaaagtggaggaccatacgtcgtaaaaaatccagcaggaaatgatggaaattatcttgcttctgaaactgcaaagcagggcactcagcctgttaaacctcagcccattgaagttcctaatatatcagcagatgaactgaaagaagttacagataactttggtcaagatgctctgattggagagggatcctatggaagagtatattatggtgttcttaaaagtgagctggctgcagcaatcaagaagttggatgccagtaaacagcctgatgaggaatttttagcccaggtttcaatggtatcaaggttgaagcatgaaaattttgttcagttgcttggatattgcattgatggaagctcccgtattcttgcttatgagtttgcatctaatgggtctcttcatgatattttacacggcagaaaaggtgttaaaggagcacagcctggcccagttttgacatgggcacaaagagtaaaaattgccgtaggggcggcaagaggacttgaatacttgcatgagaaggctgatccacacattatccaccgggacatcaagtcaagcaatgtgctaatctttgatgatgatgttgctaaaattgcagattttgatttatcaaatcaggctcctgacatggctgcacgtcttcattctactcgtgtccttggaacctttggttatcatgctccagaatatgcaatgactggacaattgaatgctaagagtgatgtatacagttttggcgttgttcttctggaacttctgactggaaggaaacctgttgatcatacactaccacgtggacagcagagtctggttacttgggctacaccaaaactcagtgaggataaagtcaggcagtgtgttgatacaagactaggaggagaatacccacccaaagctgttgctaagatggctgctgttgctgcactgtgtgtgcaatatgaagctgatttcagaccaaacatgagcattgtagtcaaagctcttcaacctttgttgactgcacgacctggacctgccggtgaaatacccaattaatctctgtatcactttctctacatatttgtgagtatgtgcacaagtgtgcatgcaaaatataacttcagaagctggtggtaaattgctcagacatgactttatatcccattgtttacactgcattcattttgttcataatccatgaggttctttgctgtttccttgcttttattcattttaatgtacttgctttgtctattttttttcctttctatcctttacttctgggatgattgccgtctttacgataaagtgttgggaaaaactgcaaaacagaattgtgtatactcaaagctaagagcaagtcaatggactatctctactggaaacagttattcaccgagagccgttcttattagattgattcttttaatttttttcattaaaatgtttgtcaaattgagagttgtataaattactcaaaatttcaattccaatgttttaggaaagaaaaaagaaaatattgtttcactgctcaatgttgtggctgttgtttcgtttgcgatttaatttttttaatcatatatgattgttttcgtttcct

SEQ ID NO: 6798 - DNA, 1411 bp, Glycine max
atcttggaccgctttatcctacgccctcctccctacttatcctgcgcatatttcgccgttttctcgccgagatcttgaactatctcctccgtgttctcactttctcaactacacaatattcttattgaattccagcggaaagaatcatgagttgcttcggctgttgtgaggaagatgactaccagaagactgctgaaagtggaggacagcatgtggtaaaaaactcaacaggaaatgatggaaacagtcgtgcatccgaaactgcaaagcaggggactcaagctgttaaaattcagcccattgaagttcctgaattacaagtggatgaactcaaagaaatcaccgatggctttggagaaagttctttgattggagagggatcctatggaagagtatattatggtgttcttaaaagtgggcaggctgcggcaatcaagaaattagatgccagtaaacagcctgatgacgaatttttagcccaggtttcaatggtttcacggctgaagcatgacaattttgttcaattgcttggttattgcattgatggaaactcccgagttcttgcttatgagtttgcatctaatgggtctcttcatgatattttacatggcagaaaaggagttaaaggagcacagcctggtcctgttctaacatggactcagagagttaaaattgctgtaggggctgccaaagggcttgagtacctgcatgagagggctgatccccacattatccaccgggacatcaagtcaagcaatgtactaatctttgatgacgatgttgctaaaattgcagattttgatttgtcaaatcaggctcctgacatggcagcacgtctccattccacccgtgtccttggaacctttggttatcatgcaccagaatatgcaatgactggccaattgaatgccaagagtgatgtatacagctttggtgttgtccttctggaacttttgactggaaggaagcctgttgatcatacactaccacgtgggcagcagagcctggttacttgggctacaccaagactcagtgaggataaagtcagacagtgtgtagatgcaagactaggaggagaatacccacccaaagctgttgctaagatggccgctgttgctgccctgtgcgtgcaatatgaagctgatttcagaccaaacatgagcattgtagtcaaagctcttcaacctttattgaatgcaagacatgggcctgctggtgaaactccaaactaatctttgtctatatttatatctgtatcaatgagtatgtgcataagtgtgcacgtgagatataagaaagtgactgcttcagaagcggatggaaatttgcttgaacatgtttatatatcccattgtttacattgcatttattttgttcataatccataggttctctgagatttacttgcttt

SEQ ID NO: 6799 - DNA, 1218 bp, Fragaria vesca
tccgcaccattgtttctctttccagatttgtggcaaatagcgattaaagaggaggaataataatttgttgggtacatgcatggggttttagattgctgtgcctagacaaattgtttgaaacatgtcgtgctgcggcggtgcggaggaagaaaactacggcccaccgcctaaccaatacacaactgctccgcccagaggtggtggtgggggtgcatatggcaatgacagaggagagccaaggagttccaatccggttagaagtggggctccggcgaaggccttaccaattgaattaccggctatgcctttggatgagttaattaggctaacgggtaacttcggtcaaaaagccttgataggagaaggttcttatggccgggttttctatgcaaaattaagtaatggtaagcctgctgcaattaagaagttggatgcaggttcacaagagccagactcagattttgggaatcaattatctacagtatcaagacttaagcatgaccattttgtggagttgatggggtattgcttagaaggaaataatcgaatcttggttttcgagtttgcacagatgggatctttacatgacatattacacggaaggaaaggagtacaaggagctgaacctggtccagctctaagttggaatcagagaattaaaattgcctatggtgcagccaaaggcctcgagtatctgcatgaaaaggttcaaccttccattgttcaccgggatgtcagatccagcaatgtgctactctttgatgatcatgttgccaaaattgcagacttcaacttgaccaatcagtcatctgacacagctgcacgacttcattcgactagagttttgggaacttttggctatcatgctcctgagtatgccatgacggggcagataacacagaagagtgatgtttacagttttggggttgttctattagagctcttgacaggaagaaaacctgtagatcatacaatgccaaaagggcaacagagtcttgttacctgggcaactcctagattgagcgaggacaaagtgaagcagtgtgttgatcccaagctaaacaacgactatccaccaaaggcgattgctaagttggcagctgtggcggcactttgtgttcagtatgaagctgacttcaggccaaacatgacaattgttgtgaaggctctacagccgttactcaattcaaaacctgcaggaccagatgcaaacgcata

SEQ ID NO: 6800 - DNA, 1613 bp, Saccharum officinarum
agactcgctgaagcaagctgtatataagctcacggctcaccgttggtgaccgcacagccacctccgtccgtcagaactcggaaggcctgcctaccccgctgcctttccactcccttccctccgcgtcctcctccgctgcctcgcgccgccgtgcatcgcccgccccgcctcccgcgccgtctcgcctctcatcgccgcgccgcctcgctccgtcgttcctgaccgccgggcgtcttctccgtcgccggctacgcgcgtgaggagggaggaggagccgcagcgcgtggatccaggggcagcggcgtccatcgcgcgtgagaagggacaggagccggacctgtctttgggtagaacatgtcgtgctttgcatgctgtggcgatgaagatacccaagtaccagacaccaggactcaatatccaggacaccatccagcaagggccgatgcataccgccctgctgatcaacctcccaagggtcctcagcctgtgaaaatgcagccaattgcagtccctgctattcctgtagatgagattagggaggtgactaagggttttggtgatgaagccttgattggtgagggctcctttggcagagtatactttggtgttttaagaaatggtaggagtgccgccgtcaaaaagttggattctaataagcagccagaccaagaattcttggcgcaggtgtctatggtgtcaaggctgaagcatgaaaatgttgttgagttgcttggttactgtgctgatgggacactccgcgtccttgcttatgagtttgctactatgggttcccttcatgatatgcttcatggaaggaaaggtgttaaaggggctcaacccggcccagtcttatcatggtcacaacgtgtgaagatagctgttggggcagcaaaaggcctcgagtatcttcatgagaaagcacaaccccatatcatacaccgagacattaagtctagcaatgttcttctttttgatgatgatgtagctaagatagctgactttgatttgtcaaaccaagctcctgatatggcagctcggcttcactcaactagggttcttggaacatttggatatcatgcgcctgagtatgcaatgactgggcaactcagctctaagagcgatgtatatagtttcggagttgttcttcttgagctattgactggaaggaaacctgttgaccatacattaccaaggggacagcagagtcttgtgacttgggctacaccaaggcttagcgaagacaaggttagacaatgtgttgactcaagacttggaggggcctatcctcctaaagctgttgcaaagtttgcagctgttgccgcgttgtgtgttcaatacgaagcagacttccggccaaacatgagcattgttgtcaaggcgctacaacccctgctgaatgcgcatgcgcgggcaactaacccaggggaaaatgctgggtcataagcttcgcttctctccctcctcttgtatgataggtaagtaagatatatgagtcgtcgatgtcgttcttgcggacatgtgggtggcagtgtgtaacatttgtgattattcttcccctgagttgtaaacaagattcttgtatccccacaatatttgattctttctatcggttg

SEQ ID NO: 6801 - DNA, 1129 bp, Solanum lycopersicum
gtagtgaaagaggagaggcaagaagtggtggtgctgctcctaagagtggacctcctcaaaaaattttacctattgaggtaccagaaatgtctttggctgagctaaatagacttactgccaatttcggaaagaaaactctgattggagagggatcttatggacgcgtttttgctgctaaattaagcaacggccaacaagcagcaataaagaaattggatactgcttgttcaccagaaccagattctgacttcaccgcccagttatcaatggtttcaagacttaagcacgagcattttgtaacactgttaggatgttgcctcacagcaaacaatcggatcttggtttttgagtttgcaactatgggctcgctgcatgatgtattacatggtagaaaaggagtacaaggtgctgagcctggtccagttcttacctggaatcagagagttaaaattgcttatggtgcagctaaaggccttgaatatctacacgaaaaagttcaaccgccaattaaacatcgggatgtcagatccagcaatgtactactgtttgatgattttactgcaaaaattgctgatttcaacttgacaaaccagtgttcggacacagcagctcgtctgcattcaactagagtactggggacatttgggtaccatgctccagagtatgctatgacaggacagataacacagaaaagtgatgtttatagttttggagttgttctgttagaacttttgacaggaaggaaaccagtagatcatacaatgccaaaagggcaacagagtcttgtcacatgggcgactccacgactaagtgaagacaaagtaaagcagtgtgtagatcctaagctaaataatgagtaccctccaaaggcaattgctaagatggcagctgttgcagcactttgtgttcaatacgaggcagatttccgcccaaacatgacaattgtcgtcaaggcactgcaaccactactcaatgcaaaaccagcaggagcacaaccgcatgcatagatacaaacaaacacaacattcttcgttcaaacaaaaaggaattcttcagttattttattacttgtggcagatcatatgttttgtttttttcttttgatccactctgtttcaacattttgcct

SEQ ID NO: 6802 - DNA, 1588 bp, Solanum lycopersicum
gactatagagaactgaaatgtactgagggaatactatttatgactaataaaacctataataaatattcacttttgtctttgcgtattgatttgagttttttgattattctctttccttttgttgctctttcagttcacagatcaaaaccccccacactttcaagaagattttgttgactgagctatgagctgcttcagttgttgtgatgatgatgatatgcacagagctactgataatgggccattcatggcacacaattcagcaggcaacaatggaggtcagcgtgccacagaaagtgcacaaagagagacacagactgtgaatatccagcccattgctgttccttccatcgctgttgatgagttaaaggatatcactgataactttggttcgaaagctttgataggtgagggatcatatggaagggtataccatggtgtcctgaaaagtggacgtgctgcagccattaaaaaattagactcaagtaagcagcctgatcgagaatttttagctcaggtctcaatggtctcaagactaaaagatgaaaatgtggttgaattactcggttattgtgtggatggcggttttcgtgtgctagcctatgagtatgccccgaatggatctcttcatgacattcttcatggaaggaaaggcgtgaaaggtgcacagccaggtccagtattgtcatgggctcaacgagttaaaattgcggttggggctgcaaaaggactggagtacttgcatgaaaaagcacagcctcatatcattcaccgtgatattaagtctagcaacattttactctttgatgacgatgttgctaagatcgcagattttgatttatcaaatcaagcccctgatatggcagcacgtcttcattccacccgtgttcttgggacctttggttatcatgcaccagaatatgcaatgactggtcagttgagttcaaagagtgacgtttatagctttggcgttgtgctcctggaactacttactggccgtaaacctgttgatcatacattgccacgtgggcaacagagtcttgttacttgggcaacgccaagacttagtgaagataaagtgaagcagtgtgttgatgctagattaaatacagattaccctccgaaggcaattgcaaagatggctgcagttgctgccttgtgtgtgcaatatgaagctgacttccggccaaacatgagcattgtcgtaaaggctcttcagcctctgttgcctcgacctgtaccaagttagacatcaagcttgtgaattttctccttacccctgcctttacgtcatgaaatgagaaagattgatatcgacattgaaattggtatgagtcacaagaggatcgtgaattcgtgatactgatagtcacctggacaactactccacaacaatgttacctccaccccccccccccctttttttttttcttcttgttgattgaatgccaaagaaattgtatattcactgtaatggaaattactttgcagattgattttcatggatttgtgttgagattttgacattctaccaagccacagttatattagtagattgttgaagttgtagtttttgttgttactgctt

SEQ ID NO: 6803 - DNA, 1379 bp, Triphysaria pusilla
agttactcgtttccttttcaaaacagacgtttcttggaatttagatatattttaggttatcacaagatcatgagttgcttcggttgttgcgaggatgatgatatgcataagactcctggtaatggggcttacccgacaacccacactacaggcaatccagctggatatcacgcaacagaaacagcacaaaaagacaaacagacaattaacatgcaaccaatatccgtgcccgccattccagtagacgagcttaaggatataaccgacaatttcggttcgaaatctttgatcggcgagggatcatacggaagagtgtaccatggagtcttgaaaaccgggcaggctgcagcggttaagaagttggactcgagcaagcagccggaccaagagtttttgtcacaagtgtctatggtgtcgagactaaagaacgagaatgttgttgggctgctcgggtactgtgtggatggtgggcttcgggtcttggcgtacgagtttgctcctaatgggtccctacatgacattcttcatggacgaaaaggtgtgaaaggtgcacagccaggtccggtcctgtcgtgggcccaaagagttaaaattgctgtggggtccgccaaaggattagaatacttgcatgagaaggcaacgcctcgtattattcatcgtgacataaagtcgagcaatgttttactttatgatgatgatgttgctaagattgccgatttcgatttgtccaatcaagcccctgacatggcagctcgtctgcattctactcgcgttcttgggactttcggttatcatgcccctgaatatgcaatgacggggcaactaagttcaaagagtgatgtttatagctttggtgtggtgcttttagaactcttgacgggccgtaaaccggtcgatcataccctgccgaggggacaacagagtcttgtgacatgggcgacacctaagctaagtgaggacaaggtaaagcaatgtgtcgacgagaggctcaacggagaataccctcctaaggctgttgcaaagatggctgcagttgctgcattgtgtgtccaatacgaagctgattttcggccgaatatgagtattgtagtaaaagctctacagcctctattgaatgctcgatcggctgggccgcctatcgaaatacccaatttgtgattttgtttttgttttcgtcttctaaacggcccccacattttggaccgatcgaagaaaagctgaaaaaacgggacctttttagaatttgttatagagcaaggtagaagatattaaatgtaaaaatactcttgagcattcttttgtgaacaaatgaatctggttgttgggtgtgtaaaaatttactttgaattgcttgtgtgaaaagtatggtatttttacat

SEQ ID NO: 6804 - DNA, 1470 bp, Triticum aestivum
ggatacggcgacccacgcttccgcagacgctgttgctactcccctccctctcccttcttgcctgcttccgccgctacctgctcctcctccgcccctccgccgtcgccgggacacgcccaagccaggacttgttttcagaagaatatgtcttgctttggatgctgtggtgatgaagatactcaaagagcaccagacaacaggaatcaatacccaggaagccatccagcaaggaatgatgcataccgcactgccgatccaattcccaaaggtcctcaacctgtgaaagtgcaacccattgcagttcccaccattcctatggatgaaattagggaggttacaaagggttttggtgatgaggctttgattggtgagggttcctttggcagagtatattttggtactctaagaaatggtagaggtgcagcaatcaaaaagctggactccagtaagcagccagaccaagaattgctggcacaggtatctatggtgtcaaggcttaagcatgaaaatgttgttgagttgcttggttactgtcttgatgggaacacccgtgtccttgcttatgagtttgccactatgggctctcttcatgatatgcttcatggaaggaaaggtgttaaaggggctcagccaggtccggtcttatcatggatacaacgggtgaagatagctgttggtgccgcgaaaggcctagagtatcttcatgagaaagcacagcctcacgtcatacacagggacatcaagtccagcaacgttcttctctttgatgatgatgtagctaaaatagctgacttcgatttgtcaaaccaagctcctgacatggcagcccggcttcactcaactagggttctgggaacatttggataccatgcacctgagtatgcgatgactggtcaacttagctctaagagcgatgtgtacagttttggagttgttcttctggagctattgactgggaggaaacctgtcgaccatacattaccgagggggcagcagagccttgtcacatgggccaccccaagactgagtgaagataaggttaggcaatgtgttgactcaagacttggaggggactatcctcctaaggctgttgcaaagtttgcagccgtcgcggcattgtgcgtccaatacgaagccgacttccggccaaacatgagcatcgtcgtcaaggcgctccagcccctgctgaatgcgcgagcagcccaccctggggctgagcatgccggacgctaagctccactccttgtatgatataatagataaggaaaaatgagccatcaattgttgttcttgcggggcgcgtggcaggcggtttttgtacatttgtgattattcttcccaagttgtaaccctcgagattctagtaccagaaatatttgattctttgtatcggttgcaaggtcagcaagtatctagtacctagaacacttgtcatcagacagaaaaaggaagaaaataaacactgctgcg

SEQ ID NO: 6805 - DNA, 1542 bp, Medicago truncatula
atactactactgctgtaacacacaattaaattattttatcacaacaatcaatcatagttgtgtttccaactcaaagcgagtcaaaagctttgctggttctttcctttattctacgcaccctttctgcttatcctacgcttcattcacccttttcgtagtatcaaatccttttatactctcactatccacctcttcatcacaatcaacacaacaatttcgctctctcgtttcattttcggaaagaatcatgagttgtttcggctgttgcgaagaggatgagtttcacaaggctgctgaaagtggtgggccatatgttgtaaaaaacccagcagggaatgatggaaattatcatgcttctgatactgcaaagcagggagctcagactgttaaagtgcagcccattgaagttcctgagatacaggcagatgaactgaaagaagttacggataactttggacaagattctcttattggagagggatcctatggaagagtatattacggagttcttaaaagtggacaggctgcggcaatcaagaagttagatgccagtaaacagcctgatgaggaattcttggcccaggtttcaatggtatcaaggctgaaacatgataactttgtccaattgcttggatattgcgttgatggaaactcccgtattcttgcttatgagtttgcatctaatgggtctcttcatgacattttacatggcagaaaaggagttaaaggagctcagcctggtccagttttgacatgggcacagagagtaaaaattgctgtaggggctgcaagagggcttgaatacttgcatgagaaggctgatccccatattatccaccgggacatcaagtcaagcaatgtgctaatctttgacgatgatgttgcaaaaattgcagattttgatttgtcaaatcaggctccagacatggctgctcgtcttcattccacccgtgtccttggaacctttggttaccatgcacctgaatatgcaatgaccggacagttgaatgctaaaagtgatgtatacagttttggtgttgtccttctggaacttttgactggaagaaaacctgttgatcatacactaccacgaggacagcagagtctggttacttgggctacaccaaaactcagtgaggataaagtcaggcagtgtgttgatacaagactaggaggagaatacccaccaaaagctgttgccaagatggctgctgttgctgcattgtgtgtgcaatatgaagctgatttcagacctaacatgagcattgtagtcaaagctcttcaacctttgttgactgcccgagcgggacctgctggtgaaacagctaattaatatttctttatctctttctatatctgtgagtatgttcactagtgtgcatgcaaaatataagagactgcttcagaagctggtattaaattggtcgaacaaggctttttgtcccaaaggttacactgcattcatttgttcataatccatgaggttgtttgaggtttccttgcttcctctattctttttaatattatttttcattctattta

SEQ ID NO: 6806 - DNA, 493 bp, Petunia hybrida
tgtatagctttggagtagttctgcttgaacttttgactggaagaaaacctgtcgatcacacaatgcctcgaggacagcagagcctggttacttgggctacaccgagattgagcgaagataaagtccagcaatgtgttgatccaaagctgaaaggatatcctccgaaagcagtggccaagatggcggccgtggcagcattgtgtgtgcagtacgaggctgagttccgtccgaatatgagtatcgttgtcaaagctctccagccattgctgaaggctcctgcaccagctccagaaacataaagagtctattttcacccacttgttttggattttcgactgccaactgaatgttttttggtacatcatgccatgatttcatttgtaacatgatgcaaacttaatacttcttttcaaaattttcccgtatttgaaaccggtgtgtaggattgattgattgcttgacttacatggtgagatggttgatgatttccatg

SEQ ID NO: 6807 - DNA, 1470 bp, Hordeum vulgare
gggaggtcatgatctgctgaccgcccccaaatcgaccaacccatcgtcgtgtccggccggcgagaacaatgtcttgctgcggcagcgccgaggaggacacctacggcccgccggcgaaccaagccgctccgccgcccaacgtcaacgctcccggcaacagaggcgggccgagggggcccggcgcccagaggcccggagggccgcccaaggtcctcaccatcgacgtgccggcgataccgctggacgagctcaacaagatgaccaacaatttcagcgacaaggccctcatcggcgagggctcctacggccgcgtctacaactgtaccctcagcgatggccgccccgccgtgatcaagaagctcgatcccagcgcctcgcaggagtccgaccctgatttctctgctcagctagcaatggtctccaagcttaagaacgagtacttcgtggaactcctgggctattgcatggaggaagggaaccgtatgctggcctatcaatttgcaaccatgggttctttgcataatatcttgcacggaaagaaaggagtgcagggcgctgaacccgggccggtgctcaactgggcccagcgcgtgaagatagcttacggagcggcgagggggctagagtacctacatgagaaagtccaaccatcgattgttcatcgagatattcggtcgagtaatatcctaatattcgacgaattcagctccaagattgccgacttcaacctgacaaaccagggcaccgacactgctgcccggttacactcgactcgtgtgctaggaacttttggataccacgctcccgaatatgccatgacagggcaaatcaaccaaaagagtgacgtctacagcttcggtgtgatcctactagaactactgacaggaagaaaaccggtcgatcacacaatgccgaaagggcagcaaagtcttgttacttgggccactccaaggttgagcgaagataaagtaaagcaatgtgttgatccaaagctcaacagtgactaccctccaaaggccgtcgccaagctagcggcagtggcagcgctgtgcgttcagtacgaatccgacttcagaccgaacatgacgatcgtcgtgaaggcgattcagccccttctcaaccaaaaaccggctggaccagccgccgaggcaccgagaccctgatcgatcagcgctaggcggcacaaagaagcctgaatgaactcttgcatggttccatgtgttatatctatagatcatctacttgatttgtctaggtcacaggcagaccacctgtggcggtgctaggatcaaaatcttgtgatgtcaaaattttcaaacggaaaactgtgtagacaaattgaacaggaacagaaaagagtgtactttgttatgttagcagtcttttatggtttgcatatatttgctatgtatgaaatacactataatacataggtttctacataagtaacgagatgaagatacaagagat

SEQ ID NO: 6808 - DNA, 1110 bp, Brachypodium distachyon
aatgtcttgctgcggcagcgccgaggaggacacctacggcccgccggccaaccaagccgctccgccgcccaatgtcaataaccccgggaacagaggcgggccgagagggccgggcgcccagaggcccggtgggccgcccaaggtggtcaacatcgacgtgccggccattccgctggacgagctcaacaagatgaccaacaacttcagcgatcgctccctcatcggcgagggatcctacggccgcgtctacaacggcaccctcagcgacggccgcgccgccgtcatcaagaagctcgactccagcacctcgcaggaatccgacgctgaattctccgctcagctagcgatggtctccaagcttaagaacgagtacttcctggaactcgtgggctactgcatggaggatggcaaccgcatgctagcctatcagtttgcgaccatgggttctttgcataacatcttgcacggcaagaaaggagtgcagggcgctgaacccgggccggtcctcaactgggctcagcgcgtgaagatagcttacggagcggcgagggggctagagtaccttcacgagaaagtccagccgtctattgttcatcgagacattcgatcgagcaatgtcctaatattcgacgagttcagctccaagattgcggatttcaacctgacgaaccagggcactgacagcgctgctcggttgcactcgactcgtgtgctaggaaccttcggataccacgctccagaatatgctatgacagggcaaattaaccaaaagagcgatgtctacagcttcggtgtgatcctactagagctactgaccggaaggaaacctgtcgatcacaccatgccgaaagggcagcaaagtcttgttacttgggccactccaaggttgagcgaagataaagtgaaacagtgtgttgatccgaagcttaacaacgactaccctccaaaagccgttgccaagctagcagcagtggcggcgctgtgcgtccagtacgaatctgacttccggccgaacatgacgattgtcgtgaaggcaatccagccccttctcaaccagaaacccgctgggcctgccatcgaggcgccgagaccctgagcaatccggcgaga

SEQ ID NO: 6809 - DNA, 1084 bp, Fagopyrum esculentum
aaatgagcgtgctgcagctattagaagttagacggcagcaacaacctgatgacgagtatctagctcaggtgtccatggtttcacgtttgaagcatgaaaatttcttgaactgcttggatattgtgtggacggaaatctccgtgtgcttgcttatgagtttgcatctaacgggtctcttcatgatattcttcacggtagaaagggtgtcaaaggtgcacagcctggcccagttttgtcttgggcacagcgtgtaaaaattgcagtaggagcagcaaaagggctggaatacttgcatgaaaaggcagatcctcatataattcaccgtgatatcaagtccagcaacgtgcttctctttgatgatgatgttgctaagattggcgattttgatttgtctaatcaagcaccggatatggcagctcgtcttcattcaactcgtgttcttggaactttcggttatcatgcacccgagtacgcgatgaccggacagctgaacgcaaagagtgatgtatatagttttggtgttgtgctgttggaacttctgactggacgaaaacccgttgaccataccttacctcgtggacagcagtcacttgtgacttgggcgacaccgaagctcagtgaagataaggtgaagcaatgtgttgatcctagactaaatggagaatatcctcccaaggccgtagcaaagatggcagctgtggctgcattatgcgtgcaatatgaagctgatttccggccaaacatgagcattgttgtcaaggctctacagcctctgcttaatactcgagctggacctggggctggttcggatgcaccaggctcatgaacccgtcaaattttaaaatacaatgcagtgtaaaagaagaacccatttcatgagtgaatcatgttattatcgacagattcattgcgttatttcatttgaacttcaacctattctttcatattcgattattcgataaacattgtattccatatccatacactaattgagggtctatgacatgtgcaaaaagattagggacaacgacttgtaccgtcgttgaggaagaaagcatgtattgaggtttagatttgcaactac

SEQ ID NO: 6810 - DNA, 1227 bp, Fagopyrum esculentum
tggtctcacgtatgaaacatgaaaatttccttgaattacttggatattccgtggatgggaatctccgggtgctcgcgtatgagtttgcatctaatgggtctcttcatgatattcttcatggtagaaaaggtgttaaaggtgcacagcctggaccagttttatcctgggcacagcgtgttaaaattgcagtaggggctgcaaaaggactcgagtatttgcacgaaaaggcagatcctcatattattcaccgtgatattaaatctagcaatgtgcttctatttgatgatgatttggctaagattgctgattttgatttgtctaatcaagcacctgacatggctgcacgtcttcattcaactcgtgttcttggaactttcggttatcatgcaccagagtatgcaatgaccggacagctgaatgcaaagagtgatgtatatagtttcggcgttgtgctattggagcttctaacgggacggaaacctgttgatcataccttacctcgtggacagcaaagtctcgttacttgggcaacaccgagactcagcgaagataaggtgaagcagtgtgttgatccaagacttaatggagaatatcctcccaaggctgttgcaaagatggcagctgtggctgcactgtgtgtccaatacgaagctgatttccgaccaaacatgagcattgtggttaaggctttgcagcctctgttgaacactcgagctggagttggtgctggttctgagacacccggctcgtgaagcatctgaactctcattttccatggaaaagggtttgtattaagcagctgtttgtattatatggcaaggagttcatgatttttgcttatcttaaattatgaactatttgcgtctgatttgttcataaatatttccccaaatttgtactatataacaaatcttttgtatcatgcatcagataatatgaatgtgtttgtaagggaactccagtaataaaatgcaaaaagattggtttgatgaccgtttttcttttttctatttatttttacctaaggagagaataatttcaagagataaaacttgtgaagtttatttatttcaagaaaagcggttagattgaataacatctttagaaggggttcaggctaaaatattttacacgaagttcttaatcaacaaaaaaaagtttgaaaaatgaatgtacaacatggagctaaaaaaatttacgaatgaaaccatgaaattcttaatcaac

SEQ ID NO: 6811 - DNA, 1480 bp, Elaeis guineensis
  misc_feature (36)..(36): n is a, c, g, or t
  misc_feature (1153)..(1153): n is a, c, g, or t
  misc_feature (1195)..(1195): n is a, c, g, or t
  misc_feature (1273)..(1275): n is a, c, g, or t
  misc_feature (1278)..(1279): n is a, c, g, or t
  misc_feature (1290)..(1290): n is a, c, g, or t
  misc_feature (1293)..(1293): n is a, c, g, or t
  misc_feature (1296)..(1296): n is a, c, g, or t
  misc_feature (1298)..(1298): n is a, c, g, or t
  misc_feature (1300)..(1300): n is a, c, g, or t
  misc_feature (1303)..(1303): n is a, c, g, or t
  misc_feature (1306)..(1306): n is a, c, g, or t
  misc_feature (1309)..(1309): n is a, c, g, or t
cccaccgccattttatcctgcgcctcgcccgctatngtgcgcgccgccgccggcctccaaccggatcctcgccagcaccgcctgcttcgccgccccttcttgagaagcggtagttgcttcaagggagacaaatcatggcatgcttttcatggtgtggacgaaatgttagtcacctagacactgacagtgggggaccatttactacaagcaatgtatcaggcaatgttggagttaatggtggctcagatcctgctcctaggggtgctcaaagtgtgagagtgcagcctattgcagtccctgccattcttctggatgaaataaaggaaattacaaaatatttcagcaatgaaactttaattggagagggttcttatgctaaggtgtactatggtgtactgaaaagtggggaaaaatcagccataaaaaaattagatgccagtaagcagcctgatcaagaatatttggcacaggtatccttggtgtcaaggttgaagcatgaaaatgttgacagctacttggctattgtgttgatggaaatctccgtgttcttgcatatgagtttgccactatgggatcccttcatgatattttacatggacggaaaggcgttaaaggagcacaaccaggtccagttttgtcatgggcacagcgggtgaaaattgctgtaggagctgcaagaggacttgaatacctacatgagaaagttcaacctcgtgttattcatcgtgacattaagtccagcaatatacttatatttgatgatgatgttgcgaaaatagctgattttgacctgtcaaatcaggctcctgacatggcagcacgtcttcactctactcgtgttcttggaacctttggttatcatgctccagagtatgcaatgacaggacagcttagttccaagagcgatgtttacagctttggtgttgttcttttggagcttttgactggtcgtaaacctgtggatcatacactaccacgaggccagcagagtcttgtaacatgggcaacaccaagacttagtgaagataaggtaaagcagtgcgtggatgcaaggctaggaggagactaccctcctaaggccgttgcaaagttggctgcagtagccgctttgtgtgtgcagtatgaagctgattttcggccaaacatgagcatngttgtgaaggcactccagcctctgttaaatactcggtctgtncctcccagtggggcaccaggattgtgaaaccgtcgcttcccattcgtattcctggctcatagcagaattcagcgtgcnnngcnngtttgctgacnaanatngncnttntcntcnaagctattcagcccttgttggtcagacccaaggttgtaaaagtctactctgccttcttgctcattgcttgtagcagaatctggttgtggatggtatttgctgccttctaggttttatatcgttgttactgaatctgtgatgagcgatgaagctaatgtgatgattgactgc

SEQ ID NO: 6812 - DNA, 1544 bp, Setaria italica
ccgcgagtgaactgacaacctctccaaggctccaaggaaagaccgaagactcggaacccgtacacaccgagctcccttctcccctactctcgctgctgccgtgctgcggcgaattttcttgccctgcgccggccgccgtggctagcctgcgccaccgccccgcttccgcccttccgccgccctccgggagccgaaaggtcttggcttagtttgaacatgtcttgtctggcatgctgtggcggcgaagacactcaaagagcacctgatagtggaggtccatactctggtggctacccagcaaggaatgatgcttatcgcactgctgatccaactcccagaggtgctcaacctgtgaaagcgcagccaatcgctgtccccactattcctgtagaagaaatcagggaggtcacaaagggttttggtgatgaagttttgattggtgagggttcttttggcagagtgtatcttggtgtacttaaaaatggtagaagtgcggcgatcaaaaagttagattcaagtaaacaaccggaacaagaatttttggcacaggtctccatggtgtcaagacttaagcatgacaatgtcgtggagttgcttggttactgtgttgatggaaacactcgtatccttgcttatgaatttgctactatgggttctcttcacgatattcttcatggacggaaaggtgtgaaaggagctcagccaggtccagtcctgtcctggacacaacgagtgaaaattgctgttggagcagcaaaaggcttggagtatcttcatgagaaagcgcagcctcatatcatacacagggacatcaaatccagcaacgtacttctatttgatgatgatgtatctaaaatagctgattttgacttgtcaaaccaagctcctgatatggcagctcgacttcactcaactagggttcttggaacatttggatatcatgcacctgagtatgcgatgactggacaacttagctctaagagcgatgtctacagttttggagttgttcttctggagctcctgactggaagaaagcccgtggatcatacattaccaaggggacagcagagtctcgtgacatgggcaactccacggcttagtgaagacaaagtcaggcagtgtgttgactcaagacttggaggggaatatcctcctaaatctgttgcaaagtttgcagcagttgccgcattgtgcgttcaatatgaggctgattttcgaccaaacatgagtattgtggtgaaggcgctccagcccctgctaaatgcgcgagcatccaacaaccctggatgagtgaatgactgctcttgcttgtacctgacgcgagtatctgattcagacaatcatgtagcattgtattaagacaaaattgtggtgtttggcttaatgcacttgaccttaatgagataactccttggtatttcctggatgtttccgactagtctctgtaccttgagagggccctagcgtatacaagtataaactgtatgccatttgtttggttgcattccgtctggtgcccctctgttccttgagaaatgattccg

SEQ ID NO: 6813 - DNA, 1305 bp, Silene vulgaris
aacatgagctgctttggctgttttggaggagacaattctcataaacctatagaaaatggaggtggttacgtacccccaaaaccatcagggagagatggttatcacattattgaaaatcaaactagcaaaccaccggtgaaggcccagcctatagatgtccctgccatttctgcggatgaactaagggacattacaaacaattatgggtccaaagctttaataggagagggatcctatggtagagtttattacggggtgctaaaaagtgggcgaaaagcggcaatcaagaaactggacgcaagcaagcaacctgataatgaatttctagctcaggtttctatggcctcgaggctgaaacatgacaattttgttgaacttcttggttactgtgttgatggcaactctcgtgttcttgcatatgagtttgcatcaaatggatctatccatgacgtccttcatgggaaaaagggcgtgaaaggagcacagcccggaccagtattgtcatgggcccaacgtgttaaaattgcagtaactgccgccagaggactggaatatctgcacgagaaggctgaccctcgtatctttcatagggatataaagtccagtaatatactgctatttgatgacgatgttgctaagattggtgattttgatttgtcaaatgaagctcctgatatggctgcccgacttcattctactcgagttcttggaacttttggctatcacgcacctgagtatgcaatgactggtcaactaaatgcaaagagtgatgtatacagttttggtgtcgtcttgcttgagatactcactggtaggaagccagtggatcatactttgccacgtggacagcagagtcttgtgacatgggcgactcctaagctgagtgaagacaaggtgagtcagtgtattgatcctaagctgaatggagagtatcctcccaagtctgttgccaagatggctgcagtggcagcgttgtgcgtgcagtatgaatcagatttcaggccgaacatgagcattgtggtcaaggcactacagcctctgttgaatactcctagaacaggagccagtcgacctaccacggttgctcctaactactgaacaagagcattatcgttacgtgatcacaaacatttttaaccattgtgcagggcgtgtttgggtggataaacgactcttaaccgctgatttgttcataatctgacgattaaatttttgggtgaatggattgtaaagccagaactttctgcttgtactgaaatatgaaaagaagctcagattttacggcatcttatattcttatgacat

SEQ ID NO: 6814 - DNA, 1523 bp, Setaria italica
ggcatcgcggcctcggttgcgaaggatgggaatagcgtacgggctggggatggtgggtgggaatggatcttgaatgtcaatatgagctcaagtgctcaaaatcgaagtgttggcgtccagaaggtcttggcttagtttgaacatgtcttgtttggcatgctgtggcggcgaagacactcaaagagcacctgatagtggaggtccatactctggtggctacccagcaaggaatgatgcttatcgcactgctgatccaactcccagaggtgctcaacctgtgaaagcgcagccaatcgctgtccccactattcctgtagaagaaatcagggaggtcacaaagggttttggtgatgaagttttgattggtgagggttcttttggcagagtgtatcttggtgtacttaaaaatggtagaagtgcggcgatcaaaaagttagattcaagtaaacaaccggaacaagaatttttggcacaggtctccatggtgtcaagacttaagcatgacaatgtcgtggagttgcttggttactgtgttgatggaaacactcgtatccttgcttatgaatttgctactatgggttctcttcacgatattcttcatggacggaaaggtgtgaaaggagctcagccaggtccagtcctgtcctggacacaacgagtgaaaattgctgttggagcagcaaaaggcctggagtatcttcatgagaaagcgcagcctcatatcatacacagggacatcaaatccagcaacgtacttctatttgatgatgatgtatctaaaatagctgattttgacttgtcaaaccaagctcctgatatggcagctcgacttcactcaactagggttcttggaacatttggatatcatgcacctgagtatgcgatgactggacaacttagctctaagagcgatgtctacagttttggagttgttcttctggagctcctgactggaagaaagcccgtggatcatacattaccaaggggacagcagagtctcgtgacatgggcaactccacggcttagtgaagacaaagtcaggcagtgtgttgactcaagacttggaggggaatatcctcctaaatctgttgcaaagtttgcagcagttgccgcattgtgcgttcaatatgaggctgattttcgaccaaacatgagtattgtggtgaaggcgctccagcccctgctaaatgcgcgagcatccaacaaccctggatgagtgaatgactgctcttgcttgtacctgacgcgagtatctgattcagacaatcatgtagcattgtattaagacaaaattgtggtgtttggcttaatgcacttgaccttaatgagataactccttggcatttcctggatgtttccgactagtctctgtaccttgagagggccctagcgtatacaagtataaactgtatgccatttgtttggttgcattccgtctggtgcccctctgttccttgagaaatgattccgtaaacttcctcattccagcctctgatttgaggtgattctgtggaattccttac

SEQ ID NO: 6815 - DNA, 1278 bp, Allium cepa
  misc_feature (1112)..(1112): n is a, c, g, or t
  misc_feature (1127)..(1127): n is a, c, g, or t
  misc_feature (1195)..(1195): n is a, c, g, or t
  misc_feature (1205)..(1205): n is a, c, g, or t
  misc_feature (1221)..(1221): n is a, c, g, or t
  misc_feature (1269)..(1269): n is a, c, g, or t
  misc_feature (1276)..(1276): n is a, c, g, or t
gtaatttgaaagagaaactaatttgtcaggcgtgtgtatatcaattgtaaaagatacataaagaagagtaaagatgcgacgctggatatgctgtcaatgcatttttgatgatgcccataatcctgatgagagccaaactcttaaaagtgctaataattatgtagatggaaatcataaaggcaaagggtctggacctaccatttcaccgaaagatgaacctgaaaagaaggaaataattatcgaagttccaaaactggcattagaagaactaaaagaaaagactgacaatttcgggtctaaggctctagttggggaaggatcttatggaagagtgtattttgcagttctttccaatggtcaacaagtcgctataaaaaaacttgatgtttcacaagaacctgagcctactaacaatgagtttctgaaccaggtggcatcagtgtcaaaattgaaacatgaaaattttgttgaactgctgggatactgcatggacggaaattacaggctgttgtcatatgagtttgccacaatgggttcacttcatgatgttctgcatggtagaaaaggagttcaaggctcccaacccggtcctgctcttgactggatgcaaagagtgaggattgcaatagatgcagctaaaggtttggagtaccttcatgagaaacatcagccttctataatacacagagatgtcagatcaagcaatggtctattgtttgaagatttcagagcaaagattgcagattttaatctctcaaatcaggctcctgacatggcggctcgtcttcattctacacgtgttttggggacattggatatcatgcaccagagtatgctatgactggtcagctaactcagaaaagtgatgtctatagttacggagttgttcttttggagcttttaaccggcagaaaaccagttgaccataccatgcctagagggcaacagagcttaattacctgggctactccaaggctgagcgaagataaagtaaagcaatgtgtagatccaagattgaaagaatatccaccgaaaggagttgctaagcttgcagcagttgcagctttatgcgtgcagtatgaagcagaatttaggcctaatatgagcattgnagtcaaagcactctnttcttttcttcgccaataagccccccacttttaccttccgcttcagcaagaagctttttggatctttnatcttaaganggatatttggtattcnaaaataaaacccaaagagctcggatttccatataaaaaaattggacantttaccnta

SEQ ID NO: 6816 - DNA, 611 bp, Cirsium arvense
gggggtcaaagagctaagattgcttatggtgcagcaagaggtcttgaatatctacacgaaaaggttcaacctccgatagttcatcgagacatacgctccagcaacgtgcttgtttttgatgattacgaaaccaaaataggcgatttcagcttgagcaatatatcttctgaaaacgcagctcggctgcactcaaccagagttttgggtacttttggctaccatgctcctgaatatgcgatgacaggacagctaacgcagaagagtgatgtgtatagttttggggttattcttttagagcttttgacgggaaggaaaccagtggatcacacaatgccgaaaggacaacaaagtcttgttacttgggcaactccaagattaagtgaagataaagtgaagcaatgtgttgatccccaattaaacaatgattaccctccaaaggcagtagctaagttggcagcagttgcagcattgtgtgtccaatatgaggcagattttcggccaaatatgacgattgtagtgaaagcattgcagccgcttgtcaacgcgaaaccaggaagctaaaggagaatcgatcaatcttgaccttttgtgaatattattagaccagcaag

SEQ ID NO: 6817 - DNA, 1225 bp, Mimulus guttatus
aaataaaaaaattagacacaaaaataatctttgaccattttcttgccatctttctgtctcttcacagaaagcaaagaatgtcgtgttgtggaggtgcagaagatgaaacaatcagtggtcctccggcaaacaattacagtaccgccccgcctaatagcgcgtatggccacggaggaggtggaggtgaaagaggagagccaaggtcatctgcagcaagaggaggtgcgggggccccacagaaagtattgccgatagagataccagctctgtcgttggacgagcttaataaagccacctctaatttcggatcgaaagctcttatcggagaaggctctcttggccgtgtcttttacgctaagctcaaagatggtcaggaatctgctatcaagaagctcgatacctcctccacagaccccgacaccgactttgctgcccagctatcgacggtatcgaggcttaagaacgagcattttgtgggattgttggggtactgcctggaaccaaacaacagaatattggtgtacgaatatgcgacaatgggttctttacatgatgtgttgcatggtagaaaaggtgtgcaaggtgcagaaccggggcccgtgctgacctggagccagagagtgaagatagcatatggtgctgcaaaaggtcttgaatttcttcatgagaaatgccagccgtcgatcgtacaccgggacgtgaggtcaagcaatgttctgcttttcgatgactttgtagccaagatagctgatttcagcttcactaaccagtcttccgacactgctgctcgtcttcactcgactcgagtccttggaactttcggatatcatgcccctgagtatgcgatgacagggcagataacgcagaaaagcgacgtatacagttttggagtggttcttttagaactactgactgggagaaagcctgttgaccacaccatgcccaaaggccagcaaagtcttgtcacttgggcgactccaaggctgagcgaagataaagtgaagcaatgtgtggacactaagctaaataatgattatcccccaaaggccattgcaaagatggctgctgtggcagcactgtgtgtgcaatacgaagcagattttaggccaaacatgactatcgtggttaaggctttgcagccgcttctcaactcgaaaccggctggccctgctgataatgctaatgcataaattatgtgtaatgtaggctattaattaacgtatta

SEQ ID NO: 6818 - DNA, 541 bp, Triphysaria pusilla
ctaaccagtcgtctgatacggcagctcgtctgcattcgactagagtactcggaacattcggttaccatgctccagagtacgcaatgacagggcaaataacgcaaaagagcgacgtttatagctttggagttgttttgttggaacttttgacggggagaaagccggtagatcacactatgcctaaagggcaacaaagtcttgttacatgggcaactccaagattgagtgaagataaagttaagcaatgtgttgatccaaagctaaatgatgattatccacctaaggctattgcaaagatggcggctgttgcagcgctttgtgtgcaatacgaagcagatttcaggccgaacatgacaattgtggtgaaggcattgcagccgctaataaactctaaaccggccgggccggattcaaatgcttaataaaaaaaagaataagaaaaaaaaggtgtagcaaatccaaagacaagcagcagctattggtttgtattgtaatattcagctgtgggataatgtaaataccttcttttaccagatgattt

SEQ ID NO: 6819 - DNA, 937 bp, Ananas comosus
cggtagaagtgcagccataaagaaattagattcaagcaagcagccagaccaggaatttttagcgcaggtgtctatggtgtcaagactgagacatgaaaatgttgtggagttgattggttattgcattgaagggaacctacgtgtccttgcatatgagtttgctactatggggtctctccatgatatccttcatgggcggaagggagtcaaaggagcacaacctggtccagttttgtcatggacacaacgcgtgaagattgctgtgggagcagcaaaagggctcgaatacttacacgagaaagcacagcctcacattattcatcgtgacattaaatcaagcaatgttctactcttcgacgacgatgtggcaaaaattgctgactttgacttatcaaatcaagctccagacatggcagctcggcttcattctactcgagttcttgggacatttggatatcatgcacctgaatatgcgatgactggacaacttagttctaagagtgatgtgtacagttttggtgttgttcttttggagctcttgactggaagaaaacctgtggatcatactctaccaagagggcaacaaagccttgtgacatgggcaacaccaagacttagtgaagacaaggttagacaatgtgtggacccaaggctaggaggcgaatatcctcccaaagcagttgcaaagatggccgctgtcgctgcattatgtgtgcaatacgaagccgatttccgaccgaacatgagcactgtagtcaaagctcttcaaccgctgctgaatacacggtccgggcatcccggtgaagcccctggatcgtgaacccttgaaacccgcccatcttctcttttttgttctgtatgatttagcaaaatgctatcttttaagctcgtttgttgattgctggttgtagattatttatatatatttcgaagctct

SEQ ID NO: 6820 - DNA, 1336 bp, Chelidonium majus
gcaccttagccggcgtcgcatcccaaaaaaagtaaccccctctctctctctctcactatttctctctgtattcaatatctctctttactaaatcgtgatctgagtgaaagcgaaaaaacaggcgaagatagaaaagaagctgtcacgcgatgggttgcttcagctgttgtgatgatgatgattcccaaagaacccctgatggtggagggccatacatggtcaacaacatggctggtaaccttggaggaaatcatgccacagatccaacaacgaaggttcctcaaactgtgaaagtccaacctattgaagtccctgtcattacagttgatgaactgaaggatgtgactgacaactttgggactaaggctttaattggggaaggttcatatggcagagtatacttcggcgaactgaaaagtgggcaggctgctgccataaaaaagttagatgccagtaagcaaccagaccaagaatttttagctcaggtatctatggtgtcaaggctgaaacatgagcatgttgttgagctggttggttattgtgtcgatggaaatctccgagttctcgcctatgagtttgctacaatgggatcactacatgatattcttcatgggcggaaaggtgtcaaaggagcacaaccggggccagttctctcgtgggctcaacgagtaaaaattgctgtaggtgccgcaaaaggtcttgaatacttgcacgaaaaggctcagccccatattatccatcgcgacattaaatccagcaatatcctactcttcgatgactatgttgctaaggttgctgattttgacttgtcaaatcaagctcctgacatggcagcacgcctgcattccacccgtgttcttggaacctttggttatcatgctccagaatatgcaatgactgggcagctgagttcaaagagtgatgtttacagttatggtgtagtcctgttggagctcttgactggccgtaaacctgttgaccatacattaccaaggggacaacaaagtctagtgacatgggcaacaccaagacttagtgaagacaaggtgcggcaatgcgttgaccaaagactaggaggagactaccctccaaaagacagttgcaaagatggctgcagtagctgccctatgtgttcaatatgaagctgatttccggccgaacatgagcattgtagtaaaagctctccagcccctattaaatgctagacctggacctgctggtcccggtgaaacagcaagcttgtgaataataagtattggcattgagaattatctataccaaccgacagggatggctctacatagtgtatcatcatttcttgctggatttttttttt

SEQ ID NO: 6821 - DNA, 1242 bp, Flaveria ramosissima
ggcattgtttgggtgatcaagggctatttgctaagattgaaggagtgatttgtatgctttcgtctaaggtaaatttgtaaattgtaagcaaaggaaagtgatcatgagttgcttcagcttctgtggagaagatgatatgcacaagtcttatgataatgggccttttgtggcaaataatgcagcaggacataatgcaggttatcatgccacagaggctgcaccaaaggatacacaagctgtgcccatccaacctattgctgtcccttcacttcaagtggacgaattgaaagaaataactgataattttggtacaaattctttaattggagagggctcgtatggacgagtgtaccatggtgtcttgagaagtgggcaggcagcagctatcaagaagttagactctagtaagcaaccagatcaagagtttttagcccaggtttctatggtatcaaggcttaaacatgataatgttgttgggttactcgggtattgcgttgatggtggtctaagagtgctggcctatgagtatgcttcaaatggatctcttcatgacatcttgcatggacgaaaaggtgttaaaggtgcacagccaggtcctgtcttatcatggtctcaaagagttaaaattgctgtaggtgctgcaaaaggacttgaatacttgcatgaaaaggcacaacctcatattatccatcgcgatataaagtctagtaatgttcttctttttgatgatgatattgctaagattgctgattttgatttatcaaatcaagcacctgacatggcagcacgacttcattccacccgtgttcttggtacctttggttatcatgcacctgaatatgcaatgactggacagttgagttcaaagagtgacgtttacagctttggggtggttctcctagaactgttgacaggccgaaaaccagttgaccacactttgcctcgtggtcagcagagcttagtgacatgggcaacacctaaactcagtgaagataaggtgaaacagtgtgttgacactagactcaatggcgaatacccaccaaaggcggttgccaagatggcagctgttgcagccttgtgtgtgcaatatgaagcagatttcaggccaaacatgagcattgtggttaaagcactgcagccattgttgaacgcgcgtcctggacaccaaacagaaccacaacactcgtgaattttcacctacggctgcgcctctactgcttgatcatggcattcaaaattagc

SEQ ID NO: 6822 - DNA, 1485 bp, Brassica napus
gaaatttccgccgggaagaaagaaaagtctctgccctctcttctcaagcctacagcttccgccaaccatacgtacaaacaagatagacacaatcctccgtacttcctttttctatcttcatcgaaagattcaaccacactcaagtcttctctctctcttttggaaagaaaaagaagttcgtgtgtgagagagaaatagcgtaatgagctgctttggttgttgtggtggtgacgattttcgtcgagttgctgaaactggtcctaagccagtctacggcgcaggaggtcacggtggaggtcaccatccaagggcagacccacccaagaacacgccagtcattcagatgcagcctatctccgtgccggctattccagctgatgagttgaaggatataactgataactacggttcaaagtccttgattggtgagggctcttatggaagagtgttttacggtgttcttagaagcggtaaggcagctgctattaagaaacttgattccagtaagcagcctgatcaagagtttctcgcacaggtatcaatggtttcgagattgagacaagacaatgttgttgcacttctgggatattgcgttgatggcccactccgtgttcttgcttatgagtttgctcctaatggatctcttcatgatattcttcatggtagaaaaggagtgaaaggagcgcagccaggacctgttctgtcgtggaaccagagagttaaaattgctgttggtgcggctaggggactcgagtacttgcatgagaaggcgaacccgcatgttgtccaccgagacatcaaatccagcaatgtgcttctgtttgacgatgacgttgccaagattgctgatttcgatctctccaaccaagcccctgacatggctgctcgccttcactcaactcgtgtgctgggaacctttggttatcacgctccagagtatgcaatgacagggacattgagcacaaagagtgatgtctatagttttggagttgttctgctagagctcctcacaggtcgtaaaccagttgatcataccttaccacgaggacagcagagtctcgttacatgggcaactcctaaactgagtgaagacaaggtgaagcagtgcgttgatgcaagactaaacggagaatatcctcccaaagctgttgccaagctggctgctgtagctgcgctatgtgtgcaatatgaggcagacttcaggccaaacatgagcatagtggtgaatcagcctctcctcaatcctcctcgctctgctcctcaaactcctcacaggaacaatccttattgatgtcctccaatctgatgccacgcttcttcatcatatcacttatttcatttgtttttgtttgaatacaatttgtgtaaattcgtgaaaacaggctttttatttctcataaaaaaacctgaaagtctcacttccaaacctgaatgttgctctatttgtttatgttatttcatgcctgcgatgtaagtttctactaa

SEQ ID NO: 6823 - DNA, 855 bp, Ipomoea batatas
ccaggtcccgtgctgtcgtgggcccagagagtgaagattgccgttggtgctgcaaagggactagaatacttgcacgagaagacgcagcctcacatcattcatcgtgatattaagtctagcaatgttttactttttgacgacgatgttgctaagattgtagattttgatttgtcaaaccaagcccctgacatggcagcccgccttcattccacccgtgttctcgggacttttggttatcatgctcctgagtatgcgatgactggtcagttgaattccaagagcgatgtttacagctttggtgtcgttctccttgaactactaactggccgtaaacctgttgatcacaccttgcctcgtggacaacagagtcttgtaacatgggcaacaccgaggttgagcgaagacaaagtgaagcagtgcgttgatgctagactgaacggggaataccctccaaaggcagttgcaaagatggctgcggtggccgccttgtgcgtgcaatatgaagcggatttccggccaaatatgagcatcgtggtaaaggctcttcaacctctactgaacgctcgagctgggcattccagcgacacgccaaacctgtgaattcctcctgttctttagccccaaatgccttaaagattgagattattttgttatcaagtgtttgaagatcctgcaacatgtgaatcagtgacaattctttctgtttggtttttcctccccaccattttgatgcatagaattattattattaattattattattatgtagatgcacaagaccaaaactgcattgatgtcattcctcccagattgtattgtatttttataaaatataatattagtttcaactcaacg

SEQ ID NO: 6824 - DNA, 790 bp, Ipomoea nil
  misc_feature (16)..(16): n is a, c, g, or t
  misc_feature (30)..(30): n is a, c, g, or t
  misc_feature (116)..(116): n is a, c, g, or t
  misc_feature (753)..(753): n is a, c, g, or t
  misc_feature (780)..(780): n is a, c, g, or t
  misc_feature (788)..(788): n is a, c, g, or t
ctgcaaagggactagnatacttgcacgagnagacgcagcctcacatcattcatcgtgatattaagtctagcaatgttttacttttcgacgacgatgttgctaagattgcagatttngacttatcaaaccaagcccctgacatggcagcacgccttcattccacccgtgttctcgggacttttggttatcatgctcctgagtatgcaatgactggtcaattgaattcgaagagcgatgtttacagctttggtgtcgttctccttgaactactaactggccgtaaacccgttgatcacactttgcctcgtggacaacagagtcttgtaacatgggcgacaccgaggttgagcgaagacaaagtgaagcagtgcgttgatgctagactgaacggggaataccctcccaaggcagttgcaaagatggctgcggtagctgccttgtgcgtgcaatacgaagcagatttccgaccaaatatgagcatcgtggtaaaggctcttcaacctctactgaacgctcgagctgggcattccagcgacacgccaaacctgtgaattcctcctgttttttaaccccaaatgccttaagggttgagattattttgttatgaagtgtttgaagatcctgcaacatgtgaatcagggacaattctttctgtttggtttttcttccccaccattttgatgcatagaattattataattataattattattattattattattattatgtagatgcacaagaccaaaactncattgatgtcattcctcccagatgtantgatttanaa

SEQ ID NO: 6825 - DNA, 1484 bp, Amsonia hubrichtii
atctgaacaaaaaatattgagcgcagtatcgagtagtcaccagtcagtactgaacaaagtgaaatggttattgcctgcttggacggctgctctacgacacccttcctctcggagtcttctccttgaagtgtttgcggtggcatctcttactccggtggatccattgacaaacccgttagagcaaaggctccgtctggcctccctgatttcaggtggtgaagatatttgaactggtagacatacgctgagagagataatgagctgtttcggctgctgtgaagaagatgatatcaacagaccttctgatggtggaggccaggccatggttaaaaaccaaacaggaaatgatgcaggatttcatgccacagaagctgcatccaagggtgctcaagcagtgaaagtccagcctatttcagtccctgcaattccagttgatgaattaaaggaagtcactgacaactttggaactaattctttaataggagagggatcatacggaagagtatattatggaactcttaaaaatgaacgggttgctgccataaagaagttggatgctagcaaacaaccagatgatgaattcttagcgcaggtttctatggtttcaaggctaaaacatgaaaattttgttgaactgcttggttactgtgttgatggaaatcaacgtgttcttgcctatgaatttgcatctaatggatctctccacgatattcttcatggaagaaaaggtgttaaaggagctcaacctggtcctgttctttcatgggcacaacgagtaaaaattgctgttggggctgcaaagggtcttgaatatctgcatgaaaaagcagaccctcacataatccatcgtgatattaagtccagcaatgtactaatctttgatgatgatgttgctaaaattgctgacttcgatttatcgaatcaagctccagacatggcggcacgccttcactccacccgcgttcttgggacattcggttatcatgctccagagtatgcaatgactggacaactgaatgcaaaaagtgacgtgtacagctttggtgttgtgctgcttgagctccttactggccgtaaacctgtagatcatacactaccccgtggtcagcaaagtctggtgacatgggctacaccaaaactcagcgaagacaaggtcagacaatgtgttgatgcaaaactggggacagattatcctcccaaagcagttgccaagatggctgctgtagctgccttgtgtgtgcaatatgaagctgattttcgaccaaacatgagcattgtagtcaaagcacttcagcctcttctaaatacccggcctgggaatgctggtgaaagtgggtcaaatgcaatggtgtaactaagcccctcgtactcaaaatacctaattgttacattccaaaatgcaaagtttggttacctgtctttttcactactttgtatacagggatttatttcagaaactagagaagttttgtagattgtgttca

SEQ ID NO: 6826 - DNA, 1558 bp, Malus domestica
gaactaataataattacaaagacttcaacctccttccctctttcgctggtgtcctcttatcctgcgcaccccttccagcttatcctgcgccgcgcttcctccgccggatttggagctctcagatctctctctctctctctctctctctctctctacacacacactgacagacaccccacacaagattagtctcttgtaattagtttacaacaacagcaagcagcaccggcgtctcctttttttctctaatttttcattctttcagaatcatgggctgcttcggctgttgcgaagacgatggtatgcataaagcgaacgaccatggaggtcaatacacggtgaaaaatccggcaggaaatgagggaagtcatcatgcttcaggaacggcacccagaggcgctcaacccgtaagggtccagcctatcgaagttcctacgataccaatagacgaactaaaggagattacggaaggctttgggaccagtgctttgatcggagagggttcgtatggaagagtatactatggggtgcttaaaagtgggcagcatgcagcaatcaagaagttggatgccagcaaacaacctgatgaggaatttctggcgcaggtttctatggtgtcaaggctgaaacacgaccattttgttcaactacttggttactgcgttgatggggtttcacgtgttcttgcctatgagtttgcatctaatggatctcttcatgatattctacacggaaggaaaggtgttaaaggggcacagcctggtccagttttgtcgtgggcgcaacgtgtgaaaattgccgtgggtgctgcaaaagggcttgagtatttgcacgaaaaggctgatccccacatcattcatcgcgacatcaaatctagcaatgtactaatatttgatgatgatgttgctaagattgcagactttgatttgtccaatcaagctcctgataatgcagcacgtctccactccactcgtgtgctaggaacttttggttatcatgcccctgaatatgcaatgactggacagttgaatgccaagagtgatgtttacagttttggtgttgtcctgcttgagcttttgactggacgaaaacctgttgatcatacattgccacgggggcagcagagtctagtaacatgggctacaccaaagcttagtgaagacaaagttaggcagtgcattgattcaagactaggaggagagtacccaccaaaggcggttgcaaagatggctgcagttgctgccctgtgcgtgcaatatgaggccgatttccgcccaaacatgagcattgttgtcaaagccctccaacccctgttaaatgctcggcatggacccgccggtgaatcaccaaacttgtgaatctcccaatctccgtgtctctctctttgcctctataggtgtgtcatgtgtgcatgtatgagtaaatcagcatgcaattattgtaactaaggcagtgtgttcagagggtggtggtatattgtttgcacaatgttctatatgcttcattttcttcttttttcctcttttcgacagttgtgtaccatattgcttcattattt

SEQ ID NO: 6827 - DNA, 724 bp, Malus domestica
gcagcacgtctccactccactcgtgtgctaggaacttttggttatcatgcccctgaatatgcaatgactggacagttgaatgccaagagtgatgtttacagttttggtgttgtcctgcttgagcttttgactggacgaaaacctgttgatcatacattgccacgggggcagcagagtctagtaacatgggctacaccaaagcttagtgaagacaaagttaggcagtgcattgattcaagactaggaggagagtacccaccaaaggcggttgcaaagatggctgcagttgctgccctgtgcgtgcaatatgaggccgatttccgcccaaacatgagcattgttgtcaaagccctccaacccctgttaaatgctcggcatggacccgccggtgaatcaccaaacttgtgaatctcccaatctccgtgtctctctctttgcctctataggtgtgtcatgtgtgcatgtatgagtaaatcagcatgcaattattgtaactaaggcagtgtgttcagagggtggtggtatattgtttgcacaatgttctatatgcttcattttcttcttttttcctcttttcgacagttgtgtaccatattgcttcattatttgcggtgtatttgatttgttcataatgcaagggggtatttttctcttagcggacgttatcgtttctcatttgatgctttcagcaaatttatacaagtgaaaagagagcttctatgtt

SEQ ID NO: 6828 - DNA, 1271 bp, Brassica napus
tttagttaacttgtcgtgtaatagaagagttgctgtagtcatgagctgctttggttggtgtgggaatgatgatggtttccgtaatggtgatgatactcgaccaatgccaagccacatccctgcaggtgacagtggaagccactatctaagatctgatccacccatgaatcagcccgttgttcagatggagcctattgctgtaccagccatcccagctgatgaactgagtgatgtaaccgataactatggttccaaggccttggtgggtgagggctcttatggaagggtgtttcacggtgttcttaaaagcggtatcacatctgccatcaagaaacttgattctagcaagcagcctgaccaagaatttctttcccagatatcaatggtttcgagattgcgacacgaaaatgttattgcgcttgtgggttattgtgttgatggccctctccgtgttcttgcttatgagtatgctcctaacggatctcttcatgatgttcttcatggccgaaaaggcgtgaaaggagcgctgcgaggtcctgttatgacgtggcatcagagagtcaagatcgctgttggtgcagccagagggcttgagtacttgcacgagaaggtcaaccctcaggttatccaccgagacatcaaatccagcaacgtgcttctctttgatgacgatgttgccaagattggtgacttcgatctctctaatcaagcgcctgacatggctgctcgacttcactctactcgtgtactaggaacctttggctatcacgctcctgagtatgcaatgacgggaacattgagcacaaagagcgacgtgtacagttttggcgttgttctgctagagctccttactggtcgtaaaccagtcgaccataccttacctcgtggacaacaaagtctagtgacttgggcaacccctaaactgagcgaagacaaggtgaagctatgtgttgatgcaagactacttggagagtacccctccaaagctgttgccaagctagctgcggtggctgcactgtgcgtgcaatatgaggcaaattttagaccaaacatgagcattgtggtgaaggcacttcaacctcttctgaaccctcctcgttctactccacataggaacccttattgatcatcagatatccaaaccacatctcagctgctgcttcataatgattaatcaactgtgtatttgtttttgcattcaagccccacttttgaatagcagtgtatgtatttctctatattatctgttttctgttatgtaatttgaggtg

SEQ ID NO: 6829 - DNA, 1665 bp, Ricinus communis
accaatcaaaattattaacaattaaacaaagtatgaaacagaacaaaaccgtaaattaaatccttaatttctttagcattattttttaagactgtcttttagcttcaagtcaaaagaaactccaatctatctatccaccgttcgatctcttgtaacgccttatcctgcacacctcggccggctcagatcccgtaatctttacaatctaagcaactgatactccttctctttactgatcgaagacggtatcagcttctttgcagcattttttcatttagagaggcattctttaaggatctgaattatgagctgctttggctgctgtgaggaagatgacatgcataaagctgctgacagtggaggtccataccctgttaaaagttcagcagggaatgttggaggttatcatgcatcagaaactgcaccaaggggagctcaggctgttaaaatccagcctattgaagtcccttccatttcagtggatgaattgaaggaagttacagataactttgggataaattctcttattggagagggttcatatggaagagtgtattatgggattcttaaaagtgggcaagctgccgctatcaaaaaattagatgcaagcaaacagcccgatgatgagttcttggcacaggtttccatggtatcacggcttaagcatgaaaattttgtacaattgcttggttattgtgttgatggaaattcccgtgtacttgcctatgaatttgcgtccaatggatctcttcatgatattcttcatgggaggaaaggtgttaaaggagcacaacctggtcctgtactttcgtggcagcagcgggtaaaaattgctgttggggctgcaaaaggccttgaatacttgcatgaaaaggctgatcctcacattattcatcgtgatattaagtcaagcaatgttcttatttttgatgatgatgttgcaaagattgcggattttgatttatcaaatcaagctccagacatggcagcacgtcttcactccactcgcgttctaggaacatttggttaccatgctcctgaatatgcaatgactggacagttgaatgcaaagagtgatgtatacagttttggggttgtgctacttgagcttctgactgggcggaaaccagttgaccatacattacctcgggggcagcagagtcttgtgacatgggccacaccgaaacttagcgaggacaaggttaggcaatgtgttgatacaagacttcaaggggattacccacctaaggcagtcgcaaagatggcggctgttgctgccttgtgtgtgcaatatgaagcggacttcaggcctaacatgagtattgtagttaaagctcttcagcccctcttaaatgcccggccaggaccagctggtgaaacaccaagcctataattctatctctgcctcctcctcgtgtatccaggtgaatattcaagtgtgcatccacaccatgctgagagaccgacaaagaattgttacggaaaatgttagtaaattatttggatagcgccctatgcttccattatttcctatgtatttcatttgttcataatgtgtgaggctgttttctcctgttatattttttatttttttctttaaaaatcatatatatattttgtttaattttcctttttaagtttttttcttcatgttaactggaaaaa

SEQ ID NO: 6830 - DNA, 790 bp, Cucurbita pepo
ctgcaagaggacttgagtatttgcatgaaaaggctgagacccacattatccatcgtgatattaagtccagcaatgtactcatctttgatgatgatgttgctaaaatcgccgactttgatttgtccaatcaagctcctgatatggcagcacgtcttcactctacccgtgttcttggaacttttggttatcatgctcctgaatatgctatgactggtcaattgaatgccaagagtgatgtatatagctttggtgtagtcttgcttgaacttctgacagggagaaaacctgtagatcctacgctaccacgaggacaacaaagtctagttacttgggctacaccaaagctgagtgaagataaagttaggcagtgtgtcgatggaaggcttggcggagactaccctccaaaggctgtagcaaagttagcagctgttgctgccctgtgtgtgcagtatgaagcagatttccggccaaacatgagcattgttgtcaaagccctccagcatctattaaatgcccgacccgcgccttccggtgactcgtcaaactcgtaagttctattcatctcactcactgtatcaatttgcacacaagcgtataagaagaaattgtatctgaagaaagttagtgaattgtttggatatttttttgaaacacatttctattaattcacctgttataagtcatctgtatcaaatcacggctcccttgtttcagtgtattctgttttcttgtttgtggaatctaatattgtttagttgttgtaagcattgccagagagggtcaatgtata

SEQ ID NO: 6831 - DNA, 1388 bp, Euphorbia peplus
caatcaacaccctcttcttacttttctcatttttctgctgaattttccataggcactcgtacgcgtttgaatcatgagctgctttggttgttgtgaagaagatgacatgcataaagcagctgacaatggaggtccacacccttataaaagttcagcaggaaactttggaggttatcatgcatcagaatcagcaccgaagggtgcgcaggctgttaaaatccagcctattgaagtccctcctattgcagtggatgaactgaaggaagtcactgataattttgggactagtgctcttattggagagggttcatatgggcgagtatattatggggttcttaaaagtgagcaggctgcagcaataaaaaagttagacgcgagcaagcaacctgatgatgaattcttggctcaggtttccatggtatcaaggctgaagcatgagaattttgtacaattgcttgggtattgtgttgatggaggttcccgtgtacttgcctatgaattcgcatctaatggatctcttcatgacattctacacggtaggaaaggtgttaaaggagcacaacctggtcctgtcctttcatggcaccagcgtgtcaaaattgctgttggggctgccaaaggcctcgaatacttgcatgaaaaggctgatccgcatatcattcaccgtgacattaaatccagcaatgttctaatttttgacgatgatgttgcgaagattgcagattttgatttgtcaaatcaagcacctgacatggcagcacgccttcattccactcgtgtgcttggaacgtttggttatcatgcccctgaatatgcgatgactgggcagttgaatgcaaagagcgatgtgtatagtttcggtgttgtcctgcttgagcttctcactgggagaaaacctgttgaccataccttgccgcgtggtcagcagagtcttgttacctgggctactccaaaacttagcgaggacaaggttaggcaatgtgtggatacaagacttcaaggagaattccctcctaaggccgttgcaaagatggctgctgttgctgccttgtgtgtgcaatatgaagctgacttccgaccaaacatgagcattgtagttaaagctcttcaaccccttctaaatgcccggcctggacctggaggtgaagcacctagcatgtgattctttaccctcttacctttctactgggcatatgattaaatgtgcatttacgcgagaaaaaggcaagactaaaacagaatgtagtataaattatttggacaggtcccttctccccattatttgttatgtatttcatttgtttataatggtgtgcagctgttttctttgcagcttatttcgattctattgtcctatatagcttttttgattcgatgtgtgtattcct

SEQ ID NO: 6832 - DNA, 1381 bp, Linum usitatissimum
gattctctcaagccttatcgccgagtaggtctccagcagaaaatcctccatatccgatcgtatcaccagtctccaagggataatcctccaattccccatgtatttcattcaatccttgcgatttggttcatttttacatttgtaaatcatgagctgcttcagctgttgcgaggaggatgagatccataaagctgctgacaacggaggtcaatatcccatgaagagttctggaggaaattatggagggcagcatgcgtcagaagcaacaccaaagggtgctcaggttataaaaatccaacccgttgaagtgcctgcattaccagcggatgagttgaaggaagtaactgagaactttgggacaaatgctttgattggagaaggctcttatggaagagtgtattatggaacactcagggacggccaagctgcagcgattaaaaagctcgactcaagcaagcagcctgatgatgaattcctagctcaggtctcgatggtctcaagacttaagcatggtaacttcgttcagttgcttgggtattgtgttgaaggtggttctcgtgttcttgcttatgaatttgcatcaaatggatctcttcatgatattcttcatggaagaaaaggtgttaaaggtgcacagccaggtcctgtcctttcatggccacagcgtgtgaaaatcgctgttggggccgcaaagggccttgaatatttgcatgaaaaggccgatccacacattatccaccgtgacatcaagtccagtaatgttcttatatttgatgattatgtcgcaaagattgctgatttcgatttgtcaaatcaagctccagatatggctgcacgacttcattctactcgtgtacttggtacattcggctatcatgctcccgaatatgccatgactgggcagttaaatgccaagagtgatgtctatagttttggtgttgtcctcctcgagcttttgactggtcgtaaacctgtcgatcatactctgcctcgtggacagcaaagtctagtaacatgggctacaccaagacttagcgaggacaaggtcaggcaatgcatcgatacacgactaggaggagaatacccaccgaaagcggccgctaagatggctgctgtggctgcattgtgtgtgcaatacgaagctgatttcagaccgaatatgagcatcgtcgtcaaagcactacaacctctactaaacgcccgaccaggacctgcaggtgaaacgctgaccatctgattttaaacatctctcttcctacttggaactggaaatgcgagcaccatgaaatttcttcttgttgtttgggagagaagggaacattcccgtaggctctctccatatatgcttatttgatttgtgcatataattcgagttggttgt

SEQ ID NO: 6833 - DNA, 1203 bp, Fraxinus spp
aaaaccatgggctgctttggttgttgtgaggacgattacatgcaaaaggctgctgataatggaccttacatgacaagtcactcagctggcaaccctgcgggttatcatgccacagaaacagcacaaaaggacaaacagactattactgtcctgccgattgctgtccctaccattccagttgatgaattgagggacatcacagataattttggttcaaagtctttgatcggcgagggatcatatggaagggtatactatggagtcttgagaagtggacatgctgctgcaattaaaaaattagactccagcaagcagccagaccaagaatttttagcacaggtttctattgtttcaagactaaagaatgaaaatgcggttgagctacttggttactgtgtggatggcggtcttcgtgtcctggcttatgagtatgctgcaaacggatctctacatgacattcttcatggacgaaaaggtgtcaaaggtgcacaaccaggtcctgtgctgacatgggctcaaagagttaagattgccgtgggtgctgcaaaaggactagaattcttgcatgaaaaggcaactcctcacatcatccatcgtgacattaagtccagcaatgttttgctgtttgatgatgatgttgccaagattgccgactttgatttgtcaaatcaagccccctgatgcggcagctcgtcttcattctacccgcgttcttgggacttttggttatcatgcccctgagtatgcaatgactggccagttaagttcaaagagtgatgtttacagctttggtgtggtacttctagaactcttgactggccgtaagcctgttgatcatacattgcccaggggacagcagagtcttgtgacatgggcaacaccaaagctcagtgaagataaggtgaagcagtgtgttgatgctagactaaatggagagtactctcctaaggcagttgcaaagatggctgcagttgctgccttgtgtgtgcaatatgaagctgatttccgtcctaacatgagcatcgtagtaaaagcactccagcctctgttaaatactcggtctgggcctcctaatgaaacatcaagcttgtgaatttttttcccccctggtctgtatttttcaagtattccatttcaaattgatttacctaaatgtttctcgaagtatccttgcctaccacactgtacccatctcttttaagc

SEQ ID NO: 6834 - DNA, 1100 bp, Vitis vinifera
atgttctgctgcggaggtgaggaggaggaaaaccatggccagcctgctaaccaatatacagctccaccaagaggaggaaatgcctatggcggcggtggaacgggagagcccaggaattccaatactgccaaaagcggagctccccagaagattctacccatcgagacaccggccatgtcattggacgagttgaataggttaactagtaactttggatcaaaggctttgatcggagaaggctcctacggcagggttttctacgcaaagttgagcagtggtgagggcgcagccataaagaagctggacaccagctcctcccaagagccagactctgattttgctgctcagttatcaatagtttcaagacttacgcatgagaatttcgtggggttgctggggtattgtttggaggccgacaacaaaatcctagtatatcagtttgcaacaatgggctctctacatgatatgctacatgggaggaaaggtgtacaaggggcagagcctggtccggttctgagttggaaccagagagttaaaattgcttatggggcagccaaaggcctggagtatctgcacgaaaaagttcagccttcaatagttcatcgagatgttagatccagcaatgttcttctgtttgatgattttctagccaaaattgcggatttcaacctgtcaaaccagtcatcggatacagcagcccgattgcattccactcgggtcttgggaacatttggctatcatgcaccagagtatgccatgacagggcagataacacagaagagtgacgtttacagtttcggagttgtacttttagagcttttgacaggaagaaagccagtagaccatacaatgcccaaaggacaacagagtctggttacttgggcaactccaagattgagtgaggataaagtgaagcaatgtgtggatcctaaactcaacaatgactacccagcaaaagcaattgcaaagatggcagcagttgccgcactttgtgttcagtatgaagcagacttcaggccaaacatgaccattgtcgtgaaggctcttcagccacttctcaatccaaaaccagcaggccctgattctaatgcatagcatat

SEQ ID NO: 6835 - DNA, 1755 bp, Pinus pinaster
gcctcttatataaaggaccggacgccgttgattgcagacttacggtgcttcctatctctccccctctaattttcctttctccacagcggggggcattagtaaagggccctgtgttcggttgattgcagggctgtctgttcccctttaaaagcggaaacatgcgcgcagatcgatccgattggttgaattggagggttgagaggtgggttgtctttgattgaactccattttggacactcagttgtttttctggttgtgagaaacagacacatttctgctggtagaagcttagaaccatggggtgttttggctgctgtgcagaagatgaaattcaaaatgcagctgatggtgcaacaccgattatggtaaatggaaattttccaggaaatgatagagtttatgaaaatgcaaacacagctctgaggagtggtcaaaatgtaaaacttcagcctattgctgttcctgaaatcacagtggaggaattgagggagataacagaaaattttagttcaaaatcgctgattggagaaggttcttatggtccggtatatcatggtatcttaaaagatggccgtgcttcagctattaaaaagttggatgccagaaaacaaccagatcaggaattacttgcacaggtttccatggtttcaaggttgaagcatgaaaatctagttgaactggttggatattgtgttgatggaagcatgcgagtgcttgcttatgagtttgcacccatggggtcacttcatgacatccttcatggtaaaaaaggagtgaaaggagcactaccaggtcctgttctcacttggatgcagagagtgaaaattgcaataggtgctgcaaaagggcttgagtacctccatgagaaggcacaaccgcctatcattcaccgggatattaagtctagcaatgtcttacttttcgacgactatacagcaaagatagctgattttgatatatcaaaccaatctcctgacatgtcggcacggcttcattccactcgtgtgcttggaacatttggttatcatgctccagaatatgcgatgacaggacaatcgactcaaaaaagtgatgtttacagctttggcattgtcctccttgagctattgactggcagaaaaccagttgatcacacattgccacgtggtcaacagagccttgtcacatgggcaaccccaaggcttagcgaggataaagtgaagcaatgtgtggatccaaggttgaaaggagactatccacctaaagcagtggctaagctggcagcagttgctgccttgtgtgtgcagtatgaagctgattttcgtgcaaacatgagtattattgtaaaggctcttcgacctctattgaatacacaatcaagtcctgctggtgggaacgcagctgtgtaatctgatgtatacctcaaattatgtcttatgatatccaaatttttgcattatttagcttttctttaacacaagcaggcatatcttctatctgcttgcatatatctggatctgtagttttaatattgtaaaggattagattacttatcacgtggaaacagaagggagtcaaggaagcaaacgcatacaattggacatgggcatgatattatgtcttaacttacgatattccaaatttgtgcattatttagtttttcttcgatacaggcgggcatattttgtatctgcttgcatattactcgacctggaattaaatattgtaaaggattggattactttaacatgtggaaacagaaggaaatcaagatag

SEQ ID NO: 6836 - DNA, 892 bp, Sarracenia psittacina
ccgtttagcttcgagtttgcatctaatggatcgcttcatgacatatccatggagaaaggggtcaaggagcacaacctggtcctgtctttcatggtacaacgagtagaattgctgttggggctgctaaagggcttgaatacttgcatgagaaagcagaacctcacattatccatcgggatatcaaatcaagcaatgtactactatttgatgatgatgttgctaagattgccgacttcgatttatcgaatcaagcacccgacatggcagcacgtcttcattccactcgtgttcttggaacatttggctatcatgctcctgaatatgcaatgactggacagctgaatgcaaagagtgatgtttatagctttggtgttgtcttgctcgagctcttgactgggcgcaaaccagttgatcatacattaccacgcggacagcagagccttgtgacatgggctaccccaaagcttagtgaagacaaagtcaggcagtgcgtggatgcaagactggggggagattaccctcccaaagctgttgcgaagatggctgctgttgctgcactgtgcgtacagtatgaagctgatttcaggccaaatatgagcattgtggtcaaagccctccagcctcttctaaatactaggccgggacctgcagctgaagtagctcatacatgactgttctctttgtcgtctcattggtcagaaagcttcaatatgcttgggtctttctttctctctctctcattcacgagtaggaaaatttttcagaaacagtgcttatgtagatggtgattgatgggcactcatatgcttttattatttacaccaatttgtttataacgttttgagtctctcttgttctcgtctgtttgtgtggggttccctttgtatgatga

SEQ ID NO: 6837 - DNA, 1096 bp, Amaranthus tuberculatus
tcagcctcctgctgtttctgctattactgtggacgagctgaaagaaattactgataattttggaacaaaagctttaattggtgagggatcttatggaagagtgtattatggtgttctaagaagtggacaggctgctgccttgaagaagctagattccagtaaacaacctgaccaagagattttgggacaggtgtcaatggtatcaagacttaaacatgaaaatgtgcttgagctcgttggctattgtcttgatggaaattttcgggtccttgcttatgagtatgctccaaatggttcccttcatgatattcttcatggtcggaaaggtgtcaaaggagcacagccaggtcctgtcctctcatgggcacaaagagttaaaattgctgttggtgcagccaaagggcttgagtatttgcatgaaaaagctcagcctcacattatacatcgtgatattaagtccagcaatgtacttcttttcgatgatgatgttgctaaaattgctgattttgacctatcaaaccaagccccggatatggcagcccgtctacattccacacgtgttcttggaacatttggataccatgctccagaatatgctatgactgggcaattaagctcaaagagtgacgtctacagttttggtgttgtcctcctagagctcttgactggccgcaaacctgtcgaccatacattacctcgtggacaacaaagtctcgtaacttgggcaaccccgaaacttagtgaggacaaggtaaagcaatgtgtcgatcctcgactaggatccgactatcctcccaaggccgttgctaagatggccgctgtagctgctctgtgtgtgcaatatgaagcggattttcgcccaaacatgagcatagtagtgaaagctcttcaacctctgttaaatactcgaacgggccctcataatgaagcttctaatgtgtaaaatcccctcttgtaacttaaaagtgtgatgtcaaatacttcaaatatttgaagatattatattgatttcttcatgtgattgagaaattagcgccatgtattttgttgaatgtggattctggtcagcttctgtaagtttaatgcaaaaaatgtt

SEQ ID NO: 6838 - DNA, 1948 bp, Malus domestica
gtctgtcgctgtgtcctacttatcctgcgcaccgtcttcccgcttatcctgcgccgcgcttcctccgccggatttggtgctctcagatctctctctacacagagccacccaccacaagagacaagactagtcccttcccttgtaattagtttacaataaagagcaagcagcaccgacttgtccttttcccctaatttttccttctttcagaatcatgagctgctttggctgttgcgaagacgatgatatgcataaagcgaccgaccatggaggtcaatacatgatgaaaaatccagcgggaaacgagggaagccatcatgcctcaggagctgcacccagaggtgctcaacccgtaagggtccagcctatcgaagttcctaccataccatttgacgaactaaaggagattacagaaggctttgggaccagtgctttgatcggagagggttcatatggaagagtatactatggggttcttaaaagtgggcagcatgcagcaatcaagaagttggatgccagtaaacaacctgatgaggaatttctggcccaggtttctatggtatcaaggctgaaacatgaccactttgttcaactgcttggttactgtgttgatggggtttcacgtgttcttgcctacgagtttgcatctaatggatcccttcatgacattctacacggaaggaaaggtgttaaaggggcgcaacctggtccagttttatcgtgggcacaacgtgttaaaattgcggtgggtgctgcaaaaggccttgaatatttgcacgaaaaggctgatccccacattattcatcgcgacatcaagtctagcaatgtactcatatttgatgatgatgttgctaagattgcagactttgatttgtccaatcaagctccagataatgcagcacgtcttcactccactcgtgtgctaggaacttttggctatcatgcccctgaatatgcaatgacaggacagttgaatgccaagagtgatgtttacagttttggtgttgtcctgcttgagcttttgactggacgaaaacctgttgatcatacattaccacggggacagcagagtctagtaacatgggctacaccaaagcttagtgaagacaaagttaggcagtgtattgattcaagacttggaggagagtacccaccaaaggcggttgcaaagatggctgcagttgctgccttgtgcgtgcaatatgaggctgatttccgcccaaacatgagcattgttgttaaagccctccaacccctgttaaatgctcgtcatggacctgccggtgaatcaccaaacttgtgaatctctcaatctccctctgtctctccctttgcctctgaaggtgtggcatgtgtgcatgtataagtaattcagcatgcaattattgtaacaaaaggggatagagttctgagggtggtctggtggtatattgtttgcacaatgttctatatgcttcgttttcttcttctttttttcctctttttgaaagagatgtactatattgcttcattatttgcggtgtatttgatttgttcataatgcaaggtggtatttcatgtttttaagagcatctccaaaatatgcgatagaataaccaaaactttattttaaagtgtctgcggtggtgggtcggatagtttgagagtcatgtttgactcatcctctgatcacttgaagatgacgcatgttgctagctttgagagcgtgctacaataccatcttctacaaatatattgttgaggcttcggtctcttctttacctgtcaagacttcggtctcctctttggtgcttggggtgctggaagcgaagcatgcagaaagattgaagaagttgctaggtttccttgtattttgcgttttctgttatgggctccaatttctgttttgggccacttgtacatgtcttttgtaatgatggcttccctgccttccttaggtcttttcttg

SEQ ID NO: 6839 - DNA, 547 bp, Brassica juncea
gcaatgacgggaacattgagcacaaagagcgacgtctacagttttggcgttgttctgctagagctccttactggtcgtaaaccagtcgaccatactttacctcgtggacaacaaagtctagtgacttgggcaacccctaaactgagcgaagacaaggtgaagctatgtgttgatgcaagactacttggagagtacccctctaaagctgttgccaagctagctgcggtggctgcactgtgcgtgcaatatgaggcaaattttagaccaaacatgagcattgtggtgaaggcacttcaacctcttctgaaccctcctcgttctactccacataggaacccttattgatcatcagatatccaaaccacatctcagctgctgcttcataatgattaatcaactgtgtatttgtttttgcattcaagccccacttttgaatagcagtgtatgtatttctctatattatctgttttctgttatgtaatttgaggtggagagaaaataccaaattatattttgtttattgttaacctaataatgatttcagaaa

SEQ ID NO: 6840 - DNA, 1413 bp, Phaseolus coccineus
gcccttcgccctgattatcctgcgcatatttagcagctttccgccgagatcatcctcctccgcggcgctatcactttctcaacgacacaatatcctgttggatttcagaaagaatcatgagttgttttagctgttgcgaagaagatgacttccagaagcatgctgaaagtggaggacaacatcttgttaaaaactcaacaggaaatgatggaaatggtcgtgcatctgaaactgcaaagcagggcattcaagctgttaaaattcagcccattgaagttcctgaattacaagtagatgaactcaaagaaattactgatggttttggagaaagttctttgattggagaaggatcctatggaagagtgtattacggtgttctgaaaagtgagcaggctgcagcaatcaagaaattagatgccagtaaacagcccgatgacgagtttttagcccaggtttccatggtttcacggctgaaacatgacaattttgttcaattgcttggttattgcattgatggaaactcccgaattcttgcttatgagtttgcatctaatgggtctcttcatgatattttgcacggcagaaaaggtgttaaaggagcacagcctggtcctgttctaacatggactcaaagagttaaaattgccgtaggggcagccaaaggactcgagtatttgcatgagagggctgatcctcacattatccatcgggacatcaagtcaagcaatgtactcatctttgacgatgatgttgctaaaattgcagattttgatttgtcaaatcaggctcctgacatggcagcacgactccattccacccgtgtccttggaacctttggttatcatgcaccagaatatgcaatgactggtcaattgaatgctaagagtgatgtatacagcttcggtgtcgttcttctggaacttttaacgggaaggaagcctgttgatcatacactaccacgtggacaacagagcctggttacttgggctactccaagactcagtgaggataaagttagacagtgtgtagatgcaagactaggaggagattaccctcccaaagctgttgctaagatggctgctgttgctgccctgtgtgtacaatatgaagctgatttcagaccaaacatgagcattgtagtcaaagctctccaacctttgttgaatgcaagacatggacctgctggtgaaacttcaaactaatctttgactgtatttctgtctatctgtatcaattagtatgtgcaaagtgagcacgcgagatgtaagaaagtgactgcttcagaagcggatggaagattgcttgaacatgtttatatatcctattgtttacgcaacattcattttgttcataatccataggtactgagatttacttggttcttttatttatttatttttattgttacctgcc

SEQ ID NO: 6841 - DNA, 1636 bp, Brachypodium distachyon
ggcccacgcgttctgacgaacacgcggagacgacgtagctgcgaccggtagaccagcagcagccgcttcgctcttgcttccccagtgcgagtactactagtacataagctcgccgccgcggctgaccggacgacagctcacagtcgcccttcttcttcttcttcttcttcttgcttagcttccttccttctcttcgtcctcccctgcgccgccgccgccgccgccgccgcctacgttgtcgccgggacacacgcccaaggacttgtttttggatagagtatgtcgtgctttggatgctgtggtgatgaagatactcaaggagcaccagacaacaggaatccatacccaggaagccatccagcaaggaatgatgcatatcgcactgcagatccaactcccagaggtcctcaacctgcgaaagtgcaaccaattgcagtccccaccattcccatggatgaaattagggaggtgactaagggttttggtgatgaagctttgattggtgagggctcctttggcagagtatacttcggtgttctaagaaatggtagaagtgctgcagtcaaaaagttggattctagtaagcaacccgaccaagaattgttggcacaggtgtctatggtgtcaaggcttaagcatgaaaacgttgttgagttgcttggttactgtgttgatgggagcatccgtgtccttgcgtatgaatttgcaactatgggttctcttcatgatatgcttcatggaaggaaaggtgtcaaaggagctcaacccggtccagtattatcatgggcacagcgggtgaagatagctgttggtgcagcgaaaggcctagagtatcttcacgagaaagcacagcctcatatcatacacagggacatcaagtccagcaatgttcttctttttgacgatgatgtagctaaaatagctgattttgatttgtcaaaccaagctcctgacatggcagctcggcttcactcaactagggttctcggaacgttcggatatcatgcacctgagtatgcaatgactggacaacttagctctaagagtgatgtgtacagtttcggagttgttcttctggagctattgactggaaggaaacctgtcgaccatacgttaccgagggggcagcagagccttgtcacatgggccactccaaggctgagtgaagataaagttaggcaatgtgttgactcaagacttggaggggactatcctcctaaagctgttgcaaagtttgcagccgtcgccgcattgtgcgtgcagtatgaagccgatttccggccaaacatgagcattgtcgtcaaggcgctccagcccttgctgaacgcacgagcaccccatgctggtgaacatgctgggcattaagctgccctcccaaccttttgtatgatatagataaggaaaatgagccatcaattgttgttctttcgggggcgtggtgtcaggaggcagtgtgtgtacatttgtgattactattcttaagttgtaaccatcaagattcattagtaccaaaaagtatttgattcttttgtatcggatgcaagacaggcatacctaatggttacttagcatatatctacatggtacacttcaatcatacagagaaaacgaatgaaagaatcgtgcattgcttagc

SEQ ID NO: 6842 - DNA, 2179 bp, Theobroma cacao
tcgacctccatcgttccattttccttcaaattattaatttttttttatctttatggatgcatttctactttctcatcatgattgttggaactccatttatggattttgagagatcaatgagggaagaaaattatgaacacaattggggcataagccacaaccttagagaatgagaatccaaagaagtcatgtgcttgatccaaaacaaaatgtagatatcaatgatgcgatgcggtccccagaggaaatggttggcagggcagctcatgtgaagtacggaggatggagcttgatgggcaatctggaccaaataagaggagagagaggaatatttgggaatggagatattttgaaggcaaatgataaaaatgaagcaaaggaagggatgaggaagcatccttggcatggaaatatagtaccatgtccttcccactgggagatgggatgggatgggatgggatgtgattgtgacccggactccgttagaaagataagaaccattattattactggtttttcaattactataacactaacaccaaagaagccagttaggagaatcatttctgtagcgaaggcatggcatggcacatggggtttcctcctttccagccaattccagcaaagccaacaaagcacaaaatcaatgttttttctactcatatttaagcctctggttttgatgtttgcggaaatggaaggtttatatgtttcgatgccaactattaatcatatgctttcgcattcacccttttataacagtaaggctattggtgaagaggaagtagaccaaatcctgagagatcaaaatttgcagtgggtgctgatttgcttgccacaagtcattggagaaagacacatgagttgcttcagctgttgtgaagaagatgatattcataaagcttctgaaaatggaccattcaggccaaataaccctgcaagtgctcatgtaggcaatactgctggaggttatctagtccaagaagcagtaacaagggatacacagtctgttaccattcaacctattgccgtccctaaaatttcagtggatgagcttaaggaaatgacagataattttggtacaaaatccttaattggtgaggggtctcacggaagagtatactatggcattctcaaaagtgggcaggctgcagccatcaaaaagttggattccagtaagcagccagaccaggaatttctagcgcaggtatccatggtgtcaagactaaaacatgataacgtggttgagcttgttggttactgtgttgatggctctctccgtgtcctggcctatgagtacgctcctaatgggtctctccatgatatgcttcatggaaagaaaggtgtgaaaggagcagagccaggtccagttctatcatggacacagagagtcaaaattgcagttgaggcagccaaaggccttgaatatttgcacgagaaggcacggcctcatataatccaccgtgacattaagtccagcaatttacttctttttgatgatgatgttgctaagattgctgattttgatttgtcaaatcaagcccccgatatggcagctcgtctccattctacacgggttcttggaacctttggttatcatgctccagaatatgcaatgactggaacgcttagttctaagagtgatgtttacagctttggtgttatcctgctggagctcttaactggacgtaaacctgttgatcatacattgccacgtggacaacagagtcttgtgacatgggcaaccccaaaacttagtgaagacaaggtgaagcagtgtgttgatgctagactgaatggagaataccctcccaaggcagttgcaaagctggctgctgttgctgccttgtgcgtgcaatatgaagctgattttcgacctaatatgagcattgtagtgaaagctcttcagccccttctgaacactcggcctgcagcttcccacagtgaaacgcgacactcgtgaattcctccatagggatgaaccctttagttgttcaaattcggtctgacgatgtgatttgtttccttttgtaaatgggtgcttttaattagtttaagatcagctaccacctaccatcctcaaccccaatcatatacttgtattgtttatcaatcatcaaatcatcatcatatcatatcgtatcattataattgagttcaatagacggaagtagaggaa

SEQ ID NO: 6843 - DNA, 1642 bp, Manihot esculenta
aatctacctaaagcacgcccgggccgatcactcaccacgccttatcctgcgcaccctcggccggcttacaccgtttcagatccgtcaaactgaatccaacctcacactccctctctggactgattgaagatagtatccagttcttgtctttaacgttacctgcaatattttctgtaggtccattcttaaagtgtgaagcatgagctgctttggctgttgtgaagatgatgacatgcataaagctgctgacaatggtggtccataccctgttaaaagttcagcaggaactgttggaagttacaatgcatcagaagcagcacctaggggtgctcaggctgttaaaatccagcctattgaggtcccttctatttcagtggacgaactaaaggaagttacagataactttgggacaaattctctgattggggagggttcatatggacgagtatattatggggttcttaaaagtgggcaggctgcagcaatcaaaaaattagatgcgagcaaacagcctgacgatgagttcttggcccaggtttcaatggtatcgaggcttaagcatgaaaattttgtacaattgcttgggtactgcattgatggaggttcccgtgtattggcatatgaatttgcatctaatggatctcttcatgacattcttcatggaaggaaaggtgttaaaggagcacaacctggccccgtcctttcatggcagcagcgtgtgaaaattgcagttggggctgcaaaaggacttgaatacttgcatgaaaaggctgatcctcatattattcatcgagacattaagtccagcaatgttctgattttcgatgatgatgttgcaaagattgcagattttgatttgtcaaatcaagctcctgatatggcagcacggcttcattcaactcgagttctaggaacatttggttatcatgctcctgaatatgcaatgactggacagttaaatgcaaaaagtgatgtatacagttttggtgttgtcctgcttgagcttctgactgggcgaaaacctgttgaccatacgctgcctcgtggacagcagagtctagtgacatgggctacaccaaaacttagtgaagacaaggtaaggcagtgtgttgatgcaagacttcaaggagattacccacccaaggcagttgcaaagatggctgctgttgctgccttgtgtgtgcaatatgaagcagacttccggccaaatatgagcattgtagttaaagctctccagcctctcttaaatgcccgtccaggacctgctggtgaaacaccaagcatgtgattcggttctctctataccggcgagcatactcaagtgtgcgtccatgcaagtatgtgagacataaaaaagaattgttacaaaaatattagtaaattatatggacagttactttgcgcccattatttgctatgtatttcatttgttcataatgtgtgaggctgtttttacgagtcatattttgttgctgctgtcccccctttttttttccccttgaaattttccttggaagttgttaatcccttattagacgagtggcttcgtgtctattatctcctacagatgtgaatgataatgatttacccatgcacttgattgaaatgaattattatttgtttaatgaacttaaaatgcttg

SEQ ID NO: 6844 - DNA, 1417 bp, Manihot esculenta
tcttcctaaacgcttgaaacatgagctgctttggctgttgtgaagaagatgacatgcataaagccgttgacagtggaggcccgtaccctgttaaaagttcagcaggaaacgtaggaggttaccatgcctcagaaaaagcacctaagggtgctcaggctgttaaagtccagcctattgaagtcccttctgtttcagtggatgaactaagagaagttactgataactttgggacaaattctctgattggagagggctcatatggaagagtatattatggggttcttaaaagtgggcaggcaacagcaataaaaaaattagatgctagcaaacagcctgatgatgagttcttagcccaggtttcaatggcgtcaaggcttaagcatgaaaatttcgtacaattgcttggttattgtgttgatggaggttcccgcatacttgcatatgaatttgcatcaaatggatctcttcatgatattcttcatggaaggaaaggtgttaaaggggcacaacctggtcctgttctttcatggcagcagcgtgtgaaaattgctgttggggctgcaaaaggacttgagtacttgcatgaaaaggctgatcctcatatcattcatcgtgatattaagtccagcaatgttctgatttttgatgatgatgttgcaaaggttggggattttgatttgtcaaatcaagctcctgatatggcagcacgtcttcattccactcgtgttctaggaacttttggttatcatgctcctgaatatgcaatgactggacaattaaatgcaaaaagtgatgtatacagttttggtgtcatcttgcttgagcttctgactgggagaaaacccgttgaccatacgttaccacgcggacagcagagtctagtgacatgggctacaccaagacttagtgaagataaggtaaggcagtgtgttgatgcaagacttcaaggagattacccacccaaggcagttgcaaagatggctgctgtcgctgccttgtgtgtgcaatatgaagcagacttccgcccaaacatgagcattgtagttaaagctctacagcccctcttaaatgcccggccaggacctgctggtgaaacaccaagcacatgattttctctctctaacttcctcctctcctctctctctctctcttccccgacatgtgtgcatgctcaagtgcgcatccgtgcaagtaccagaggcataaattagagctgttatagaaattgatagtttgctatgtatttcatttgttcataacgcttgaggctgttgtcagaatcatattcctgctgctgtctttttttccccttattttttattttcatttttgaaaaatccttgttcatctttagtagatgaatagctttgggtcatttatctcttataaatgtgaatgatcgatgatttcctcaacc

SEQ ID NO: 6845 - DNA, 2472 bp, Ricinus communis
aggggcattcttcaaccatttaaatcatgagctttggctattgtgaagaagatgacatgcataaagctgctgacattggaggcccataccccgttaaaagttcagaagatgatgcatcagaaacagcagatacgggaggtcaggctattgaaatccagcctattgaagtcccttccatttcagtggatgaattgaaggaagttactgataactttgggacaaaatctcttattggaaagggttcatatggaagggaatattatgggattcttaaaagtggacaggctgcagttattaagaaattagatacaagcgaacagcccgaggataagttcttggcacaggtttccttgatatcacagcttaagcatgagaatcttgtacaattgcttggttattgtgttgatgaaaatgcgcgtatacttgcctatgaacttgcgtccaatggttctcttcatgatattcttcatgggaggaaaggtgttaaaggagcacaatctgatcctggcctttcatggcagcagcgagtaaaaattgctgttggcgctgcaaaaggccttgaatacttgcatgaaaaggctgatcctcgcattattcatcatgatattaagtccagcaatattctgatttttgacgatgatgttgcaaagatttcagatcttgatttattaaatcaagctctggatatggaagaacgtcttcaggccattgatgaaggaacgtttgattatgaatatgcaatgactagccagtcgaatgcaaagggtgatgtgtatggttttggggttgtcctacttgagcttctgactggacaggaaccagttgaccatacattaactcaggagcagcagaatcttgtgacatgggctacagaagaaagtagtgaggacaagtttaggcaatatgttgatacaagacttcaaggggattacccacttagggcagtcacaaagatggcggctgttgctggcttgtgtgtgcaagatgaagcggacttcaggccaaatatgaggattgtggttaaagcccttgagcacctcttaaatttcaaaccagaagcagctggtgaaacaccaagcatataattctatctctctatctttctctgtgtatccagggaatgttggaggttatcatgcatcagaaactgcaccaaggggagctcaggctgttaaaatccagcctattgaagtcccttccatttcagtggatgaattgaaggaagttacagataactttgggataaattctcttattggagagggttcatatggaagagtgtattatgggattcttaaaagtgggcaagctgccgctatcaaaaaattagatgcaagcaaacagcccgatgatgagttcttggcacaggtttccatggtatcacggcttaagcatgaaaattttgtacaattgcttggttattgtgttgatggaaattcccgtgtacttgcctatgaatttgcgtccaatggatctcttcatgatattcttcatgggaggaaaggtgttaaaggagcacaacctggtcctgtactttcgtggcagcagcgggtaaaaattgctgttggggctgcaaaaggccttgaatacttgcatgaaaaggctgatcctcacattattcatcgtgatattaagtcaagcaatgttcttatttttgatgatgatgttgcaaagattgcggattttgatttatcaaatcaagctccagacatggcagcacgtcttcactccactcgcgttctaggaacatttggttaccatgctcctgaatatgcaatgactggacagttgaatgcaaagagtgatgtatacagttttggggttgtgctacttgagcttctgactgggcggaaaccagttgaccatacattacctcgggggcagcagagtcttgtgacatgggccacaccgaaacttagcgaggacaaggttaggcaatgtgttgatacaagacttcaaggggattacccacctaaggcagtcgcaaagatggcggctgttgctgccttgtgtgtgcaatatgaagcggacttcaggcctaacatgagtattgtagttaaagctcttcagcccctcttaaatgcccggccaggaccagctggtgaaacaccaagcctataattctatctctgcctcctcctcgtgtatccaggtgaatattcaagtgtgcatccacaccatgctgagagaccgacaaagaattgttacggaaaatgttagtaaattatttggatagcgccctatgcttccattatttcctatgtatttcatttgttcataatgtgtgaggctgttttctcctgttatattttttatttttttctttaaaaatcatatatatattttgtttaattttcctttttaagtttttttcttcatgttaactggaaaaacttctgggtcctttgtctcccccatgtgaatgaaaatgatgtccttatccatcatgttaatccaatggtttttgtttaa

SEQ ID NO: 6846 - DNA, 1317 bp, Centaurea maculosa
  misc_feature (63)..(63): n is a, c, g, or t
  misc_feature (65)..(65): n is a, c, g, or t
  misc_feature (72)..(72): n is a, c, g, or t
  misc_feature (77)..(77): n is a, c, g, or t
  misc_feature (83)..(83): n is a, c, g, or t
  misc_feature (89)..(89): n is a, c, g, or t
  misc_feature (110)..(110): n is a, c, g, or t
  misc_feature (112)..(112): n is a, c, g, or t
  misc_feature (1255)..(1255): n is a, c, g, or t
cggggatcttcttgttctacctacgcgcctttctctttctctcatcctccggtgcactttagncntcttctntctcncccccnaattantcatctttctttctttctttntntatatttttccctaaatcaatcactcatcttgattccagccaactacacaagatcttaaggtgtgagtagaggaaagcgattatgagctgcttcaattgctgtggagaagatgacatgcataagtcttatgataacggcccattcatggcaaataatgcagcagggcataatgcaggttatcgtgccacagaggctgcaccaaaggacacacaggccgtagctatccaacctattgccgtccctgccctccaagtggacgagttaaaagatatcacagataactttggcacaaagtctttgatcggtgagggatcatatggacgagtttaccatggtgtcttgcgaagtggccaagcagccgctatcaaaaagctcgattccagtaagcagccagaccaagaattcctagcacaggtttctatggtatcaaggcttaaacacgataatgtcgttgggctactcgggtattgtgttgatggtggtctaagagtgctggcttatgaatatgcatcaaacgggtctcttcatgatattctgcatggaagaaaaggcgttaaaggtgcacagcctggtccagttctctcatggtctcaaagagttaagatcgctgttggggctgccaaaggacttgaatacctgcatgaaaaggcgcagcctcatattatccatcgtgatataaaatctagcaatgttctgctttttgatgatgatgtcgctaagattgctgattttgatttatcaaatcaagcacctgacatggcagcacgccttcactccacccgtgttcttggcacctttggttatcatgctcctgaatatgctatgactggacaactgagttcaaagagcgatgtttacagctttggagtggtgcttctagaactgttgaccggccgaaagcctgttgaccacactttgcctcgtggtcaacagagtctagtcacttgggcaacgccaaaactgagtgaagataaggtgaaacagtgtgttgatactagactgaatgcggaataccctcccaaggcagttgccaagatggcggcggttgcagccttgtgtgtgcaatatgaagcggattttaggccaaacatgagcattgtggttaaagcactgcagccgttgttgaatgctcgacctggccncaaaccgaagcaccgcatttgtgatttccccaatctcttaaaggatctctccatctactgcc

SEQ ID NO: 6847 - DNA, 1549 bp, Castanea mollissima
cttcaaaagtctgaaaagcgcttttaacctgcgcactctgtctctgcttatcgtgcgcgcaccttgtacggcttcggagctcagatctcgaatcgcaacactgattcaagcaacagtgagctcttcgtgttttttgtactatcgtttctccgatttccagagaagagtattctttaggcaaagaatcatgagctgcttcagttgttgtgacgatgatgattttcacaaagccgctgacactgggggtcaatatgcggtgaaaagttcagcaggaaatgatggaggttatcatgcatcagaaactgcacctaagggtgcacaagctgtgaaagttcagcccattgaagttcctgctttactagtggatgaactaaaggaagttacagaaaactttgggaccgatactttgattggagagggatcatatggaagggtatattatgggattcttaaaagtgggcaggctgcagccatcaagaagttagatgccagcaaacaacctgacgatgaatttttagcccaggtttctatggtatcaaggctgaagcatgacaattttgttcaattacttggttactgtattgatggaaattcccgtattctggcctatgagtttgcatctaatggatcccttcatgatattctacacgggaggaagggagttaaaggagcacaacctggtcctgttctttcatgggctcaacgagtaaaaattgctgtaggggctgcaaaagggcttgagtacttgcatgaaatggctagtcctcacatcatccatcgtgacatcaagtccagcaatgtactaatcttcgatgatgatgttgctaagattgcagactttgatttatcaaatcaagctcctgatatggctgcacgtcttcattccactcgtgttcttggaacctttggttatcacgcacctgaatatgcaatgactggtcagttgaatgccaagagtgatgtgtacagctttggtgttgtcctgcttgaacttctgacagggcgaaaacctgtggatcatacattaccacgtggacagcagagtttagttacatgggctaccccaaaacttagtgaagacaaggttaggcagtgtgttgatacaagacttaattcagaatacccacctaaggccgttgcaaagatggctgctgttgctgccttgtgcgtgcaatatgaagctgacttccggccaaacatgagcattgtagttaaagccctccagccactgttacacgcccgtcctggacctgccggtgaagcacaacactagtgattctgtctctctgtgcctgcgagtgtgcgcatgtgagcatgcatatataacaaatggattgtttcagagagtggtggtaaattgtttgatcaaggttccatgtgcttccattatatacacactgtttatttgttcatagtttgtggggctgctttttttctcgtctggaattatccttaatttttttttctttttctttttcccttcccccaaaaaatggttgccatctttacctaaattggtgtgtagcttacccctgtttgtcatcccccc

SEQ ID NO: 6848 - DNA, 1320 bp, Cichorium intybus
agagagaacaggaaaagaattggatcaaactttttctgctttctttctcttcattccttcgtcaaccctgcttcgttggattggttctccttttcttctatcgtagtcggcttcaatttatgattatgggaaatcggattgaataacatcgtaaagatagaagacaaaaatcggattcctgtagtttgccacttaaatgatgtcgtgttgtggatactgtcgtaggaaaaacgagaatgagagtacccatgaaggtgcaaccacaaacaattgtcagacagcaccacctcgggcacccctttatggtggaggcagcatgagagcaccaagaaacaatggagctgggcctcaaaaagatttgccaatcgaagcaccatctctatcatttgatgaaataaacaaaatgacagataattttggttcaacttctttaattggtgaaggctcttacagtcggattttctatggaaagttagaagatggggaagaagtagccataaagaaactagacatcacctcgtcaacagaacccgaatctgaatttagggaaaagttatccatgatttcaagactgaaaagtgagtatttttccgaattacgtggttattgtctggaaaaacacaatcgaatcttgctatatcaatatgccaacaagggtggtttgcatgaaatattacatgggaaaaagggtggtaatgaaggtagcatagttttgacttgggcccaaagagttaaaatttcttatggtgcagcaagaggtcttgaatatttacacgaaaaggctcaacctccaatagttcatcgtgacataaggtcaagcaacgtgttggtgtttgatgattttcaatcaaaaatatccgatttcagtttgtgcaacatgtcttctgacaacacggctcgattgcattccacaagagtattgggaactttcggctaccatgctcctgaatatgcaatgacaggacagataacgcataagagtgacgtgtatagttttggagttgttcttttggaacttttgaccggaagaaaaccagtggatcatacaatgcctaaaggacaacaaagtcttgtgacttgggcaactccaagattgagcgaggataaagtaaagcagtgtgtggaccccaagttaaacaatgattacccctcaaaagcggttgctaagatggcagcagttgcggcactatgtgttcaatatgaagctgattttcgacaaatatgacaatagtggtgaaggctttgcaaccacttctccattcaaaagcaacatcctcagagtcttgacctttttgtgaatatttagaccaccaagattca

SEQ ID NO: 6849 - DNA, 3992 bp, Gossypium hirsutum
acatgtctgccctgcctggtaaacgaatccagtctattctaaactatgttcaagtcgcaaattcagaccaaactctgcaaacacacagcctttacgtcttcgctgactttcaagtaatctaaactagcaggaaaaagaaacatgagttgctttagctgttgtgaagaagatgacatccataaagcttctggaaatgggtcgttcatggcgaatacccccgcaagcaataccggaggatatggatataaagcaagggaagctgtaacaagggacccacggcctgttactattcaacctattgccatccctgcaataacggtggatgagctaaaggaaatgactgataatttcagtatgaaatccttaattggtgagggctcttatggaagagtatattatggcattctaaagagtgggaaggctgcagccatcaaaaagttggactcgagtaagcaaccggaacaagaattcttagcgcaggtctccatggtttcgagattaaaagacgaaaatgttgttcagcttcttggttattgtgttgatggatccctccgtttcctggcgtatgagtatgcctctaatggatcactccatgatagacttcatgggaagaaaggtgtgaaaggagctcagccaggtccagttctatcatggacacagagagttaaaattgcttatggagccgcaaaaggcctcgaatatttgcacgaaaaggcacatcctcatataatccaccgtgatattaagtccagcaatttgcttctttttgatgatgatgttgctaagattgctgattttgatttgtcaaatcaagcccccgacgcgaccgctcgcctccattctacaagggttcttggaactttcggttatcatgctccagaatatgcaatgacaggaacacttagttctaagagcgatgtttacagcttcggtgtcatccttctagagctcttaactggtcgcaaaccggtagatcatacgttgccacgtggacagcagagtctagtgacatgggcaaccccaaaactaagtgaagacaaggtgaagcagtgtgttgatggtagactaaatggagaataccctcccaaagcacttgcaaagctggctgctgtggctgcattgtgtgttcaatatgaagctgattttcgacctaatatgagcattgtagtgaaagctcttcagcctcttttgaatccaactcgtccagcaacaacatcccgtgcctacggtgaaaggtgacatcgtgatgatgagccaattagtggctggaaactgaatcaagaccagttgaagtcgaaaaacctgcctgtcattatgatttgttttgtaaataggtagctttgcttgtattccaccctaaaaccccacaagttgaattactagagctgccacataaagagtagctgtagaatgtagagatatttcatataattcataagcgtagtctgtctgtattttatattggttgtttccatgaattccaaagaatgagattgtgacattagagaggaaaagacaatggaaatagatgaaaatagtatagtttgaaaatggtggcctcagcctcattctcattggacctaaaaccatgtgctggatgcatgcagatgtcaatgccattgcacatggacgtcgtggtggtggtgggcgcacttattgttgttgctcctcctctgcacatgcaatgcaaatcaacattaccttcctgttaaggtactcttacctgcagtttcaggtcctaactcattaattcttatctctaatgagaaataaatgatcaagcagacagggccgaaccctacacatggatccatggtcctaattttcagcttcaactattgctattacagcacaagtacaatctcatcctgttttggtttttcaacattccttacaaaaaatttccaacataaacaagtataggtacttattgtccctgtattggcatcacattcattttcattttctccatcccagcaacaacaaaagttaagaatatagcatccgaataacgaggcaaaaaattatatagaatccatatagacctgtacagaaaatctagtgccaatgcccttttcaagacaagctaatgttttctacaatctagaagaagatatgtatgtatgctccacaaaagaaaaaaaaaattaaaaataaaaaataaaataaaaaatccctcagtttcctgcatgtgctgcaaatctcaactatataggggtcatctgaaggcattggatagtaacgaatgtaatgatggtagtttcccttgttctcagcttctaaagctcattttgtccccaagtctaagggtgatggtgcattccgctctccaacctcaaatctggatcatcactccggtctgcatcagagtttttcctctgtgtatcggcatctgaattaactgattgattccttctgcgtcttctatcctctcgaggaagaggatactcttctgcttcaagcatgcgagcaacctgactcatcttaggtcttttatcagcatcgggatcaacacatctcaaagcagttaaaagagcccgtttaagagcactagttgatggtctagtctcaatgtttgggtcaactacttcttctgagcgtctgagttgaaccatcatctttaaccactcgaccatatttacctcaggctgagggcgaccataatcaattgggtatcttccagtaattgcttctaagagcacaacgccaaagctataaacatcactcttctcattcaggatcccagagtttgcatactctggagcaacataaccaaaggtacccataactcgagttgtgataaaacttttcccatcacctagcaatttggccagaccaaaatcggatatctttgcatcaaagttgtcatcaatcagtatattacttgattttatgtccctatgcacgacttttggttcaatggcctcgtgcaaatatgccagcgccttggcggtgccaagaagaatctttatgcgagcctcccaggtaagatatcccttgtcagacatatctccacggagccattgctccaaattgccgttattgacgtattcataaaccaacaacctttgtgtgccctcgatacagtacccaagaagacgaactaagtttttatgccgcacgtgaccaatggcttcaacttccaccctgaaatccttgtcagcttgtccgggattgttaagaagctttttgacggctacaggagtcccgttaatcagattgcctctataaacaactccatatccaccatcaccaataatattatcctttgaaaaccggttagttgcaaggtgtaggtccctgagagtgaaccaatgaccccagcctaggcgcgaaaattcaggcaggccagacaaaggtgaaggagctgtcaaaggatttgaagaaggcctgtatgtagatactgccccagtagctccctcttctcctggttgagatcctttaacatctttatctacatgattaaaagaacctgactgaccgctatcctctccattatctacattaaacaaacccttctccgaacctttgtcactaaatttctcattaagggtgttaccattgtttgcagaagcttgatcaactcttatctctttaatttcctctgaaacatatggaacttgggtgagaggaagcatcacattcgcccttctagatttcttccgaaagataagccacagtgatatgctaaggataactaagaataccactcctaagcaaattacaataagaacccacaattgcagaccaatgtactcttttgacagagttttgttcagatcagaggccatcttcacctacaccaagatgccttgttgagacagtgctgggaagagacgaaaagggggaaaaaagaaagaaaagaagtttaatttaagagcttggatgtttgtaaagactgtaggaggaaatcccagaagaaaccatattgaaaagctagaaaaggggttacagcaatgtcaaaaaatgaagggatttttgtagggtttcca

SEQ ID NO: 6850 - DNA, 1382 bp, Vigna unguiculata
  misc_feature (134)..(134): n is a, c, g, or t
aaaagcttggactgctttatcctacgccctcctcgctgattatcctgcgcatatttagcctctttctcgtcgagatcctcctcctctgcggactctcactctctcaaagacacaatatcctgttggattccagnagaaagaatcatgagttgtttcagctgttgcgaagaagatgacttccagaagcatgctgaaagtggaggacaacatcttgtaaaaaactcaacaggaaacgatggaaatggtcgtgcttctgaaactgcaaagcagggcattcaagctgttaaaattcagcccattgaagttcctgaactacaagtggatgaactcaaagaaattactgacggctttggagaaagttctttgattggagagggatcctatggaagagtgtattacggtgttctgaaaagtgggcaggctgcagcaatcaagaaattagatgccagtaaacagccagatgatgagtttttagcccaggtttcgatggtttcacggctgaaacatgacaattttgttcaattgcttggttattgcattgatggaaactctcgaattcttgcttatgagtttgcatctaatgggtctcttcatgatattctgcatggaagaaaaggtgttaaaggagcacagcctggtcccgttctaacatggacacaaagagttaaaattgctgtaggggcagccaaagggcttgagtacttgcatgagagggctgatcctcacattatccaccgggacatcaagtcaagcaatgtactcatctttgacgatgatgttgctaaaattgcagattttgatttgtcaaatcaggctcctgacatggcagcacgactccattccactcgtgtccttggaacctttggttatcatgcgccagaatatgcaatgactggtcaattgaatgccaagagtgatgtatacagttttggtgtcgtccttctggaacttttgacgggaaggaagcctgttgatcatacactgccacgtgggcaacagagcctggttacttgggctactccaagactcagtgaggataaagttagacagtgtgtagatgcaagactaggaggagattaccctcccaaagctgttgctaagatggctgctgttgctgccctgtgtgtgcaatatgaagctgatttcagaccaaacatgagtattgttgtcaaagctctccaacctttgttgaacgcaagacatggacctgctggtgaaacttcaaactaatctctctgactatatttctgtctatttgtatcaattagtatgtgcatcagtgagtgtgcacggaagatgtaagaaagtgactgcttcagaagcggatggaagatgaacatgtttatatatcccattgtttatgcagcaaaaaaggaaaaaaa

SEQ ID NO: 6851 - DNA, 665 bp, Cyamopsis tetragonoloba
tccaccagcctgttcaattcgcatcaactcatcaggcctgtcggcgagcaatgttctaatctttgatgatgatgttgctaaaattgcagattttgatttgtcaaatcaggctccagacatggcagcacgtcttcattccacccgtgtccttggaacctttggatatcatgcaccagaatatgcaatgactgggcaattgaatgctaagagtgatgtatacagcttcggtgttgtgcttctggaacttttgacaggaaggaagcctgttgatcatacactaccacgtggacagcagagtctggtcacttgggctacgccaagactcagtgaggataaagtcagacagtgtgtggatcaaagactaggaggagattacccccccaaagctgttgctaagatggctgcagttgctgcactttgtgtgcaatatgaggctgatttcagacccaacatgagcattgtagtcaaagctcttcaacctttgttgaatgcaagacatggacctgctggtgaaacaccaaactgatatctgtctatatctctttctatctgtgtcagtgagtgtgcactagtgcgcacgcaaatgtaagaaagtgactgcttcagaagctggtggtaaaatgctcaaacatgattatatatccaattgttttacactcctcgtg

SEQ ID NO: 6852 - DNA, 1366 bp, Setaria italica
gccatcgccgccgggacacgcaaagatcttgttttttggatagaatatgtcgtgctttggatgctgtggtgatgaagatacacaaggagtgccagactccaggaatcagtacccaggacaccatccagcaaggaatgatgcataccgccctgctgatcaacctcccaagggtcctcagcctgtgaaaatgcaaccaattgcagtccctaccattcctgtggatgagattaaggaggtgaccaagggttatggtgatgaagctttgattggtgagggctcctttggaagagtatattttggtgttctaagaaatggtaggagtgcggcagtcaaaaagttggattctaataagcagccagaccaagaattcttggcacaggtatccatggtgtcaaggctgaagcacgaaaatgtagttgagttgcttggttactgcgctgatgggaccctacgtgttcttgcttatgagtttgctactatgggctctcttcatgatatgcttcatggaagaaaaggtgttaaaggagctcaacctggtcctgttttatcatgggcacaacgtgtgaaaatagctgttggggcagcaaagggccttgagtatcttcatgagaaagcacagccccatatcatacaccgagacattaagtccagtaatgttcttctttttgatgatgatgtagctaagatagctgactttgatttgtcaaaccaagctcctgacatggcagctcggcttcactctactagggttcttggaacattcggatatcatgctcctgagtatgcaatgactggacaactcagctctaagagtgatgtgtatagttttggagttgttcttctcgagctgttgactggaaggaaacctgtcgaccatactttgccaaggggacagcagagccttgtgacctgggctaccccaagacttagtgaagacaaggttagacaatgtgttgactcaagacttggaggtgactatcctcctaaagctgttgcaaagtttgcagctgttgccgcattgtgtgttcaatacgaagcagacttccggccgaacatgagcatcgtggtcaaggcgctccaacccctgctgaatgcgcgggcggctaaccctggagaaaatgccggatcataagcttcacttcactcccccttcttgtatgatagataagtaagatatatgagtcgacaatgtcgttcttgcgaacgtttgcctggcagcatgtaacatttgtgattattcttcccccgagttgtaaacatcaagattcttgtacccccacaatatttgattctttctatcggttgcaagatgacctgtttattggtggcacgcatcgtatatatctaactggagtatgttccttgc

SEQ ID NO: 6853 - DNA, 1516 bp, Setaria italica
acagctccgcccgtcgcaaggagagtactagctgccttcctactcgcttcccttcccgtcctcctccgcgtacctccgctgcctcccctcgtcctcgtgccgccgccgcctcctcctcctcctccggcatcgtcttccaccgttcgccgccatcgccgccgggacacgcaaagatcttgttttttggatagaatatgtcgtgctttggatgctgtggtgatgaagatacacaaggagtgccagactccaggaatcagtacccaggacaccatccagcaaggaatgatgcataccgccctgctgatcaacctcccaagggtcctcagcctgtgaaaatgcaaccaattgcagtccctaccattcctgtggatgagattaaggaggtgaccaagggttatggtgatgaagctttgattggtgagggctcctttggaagagtatattttggtgttctaagaaatggtaggagtgcggcagtcaaaaagttggattctaataagcagccagaccaagaattcttggcacaggtatccatggtgtcaaggctgaagcacgaaaatgtagttgagttgcttggttactgcgctgatgggaccctacgtgttcttgcttatgagtttgctactatgggctctcttcatgatatgcttcatggaagaaaaggtgttaaaggagctcaacctggtcctgttttatcatgggcacaacgtgtgaaaatagctgttggggcagcaaagggccttgagtatcttcatgagaaagcacagccccatatcatacaccgagacattaagtccagtaatgttcttctttttgatgatgatgtagctaagatagctgactttgatttgtcaaaccaagctcctgacatggcagctcggcttcactctactagggttcttggaacattcggatatcatgctcctgagtatgcaatgactggacaactcagctctaagagtgatgtgtatagttttggagttgttcttctcgagctgttgactggaaggaaacctgtcgaccatactttgccaaggggacagcagagccttgtgacctgggctaccccaagacttagtgaagacaaggttagacaatgtgttgactcaagacttggaggtgactatcctcctaaagctgttgcaaagtttgcagctgttgccgcattgtgtgttcaatacgaagcagacttccggccgaacatgagcatcgtggtcaaggcgctccaacccctgctgaatgcgcgggcggctaaccctggagaaaatgccggatcataagcttcacttcactcccccttcttgtatgatagataagtaagatatatgagtcgacaatgtcgttcttgcgaacgtttgcctggcagcatgtaacatttgtgattattcttcccccgagttgtaaacatcaagattcttgtacccccacaatatttgattctttctatcggttgcaagatgacctgtttattggtggcacgcatcgtatatatctaactggagtatgttccttgcta

SEQ ID NO: 6854 - DNA, 1416 bp, Lactuca sativa
cgcgctttcctaattggcttatcttagccgtctgtcttctcgctcgctcaatattactagccaacaaagcgtaattaacacaattgtgtttgtaatctttctttctttctttcttttctattgcttattacaaaaaaaaaaactcattttttttgaagcaatatcgttcactgagtcaaccactgcaaaaatcttagctttgtcgccagaggaaagtaatcatgagttgcttcagctgttgcggagaagatgacatgcataagtcttacgacaatggaccttacatggcaaataacgcagcaggaaacaatggaggctatcgcacgactgaagccgcaccaaaggacacacaggctgtagccattcagcccatcgctgttcctactgtccaggtggacgaattgaaggaaattactgataattttggtacaaagtcattaattggtgagggatcatatggaagagtctaccatggtgttttaagaagcggacaagctgcagctattaaaaagttagactctagtaagcaaccagatcaggagtttttagctcaggtttctatggtatcaaggcttaaacatgatcatgtcgttgagctacttggatactgtgtagatggtggtttgagagtacttgcttatgagtacgcttcaaatggatctcttcatgatattcttcatggaaggaaaggtgtaaaaggtgcacaaccaggtccagttttatcatggtctcagagagttaaaattgcagttggggctgcaaaaggactcgaatacttacatgaaaaagcacagcctcatattattcatcgtgatataaagtcaagtaatgtgcttctttttgatgaagatgttgcaaagattgcagattttgacttgtcaaaccaagctcctgacatggcagcaagacttcattccacgcgtgttcttggaacctttggctatcatgcacctgagtatgccatgactggacagctcagctcaaagagtgatgtctacagcttcggagttgttcttttggaactcttgaccggccgaaaacccgttgaccatactttgccacgtggtcaacagagtctggtcacttaggcaacaccaaaactcagtgaagataaggtgaaacagtgtgttgacaccagactgaatggagaataccccccaaaggcagttgccaagatggcggcagttgcagccttgtgtgtgcaatatgaagctgattttaggccaaatatgagcattgttgttaaagcattgcagccattgctgaatgctcgacagggacctcaaacagaagcaccacacttgtgaattcatctttctatttatgctgaatattatatatgtttattgtttttgaacgacatgccgcctaaaggtagcagatatttatgtatgatttgtagaatcattcttttaa

SEQ ID NO: 6855 - DNA, 1488 bp, Pennisetum glaucum
gaacggttgaagacggtggcggaggaggaggcggcggaggtaggactaggggagcccgtcgcaaggagagtaccagctgccttcctactcgcttcccttcccgtcctcctccgccagtccgcctacctccgctgcctcccctagtcctcgtgccgccgcctcctcctccgccaccgtcttcaaccgttcgccggctcgccgccatcgcctccggggcacacaaaggtctttttttggatataatatgtcgtgctttggatgctgtggtgatgaagatacacaaggagtaccagactccaggaatcagtacccaggacaccatccagcaaggaatgatgcataccgccctactgatcagcctcccaagggtcctcagcctgtgaaaatgcaaccaattgcagtccccaccattcctgtggatgagattagggaggtgaccaagggttttggtgatgaagctttgatcggtgagggctcctttggaagagtatatttgggtgttctaagaaatggtaggagtgcggcggtcaaaaagttggattctaataagcagccagaccaagaattcttggcacaggtatctatggtgtcaaggctgaagcacgaaaatgtagttgagttgcttggttactgcgctgacgggacccttcgagttcttgcttacgagtttgctactatgggctctcttcatgatatacttcatggaagaaaaggtgttaaaggagctcaacctggtcctgttttatcatgggcgcaacgtgtgaaaatagctgttggggcagcaaagggccttgagtatcttcatgagaaagcacagccacatatcatacaccgagacattaagtccagcaatgttcttctttttgatgatgatgtagctaagatagctgactttgatttgtcaaaccaagctcctgacatggcagctcggcttcactctactagggttcttggaacattcggatatcatgctcctgagtatgcaatgactggacaactcagctctaagagcgatgtgtatagtttcggagttgttcttctcgagctgttgaccggaaggaaacctgtggaccatactttgccgaggggacagcagagccttgtgacctgggcgaccccaagacttagtgaagacaaggttagacaatgtgttgactcaagacttggaggtgactatcctcctaaagctgttgcaaagtttgcagctgttgccgcattgtgtgttcaatacgaagcagacttccggccaaacatgagcatcgtggtcaaggcgctccaacccctgctgaatgcacgggcgactaaccctggagaaaatgccggatcataagcttcactttactcgccctcttgtatgatagataagtaagatacgagtcgacaatgtcgttcttgcgaatgtttgcctggcagcatgtaacatttgtgattattctttccctgtaaacatcaagattcttgtaccccaacaatatttgattctttcta

SEQ ID NO: 6856 - DNA, 1304 bp, Momordica charantia
ttggttgctgcgaagaagatgctatccagaaggccgctgatgacagcagaatgtacccagttaaaagttcattaggaactgatgaaagctatcacaaatggcaagctgcacctaagagtcctccaatagtgaaaatgcggccaattgaggtccctgccatatcatttcaggaactaaaggaggttacaaaaaattttgatgcagacagtttgattggagagggttcctacggtagagtatactatggggtatttacaaatgggcagtctgtggcaatcaaaaagttagattccagcaaacaacctgatgatgaattcttatcccaggtttccatggtttcaagactaaagcacaataattttctaaatttgattgggtactgtgttgatggcaattctcgaattcttgcatatgagtatgcttcaagtggatctcttcacgacattttacacgggaggaaaggagtcaaaggagcacagcctggtcctgttctttcctgggcacagagagtaaaaattgctgcaggggctgcaaaggggttggagtatttacatgaaaaggctgatcctcatatcatccatcgggacataaaattgagcaacgttctaatatttgatgatgatgttgcaaaaattgctgactttgatttgtcaaaccaagcccctgatatggctgcacggcttcattccactcgtgttcttggaacctttggttatcatgctcccgagtacgcaatgactggacaattgaatgccaagagtgatgtgtacagttttggtgttgtcctgcttgaacttttgacaggaagaaagccagttgatcatacattacctcgaggacagcaaagcctcgtgacatgggcaacgcccaaactttgcgaggataaagtcaggcagtgtgttgatgcaaaactaggagatgagtaccctcccaaggcagttgctaagtttgcggccgttgcagcattgtgcgttcaatacgaggcagatttcaggccaaacatgagtattgtagtcaaagctctgcagcctctgttaaatgcccgacctggtcctggtggtgaagcaccataaacaagtaaatctctctctctctctgtgtttctgttgggttttttcgttggttcatgtgccaacacgtgagctgcaaattattagcaagggaattaatttccagtaggtggtggtgatcaatttgtttccaaaaagaaaacagtgggatgggatacataattatgatttttatttgatatatgaggtgtagacactgcttttgcctctcatttgtgtgcatgcttcttagac

SEQ ID NO: 6857 - DNA, 1403 bp, Tropaeolum majus
agatttttattttgcttatcctacgcacataaaccggagaaaccacgacgacgaataagaaatcctcgagtaaaagcatcctacttacctgggctgaccatcaacggggttgcctgacgcgaaaccatcatgagctgcttcagttgttgccgagaagatgatttccatagaacttctgataatggatcttacatggcaaataatccagcaagcaatcttgggggttatcaagagagagaagctgcaccaagggacgcacaggccatagttatccaacctattgctgttcctgccattacggttgaagaactgaaggacgttacagataatttcgggacaaaggctttgattggggaaggctcatatggaagagtatattatggagttctgagaagtggccaggctgcagctatcaaaaagttggactccagtaggcaaccggatcaagaatttctcgcccaggtctccatggtatcaagattgatgcatgaaaatgttgttgggctcgttggttattctgttgatggtccttttcgtgtcctcgcttatgaatatgcttctcatggatctcttcatgatattcttcatggaagaaaaggggttaaaggatcagaaccagggcccgttctattatgggcacaaagagttaaaattgcggttggtgcagcgagaggactcgagtatttgcatgaaaaagcagaacctcatattatccatcgtgatatcaagtccagcaatgtactgctttttgatgattatgtagccaaaattgctgactttgatttatcaaatcaagctcctgatgcagcagctcgtctgcactccactcgtgttcttggcacgtttggttatcatgcaccagagtatgcgatgactggaaccttgagctcaaagagtgacgtgtacagctttggtgttgtgttactggagctcttgactggtcgtaaacctgtggatcatacactgccccgtgggcagcagagtctagtgacatgggcaacacctaaactgagtgaagataaagtgaaacagtgtgttgatgcaagactgaatggagagtatcctcccaaggcagtcgccaagatggctgctgttgctgcactctgcgtgcaatacgaagctgattttcggccaaatatgagcatcgttgttaaagctctccagccattgttgaacactcggcctgctcctcaaaccggaataccacattgatgaatcaactcataaaacatggatattttactgcagtgtgctgtaaattgtgtatcattaatttccaaatgaaccacaggaaataacttcatttggagtttttaactttttccctttctcttacgtggatgggtttgtctttgtttgtttagacaaccagtttcaattgtgtaatacaaaatttggttgat

SEQ ID NO: 6858 - DNA, 1559 bp, Tropaeolum majus
agaaaaaggaaagaaaaatcgcccctaataattcaatcaatctaaaggccgtatgaatgcacatctcaaaagagctgttttcatgtaacttgacatcatttctgtttttttttttgctttatcatttggcttccggagcaacatctatagttggattcgctattttttagatctgcatttgatttacagcattactatcagtagagtgatcgaagtagtccaagtgttttcggctccgttttgacttacttcggttgaggttatttgaaggaatcaaggaagtccattaataagattcaaatcatgagttgcttcggttgttgtgatgaaagtgatatgcataaagctgccgacaacgaaagccaatacattgttaaaaacgctagagaaaatgatggaggatatcatgcttctgaaaatgcacctaaaggcgcccaaactgtgaaagttcaacccattgaagtgcctacaattgaagcggatgaactgaaggaagttacagataactttgggacaaattcattgattggagaaggttcatatgggagagtatattacggggtactaaaaaatgagcaggctgcagcaattaaaaaactagatgccagcaaacaaccagatgaggagttcttagctcaggtttccatggtatcaagactgaagcatgagaactttgttcaactgcttggatattgtgttgatgggagctcacgtgtacttgcctatgagtttgcatccaatggatctctacatgatattcttcatgggaggaaaggcgtgaaaggggcacaacctggtcctgttctttcatggcagcaaagagtaaaaatttctgttggagcggcaaaagggcttgaatatttgcatgaaaaggcaaatcctcacatcatccatcgggacatcaaatccagcaatgttttaatttttgatgatgacgtgggaaagattgctgactttgatttgtctaatcaagctcctgatatggctgctcgtcttcactccactcgtgttcttggaacttttggataccatgctcctgaatatgcaatgactggacagttgaatgccaagagtgacgtatacagctttggtgtcgttttgcttgagcttctgactggtcgaaaacctgtggatcatacattaccacgcggacagcagagtctagtaacatgggctacacccaaactaagtgaggacaaggttaggcagtgcattgatgcaagactaggaggtgaataccctcccaaggcagttgctaagatggctgctgttgctgccttgtgtgtgcaatacgaagctgattttcgaccaaatatgagcatcgttgtcaaagcccttcagccgctgttaaatgcacggccaggacctacgagtgaaacagcaaactaagtaactctttttttctaacccccctctctctattgtgaatgtattatgttgtgtgaatttataatttaagaaaaggtttgttaaaaaaggcggtgttcgggattttgaactaagtttaacccatcattgatttgtttatatcgtaagtctaaaccgagaggtgcattaat

SEQ ID NO: 6859 - DNA, 1727 bp, Quercus alba
tgaaagcgcttttaacctgcgcactctgtctctgcttatcgtgcgcacacctttttcggattcggagctcagatctcgaagctcgctgcgaatcgcaacactgattccagcaacagtgagctcttcgtgtttctgtactatcgtttctccgatttccagagaggagtattctttaggcaaagaatcatgagctgcttcggttgttgtgacgatgatgattttcacaaagctgctgacactgggggtcaatatgcggtgaaaagttcagcaggaaatgatggaggttatcatgcatcagaaaccgcacctaagggtgcacaagctgtgaaagttcagcccattgaagttcctgctatactagtggacgaactaaaggaagttacagaaaactttgggacaaatgctttgattggagagggatcatatggaagggtatattatgggattcttaaaagtgggcaggctgcagccatcaagaagttagatgccagcaaacaacctgacgatgaatttttagcccaggtttctatggtatcaaggctgaagcatgacaattttgttcaattacttggttactgtattgatggaaattcccgtattctggcctatgagtttgcgtctaatggatcccttcatgatattctacacgggaggaagggagttaaaggagcacaacctggtcctgttctttcatgggcacaacgagtaaaaattgctgtaggggctgcaaaagggcttgagtacttgcatgaaatggctagtcctcacatcatccatcgtgacatcaagtccagcaatgtactaatctttgatgatgatgttgctaagattgcagactttgatttatcaaatcaagctcctgatatggctgcgcgtcttcattccactcgtgttcttggaacctttggttatcatgcacctgaatatgcaatgactggacagttgaatgccaagagtgatgtgtacagctttggtgttgtcctgcttgaacttctgacagggcgaaaacctgttgatcatacattaccacgtggacagcagagtttagttacatgggctaccccaaaacttagtgaagacaaggttaggcagtgtgttgatacaagactaaattcagaatacccacctaaggccgttgcaaagatggctgctgttgctgccttgtgtgtgcaatatgaagctgacttccgcccaaacatgagcattgtagttaaagccctacagccgctgttacatgcccggcctggacctgccggtgaagcacataactagtgcttctgtctctctctgcctgtgagtgtgcgcctgtgtgcacgcatatatataacaaaaggattgtttcagagagtggtggtaaactgtttgatcaaggttccatgtgcttccgttatttacacactgtttatttgttcatagtttgtggggctgcttttttctcgtctggaattatcctaattttttttttcccttcccccaaaaatggttgccatctttaaactgatgtgtagcttacccctgtttgtgatcccccccttccccataatagtggggtccctaaaagtgtacccaagtagttttcgctctagaacaaagcaagaggaaaaggaaaaaacctagatgcactctagcaaaacattgtagtattgtacctcaagtcggcttgggtgagacattgtgcatctccattaattggcatatacttcagaaatgaaatgttataaatattc

SEQ ID NO: 6860 - DNA, 1428 bp, Orobanche aegyptiaca
gggattgaaagggacatttgaggagatccttgttggaagagtatgagttgctttagctgttgtgaagaatatgacacaaataaaaatgctgatggtggagggcagtacttagtcaaaaactcatctagaaatgatgggggttaccataacacagaagctgcattaaaagatccagcatttaaggtccagccaattgcagtcccgtcaattcccgtggatgaactgaacgaagttactagtaactttagcgcggagaccttgataggggaaggctcgtatggaagagtgtattatggaacccttacgaatggcagggctgcggcgattaagaaattagatgcaagcaaacaaccagatgatgaattcttagctcaggtgtctatggtgtccaggttaaaacatgaaaattttgtggagttacttggttattgtgttgatggaaatcaacgtgttcttgcatatgaatttgcgtctaatggatctcttcacgacatccttcatggacggaaaggtgttaaaggagcacaacctggtcccgttctttcttttcctcaacgtgttaaaatcgcagttggtgctgctaagggccttgaatatcttcacgaaaaagccgaacctcacatcatccaccgtgatattaagtccagcaacgtacttatatttaatgatgatgtagctaagattggtgactttgatttatcaaatcaagctcctgatatggcagcacgtcttcactctacccgtgtcctagggacatttggatatcatgctcccgagtatgcgatgactggtcaactgaactcaaagagtgatgtgtacagctttggtgtggtccttctggagcttcttactggacgcaaacctgtcgatcacacattacctcgtggacagcaaagtttagtaacatgggctacaccaaaactgagtgaagacaaggtccggcaatgtatcgatagtagactggggagtgaatacccacctaaggctgttgctaagatggctgctgttgccgctttgtgtgtacaatatgaagccgatttccggccaaacatgagcattgtggtcaaagcactccagccccttctaaatactcgtccaggaccatccgctgaaagtggcttaacatgaggagctctcgagtcgtgacacatcatgcggtttaacacgagagctggtaattaaatgttgccatgagaatcttcaactcttcacatatatatttatttatatgtgtgtgtgtgtgtgtcgaaataaataagaagaaattaatggtcttgagaatttatatatcaattggtatgctcgtacttagatactcgattcggtgtggttcttgttgtttgtaaactgtatgaataattcttttcaacaagaagaaagagtccccttgtgtgcgtgtgtgtttgtttatcgccaaaattccgagtt

SEQ ID NO: 6861 - DNA, 984 bp, Ananas comosus
agctagttatgcatcacatcctgccccgagggctcctcaacctgtgagaatgcagcctattgaagttccttccatttctgttgaggaaataaaagaaatcgcgaaaaattttagcaatgatgctttaattggagaaggctcttatgccagagtatactatggtgtcttgagaaacggaagaaaatctgcagttaaaaagcttgatgccagcaagcagcccgatcaagaatttctcacgcaggtgtccatggtctcaaggttaactcatgaaaatgtcattgagctgctcggttattgtgttgatggaaatctccgtgtacttgcttacgagtatgcgacgatggggtcccttcatgatattctacacgggaggaaaggtgtgaaaggagcacaacctggtccagttttatcttgggcacagcgtgtaaaaattgctgtgggagccgctaggggacttgaatacctacatgagaaagcgcaaccccaagtcattcaccgtgatatcaaatccagcaatatacttctttttgaggactatgtcgcaaaaataggcgattttgacttgtcgaatcagtctcctgacatggctgcacgcctccactctactcgtgttcttggaacttttggctatcattctccagagtatacaatgactgggcagcttagcaccaagagtgacgtttacagctttggtgtggtccttttggagcttttgactgggcgtaaaccggttgatcatacgttaccacggggtcagcagagtcttgtgacatgggccgcgccaagacttagtgaagataaggtgaggcaatgtgtggaccccaggctaggcagtgagtaccctcccaaggctgttgcaaagttggctgcggtagctgctctatgcatacagtatgaagctgatttcaggcccaacatgagcatagttgtcaaagctctccagcctctgttgaatgttcggtctggcccttctgccgaggctcc

SEQ ID NO: 6862 - DNA, 1632 bp, Oryza sativa
ggagatagagaaagagagagtagaggagagaggaagctgccgcaacgacgaccagttggctggctctcttctgtagcagtagcaactagcaaagctgctgtatttaagttcaccgcgggtcaccacaccagctcacacacgctgtgctgctgctgctgccgctgctcctcctcctcctcttacatcccatcctcgccgcgatttccttcgccgccgccgccggcttcgtcttcttccccggcgccggggcacgcgaaaagggtttgtttctagtagaatatgtcgtgctttgcatgctgtggtgatgaagatactcaaggagtaccagacaacaggaatccatacccagggaaccatccagcaaggagcgatgcatatcgcacagctgatccaactccaagaggtcctcaacctgtgaaagtgcaaccaattgcagtccccatcattcctgttgatgaaattagggaagtgactaagaattttggtgatgaagctttgattggtgaaggttcctttggcagagtgtattttggtgttctaagaaatggtagaagtgcagcggtcaaaaagctagactctagtaagcagccagaccaagaatttttggcacaggtatctatggtgtcgaggcttaagcatgaacatgttgttgagctgcttggttattgtgttgatggaaatctccgtgtccttgcttatgagtttgcgactatgggttctcttcatgatatgcttcatggaaggaagggtgttaaaggagctcaacctggtccagtcttatcatgggcacaacgtgtgaagatagctgttggggcagcaaaaggcctggagtatcttcatgagaaagcacagcctcatatcatacacagggacatcaagtccagcaatgttctccttttcgatgatgatgttgctaaaatagctgactttgatttgtcaaaccaagctcctgacatggcagctcggcttcactctactagggttcttggaacctttggatatcatgcacctgagtatgcaatgactggacagcttagctccaagagtgatgtgtacagttttggagttgttcttcttgagctattgaccggaaggaaacctgttgaccatacattaccaaggggacagcagagtcttgtgacttgggccaccccaaggcttagtgaagacaaggttaggcaatgtgttgactcaagacttggaggggactatcctcctaaagctgtcgcaaagtttgcagctgttgcggcgttatgcgttcagtatgaagcggactttcgaccaaacatgagcattgtcgtgaaagcgctgcaacccctgctgaatgctcgggcaactaaccctggagaaaatgccgggtcataaaactttggtctaccttttgtatgatagatattaagttaagaagtatgagacatcgatattgttcttgcggatgtgtggctggctggaagtgtgtacatttgtgattattcgtcccttgttgtaatcaccaaggttctagcaaccgaaaatatttgattcttcgcatcgggtgagacataacttgtctgaaggtgacatgcatatctatctaccttactcaagagggaaaacaaaattctgcatcttgaactgaactgaactgaactg

SEQ ID NO: 6863 - DNA, 944 bp, Solanum phureja
gggacaaaagcatcagttcctgccaaggctgaagtgcaaaaagcaataccaactatagaggtccctgcattgtctttggatgaattgaaagaggaaactgacaattttggatcaaaagcattaattggtgaaggatcttatggaagagtatactatgctaatctaaacaatggcaaacccgtggctgtgaaaaagcttgatgtttcatctgagcctgagactaatgttgacttcctgagccaggtctctatggtttcaagattgaagcatgaaaatctggtggagttgcttggttactgtgtggaagggaaccttcgtgtattagcgtatgagttcgcaacaatgggttccttgcatgatattctgcatggcaggaaaggtgtacaaggagcacaacctggacccactcttgattggatgcagcgggtaaaaattgttgttgatgctgcaaggggcctttagtatttgcatgagaaggtccagcctccaagaatacacagggatattagatcaagcaatgtccttctctttgaagcctacaaagcaaaaattactgattttaatctgtcaaatcagtctcctgacatggctgctcgtcttcattctacacgagttttgggaacatttggttatcatgcaccagaatatgcaatgacaggacaattgacacaaaagagtgatgtgtatagctttggggtggttcttcttgaacttttgacaggaagaaaacctgtagatcatacaatgcctcgtggacaacagagcttggttacttgggctactccgagattaagtgaagataaggtcaagcaatgcatcgatccaaagatgaaagaagttcctggaaaaggagttgctaagttggcagctgttgcagcactgtgcgtacaatatgaggctgagttccgtcctaatatgagtattgttgtcaaagctcttcaacc

SEQ ID NO: 6864 - DNA, 1677 bp, Glycine max
acattatgccattacggtgcttgtgtgtcagtgtgtaaacaaggtttagttggaataacatctttgtgtatgtaataatagcattacattcttactcttacctaattttaatcatttcaattccaatctagtcaaaaacttggaccgctttatactacgccctcctccctacttatcctgcgcatatttcgccgttttctcgccgagatcttcaactacctctcccgcattctcgcttcctcaactgcacaacattcctattcaattccagaggaaagaatcatgagttgtttcagctgttgtgaagaagatgactaccagaaggcttctgaaagtggaggacagcatgtagtaaaaaactcaacaggaaatcatggaaatggtcgtgcatccgaaactgcaaagcagggcactcaagctgtgaaaattcagcccattgaagttcctgaattaccagtggatgaactcaaagaaattacggatggctttggagaaagttctttgattggagagggatcctatggaagagtatattatggtgttctgaaaagtaggcaggctgcggcaatcaagaaattagatgccagtaaacagcctgatgatgaatttttagcccaggtttcaatggtttcacggctgaagcatgacaattttgttcaattgcttggttattgcattgatggaaactcccgagttcttgcttatgagtttgcatctaatgggtctcttcatgatattttacatggcagaaaaggtgttaaaggagcacagcctggtcctgttctaacatggactcagagagttaaaattgctgtaggggctgccaaagggcttgagtacctgcacgagagggctgatccccacattatccaccgggacatcaagtcaagcaatgtactaatctttgatgacgatgttgctaaaattgcagattttgatttgtcaaatcaggctcctgacatggcagcacgtctccattccacccgtgtccttggaacctttggttatcatgcaccagaatatgcaatgactggccaattgaatgctaagagtgatgtatacagctttggtgttgtccttctagaacttttgactggaaggaagcctgttgatcatacactaccacgtgggcagcagagcctggttacttgggctacaccaagactcagtgaggataaagtcagacagtgtgtagatgcaagactaggaggagagtacctgcccaaagctgttgctaagatggccgctgttgctgccctgtgcgtgcaatacgaagctgatttcagaccaaacatgagcatcgtagttaaagctcttcaacctttgttgaacgcaagacacgggcctgctggtgaaactccaaactaatctctgtctatatgtatcaacgagtatgtgcataagtctaagtctgcacccgagatataagaaagtgactgcttcagaagcggatggaaaattgcttgaacatgtttatattattgttgtgtaattacaaacttgtgtaggacctattagcaattaagaagactttgtgtatcagttttgtgaacggttaaaattcatttaactgtaattaggcaatggtatttttcacgctttaccatagtttagttttgattaagtgttataaatacacattctaataagtcaattcatatatgtgcaaatacgtgc

SEQ ID NO: 6865 - DNA, 1728 bp, Fragaria vesca
ggccaacaccgaaacagagtaagaattaagaaatgaaataaatttttatagaatttatagaattcataatcaaaatcactagcgtattctcatttggttcattgattgggttatcctacgcacccttttccctcctatcctgcgccgcgcatccttcgccggctcagatctcccaagactccaccaactcagtccttcactgactcacttcccccacttcagattcaggaatcatgagctgcttcagctgttgtgatgaagatgatatgcataaagctactgacaatggaggtccttacatgatgaaaaaccctgcagggaatgagggaagtcttcatgcctctggtaatgcgcccaggggtggtcaagccgtaaaggtccagcctattgaggttccgcttataccggtagaggagctaaaggagattacggataacttcgggacaaatgccttgattggggaaggttcgtatggaagagtatattatggggtactaaaaagtggggagcatgcagcaatcaagaagctagatgccagcaaacaacctgatgaggaatatcttgcacaggtttctatggtatcacggctgaaacatgataattttgttcaactgcttggttactgtgtggatggaaattctcgtgttcttgcctacgagtttgcatctaatggatctctccatgatattctacatggaaggaaaggtgtcaaaggagctcaacctggtcctgttctaacctgggcacaacgtgttaaaattgcagtgggtgctgccagaggactcgagtatttacatgagaaggcggatccccatatcattcatcgcgacatcaagtccagcaatgtactaatatttgatgatgatgttgctaagattgcagactttgatttatccaatcaagctcctgatatggcagcacgtcttcactctactcgtgttcttggaacctttggttatcacgccccagaatatgcgatgactggacagttgaatgccaaaagtgatgtttacagttttggtgttgtgctgctagagctcttgactggaagaaaacctgttgatcatacattaccacggggacagcagagcctagtgacatgggctacaccaaaactcagtgaagacaaagttaggcagtgtgttgatgcaagactaggaggagaattccccgcaaaggctgttgcgaagatggcggctgttgctgccttgtgtgtgcaatatgaagctgatttccgcccaaacatgagcattgtggtcaaagccctacaacccctgctaaatgctcggcctggacccactggtgaatctccaagcttgtgattttcagtctcagtctccttctctccttctctcctttagctctggctgtgaagatgtgtcaaatctgcatgcttcagttgttcagtatgcataatataacaaaaggattatttcagagggtggtggtaaattgttcacaatgctatatgcttcattatttactgtgtatgtagtttgttcataatgcaaggggggtatgttcttattggacggggttttcattttttttatatatataatactcaacatttattcattgatgaatgagtttggccgtgaaatctttcgattgcattttatggaactatattaaaatctaagtcatgggggtgtaaatcgtgtaatgtttataatttcacagattgtttatgaaaccattggatctattcatttattagatgagttg

SEQ ID NO: 6866 - DNA, 1421 bp, Panicum virgatum
gtcgggaggaaggagtagccccgctgtaccagctgccttcctactcgcttcccttgccgtcctcctcgcctacttcgccgcggcccccctcatccggcgtcgtcttccgccgtccgccgccgggacacgcaaagatcttgtttcttcgatagaatatgtcgtgctttggatgctgtggtgatgaagatgcacaaggagttccagactccaggaatccgtacccaggacaccatccagcaaggactgatgcataccgccctgctgatcaacctcccaagggtcctcagcctgtcaaaatgcaacccattgcagtccctgccattcctgtggatgagattagggaggtgactaagggttttggtgatgaagctctgattggtgagggctcctttggaagagtatattttggtgttctaagaaatggtaggagtgcggcggtcaaaaagctggattccaataagcagcccgaccaagaattcttggcgcaggtgtctatggtgtcaaggttgaagcacgaaaatgttgttgagttgcttggttattgcgctgatgggaccctacgtgtccttgcttacgagtttgctactatgggctctcttcatgatatgcttcatggaagaaaaggtgttaaaggagctcagcctggtccagttttatcatgggcacaacgtgtgaagatagctgtcggggcagcaaaggggcttgagtatcttcatgagaaagcacagccccatatcatacaccgagacatcaaatccagcaatgttcttctttttgatgatgatgtagctaaaatagctgactttgatttgtcaaaccaagctcctgacatggcagctcggcttcactctactagggtgcttggaacattcggatatcatgcgcctgagtatgcaatgactggacaacttagctccaagagcgatgtgtatagcttcggagttgttcttctcgagttgttgactggaaggaaacctgtcgaccataccttgccaaggggacagcagagtcttgtgacatgggctaccccaaggcttagtgaagacaaggttagacaatgtgttgactcaagacttggaggagactatcctcctaaagctgttgcaaagtttgcagctgttgccgcattgtgtgttcaatacgaagcggacttccggccaaacatgagcatcgtggtcaaggcgctccagcccctgctgaatgctcgggcgactaaccccggagaaaatgccagatcataagtttcatttcatcctaccctcccccccaacaccccctctttctattatatgataaataagacatatgagtcgacaatgtcgtttttgcggacgtgtggctggcagcgtgtaacatttgtgattatttttcccccgatttgtaaacatcaagattcttgtacccccacaatatttgattct

SEQ ID NO: 6867 - DNA, 697 bp, Panicum virgatum
cagcaatgttcttcttttgatgatgatgtagctaaaatagctgacttgatttgtcaaaccaagctctgacatgacagctcggcttcactctactagggtgcttggaacattcggatatcatgcgcctgagtatgcaatgactggacaacttagctccaagagcgatgtgtatagcttcggagttgttcttctcgagttgttgactggaaggaaacctgtcgaccataccttgccaaggggacagcagagtcttgtgacatgggctaccccaaggcttagtgaagacaaggttagacaatgtgttgactcaagacttggaggagactatcctcctaaagctgttgcaaagtttgcagctgttgccgcattgtgtgttcaatacgaagcggacttccggccaaacatgagcatcgtggtcaaggcgctccagcccctgctgaatgctcgggcgactaaccccggagaaaatgccagatcataagtttcacttcacccttacccccccccccccctccttgtatgatagataagtaagacatttgagtcgacaatgtcgttcttgcggacgtgtggctggcagcgtgtaacatttgtgattattcttcccccgagttgtaaacatcaagattcttgtacccccacaacatttgactctttctatcggttgcaagatgacatatttattggtggcgtatca

SEQ ID NO: 6868 - DNA, 631 bp, Petunia hybrida
actggtcagctgagttcaaagagtgatgtttacagttttggcgttgtactccttgaaactactcactggtcgaaaacctgttgatctacattgccacgtgggcaacagagtcttgtgacatgggcaacaccaaggcttagtgaagataaagtgaagcatgtgttgatgctagattgggtacagaatatcctcctaaggcagttgcaaagatggctgcagttgctgcattgtgtgtgcaatatgaagccgattttcgaccaaatatgagcattgtggtaaaagctcttcaacctctgttgcacgcccgagctgcacctactgaagcatcacacttgtgaattctctcctttcccatagccactgctgcacgaaacgacaacgattgagatttgttttgttgatttgaagacgatattatactagtagtcatctgtgaatcagcacacagtgtaaacaccccccccccttcctcttccttgtcgattgaatgtgaatacttttataatgcactaatgaaagtagatttgcctattcttttcatggattgttattgaggttctgaataatctccatcatctaagtggacgatagctatgaaagaaagctcaaactaccacgagctcaactttcc

SEQ ID NO: 6869 - DNA, 1671 bp, Sorghum bicolor
ctctctccagcagcaccacagcactcccctcgcattgttcttgatcccatccttccatccagtactacgattctcgctccctctccaagatcaatcaaaggtcggagaagaaggaattcagggttagggagccagccatggggtgcttttcatgctgctgcgtggccgatgacgacgacattggcaggaggaagaagcatgacgatgcctacgttcctatccctgctcaagttgataactttggacctagccggcccccagccccaatccctgtcatccccacaggcagagatcagccaattgcagtaccgcccattcatctggaagagttgaaggaaattacaaagaacttcagcagtgatgccctcattggtgagggctcgtatgccagagtctatttcggtgtgctgaaagatgggacgaaatctgcagtgaagaagcttgactccagcaaacagcctgatcaagaattccttgtgcaggtttcagctgtctcaagattgaagcatgagaatgttgtccaactcgttggatactgcgctgaagggatcacccgcgttcttgcttatgagtatgcaacaaggggatcattgcatgatatcctccatggtaaaaagggtgtcaagggagctcagccagggccagtcctgtcatggatgcagcgagcgaggattgccgtaagtgcagctcgtgggctcgagttcctccacgagaaggcggactctcgagtggtccaccgcgacatcaagtccagcaacatactgctctttgacaatgacgttgccaagatcggggactttgacatctcaaaccagtcccctgacatggctgcgcgcctccactctactcgtgttcttggcacctttggctaccatgcaccagaatatgccatgactggacagcttagcaccaagagtgatgtttacagctttggagttgtgctgttggagcttttaaccggtcgcaagccagttgaccacacactgccccgtggccagcagagccttgtgacatgggctacaccgaggcttagtgaagacaaggtgaagcaatgcgtggatccaaggctcggagatgaataccctccaaaggctgtagccaagatggctgctgtggccgccctgtgcgtgcaatacgagggtgaattccgtcccaacatgagcatcgtggtcaaggccctgagccccttgctgcacagccggcccggcaaccgccccgctgcctcgccggcctcccccgctgcagcagcagcagcagcagcagcagagcgatctggactgtgattcctcatcaccaaagatggccatggtcctgtgtgcgacgtgacgactttgggttgaggaagaagagaccgtcttgtggagcgttgcgttgcgttgcgttgctgtgtcaagactgttttaagtcttggcgccgagaagagctttgccatgcggctgtgtattgttgtaagcgctgtcccctgctttgtgtgtctgtcatcaacctgttctagaaaatggtgtgcgagggatcatggatggatgataccaactgtttggtctcttttggaatgcaaaaacgcagcacttggcttcctatgtgcagatccgctgctctgttactgcaaagtaggtgtatatctcttttggaatgcaaaaatacagcacttggcttcctatgtgcagatcc

SEQ ID NO: 6870 - DNA, 1784 bp, Sorghum bicolor
ggcaaccccacaacagaggagaagaaggggaaggaagggcggcgagggagaccctccgcgtcgtgtcccttcctcttcctcctcctcctccttctccttctcatcccctcctcctctctccagcagcaccacagcactcccctcgcattgttcttgatcccatccttccatccagtactacgattctcgctccctctccaagatcaatcaaaggtcggagaagaaggaattcagggttagggagccagccatggggtgcttttcatgctgctgcgtggccgatgacgacgacattggcaggaggaagaagcatgacgatgcctacgttcctatccctgctcaagttgataactttggacctagccggcccccagccccaatccctgtcatccccacaggcagagatcagccaattgcagtaccgcccattcatctggaagagttgaaggaaattacaaagaacttcagcagtgatgccctcattggtgagggctcgtatgccagagtctatttcggtgtgctgaaagatgggacgaaatctgcagtgaagaagcttgactccagcaaacagcctgatcaagaattccttgtgcaggtttcagctgtctcaagattgaagcatgagaatgttgtccaactcgttggatactgcgctgaagggatcacccgcgttcttgcttatgagtatgcaacaaggggatcattgcatgatatcctccatggtaaaaagggtgtcaagggagctcagccagggccagtcctgtcatggatgcagcgagcgaggattgccgtaagtgcagctcgtgggctcgagttcctccacgagaaggcggactctcgagtggtccaccgcgacatcaagtccagcaacatactgctctttgacaatgacgttgccaagatcggggactttgacatctcaaaccagtcccctgacatggctgcgcgcctccactctactcgtgttcttggcacctttggctaccatgcaccagaatatgccatgactggacagcttagcaccaagagtgatgtttacagctttggagttgtgctgttggagcttttaaccggtcgcaagccagttgaccacacactgccccgtggccagcagagccttgtgacatgggctacaccgaggcttagtgaagacaaggtgaagcaatgcgtggatccaaggctcggagatgaataccctccaaaggctgtagccaagatggctgctgtggccgccctgtgcgtgcaatacgagggtgaattccgtcccaacatgagcatcgtggtcaaggccctgagccccttgctgcacagccggcccggcaaccgccccgctgcctcgccggcctcccccgctgcagcagcagcagcagcagcagcagagcgatctggactgtgattcctcatcaccaaagatggccatggtcctgtgtgcgacgtgacgactttgggttgaggaagaagagaccgtcttgtggagcgttgcgttgcgttgcgttgctgtgtcaagactgttttaagtcttggcgccgagaagagctttgccatgcggctgtgtattgttgtaagcgctgtcccctgctttgtgtgtctgtcatcaacctgttctagaaaatggtgtgcgagggatcatggatggatgataccaactgtttggtctcttttggaatgcaaaaacgcagcacttggcttcctatgtgcagatccgctgctctgttactgcaaagtaggtgtatatctcttttggaatgcaaaaatacagcacttggcttcctatgtgcagatcc

SEQ ID NO: 6871 - DNA, 432 bp, Nicotiana tabacum
tggttatcatgcaccggaatatgcaatgactggtcagttgagttcaaagagtgatgtttacagctttggtgttgtgctactggaactacttactggccgtaaacctgtagatcatacattgccacgtgggcaacagagtcttgtaacttgggcaacgccaagacttagtgaagataaagtgaagcagtgtgttgatgctaggctaaatacagaatacccacccaaggcagtcgcaaagatggctgcagttgctgccttgtgcgtgcaatatgaagctgatttccgcccaaatatgagcattgcagtaaaggctcttcagcctctgttgcctcgacctgtaccaagttgaacatcaagcttgtgaattttctccattctccagcctttacatcatgatcacaatattagtggtcgcctaggaaactactgcat

SEQ ID NO: 6872 - DNA, 1363 bp, Primula obconica
ccttttctaatttaaaaaaggcaatcatgagctgcttcggatgttgtggagatgataatcagcatatggctgctgatcatggaaactatttgccaaacaactctgcggggaacaattatggagcccgtaatgctagtgatgcagcacagaaaccaacaaaaatcgtggacatgaagcctattgctgtgccatctatccctgtggacgaattgaaggatttaactgataattttggggtaaaggcattaattggtgaaggatcatacggaagagtttactatggtcttcttcaaggcggtagggctgcggcaattaaaaaattagactcaagtaaacagccagatcaagatttttagctcaggtttcaatggtatcaaggctgaaaagtgataatttcgttgagcttctggttattgtgtcaatggtgggatcagggtccttgcttatgagtatgctccaaatggatctcttcatgatattcttcatggaaggaaaggtgtgaagggagcacaaccaggaccagttctatcgtggttacaaagggtcaaaattgctgttggtgctgcaaaaggtctagaatatctacatgagaaggcagatcctcatatcatccatcgcgacatcaagtcgagcaatgtcttgcttttcgatgacgacgtggcaaaaattgcggactttgatctctctaatcaggccccagatatgacagcacgtttacattcgactcgtgttttaggaacctttggctatcatgctccagaatatgcgatgactggacaactgagtctaaagagtgatgtttatagctttggtgttgtccttctagaactattgactgggcgtaaacctgtggaccacacattgcctcgagggcaacaatccctggtgacttgggcgacaccaaagcttagcgaagataaggtgaagcagtgcgttgacgttaggttgggtacggagtaccctcccaaggcagttgctaagatggctgccgtagctgcattgtgcgtgcaatatgaagctgattttcggccaaatatgagtattgttgttaaagctctccagcctttgttgaatgctcgatcagggcctcccgctgatgcacaatcaagattttaagcctatatggaaatcttgctagtgagatccgtatgtaattaggtggttgtgaaattctacttccccgtgcctcttccattggcactttttgtcaaaaacactgaaatggatcgtgtattagtgcataataatgttatctgtaaaaatacttgatttacttgagtgttgcaaattcgttcatttgggttggaggatatgtgtatgctcttcatatctaattttatgtataaattttccatgtggttgt

SEQ ID NO: 6873 - DNA, 1319 bp, Brachypodium distachyon
aaaaaggaaacggccggacaaaagaaacaaaccaacaagcaagaagcggcgagagagagaaggaggggggcaaggcagcaagccaacggaggaaggggaagggcgaggaagaccgcgtcgtgttcctcgtcccgtctcctctcctctccatccccttcgcattgctcttaggattccgattcaaccaaagaagaggaaccaaacggagcgatggggtgtttttcatgctgcggagccgatgctgttggcaagaggaagaagcacgacgatcctcttgttcctgcccctgctccaggggttaactatggatatagccgggggccagcccctacccctgccatccgcaccggcaaaactcggccaattgaagtaccagccattcccctagacgaaatgaaggaaataaccaagaacttcagcaatgatgctcttataggagagggctcgtatgctagagttttctttggtgtacagaaagatggtcagaaatctgcggtgaagaagctcgactccagcaaacagcctgaccaagaattcctttcgcaggtttccgccgtttcaagactcaagcatgacaatgttgtccaacttatgggatactgtgctgtagggagcacacgccttcttgcctatgagtatgcgacaaggggatctttgcatgatattcttcacggtaaaaagggtgtcaagggcgcccagccgggaccagttctatcatggatgcagcgggcgaggatcgccgtaaatgccgcaagagggctcgaattcctccatgagaaggcagagcctcgtgtcgtccaccgtgacatcaagtccagcaacatactactctttgacaacgatgttgcaaagataggagactttgatgtctccaatcaggcacctgacatggctgcgcgccttcactctacgcgtgttcttggcacctttggttatcatgctcccgagtacgcgatgactgggcagcttagcgcgaagagtgatgtctacagctttggagtcgtgttgctggagcttttaactggtcgcaaaccagttgatcatacactgccacgtggacagcagagccttgtgacatgggctacaccaaggctaagtgaagacaaggtgaggcaatgtgtggatccaaggcttggatcggattatcctcctaaggctgtcgccaagatggctgccgtggccgccctgtgcgtacagtacgaggcggagttccggcccaacatgagcatcgtcgtcaaggctctggccccgctgctgcacacccggtcaagacccgccgcctcggcctccgcttccaccgccatctgagggatcctgcc

SEQ ID NO: 6874 - DNA, 1683 bp, Vitis vinifera
aagaagggtgcctaaatgatagaagaataatcagtctggtgaggatgtggtacaagtcaaggctcaagaaagacactgaagaaggcttccattgcatgatttttctatcttgtgctttgcttgctagccggctttatagcttcagatcctccgcatttgctttgtgtactgctgattactatgcaatactgttaataataggctgaacagtctgcagactttattagagaaagtaaagtgaaagacaaggcataaatacaagtataatctccaccagcaagcatctgggtctgaatcgaggagaaaaaatatgagttgcttcagctgttgcgaagaagatgacatccacaaggcttctgatactggaccatatgtggcaaataattcagcagttggccataatggaaattatcacatgactgaagcttcacgatcaaacgacacacaaactgtggatgtcctgcctattgctgtctcagccatctctgtggatgaattgaaagaaattacagataactttggtcaacaggctttaattggggaaggctcatatggaagagtataccatggtcttctgaaaactgggcaggctgcagccataaagaagttggattccagcaagcaaccagaccaagaatttttagcgcaggtttccatggtatcaagactaaagaatgagaatgttgttgagctagttggctattctgttgatggcggtctccgtgttgtagcttatgagtatgcttctaatggatcccttcatgatattcttcatggaaggaaaggtgtcaaaggagcacagccaggtccagtactctcatggtctcaaagagttaagattgcggttggagcggctaaaggactagaatatttacatgagaaggcacgacctcatattattcatcgtgacatcaagtccagcaatgtgctactatttgatgatgatgttgctaagattgctgattttgatctgtcaaatcaagcccctgattcagcagcacgtcttcactctactcgtgtccttggaacctttggttatcacgctccagaatatgcaatgaccggacagctgagttcaaagagtgatgtttacagctttggtgttgtcctgctggaactcttgactgggcgtaaacctgttgatcacacactgccacgtggtcagcagagtcttgtaacatgggccactccaaaactcagtgaagataaggtgaagcagtgtgttgacaccagactaggaggagaataccctcccaaggctgtagcaaagatggctgctgttgctgccttgtgtgtacaatatgaagctgatttccggccgaacatgagcattgtagtcaaagctctgcagcctctgttgaatgctcggcctggacatacaccaaccttgtgaattccctcttccctcccagtcatctcttgcaggaatattttattgagatctgttttttgacagggtgctgctatatacataatccaccatttggtactttggcttgtagtaattttaaatgcttactggattcttttctgttatgcatagaaagattctacatgatgaaggctctctctattttgttgttgggtgtcacagcaagggtaacctttgtatggatgtttgtataagattgaaataataggggaaaaaaaggaaagaaagaaatctacacccctcatttgact

SEQ ID NO: 6875 - DNA, 1643 bp, Vitis vinifera
  misc_feature (1281)..(1281): n is a, c, g, or t
gaggatgtggtacaagtcaaggctcaagaaagacactgaagaaggcttccattgcatgatttttctatcttgtgctttgcttgctagccggctttacagcttcagatcctccgcatttgctttgtgtactgctggttactatgcaatactgttaataattggctgaacagtctgcagactttattagagaaagtaaagtggaagacaaggcataaatacaagtataatctccaccagcaagcatctgggtctgaatcgaggagaaaaaatatgagttgcttcagctgttgcgaagaagatgacatccacaaggcttctgatactggaccatatgtggcaaataattcagcagttggccataatggaaattatcacatgactgaagcttcacgatcaaacgacacacaaactgtggatgtccagcctattgctgtctcagccatctctgtggatgaattgaaagaaattacagataactttggtcaacaggctttaattggggaaggctcatatggaagagtataccatggtcttctgaaaactgggcaggctgcagccataaagaagttggattccagtaagcaaccagaccaagaatttttagcgcaggtttccatggtatcaagactaaagaatgagaatgttgttgagctagttggctattctgttgatggcggtctccgtgttgtagcttatcagtatgcttctaatggatcccttcatgatattcttcatggaaggaaaggtgtcaaaggagcacagccaggtccagtactctcatggtctcaaagagttaagattgcggttggagcggctaaaggactagaatatttacatgagaaggcacgacctcatattattcatcgtgacatcaagtccagcaatgtgctactatttgatgatgatgttgctaagattgctgattttgatctgtcaaatcaagcccctgattcagcagcacgtcttcactctactcgtgtccttggaacctttggttatcacgctccagaatatgcaatgaccggacagctgagttcaaagagtgatgtttacagctttggtgttgtcctgctggaactcttgactgggcgtaaacctgttgatcacacactgccacgtggtcagcagagtcttgtaacatgggccactccaaaactcagtgaagataaggtgaagcagtgtgttgacaccagactaggaggagaataccctcccaaggctgtagcaaagatggctgctgttgctgccttgtgtgtacaatatgaagctgatttccggccnaacatgagcattgtagtcaaagctctgcagcctctgttgaatgctcggcctggacatacaccaaccttgtgaattccctcttccctcccagtcatctcttgcaggaatattttattgagatctgttttttgacagggtgctgctatatacataatccaccatttggtactttggcttgtagtaattttaaatgcttactggattcttttctgttatgcatagaaagattctacatgatgaaggctctctctattttgttgttgggtgtcacagcaagggtaacctttgtatggatgtttgtataagattgaaataataggggaaaaaaaggaaagaaagaaatctacacccctcatttgact

SEQ ID NO: 6876 - DNA, 1622 bp, Triticum aestivum
ctcccagcccccgagacgacgaagccgaccaaaagtaagcaacgccgccgacccctcgagtaggggtgaaacaaggcaaagggagagtaatgtggcgtcgctgcatttgctgtcaagccgctgagtttgatgagaatgaaaatgggcgtgccaaggccaaggccccaacaaataacgtagatggaatgaaaaagggtttgaaagattctgctactgtgaaagccgagccacaagattcagctccctctatcaatattcctgttctatctttggatgaattaatagaaaagactgatgattttggggcaaaggctttaataggcgaagggtcttatgggagagtgtactacgctgtccttgataatgggacaaaaatggcagtgaagaaacttgatgctactgaaaatgagcccatatcagaattctcgactcaggtttccttggtttcaagattgaaacatgaaaacttcgtagatatattgggatactgtatggagcgtaaccttcgcatagtagcctatgaatttgccaccatggggtctctgcatgatgttctacatggaagaaaaggagtacaaggtgcacaacctggtccaccacttaattggatgcagcgaatgaaaattgctgttgatgctgccaaaggacttgaatatctgcacgagaaggtccagccttctattgtacatagagatgttagatccagcaacatcctcttatttgaggacttcaaggccaagattgcagacttcaatctttcaaatcaggctccagatatggctgctcggttgcattctactcgtgtgttgggaaccttcggttatcatgccccagagtacgcaatgactggtcagctgacccagaaaagtgatgtgtatagttttggggttgttctcttggaacttctgacaggaagaaagcctgtggaccatacagcgcctcgagggcagcagagcctggttacatgggctacaccaagattaaccgaagacaaggtgaagggttgcatagatccccggttggagggtgaatatccgccaaagggacttgcaaagcttggggcggtagcagctctgtgtgtgcaatatgaagccgagttccgtccaagcatgagcattgtggtgaaggctttatctccccttaccttgagcaggcaaactccacctgcaccagcagcagctctggacagttgatccacagaattaaccaaagaaataagatacctctttaactgaagatggcctgcacgaagatagtccgtccgcttgcctcatgctgctatctcttttaccgaaagctgatgatgatatgcaagtcaagatatgaggaaattggagccttgtcagatcactttataactaactaaattaagacgtgtggctttggtggaacacagagacgtccttttctagtagtatatctctaaaacttgggaattatctgtagagaacaatatctgcatttttcacattcgttgattgtagaacttcctgtcgtgctacttctggcctaactatagggacgaaatacctttcttacgatcctcctggccgtgggtcagctgaggaacaatgtttcctctattactgtccttggggttatgaacaaaaaaaaaaaaaaag

SEQ ID NO: 6877 - DNA, 653 bp, Primula obconica
acagtagtatatttggctatcacgctccagaatatgcgatgactgggcatttaactcagaagagtgacgtgtatagctttggcgttgttcttcttgagcttctgacgggccgcaaaccagttgatcataatatgcctcgtggccagcagtctctcgttacctgggccactcctagactgagtgaagataaagtcaaacaatgtgtagatccaaagctgaaggaatatcctcaaaaaggagttgctaagcttgcagcggttgcagcattgtgtgtccaatatgaggctgaatttcgaccaaatatgagtattgttgtcaaggctctacaacctcttttaaagcctcctggtccacctcctggtcctgtttcagagttataaaccaagagattcttgtgcacagtttggtcccatttcttttcctcgactctttatgcatataaatatattcgttttatttaattgcgaatgagattatgtgtgtaggcgtggtttgcttattccatatctagtattgcttgtgatgctagagtcttgttgtactcatagaatgactttgggatggttagttattggttgtttggtaatacctctggattgtgtttttctttattgtctcttgatattcgagtgagttcagctatttttttttct

SEQ ID NO: 6878 - DNA, 1197 bp, Eutrema halophilum
agacaggaacaatgagctgtttcggttgttgccgtgaagatgatttgcttggagcaaatgattatggaggccagaatatgaccaaacaatctggaggaaatgatggaaggcgcaatacctctgaaattgcacaaaaaactgtgaaggtgcagcctatagaagtagccgccattctcgctgatgaacttatcgaagcaacaaatggttttggatcagaatctctcatcggtgaaggatcatatgcaagagtatatcacgggttcttaaagaatgatcagcctgcagcaatcaaaaagttagactctaacaaacagcctgacgatgaattccttgcccaggtttctatggtttcgaggttgaagcatgataactttgtcgagctgcttggttactctgttgatgggaactcgcggatacttgtctttgagtttgcccaaaatggatctcttcatgatattcttcatgggagaaaaggtgtcaagggggcaaagcctggtccactcttgtcgtggcatcaacgagtgaaggttgcggttggagcagcaagagggcttgagtacttgcatgaaaaggcgaatccacatatcatccaccgcgacataaagtccagcaatgttctaatctttgatgatgatgtagctaaaatcgctgactttgatctttcaaatcaagctcctgatatggccgcacgccttcattccactcgtgttcttggaacctttggttatcatgcccctgaatatgcaatgactgggcaattgagtgccaagagtgatgtgtacagcttcggcgttgtattgctcgagcttctaacaggtcgaaagcccgttgatcatacattgcctcgaggccagcaaagtttagtcacatgggctacaccaaagctaagcgaagacaaagttaagcagtgtgttgattcaagactcggaggagattaccctccaaaagctgttgctaagttagctgctgttgctgcattgtgtgtacaatacgaagctgatttcagaccaaacatgagcattgtcgtcaaggctcttcaaccattgttgaatgctcggaccggacctgccggaggaggagcaccttagtgttaagaaggaaaattgatttaccttcccatacaaccctatcaacatagtgttcatagaattacgacattaatcctaattattttctccagtaaactgacatgtgatt

SEQ ID NO: 6879 - DNA, 855 bp, Castanea mollissima
atattattcatggacgaaaaggtgtcaaaggagcacagccaggcccagttctgtcatgggcacaaagagttaaaattgctgttggggcagcaaaagggcttgaatatctacacgagaaggcacaacctcatatcgtccatcgtgatatcaagtccagcaatatactgctttttgatgatgatgtcgcaaagattgctgattttgatttgtcaaacgaagcccctgataatgcagcacgccttcattccactcgtgtacttggcacctttggttatcatgctccagaatatgcaatgactgggcagctgagttcaaagagtgatgtttacagttttggagtcgtcctactggaactcttgactggtcgtaaacctgttgatcatacactgccacgtggacagcagagccttgtgacatgggcaacaccaaaactcagtgaagataaggtgaagcaatgtgttgatgctagactcaatgcggaataccctcccaaggcagttgcaaagatggctgctgttgctgccttgtgtgtgcaatatgaagctgattttcggccaaatatgagcattgtagttaaagctctacagcctctattgaaccctcgatctggtcccccaagtgaaacaccgcagcgcttgtgaattcttcctgacaacctaatcttccttgcaggatatattattgaaatttgttttgtaaacagggtgttttagatcatgtaccattttgtgtaccttttagtcatcaatagcctaccagatttatgtttgtaatctatgtaatcattttacacgtgatgatttgattgttgagagcattagcttattgaactgctatgggtgatttattgctcta

SEQ ID NO: 6880 - DNA, 1656 bp, Actinidia deliciosa
  misc_feature (653)..(653): n is a, c, g, or t
  misc_feature (655)..(656): n is a, c, g, or t
  misc_feature (663)..(663): n is a, c, g, or t
  misc_feature (665)..(666): n is a, c, g, or t
  misc_feature (672)..(672): n is a, c, g, or t
  misc_feature (674)..(674): n is a, c, g, or t
  misc_feature (678)..(678): n is a, c, g, or t
  misc_feature (680)..(680): n is a, c, g, or t
  misc_feature (682)..(682): n is a, c, g, or t
  misc_feature (686)..(686): n is a, c, g, or t
  misc_feature (689)..(689): n is a, c, g, or t
  misc_feature (721)..(721): n is a, c, g, or t
  misc_feature (724)..(724): n is a, c, g, or t
  misc_feature (751)..(751): n is a, c, g, or t
  misc_feature (760)..(760): n is a, c, g, or t
  misc_feature (802)..(802): n is a, c, g, or t
  misc_feature (856)..(856): n is a, c, g, or t
  misc_feature (858)..(858): n is a, c, g, or t
  misc_feature (883)..(883): n is a, c, g, or t
  misc_feature (915)..(915): n is a, c, g, or t
ctcttccaaaactagttggtgttaaagccacacacacgagtaaaaagccactgacctacaccactacacacagttgcggacatacacaagaaagagagccagaaaaagtgcttacctttgcagatgcagttgtatactatatatatatttcaagcacagttgctgcctccccgccaaagtgcaacaaagttgaccattgcaatcttacgtctttgttcatttgaggaggacaatcatgagctgcttcagctgttgcatagaaggtgatatgcaaaggactgctgataatggacagttcatgacacataactcaacaggaaactatggaggttatcatgacactgaagctgcaccagaggacacaaaaactgtagatatccagcctattgctgtccccacaatcccagtggatgaactgaaggaaataacagacaactttggttcaaaggtattaattggtgagggctcatatggaagagtttactatggtcttctcaaaagtggacagactgcagccattaaaaagttagactccagtaagcagccagaccaagaattttatgcacaggtttcaatggtatcaagactcaaacatgaacatgttgttgagcttcttggttattgatggatggcagtctccgagtccttgcttntnngtatgcntnnaatatntnttcntnanattntgnatggacggaaaggtgtcaagggagcccaaccnggnccagttctgtcatggacacaaagggtnaaaattgcngttggggctgcaaaaggacttgaatatttacatgaaaaggcnaagcctcatattatccatcgtgacatcaagtcaagcaatgtcttactgtttgangntgatgttgcgaaaattgcggatttngatctctcaatcaagcccctgatatggcagcncgcctgcattccactcgtgttctgggaacctttggttatcacgctccagaatacgcaatgactggacaactgacgtcaaagagtgatgtttacagctttggtgttgtcctcctggaactattgactggacgtaaacctgttgatcatacattgcctcgtgggcagcagtctcttgtgacatgggcaacaccacaactcagcgaagataaggtgaagcagtgtattgacgctagactgggaggagagtaccctcccaaggcagttgcaaagatggctgccgttgctgccttgtgtgtgcaatatgaagctgatttccggccgaacatgagcattgttgttaaagctctccagcctctgttgaatgctcgatccggacctcccagtgttacaccaaacatgtgattctatttctgtcggcctctcttgcgaaatttgtttgttggcagctaggcacatatatcttcactggcacccttcagtcttcaagaaaccgaagtggaattttctttgtaatgcacagaatctttcgggcgatgcatgactttagtagtagcatggcatttttttcattgggcttgtattaaaggttttcaaacacttgccaatgccttatgttattttcgtctaatattattacaaggggaaaagtaattggttattgtatagatgcatagaatttcagttgccggctggttctgaaaatttctctgagattcaatgactattgctgcttaaaaaaaa

SEQ ID NO: 6881 - DNA, 1859 bp, Glycine max
ggaccatttgcaatggagaatcgtgaataaagaaaagaaaaaaaaaaggataaaaaaagagaagaaagtgcccgccgtttcggaaacgggcttttgagtttgttgacttggcaaaggcaaaggcaaaggcagcggttgtaataaatgtgaataaatagcgtttggtttggtgatgttcataagaggtgtctcggtgaagtcaaggttggtctcttctggtctgttctgttcttctacgcagacacataacataacacaacgcacctcttcttcttcttctttcccttcaaatttcaacttcttcatccattttgtgctccaaacagcacaaacactgcaatcacaccgtcttcgctttctactcatctaaaagatagaggttcatgggttgctttggcttctgcaaaggagatgatagtgttacagttgctgacagaggacctttcatgcaaagcactcctactgggaaccccagttatcatggaagacacacagcagtaactgctcctcggactataaattttcaacctattgctgtcccttccatcacagtagatgaattgaagtctttgacagataattttggctcaaaatatttcattggtgagggtgcatatgggaaagtatatcaagccacattgaaaaatgggcatgcagtagtaataaaaaagttagattccagtaatcagccagagcaggaatttctttctcaggtctccatcgtatcaaggctaaagcatgaaaacgttgtcgagcttgttaactattgtgttgatggtcctttccgtgcccttgcctacgagtatgctcctaaaggatcccttcacgatattctacatggacgcaaaggtgtcaagggtgcacaacctggtccagttctctcatgggctcagagagttaaaattgctgttggagcagccaggggacttgaatatcttcatgaaaaggcagagattcatatcatccatcgttacattaagtctagtaacatacttctttttgatgatgatgttgcaaaggttgctgattttgatttgtcaaatcaagcccctgatgcagcagcacgtcttcattctactcgtgttcttgggacctttggttatcatgctccagaatatgcaatgactggacaactcacttcaaaaagtgatgtttatagctttggagttatactgctggaactcttaacggggcgtaaaccagtggatcatacactgccacgaggacagcaaagccttgtgacttgggcaacaccaaagcttagtgaagataaggtgaagcagtgtgttgatgttagactaaagggagagtacccttcaaaatcagttgcaaagatggctgctgttgctgcattgtgtgtgcaatatgaagctgagtttcgaccaaatatgagcattatagtgaaagctctacagcctctactgaatactcgttctgttcactcaaaggaagcacccaagatgtaataaaaacatgtaaattccaaaatcattcatttcttctttcagactggagtgcgttgaccaattgtccttgtgacacgtgtcagtattacataatctgaagcatatagtattaaagtatattttgcgttattatatttgtatctcaactaagcatgttatagctgatataaaaaaaatagtgatggtaggtggcaagagcctatcatagatggttaagtttatggtttgaatacttattaatttgtatttgtttgtttgtttttcctataagccgtgtacaagtgaatttataatattacttgtcatgtacatcacatgtctagttgctttactatttcaaagagaggtttcttctcaacgcgtagggaatctagaagcatgcttctttttttt

SEQ ID NO: 6882 - DNA, 1295 bp, Cichorium intybus
tgttgtcaattgagacaagggatcatgagttgcctcagctactgtggagaagatgatatgcacaagtcttatgataatgaagcattcatgactaataatgcagcagggaataatgcaggctatcatgccacagaggctgcaccaaaggacacacaggctgtagccattcagccaattactgtctgctcttcaagtggatgaattgattactgataattttggtacaaaatctttaattggtgaaggctcgtatggtagagtctatcatggtgtcttgagaagtggccaggctgcagctatcaaaaaattagactccagtttctatggtatcaaggcttaaacatgataatgttgttgggctacttgggtattgtattgatggtggtctaagagttctagcctatgagtttgcttcaaatggatctcttcatgatattcttcatggaaggaaaggtgtaaaaggtgcacagccaggtccggttttgtcatggtctcaaagagttaaaattgctgttggtgctgcaaaaggacttgaatatttgcatgaaaaagcacagcctcatattattcatcgtgatataaagtctagtaatgttctactttttgatgatgatgttgctaaaattgctgattttgatttatcaaatcaagcacctgacatggcagcacgccttcattccacccgtgttcttggtacctttggttatcatgcacctgaatacgcgatgactggacagttgagcccaaagagtgacgtgtacagctttggagtggttcttctagaactgttgaccggccgaaagccagttgaccacactttacctcgtggtcaacagagcttagtcacatgggcaacacctaaactcagtgaagataaggtcaaacagtgtgttgacactcgactgaatggggaataccctcccaaggcagttgccaagatggcggcggttgcagcattgtgtgtgcaatacgaagctgatttcaggccaaacatgagcattgtggtgaaggcgttgcagccattgttgaatgctcgccctggaactcaaacagaagcaccacacttgtgaattgttgtcatccactgctgattaatcatgacaagacaaaaagttagcagatatatgtatgtttatgtttgctgtgtagaatcgattattttgtttgacgttggttccaaaattgttttaagaatttcttggtggtaatttgtcgtaaatagtgaagggaatttggtgtggttcgtggacagcaaagaattctatttattgcagaaacaagtttattcgcttttt

SEQ ID NO: 6883 - DNA, 879 bp, Utricularia gibba
actagagttcttgggacatttggatatcatgctccagaatatgcaatgacagggcaactgacgcagaagagcgatgtgtacagctttggagtggtactgctggagctcctgaccggacggaagcctgtggatcacacgatgcctcgtgggcagcagagcctggtgacgtgggccccccccaggctgatcgaggacaaggtcaagcaatgcgttgatcccaaactcaagggagagtacccaccaaaaggagttgccaagctggctgcagttgcagcgttgtgtgtacagtacgaagccgagttccggcccaacatgagcatcgtggtgaaggcactgcagccgctgttgaagtcggctgcagcagctgcccccagtgttccggaggcatgatgatgacgcttcaagttcattttgtggagtggattggattggagcagccatattcaatttatgccttcgacacaattcatgtcacaattcggacaacttgatcaaggattaaataacagagcccgtacacatcccctgcctacttttttcccccatttgggagcaaaaataactgagttgcaagaatagtgatttcataagacccattacaaagaatgttggagacaatatgacgaataaactcaaaattattgagacaatggagctaccctttgaatctgatgctgcggctgatggttgcattgataccagtggcttcccctccatatggacctgtgggttttcttatttcacgaacctgccctttcctgcgaatctccgccttctggtgcttcatcttgtatttctttctaggattttttgtgagctttttgcggttgcgagttaagcctctgttcttctccatctgatgagtgatatgacgtttcc

SEQ ID NO: 6884 - DNA, 1188 bp, Brassica napus
caagtttgtgtaagagagaagcataatgagctgctttggttgttgtggcgatgatgatttccatagagttaatgaaacaggaccaaagacagcgtacaacacagcaggttacgatggtcaccatcaaagggttgaaccattcaagagcccaccagccattcagatgcagcctatctctgtaccagccattccagcagatgaactaaaggatataaccgataactatggttcaaagtctttgattggtgagggctcatatggaagagttttttatggtgttctgaaaaacggtaaggcagctgccattaagaaacttgattccagtaagcaaccggatcaagaatttctatcccaggtatcaatggtttcgagattgcgacaagacaatgttgttgcgcttcttggctattgcgttgatggaccactccgtgttcttgcttatgaatatgcccctaaaggatctcttcatgatatccttcatggtaaaaaaggtgtgaaaggagcacaaccaggtccggttctgtcgtggcaccagagagtaaaaattgcggttggtgcggctaaaggactagagtacttgcatgagaaggcaaaccctcatgttgtccaccgagacataaaatccagcagtgtacttatgtttgaagatgatgttgctaagattgctgattttgatctgtctaatcaagcccctgacatggctgcacgccttcactcaactcgtgtgcttggaacctttggttatcacgctcctgagtatgcaatgacaggaacgttgagcacaaagagtgacgtgtatagttttggagttgttctgctagagctcctcacaggtcgtaaaccagttgatcataccttaccacgaggacagcagagtctcgtgacatgggcaacccctaaactgagtgaaaacaacgtgaaccagtgcgttgatgcaagactaaagggagagtatcctctcaaagctgctgccaagatggctgctgtagcggcgctttgtgtgcaatatgaggcagagttcaggccaaacatgagcatagtagtgaaggcacttcagcctcttctcaatcctcctcgctctgctcctcagactccgcagaggaacatcccttattgattgtcacacttcatcatatcactacttcatttgtttttgcttcaatatgatttgtgtaaattcgtgaaata

SEQ ID NO: 6885 - DNA, 1473 bp, Thalictrum flavum
ttcttatcctgcgcttcttaaatcagttttctttgatcactaacttctctttgactgattactactactacttcaaagatcttttacttttgctctctcttctcgaaagtgaattgaaaggaaagaaagtttaaagatagaaagctgctaaagaaaaagaaatgagttgcttcagctgctgtcaagaagatgatatccatagggctaacgataatgcaggtccattcgtggtgaacagtgcagcaggtaaacagggtggatatcatgccgcagatcctgcaactaaggctgctcaggtagtcaaagtccaacctattgcagttccccctatttcagttgaagaactgaaagaagtgactgataactttgggactaagtctctaattggggagggttcatatggcagagtatattatggactcttgaaaagtgggcgggccgcagcaataaaaagttagatgctagtaaacaatcagaccaagaatttacagcacaggtttccatggtatcaagactgaaacatgaaaacgttgttgagctagttggtattgtatagatggaaatctccgtgtccttgcttatgaatttgcaacaaaggggtctcttcatgatatccttcatgggaggaaaggtgtgaaaggagcacaacctggcccagttctttcatgggctcaacgagtaaagattgctgtaggagcagcaaaaggacttgagtacttgcacgaaaaagcacagccccatgtcatccatcgtgacatcaagtccagcaatgtgctcatttttgatgatgacgtatctaaagttgcagactttgacttgtcaaatgaagcacctgacaatgcagcacgtcttcattctacacgtgtgctcggaacttttggatatcatgctccagagtatgcaatgacaggacagctgagttcgaagagtgatgtctatagctatggtgttgtgctgttggaactcttgactggccgtaagccggttgatcatacattgccacgaggacagcagagtcttgtcacttgggcaacaccaagactcagtgaagacaaggtaaggcagtgtgttgaccaaagacttgggggagattaccctccaaaggctgttgcgaagatggctgctgttgctgctctctgtgtgcaatatgaagctgatttcaggcctaacatgagcattgtagtcaaagctttacagcctctattaaatgctcggccaggacatgctcctggtgaaacccctagctaagttatccttgggtccttcctgtgtatcctctcgctctctctcgctgagatttatttgttaacaactgggtggctgtagatttttgacattgtgaaccactattttatacacatcaattgtttgaaaatgtgcaggatttgtttccttcacacaaacttaaaactgttgaaagttcgggttttcatttgaccttctggtttttctcacatgaatatgcagtagacc

SEQ ID NO: 6886 - DNA, 1435 bp, Vinca minor
ttagatcatcagatcaaccttaattcggtttgctaaattcattataaggagaaagaaaagattgaaagaaacaaacatgagctgcttcggttgttgtcaagaagatgacatgcaaaagacttccgataatggacaattcccggcacataactttgcaggtaataatgcaggttatcgttcccaagagccagtacagaaggatgcacagaccataaaggtccagcctattgctgtacctgcgattccagttgatgagttgaaggacatcactgataactttggtacaaaggcttttataggcgagggatcgtatggaagggtatatctcggtgtcctgagaagtggccaggctgcagcaataaagaagttagactctagcaagcaaccagatcaggaatttttggcacaggtttctatggtgtcaagactaaagcatgaacattttgttgagcttcttggttattctgtggatggtggtattcgtgtcttagcttatgaatatgcttcaaatggatcgcttcacgatattcttcatggaaggaaaggtgttaaaggtgctcagcctggtccagtgctcacttgggtacaaagggttaaaattgcggttggagctgcaaagggtctagagtacttgcatgaaaaggcacaacctcatattatccatcgtgatataaaatccagcaatgtcttactctttgacgaggatgttgcaaaaattgccgattttgatttgtctaatcaagcccctgatatggcagcacgccttcactctacccgtgtgcttggcacttttggttatcatgccccagaatatgcaatgactggccagctgagttctaagagtgatgtttatagctttggcgtggttctcttggaactcttaaccggccgtaaacctgtcgatcatacattgccacgtggacaacagagtcttgttacatgggcaactccaaagctcagcgaagataaggtcaaacaatgtgttgatgctagactgcaagatcaataccctcctaaagcagttgctaagatggctgctgtagctgcattgtgcgtgcaatatgaatctgattttcgaccaaacatgagtattgtggttaaagcccttcaacctctcttgaatgctcgaactggaccttcttcgactgaagcatctcattgatcttgttctcttttgccaaagaatagggcagcgatattaagttcaaaaaggaaaacaaaatagaaaattcgttctggctcggcattttgtttgttatacattgtttatttaagaaagacattgagcctcacacctcaaaacaaaagtaacaacattccaaaatcgcttaatgcagtgttcagaatgttgtaaatgcggaatgttgaggattgtcctttccagatggtcttatttctgttgtaaatacgttcttgtacctccatttttatttta

SEQ ID NO: 6887 - DNA, 1622 bp, Gossypium hirsutum
aagactgtatttccccttttattgtacgcactctcgattctcttaacctaagcacctttcgccggcttcaccgtctcagatcttcagctcaactaataggcagagtctctttttgaactgattgcttcacttcatcgtccccaaatttcagatttggatcttgcaaattagagataattcgcaagaggaactatgagttgctttggctgttgtgaagaggatgacatccacagagccgctgacaatggaggtcaatacgttgttaaacatgcagcaggaaacgatggaggttaccagacttctgaaactgcatcaaagagtgctcaaactgtgaaggttcagcctattgaagtccctgttattccagctgaagaattgaaagaaatcacagataactacggtacaaattctttaattggagaaggttcctatggaagagtttattatggggtccttaaaagtgggcagcatgcagcaatcaaaaagttagatgccagcaagcaacctgatgatgagtttttgtcccaggtttctatggtatcaaggttgaaacatgaaaactttgttcaattgcttggttactgtgttgatggcagctcccgtatacttgcctatgagtttgcatcaaatggatcactgcatgatattctccatgggagaaaaggtgttaagggagctcagcctggccctgttctgacatgggcccagagagtaaaaattgctgtaggagctgcaagagggcttgaatacttgcacgagaaggctgatcctcacatcattcatcgtgacattaagtccagcaacgtgctaatatttgacgatgatgtggcaaagattgctgactttgatttatcaaatcaggctcctgatatggcagctcgtcttcattccactcgtgtacttggaacttttggttatcatgctcctgaatatgcaatgacgggtcaattaaatgccaagagcgatgtatacagctttggtgttgtgctgcttgagcttctaactgggagaaaacctgttgatcatactttaccccgtgggcagcaaagtcttgtgacatgggctacaccaaggcttagtgaagacaaggtcaggcagtgtgttgatcaaagactagggggagattatccttccaaggctgtcgctaagatggctgctgttgctgcattgtgcgtgcaatatgaagctgattttcggccaaatatgagcatcgttgtcaaagctctacagccgctgctaaatgctcggcccggacctgttgaaacaccaagcacataattttatacgtcacacgcacagacactctctcaccctttgtatctctatagcctgtgcgtgcagtagtgttcacacgcagcatccaaaatatacaatgaggggacaattagaaggtggtgataatttgttgaaaattccaaatgcatccattatacactgtattcgatttgttcataatgtgagttattcgttgtttttttcccttgaatatatgttcatggtattccaacttgaatcctttttgtaaattttttcttaacctttattcatttcatgattggtgttatttttccttctctacaaatggtttatgctgaaaataagatatgccatatgggctatgg

SEQ ID NO: 6888 - DNA, 1599 bp, Gossypium hirsutum
ttttgtttgtgtgtgtgtttcttttcttaaaacctctcggttgatccctccagaggctttcaggtactatttcttttgttcgtttgaaaatttgggtcatcaagttttttcaatgaaagaaaatctaatcaacaacatttttttatatttggttttcatgcatgaaaaaaattggtttttgtattgaatcgaataaagggtcacatgagatattaacatcctgaagcaatgttctgctgcgggggttcggataacgaacctaaaggcccacctgcaaaccaatatactgccccatctaaaggaggagatcaaaatggtggtactggcggtactggaagaggagagccaaatgctcggaatggagttaaacctggtggggcttcccagaaagttctgcccattgaaatcccatctgttcctttagacgaactaaataagatgacagataactttggtaaaaaggctttgattggagaaggatcttatggtcgtgttttttacggaacatttaatggccagcctgctgcaataaagaaactggacactgggtcttcacctgagccagattctgagtttggagcacagttatccgtagtttcaaggcttaaacatgaaaactttgtggagttgctggggtattgtatggaggaaaataataaaatcttaatatatgaacacgctacaatgggttctttgcatgatgtattacatgggaggaaaggagtacaaggagctgaaccaggtccggttctgagctggaaccaaagagtaaggattgcagtaggtgcagcgaaaggtctaaaatatttgcatgagaaagttcagccttcgatagttcaccgtgatgttagatcaagcaatgtccttctgtttgatgactttgtgactaaaattgcggatttcaacttgaccaatcaatcatctgattcctcagctcgactgcattccactcgtgtcttgggtacatttgggtaccatgcccctgagtatgcaatgacgggacagatcacgcagaagagtgatgtatacagtttcggagttgttcttcttgaactgttgacgggaagaaaaccggtggatcatacaatgcccaaaggccaacagagtcttgttacttgggcaaccccaaggttgagtgaagacaaggttaagcaatgtgtggatcccaagctcaacaatgattacccaccaaaggcaatcgccaagctagcagccgttgcggcactttgtgtccagtacgaggcagatttccgaccaaacatgacaattgttgtcaaagctcttcaaccacttcttaatgcaaaaccagaagcaaaaccagcaggaacagaccctcaaccatagtgtctatatctggcctgtaaagaattagtgtgaggcttttgtagttgttatttttttcctatatattatccggaatattttttactcctaaattttttcatgcatttcaagaattacatacttatattcgaataaatgtcggatgtaagtactggacaggaatgcgtttaaaagaaaatgaaaaacatggataacgtggctctttgttcatgttttataatctcattacttgacgaaatcaattttacagatatc

SEQ ID NO: 6889 - DNA, 868 bp, Panicum virgatum
cagacttcaatctctcaaatcaagctccagatatggctgcccggttgcattctactcgtgtgctgggaacctttggatatcacgcaccagagtatgcaatgactggtcaactaacccagaaaagtgatgtatatagctttggagtagttctcttggagcttttgacaggtagaaagccagtggaccatacaatgcctagaggacagcagagtctggtaacctgggctacaccaagattaactgaagacaaagtgaagcagtgtgtagatcctcggttgatgggtgaatatccagcaaaaggactcgcaaagctcgctgctgtagcagctttgtgtgtgcaatacgaagctgagtttcgcccaaatatgagcattgtggtcaaggctttatctgtgctgctcgtaagtaagcagactcaaacacctgcaccaccagtccacttgccgttgacagttgatgcatagaattaaccaaaaatgcctggaacatcctgatttggacagacagttcactctctgcaatatcagttaggctgcaaatatgataggaacaacagcttggataatgcacacaaaggctcaattcacctctcagatttcaacaactaactgcatgaaggacgtcttcagtactgcaaggagcatctgcagttctgtaacaatgttcatatttatctttcaggagacctgaattctgatgcaagtcggcattttggctggctataggaacttcatgcctgtacttgggtcaaacatataaactggaatgtacaagtcacaggaattcgttcaaaacagcttgggtctgtcatttgacgtgctctcgttgacagattttactcagtgagctacatgtaatgtggactgcg

SEQ ID NO: 6890 - DNA, 1050 bp, Panicum virgatum
gccgtctcaagactgaagcatgaaaatgttcttcaacttgtcggattctgcactgaaggaaacatccgagttcttgcttatgagtatgcaacaaggggctcattgcatgatattctccatgggaaaaagggtgtcaagggagcccagccagggccacccctgtcatggatgcagcgggtgaggattgccgtgagtgccgctcgagggctggagttcctccatgagaaggcggagccacgtgtggtccaccgcgacatcaagtccagcaacatactgctcttcgacaatgatgtcgccaagatcggagactttgatgtctccaaccagtcccctgacatggccgcgcgccttcactccactcgtgttcttggcacatttggttaccatgcaccggagtacgccatgactggacagcttagcacgaagagtgacgtctacagttttggagttgtgcttctagagcttttaactggtcgcaagccagtcgatcatacgctgccacgcggccagcagagccttgtgacatgggctacaccaaggcttagtgaagacaaggtgaggcaatgcgttgatccaaggcttgatggagaataccctccaaaggctgttgccaagatggccgctgtggccgccctgtgcgtgcagtacgagggcgacttccgccccaacatgagcatcgtcgtcaaggccctgagccccttgctgcacagccggtcaggcaaccgcccctccgtctcctcggcctccgcctccaccgttgcagagcgttctggactgtgaattcgtcgccggcagcggtcgccacggatgcggggttcaagaagaagaccatcttgtggagcggggcgcgttggcgttgctgtgtgtcctgactcggagtctctccggcttgtgccgtgaattgttaccagcgatcggtccccggcttgtgtgtgtgccttggcatcaacatgttgtagaaaacggtgagcgatggatggatgatacatatactgtttggtctcctttggaatgcaaaacaaaaatccggcactctggcctcagctgggg

SEQ ID NO: 6891 - DNA, 686 bp, Olea europaea
ggttttcgtgtcctggcttatgagtatgctgcaaatggatctctacacgacattcttcatggacgaaaaggtgtcaaaggtgcacaaccaggtcctgtgttgacgtggcccaaagagttaagattgctgtgggtgctgcaaaaggactagaatacttgcatgaaaaggcaactcctcacatcatccatcgtgacattaagtccagcaatgttttactgtttgatgatgatgttgccaagattgccgactttgatttgtcaaatcaagcccctgatgctgcagctcgtcttcattctacccgtgttcttggaacttttggttatcatgtccctgagtatgcaatgactggccagttaagttcaaagagtgatgtttacagcttcggtgtggtacttctggaactcttgactggccgtagacctgttgatcatacattgcccaggggacagcagagccttgtgacatgggcaacaccaaagctcagtgaagataaggtgaagcagtgtgttgatgctagactaaatggagagtaccctcctaaggcagttgcaaagatggctgcagttgctgccttgtgtgtgcaatatgaagctgatttccgtcctaacatgagcatagtagtaaaagcactccagcctctgttaaatactcggtctgggcctcctaattaaacatcaagcttgtga

SEQ ID NO: 6892 - DNA, 1621 bp, Amorphophallus konjac
ctgccgccggcgtcgtatcgtgaaggaatttccttgagagaaaataatcatggggggtgcttctcgtgttgtgaagaagacaatttccatagagcatctgacagcggaggacattttacaacaaaccatgcagcaggtaatgatggaggttatcgagccacagatcctgccccaaagggtgctcaggctgtaaaggtccagcctattgcagtccctccaattcctgtagatgagctaaaggaggtaacagataactttggaattaaggcacttataggggagggctcttatggtagagtgtattatggagtgttgaagaatgggaaagctgcagccataaaaaattagatgccagtaagcagccagatcaagaatttctggcacaggtgtctatggtttcaaggttgaaacatgaaaatgtagttgagctgcttggctattgtgttgatgggaacctacgtcttcttgcatatgaatatgccacaatgggatcccttcatgatattctccatggccgaaaaggtgtcaagggagctcagccaggtccagtgttgtcatgggcacagcgggtgaaaattgctgtaggagcggcaagaggacttgagtacttacatgagaaagcacagccgcacattattcaccgtgatattaagtccagcaatgtgttgatttttgatgatgatgtagctaaaatttctgattttgatctgtcaaaccaagctcctgacatggctgcacgtcttcactctactcgtgttcttggaacctttggttatcatgctccagaatacgcaatgactgggctgcttagctccaagagtgatgtttacagctttggtgttgttctcttggagcttttaactggtcgtaaaccagtggaccacacattaccacgaggacaacaaagtcttgtgacatgggcaacaccaaggcttagtgaagataaggtaaggcaatgtgttgacccgaggctgggaggagaataccctcccaaggcagtggcaaagatggcggctgtagccgctctgtgtgtgcagtacgaagctgattttcgccccaacatgagcatcgtagttaaagcccttcaaccactgtcgaatactagatctggtcatcccggcgaggcccaagggttgtgagccatgagaagacaccaattccatttactggtcatacacaaagattgtgcattcttcgtcttccttttcttttggttgcgggtttatgctagctagatgtttgttgatttgtctaccattttctgactctattattcaatgttctgtctgtacgggggaactggatggtgtagtaaatatgctggaccgaagagccaaaagaagaaagaaattgtgtggtaacatggatcttctgctagaatgtatgccttcaacagtgccacggacgacagggattgaaattttgttttgttgcctctccagatgtgcttggccacctagactacatgtgtttggttaccgcttgaacgatgttggtacagttattgggtgggatccttgtttggcttggttaccccttctccacagtaatctgggaaggggttctattccttaccttatggaacggtttcccatgtaccattctacttgaatgttcaagg

SEQ ID NO: 6893 - DNA, 747 bp, Arnica chamissonis
ttattagcccaggtttctatggtatcgaggcttaaacatgataatgttgtcgcgttacaggggtattgcattgatggtggcctaagagtgctagcctatgagtatgcttcaaatggatctcttcatgatattctgcatggaagaaaaggcgttaaaggtgcacagccaggtcccgttttatcatggcccgaaagagttaaaattgctgttggtgcggcaaaaggactcgaatacttgcatgaaaaggcacgacctcatattatccatcgtgatataaagtccagtaatgttctgctttttgacgacgatattgctaagatcgctgattttgatttatcgaatcaagcacctgacatggcagcacgtcttcattctacccgtgttcttggtacctttggttatcatgcacctgaatatgcgatgactggacagttgagttcaaagagtgacgtttacagctttggagtggttctactagaactattgacaagccgaaaaccagttgaccacacgttgcctcgtggtcaacagagcttagtgacgtgggcaacacctaaactcagtgaagataaggtgaaacagtgtgttgacactagactcaacggggaatacccgccaaaagcagtagccaagatggcggctgttgcagccttgtgtgtgcaatatgaagcggatttcaggccaaacatgagcatcgtggttaaagcactgcagccattattgaacgcgcgccctggagcccaaacg

SEQ ID NO: 6894 - DNA, 1657 bp, Catharanthus roseus
aaaacaaaggcaaagtgggggagagtagagataaaggaaggaagggagagtagtcagtcgccggcttctgcatttgggatctaaatagagcgcagcagtcacagtgtgacagactgggaatagtaacgtatagtgagttaacaaagtgaaatgtttatcgcctgctcggacggcacctcctctacaacacttttcctcaccgattcttctccttgaaatcattgccgtccactctcctactctgctggatccattgccaagcccattagagctcatcgccggttcaggttactgaaggaagtttgaactggtagacatacatacactaaaagagagataatgagctgtttcagctgctgtgaagaagatgatatcaacagatcttctgacggtggtggccatgctgtggtacaaaaaccaaacaggaaatgatgcaggatttcatgccacagaagctgcatctaagggtgttccggcagtgaaactccagcctatttctgtccctgcaattccagtggatgaattaaaggaagtcactgacaactttggaactaattctttaataggagagggttcatatggaagagtatattatgggactcttaaaagtggacgtgctgctgccattaagaagttggatgctagcaaacaaccagatgatgaattcttagctcaggtttctatggtttcaaggctaaacatgaaaattagttgaactgcttggttattgtgttgatggaaatcaacgtgttcttgcctatgaatttgcatctaatggatccctccacgatattcttcatggaagaaaaggtgttaagggagctcaacctggtcctgttctttcatgggcacaacgagtaaagattgctgttggggcagcaaagggtcttgaatacctgcatgaaaaagcagagcctcacatcattcatcgtgatattaagtccagcaatgtactaatctttgatgatgatgttgctaaaattgctgattttgatttatcaaatcaagctcctgacatggcggcacgccttcactctacccgtgttcttgggacgtttggttatcatgctccagagtatgcaatgactggacaactaaatgcaaagagtgatgtttacagctttggtgttgtactgcttgagcttcttactgggcgtaagcctgtagatcatacactgccccgtggtcaacaaagtctggtgacatgggctacaccaaaactcagtgaagataaggttagacaatgtgttgatgtaaaactggggacagattatcctcccaaggctgttgctaagatggctgctgttgctgccttgtgcgtgcagtatgaagctgattttcgaccaaacatgagcattgtagtgaaagcacttcagcctcttctaaatacccggcccgggaatgctggtgaaactggatcaaatgcaatggcgtaactgtactccaaattctatctaattggtacattccaaaaatgcaaagatcttctcgactcttttgtatacactatacagggattcgtttgagaaactagagaatttttgtagattgtctgcactggaaaactgtaatattctttgtggagcatatgaagtttgtccataatgtatgtggttaatttctgttttcagtgtgtgaaaggcatgatttttgttta

SEQ ID NO: 6895 - DNA, 1391 bp, Euonymus alatus
ctggtcacctggtctgtagatatcctgcttctcagatttcttctgtattttcttcttctgccactacaaacctaaactaacctttcggtgtcggaataagaatcgtaagaccattctacgcttcttacgagcttccgccaaagcccaaagacaaagcgatgggttgcttcagctgttgtgttgatgatgaaatccataaagcttatgataccgggcctttcgtgcccaacggctcaacaagcaacaacacaggttatcatgtgaaagaagttgcagcaaaggatgtgcagactgtattccaacccattgctgtgcctgccatttcaatagatgaactaaaggaaattaccgaaaattttggtaccagcactttaatcggtgagggttcatatggaagagtatattatggtgttctgagtagtgggcaggctgtagctatcaagaagttggattcaagtaagcagccagagccagaatttttagcacaggtttcaatggcatccagattaaaacatgaaaatgctgtcacgctcgttggttactgtgttgatggccctcaccgtgtcattgcctatgaatatgctcctaatggatcccttcataacattctacatggacgaaaaggcgtcaaaggatcgaagccaggtccagttttgtcttgggcacaaagagttaaaattgctgttggggctgcaagaggacttgaatatttacatgagaaggcccagcctcatatcatccatcgtgacattaagtccagtaatgtgttactttttgatgatgacgttgctaagattggtgactttgatttgtcaaatgaagctcccgacaatgctgcacgtcttcattctactcgtgtacttggaacttttggttaccatgctcctgaatatgcaatgacaggacatttgacttcgaagagcgatgtttacagctttggggtcgtgctactggaactcttaaccggccgtaaacctgttgatcatacactgccacgtggacaacagagccttgttacatgggccaccccaaagctcagcgaagataaggtgaagcagtgtgttgatgctcgattaaatgatgaataccctccgaaggcaatggcaaagatggctgccgttgccgccttgtgtgtgcaatatgaagctgatttccggccgaatatgagcattgtagtcaaagctctccagcctcttttaaacactcgctctggtcccgcaagtgaaacgccacatccatgaattcccgttgagccttccatctttggtgcaaattgagatctatgttgtagatgttgcggttgatcatataccttcattttgtaactttttctcaaaattttctgcatttttttttctttataagttgaattatactataaattcagtcat

SEQ ID NO: 6896 - DNA, 1198 bp, Flaveria ramosissima
tattcatttctcttttctgcagtttaccaaaatttcctcctttcttcatcctccaaggcaagcaatcgctcttgttgattaagattcaccccccaactccatagacagcatcttttgatttgtcaagtagaggaatctgaacatgagttgcttcagctgctgtggtgaagatgacatgcataagtcttttgacaacggaccatacatgccgaataatgcagcgggacctaatgcaggttatcgtgccactgaggctgcaccaaaggacacgcaggctgtagctgtccaacctattgctgtccctgctctacaagtggatgaactgaaagaaataactgataattttggtacaaaatgtttgattggagagggatcatatggaagagtgtaccatggtgtcttgagaagtggccaggcagcagctatcaagaagttagactccagtaagcaacctgaccaagaatttttagcccaggtttctatggtatcaaggcttaaaaatgataatgttgtggggctactcgggtactgtattgatggtggtctaagagtgttggcctatgagtatgcttcaaatggatctcttcatgatattctgcacggaagaaaaggtgttaaaggtgcacagccaggtccagttttatcgtggtctcaaagagttaaaattgctgttggtgctgcaaaaggacttgaatacttgcatgaaaaggcacaacctcatattattcatcgcgatattaagtctagtaatgttctgctttttgatgatgatgttgctaagattgctgattttgatttatcaaatcaagcacctgacatggcagcacgccttcattccactcgtgttcttggtacttttggttatcatgcacctgaatatgcgatgactggacagttgagttcaaagagtgatgtttacagctttggagttgttcttctagaactcttgacaggccgaaaaccagttgaccacactttgcctcgtggtcagcagagcttggtcacatgggcaacacctaaactgagtgaagataaggtgaaacagtgtgttgacactagactcaatggggaatacccccctaaggcagtggcaaagatggctgctgttgctgccttgtgtgtgcaatatgaagcggatttcaggccaaacatgagcattgtggttaaagctctgcaaccattgattgaacgctcgtgc

SEQ ID NO: 6897 - DNA, 1608 bp, Avena sativa
ctgctcgaggcctctcacctactacctcttctttgttcctctaatttctcatcccaaattctctcatcccatcccatcccctcttcttgtaagatcgcgacgggcagaagagcgacacctccgatctctctctctctctctcttctttgaccggcgaccggcgaccgcgacggcgacggcgaccggagcagggacctcccgacgcttcgcctttcccctctccggcggtcgtcttctcctcccaagatctgctccgccacatatctcctgtcccctccggcgacgaggacggccggcggcggaagcgtctgtctttttcctcctcgaccaaggactttttttcagataggatatgtcgtgctttggatgctgtggtgatgaagacactcaaagagcaccagacaacaggaatcaatacccaggaagccatccagcaaggaatgatgcatatcgtactgctgatccaactcccaagggtcctcaacctgtgaaagtgcaaccaattgcagtccccacaattccgatggatgaaattagggaggtgacgaagggtttcggcgatgaagctctgattggtgagggctccttcggcagagtatattttggtgttctaagaaatggcagaagtgctgcagtcaaaaagttagattctagcaagcagccagaccaagaattgttggcacaggtgtctatggtgtcaaggcttaagcatgaaaatgttgtcgagttgcttggttactgtcttgatgggaccacccgtgtccttgcttatgaatttgccactatgggttctcttcatgatatgcttcatggaaggaagggtgttaaaggtgctcaacctggtccagtcttatcatgggtacaacgggtgaagatagctgttggggcagcgaaaggtctagagtatcttcatgagaaagcacagcctcatatcatacacagggacatcaagtccagcaacgttcttctttttgatgatgatgtagctaaaatagccgacttcgatttgtcaaaccaagctcctgacatggctgcccggcttcactcgactagggttctcggaacatttggataccatgcacctgagtatgcaatgaccggacaacttagctccaagagcgatgtgtacagtttcggagttgttcttctggagctattgactggaaggaaacctgtcgaccatacattaccgagggggcaacagagccttgtcacatgggccaccccaagactgagtgaagataaggttaggcaatgtgttgactcaagacttggaggggactttcctcctaaagctgtcgcaaagtttgctgccgtcgctgcgttatgcgtccaatacgaggccgattttaggcctaacatgagcatcgtcgtgaaggcgctccaacccctgctgaacgctcgagcagcccacccgggggaacatgctggtcgttaagctccattccaaccttttgtactccgtatgatatagggaaaaggagcatgttgcaggcagtgtgtgtgtgttttgtgattattcttctcaagtttcaaccctcaaaattctagtacagtaccaaacatactggattcttcctatctgttgcaagattggctattggtgac

SEQ ID NO: 6898 - DNA, 1274 bp, Phalaenopsis aphrodite
tgcactctgccgccgcagttcatcaccgtacttcgccgacggccgccgggttcataacagaagggaagtaaaatagagaaaaatgtcgtgcttttcatgctgtggaggatcagataatcataagacaactgataatggagctgcttttcctgcaaagcaatcatctggcaatgacggaggttttcgtgcatctgatgctaccctgaagggtgctcagagtgttaaagtgcagcctattgaagttccagctattcctgtggaacaaataaaggcattaactgataattttggaagcaattctttagtaggagaaggttcttatggccgagtctattatggcttactagaaaacgagaaagctgctgcattaaaaaaattagatgccagtaagcagcctgatcaagaatttctggctcaggtgtcaatggtttcaagattgaatcatgaaaatgttattcaactgcttggatactgtattgatggcagtctacgtgtcctcgcatacgagtttgcaacaaatggctctcttcatgacatccttcatgggcgtaaaggtgtcaagggagcacagcctggtcccgttctttcgtgggctcagagagtcaaaatagctgtaggagcagcaagaggacttgaatacttgcatgagaaatcacaaccccctgtcatccatcgtgatatcaaatccagcaatgtccttcttttcgacgaagatgttgcaaagattggcgattttgatctttcgaatcaatctcccgacacagcggctcggcttcactcaactagagtacttggtacatttggatatcatgctcctgaatatgcgatgacagggcagcttagttcgaagagcgatgtttatagctttggtgttgtacttttggagctacttacaggccgtaagcctgtcgatcatacgttaccacggggtcagcaaagtcttgtgacatgggcaacgccgaggcttagtgaagacaaggtaagtcaatgtgttgacacgaggctaggaggagactatcctcccaaggcagtagccaagtttgctgctgtggcggccttgtgcgtgcaatatgaagctgattttcggccaaatatgagcattgttgtgaaagctcttcagcctcttctcaattctcgggtcagtggttctgttgctgatgctccataatcatatatatattcatgtccatgtaaattggcgcagacagattccctcttttggaactattttctgtaatttatttttttgttttgatttgcatatatactattta

SEQ ID NO: 6899 - DNA, 1441 bp, Plantago ovata
taggataaagaagtacatatttgaccgaagaggagatcaagtatcaagtatgagttgctttggctgctgcggacaagatgattttagcaaacaagctgatggtggaggtcaatatgctgttaaaaatgcagctggaaatgatggaggtcatcatactacagaagctgcaacaaaagcccaagctgtgaaagtccagccaatctcagttccacccattactgtggatgaattgaaggaagttacaggtacctttagcactaattcattgattggggaaggctcatatggaagagtatattatggagtccttaatagtggcaagactgctgctataaagaagttggattcaagcaagcaaccagatgatgagttcttggcacaggtttctatggtgtcaaggctaaaacatgaaaattttgtggaactgcttggttattgtgttgatggaaatcaacgcgttctggcctatgaatttgcgtctaatggatctcttcatgacattcttcatggaaggaaaggagttaaaggagcacaacctggtcctgttctttcttggtctcaacgtgtcaaaattgcagttggggctgccaagggccttgaatatcttcatgaaaaagcagaacctcacattgttcaccgtgatattaagtccagcaatgtattaatatttgatgaggatgtagctaagatagctgactttgatttatcaaatcaagctcctgatatggctgctcgtcttcactctactcgtgtcctggggacctttggatatcatgctccagaatatgcaatgactggacagttgaattcaaagagtgatgtgtacagctttggagttgtcttgctagagcttctaactggacgaaaacccgtcgatcacaccttacctcgtggtcaacaaagcttagttacatgggctacaccaaaattgagtgaagacaaggtccgacaatgcattgatggccgacttggaggagattacccaccaaaggcagttgctaagatggctgctgttgctgctttgtgtgtacaatatgaagctgatttccggccaaacatgaccattgtagtgaaagcacttcagcctcttctaaacactcgtcctggacctgccggtgagagtggccacatatagaacttcagcaaagctgtttcatactgttccttggccattagagctggtaaatattacttcaagttgagcataaaatatgtatgctccagttttcaacgggaaaatagcttggaaagagataatttccttgaatgattggacattgatgttcaaagcagtggaatctgtcatgttcatagtgttaaatgtgttgtggtcattcatgaagagagatttatgtgacagttaatattggttttacatgtattaatattttactttattgtaaaactttgtaggctagtgaaacttcggtttgagctttac

SEQ ID NO: 6900 - DNA, 547 bp, Scabiosa columbaria
gttaaaattgcagttggtgctgcaaaagggcttgaatatttacacgagaaggcacaaccccacataatacaccgtgatattaagtcaagtaatgttttactttttgatgatgatgtggctaagatcgcagattttgatttatcaaatcaagcacctgatatggcagcgcgtcttcattctactcgtgttcttggaacttttggttatcatgctcctgaatatgcaatgactggtcagctaagctcaaagagtgatgtatacagcttcggcgtggtacttttggaattgctgacagggcgcaaacctgttgatcatacattgccacgtggacaacagagtttagttacatgggccacaccaaagctgagtgaagataaggtgaaacagtgtgttgacactagacttaatagtgaatatccacccaaagcagttgctaagatggcagcagttgcagctttatgtgtgcaatatgaagctgatttcaggccaaacatgagcattgtggttaaagcattacaacctctgttgaacacgcgatctggacccg

SEQ ID NO: 6901 - DNA, 1241 bp, Tabernaemontana elegans
gctagagggttccatttctggattagagcagcagatcaaccaaagctccacagttatacaaccaacagccaaggcaacgtccaagaggagaaagaagagattgaaacaaacaaaccatgagctgcttcagttgttgttgtgaagaagatgacttgcaaaagactgctgataatgggcaattcgcggcacataactttgcaggcaataatgcaggctatcatgccacggagccagtacagaaggatccgcaggccataaaggtccagcctattgctgtacctcctattcctgttgatgagttgaaggacatcactgataactttggcacaaaggctttgattggtgagggatcttatggaagggtctactatggtgtcttgaaaagtggccaggctgcagcgataaagaagttagactctagtaagcaaccggatcaggaatttttagcacaggtttctatggtatcaagactaaaacatgaacatgttgttgagcttcttggttattctgtggatgctggtcttcgtgttttagcttatgagtatgcttcaaatggatctcttcacgatattcttcatggacgaaaaggtgttaaaggagctcagcctggtccagtgctctcttgggctcaaagggttaaaattgctgttggggctgcaaagggtctagaatacttgcacgaaaaggcacaacctcatattatccatcgtgatataaaatccagcaatgtcttactttttgacgatgatgttgcaaaaattgccgattttgatttgtctaatcaagcccctgatatggcagcacgccttcattctactcgtgtgcttggtacttttggttatcatgcaccagagtacgcaatgactggccagctgagttcaaaaagtgatgtttacagttttggtgtggttcttctggaactcttaactggccgtaaacctgttgatcacacgttgccacgtggacaacagagtcttgtgacatgggcaactccaaaactcagtgaagataaagtcaaacaatgtgttgatgctagattgcaagatcaataccctcccaaggcagttgctaagatggctgctgttgctgccttgtgtgtacaatatgaagcagattttcgaccaaacatgagcattgtggtaaaagccctgcagcctctcttgaatgctcgaactggaccttcagctgaagcatcacacttgtgacttctgtatcttatcctgacctctattgctaaagag

SEQ ID NO: 6902 - DNA, 1512 bp, Tabernaemontana elegans
gcattcgtcgcggacttgccggcttggcatttgggatctaaaaaaggtgatagagcgcagtaatcactagtcagtatgtatgattatcgcctgctcggacggctgctctacaaccccatccccttcctctcggcctattcttcttgaactgattgagtgattgctgtggactctctgttgctctgctcgatccattcccaagccctcagagctcactttccatttcgctccagttcaggttagtaaaagatatttgatctggtagacatacaccgaaagagagacaatgagctgtttcagctgctgtgaagaagatgatatcaatagaccttctgatggtggaggccaacccatggttaaaaaccaaacaggaagtgatgcaggatttcataccacagaagctgcatccaagggttctcaagcagtgaaagtccagcctatttcagtccctgaaattccagtggatgaattaaaggaagtcactgacaactttggaactaatgctttgataggagagggatcatatggaagggtatattatggaactcttaaaagtggacgtgttgctgccatcaagaagttggatgccagcaaacaaccagatgacgaattcttagcacaggtttctatggtttcaaggctaaagcatgaaaattttgttgaactgcttggttattgtattgatggaaatcaacgtgttcttgcctatgaatttgcatctaatggatctctccacgatattcttcatggaagaaagggtgttaaaggagctcaacctggtcctgttctttcatgggcacaacgagttaagattgctgttggggctgcaaagggtcttgactatctgcatgaaaaagcagagcctcacataatccatcgtgatatcaagtccagcaatgtactaatctttgatgatgatgttgctaaaattgctgactttgatttatcgaatcaagctcccgacatggcggcgcgccttcattccacccgtgttcttggaacatttggttatcatgctccagagtatgcaatgactggacaactgaatgcaaagagtgacgtatacagctttggtgttgtactgcttgagctccttactgggcggaagcctgtagatcatacactgcctcgtggtcagcagagtctggtgacatgggctacgccaaaactcagtgaagacaaggttagacaatgtgttgatgcaaaactggggacagattatcctcccaaggcagttgccaagatggctgctgttgctgccttgtgtgtgcaatacgaggctgattttcggccaaacatgagcattgtagtcaaagcacttcagcctcttctaaatacgcggcctggggctgctggtgaaactgtgtcaaacgcaatggtgtaactgaactcattgtactttccatcaaattattgcattgcagaatgcaaagcttgaggactgtctttttcactcctttgtatacagggatttgtttcagaaactagagaatttttgtagattgcgtgcac

SEQ ID NO: 6903 - DNA, 1612 bp, Trigonella foenum-graecum
acaacgtttggtgatgtctttaattaatgtgtaacatattcattcatattgtacctttttactatatttttcttctcaaaccaaacggcaaagtcaagaagatagtttggttttcccttcatctcatttcacaacacacaaaacataaactccattcatcaaacctttttttcttcatccattttgtggtccatcacaaactctgcaatttctacctaacagaacataataggatcatgggttgctttggtttctgcaaagagaatgatgcttatactactgctgacaaaggaatctacatgcaaaccaatcctaccgggaactccagttatcatggcagacacaccgcagtaactgttcctcggcctataaatctccaacctatttctgtcccttccattacagtagatgaattgaggtctttgacagataattttggttcaaagacttttgttggtgaaggtgcatatgggaaagtatatcgcgccacattgaaaaatggacgcgaagtggcaattaaaaagttggattccagtaagcagccagaccaagaatttctttctcaggtctccatcgtatcaaggctaaagcatgaaaatgttgttgagcttgttaattattgtgttgatggtcctttgcgtgcccttgcgtacgagtatgctcctaatggatcccttcatgatattctacatggacgcaaaggtgtgaagggtgcagaacctggtcaagttctgtcatgggctgaaagagttaaaattgctgttggagcagccagaggacttgaatatcttcatgaaaaggcagaggttcatattgtccatcgctacattaaatctagtaacatacttctattcgaggacggtgttgcaaagatcgctgattttgatctgtccaatcaagcccctgatgctgccgcacgtcttcattctacccgtgttcttggaacctttggttatcatgctccagaatatgcaatgactggaaacctctcttcaaagagtgatgtttacagttttggagtcatactgttggaactcttaaccgggcgtaaacctgttgatcatacacttccccgaggacaacaaagccttgtgacctgggcaacaccaaagcttagtgaagataaggtgaagcagtgtgttgatgttagattaaagggagagtacccttccaagtcagttgcaaagttggctgctgttgctgcactgtgtgttcaatatgaagctgagtttcgaccaaatatgagcatcattgtcaaagcattacaaccgctaatgaataatacgcgttcttctcaaacaagggaaccacgcaacttgtaaaaattcacaaaccaaacccagcatttcttcgattgtgttaatgacaattgacatttgtgacttagtgtgaaagtatcgtttgtactatttattttacctaacatttatatttcaagtaagcattactaagaaaatagcaattggtagttgaatttctggttttgaatgcttatgttgcagtgtcatgtttttgttgcaacatcatgtacaagtgaatatattatataactactgaacaacatttgtctgtttgtattttaaaatgaaatttcatcccaatgcaaggggaa

SEQ ID NO: 6904 - DNA, 1017 bp, Arabidopsis thaliana
atgtttttttttcttgtcatcacatatgtagcaaatcaaaagaatcaaaaaccacaagatcttgcaaagcctaaggagattcttcccattatagttccttccttgtcagtggatgaggttaatgaacagactgacaattttggaccaaattctctgattggtgagggatcttatggaagggtatactatgcaactctaaatgatggaaaagcagttgctttgaagaaactcgatcttgcacctgaagatgaaacaaacaccgagtttttaagccaggtttccatggtttcaagactaaagcatgagaatctcattcaactggtcggttattgtgttgatgaaaaccttcgtgttcttgcttatgagtttgcaacaatgggatcattgcacgatattctgcatggtaggaagggagttcaagatgcactaccaggtccaacacttgactggataacaagggtgaagatagccgttgaggcagctagaggtttagaataccttcatgagaaggttcagcctcaagtaatacatagagacataagatctagcaatatacttctttttgacgactatcaagcaaaaattgctgattttaatctttcaaatcaatctcctgataatgctgctcgtttacaatctacaagagttttgggcagctttggctattactctccagaatatgctatgactggagagttgacacataagagtgatgtatatggttttggggttgtacttctagagctcttgacagggaggaaaccagttgaccatacaatgccgcgaggccaacaaagtcttgtaacttgggctacaccgaaacttagtgaagatacagtagaggagtgtgttgatccaaagctaaagggagaatattctcctaaatcagtagctaagctagcagcggtggcagcattgtgtgtgcaatatgaatctaattgtagaccaaaaatgagtacagttgtgaaagctttgcaacaacttcttatagcgacaggctcaataccgcaattctaa

SEQ ID NO: 6905 - DNA, 1490 bp, Brachypodium distachyon
acccgcactcccgcagcgccttccttccaccgtctccatccgttccttccacggttgctgtcacctcgaagcaaagcaagtctcctcccctagctcttgcttcccctccacggggcttggtgcgcgcgcagcggggggatccgtcctgattccgccctgcttcggacttgtataaattgaacatgtcgtgctttgcatgctgtggtggtgatgacacgcaaggggcacctgataacagaggatcatacgctagtggctacccagcaaggaatgatgcttatcgtactgctgatccaactcccaaaggtgctcaacctgtgaaagttcaaccaattgcagtccccacaatttctgtagaagaaattagggaggcaactaaggattttggtgatgaaactttgattggtgagggttcttttggtagagtgtactttggtgccctaaaaaatggtagaagtgcagcagtaaaaaagttagattcaagcaagcaaccagaccaagagtttttggcacaggtctccatggtgtcaagacttaagcatgaaaatgttgtggagttgcttggttattgtgttgatggaaacacccgtatccttgtttatgagtttgctacgatgggctcccttcatgatatgcttcatggacggaaaggtgtgaagggagctcagcctggtccggtcttgtcatggacacaaagagtaaagattgctgttggagcagccaaaggcctagagtatcttcatgagaaagctcagcctcatatcatacacagggatatcaagtccagcaatgttcttctatttgatgatgatgtagctaaaatagctgattttgatttgtcaaaccaagctccagatatggccgctcggcttcactcaactagggttcttggaacatttggatatcatgcacctgagtatgcgatgactggacaacttagcactaagagcgatgtgtacagttttggagttgttcttctagagctcctgactggaagaaagcctgtggatcatacattaccaagaggacagcagagccttgtgacatgggccactccccgacttagtgaagacaaggttaggcagtgtgttgattcaagacttggaagtgaatatcctcctaaagccgttgcaaagtttgcggctgttgctgcattgtgcgtgcaatatgaagcagattttagaccgaatatgagcatagtcgtgaaggcactccaacccctgctgaatgcacgatcatccaaccctggcgaacatagatcttaaatctttcaccctgcgaagttgctttgtcgagtggtgtctgagaggcttgctggctgtatgtagatctgtgtctattcaaccctagttgtaatctatctcctggcattggtgattcttttgatgtgatgcatgatgactgttcttgtttgtgcctgatgcgaatatctaacaattatgtagggatgagatgagtaataaggaaaaaacgcatggtgtttgacttga

SEQ ID NO: 6906 - DNA, 567 bp, Catharanthus roseus
gtggatccaaagaattcggcacgaggatacctgcatgaaaaagcagagcctcacatcattcatcgtgatattaagtccagcaatgtactaatctttgatgatgatgttgctaaaattgctgattttgatttatcaaatcaagctcctgacatggcggcacgccttcactctacccgtgttcttgggacgtttggttatcatgctccagagtatgcaatgactggacaactaaatgcaaagagtgatgtttacagctttggtgttgtactgcttgagcttcttactgggcgtaagcctgtagatcatacactgccccgtggtcaacaaagtctggtgacatgggctacaccaaaactcagtgaagataaggttagacaatgtgttgatgtaaaactggggacagattatcctcccaaggctgttgctaagatggctgctgttgctgccttgtgcgtgcagtatgaagctgattttcgaccaaacatgagcattgtagtgaaagcacttcagcctcttctaaatacccggcccgggaatgctggtgaaactggatcaaatgcaatggcg

SEQ ID NO: 6907 - DNA, 999 bp, Cenchrus ciliaris
  misc_feature (214)..(214): n is a, c, g, or t
aaagttggattctaataagcagccagaccaagaatttttggcacaggtatctatggtgtcaaggctgaagcacgaaaatgtagttgagctgcttggttactgtgctgatgggaccctacgtgttcttgcttacgagtttgctactatgggctctcttcatgatatgcttcatggaagaaaaggtgttaaaggagctcaacctggtcctgttttnacatgggcacaacgtgtgaaaatagctgtcggggcagcaaagggccttgagtatcttcatgagaaagcacagccacatatcatacaccgagacattaagtccagcaacgttcttctttttgatgatgatgtagccaagatagctgactttgatttgtcaaaccaagctcctgacatggcagctcggcttcattctactagggttcttggaacattcggatatcatgctcctgagtatgcaatgactggacaactcagctctaagagcgatgtgtatagtttcggagttgttcttctcgagctgttgaccggaaggaaacctgttgaccatactttgccaaggggacagcagagccttgtgacctgggcgaccccaagacttagtgaagacaaggttagacaatgtgttgactcgagacttggaggtgactatccccctaaagctgtcgcaaagtttgcagctgttgccgcattgtgtgttcaatacgaagcagacttcaggccgaacatgagcattgtggtcaaggcgctccaacccctgctgaatgcacggacgactaaccctggagaaaatgctggatcataagcttcacttcactcccccctcttgtatgatagataagtaagatatatgagtcgacaatgtcgttcttgcaaacgtttgcctagcagcatgtaacatttgtggttattcttcccccgagttgtaaacatcaagattcttgtaccccaacaatatttgattctttctatcggttgcaagatggcctgtttattggtggcaca

SEQ ID NO: 6908 - DNA, 1626 bp, Actinidia deliciosa
  misc_feature (77)..(77): n is a, c, g, or t
  misc_feature (99)..(100): n is a, c, g, or t
  misc_feature (470)..(470): n is a, c, g, or t
caacgtcatcggaatgtgttggggaagaaaattcaagttcactattccctagtcaacaccggctgcggctcattcangaaagaaagaaaagaaaatacnntcctacaatcaaatcaaaagggtcgactctctttccaattcctctagcacttggatttgatttgattttattcatcctacgcactcgtattgggatatcctgcgcatccatcgccggcttccaggattcagaatcggatcttcaccactcaacacaaaattcacacagaaaggggcttcgttgggggaaagaatcatgagctgtttcagctgttgtgaagatgatgatatcaatagacccaatgatggtggaggtgcatacatggtgaaaaattcagctggtaataacggaggttatcatgccacagaagcggcatctaaggccgctcaaactgtgaaaatcctacctattgctgttcctgatatttcanttgatgaattaaaggaagttacagataacttcgggcctgattccttaattggagaaggctcgtatggaagagtatactacggagttctaaaaaatgagagggctgctgcaataaagaagttggactccagcaagcaaccagatgatgattttaaagcccaggtttctatggtatcaaggctgaaacacagtaattttgttgaattgattggttattgtcttgatggaaatcaacgtgtgcttgcgtatgagtttgcatctaatggatctcttcatgacattcttcacggaaggaaagggattaaaggagcacaacctggtcctgttctttcgtgggcacaacgtgtaaaaattgctgtaggggctgctaaaggacttgaatacttgcatgagaaggcagaacctcacatcatccatcgagacatcaaatctagcaatgtactactctttgatgacgatgttgctaagattgctgactttgatttatcaaatcaagcacctgacatggcagcacgtcttcattccactcgtgttcttggaacatttggttatcatgctcccgaatatgcaatgactggacagctgaatgcaaagagtgatgtttatagttttggtgttgtcttacttgagcttttgactgggcgcaaaccggttgatcacacgctaccacgtggacaacagagtcttgtgacatgggctacaccaaaacttagtgaagacaaagtcaggcaatgtgttgatgcaagactgggggcagattatcctcccaaagcagttgcgaagatggctgctgttgctgcgttgtgtgtacagtatgaagctgatttccgtccgaacatgagcattgttgtcaaagccctgcagcctcttctaaataccagggcgggacctgctggtgaaacaggtcatacatgagcattgtttttgtcaagtctccagaggctgtacctgctagttaataactcaatccccatctctctctctctctctccgtctctctgtttgtgttgcatgagcacaattatgaaagactgcttttgtagatggtgatttgtgtgcagtcatatgcgtccattatttacactatattttatttgtttatagtgttttgagacttagcattcttattaaatctgtttgcccgttaaaaaaaaaaa

SEQ ID NO: 6909 - DNA, 561 bp, Liriodendron tulipifera
gcacagcctcacatcatccatcgcgatattaaatcgagcaatgtactgctatttgatgatgatgttgctaagatagctgattttgacttgtcgaatcaagctcctgacatggccgcgcgccttcattcaactcgtgttctcggaaccttcggttatcatgctccagaatatgcaatgactggacagttgagttcgaagagtgacgtttacagctttggcgttgtccttttggagctcttgaccggccgtaagcctgtcgatcatacattgccacgggggcaacagagtcttgtgacatgggccacgcctagacttagtgaagataaggttaagcaatgtgttgacactcggctaggaggagagtaccctcccaaggcagttgcatagatggctgcagttgctgcattgtgtgtgcaatatgaagctgatttccggccaaacatgagcattgtaatcaaagcgctccagcccctggtgaatgctcggtctggacctaccggcgagaattcaaacttgtgaatccttctccctctcttcggtttgtttcttgcttgtgatggg

SEQ ID NO: 6910 - DNA, 1444 bp, Medicago truncatula
ctctcaatcactcacataaattccaaactctatctgctaaactttgctttctacacaattcttatttccagtgaacataataggatcatgggttgctttggattctgcaaagagaatgatgcttatactactgctgacaaaggaatcttcatgcaaaccaatcctaacggcgggaacaccagttatcatggcagacacactgcagtaactgttcctcggcacataaatctccaacctatttctgttccttctattacagtagatgaactgaggtctttgacagataattttggtacaaaaactttcgttggtgaaggtgcatatgggaaagtgtatcgtgccacattgaaaaatggacgtgaagtggcaattaaaaagttggattccagtaagcaaccagaccaagaatttctttctcaggtctccatcgtatcaaggctaaagcatgaaaatgttgttgagcttgttaattactgtgttgatggtcctttgcgtgcccttgcatacgagtatgctcctaatggatccctccatgatattctacatggacgcaaaggtgtcaagggtgcagaacctggtcaagttctttcatgggctgaaagagttaaaattgctgttggagcagccagaggacttgaatatcttcatgaaaaggcagaggttcatatagtccatcgttacattaaatccagtaacatactcctattcgaggacggcgttgcaaagattgctgattttgatctgtcaaatcaagcccctgatgctgccgcacgtcttcattctacccgtgttcttggaacttttggttatcatgctccagaatatgcaatgactggaaacctctcttcaaagagtgatgtttacagttttggagttatactgttggaactcttaaccgggcgtaaacctgttgatcatacacttccccgaggacaacaaagccttgtgacctgggcaacaccaaagcttagtgaagataaggtgaagcagtgtgttgatgttagattaaagggagagtacccttcgaagtcagttgcaaagttggctgctgttgctgcactgtgtgttcaatatgaagctgagtttcgaccaaatatgagcatcattgtcaaagctttacagcctctaatgaataatactcgttcttctcaaccaagggaaccacgcaacttgtaaattcacaaaccaaagccagcatttcttagattgtgttaatgacaattgactcttgtgactcaagtgttgaaagtatcagttgtagtatttattttacctaacatttatttatatttcaagtaagcatattactaagaaaatagtgattggtagttgagtctctggttttgaatgcttatgttgcagtgtcatgtttttgttgcaacatcatgtacaagtgaatatatattaaaatgaaattccatcccaatgcaaggggaattatcga

SEQ ID NO: 6911 - DNA, 1739 bp, Avena sativa
ggcattgtgatacgatgagaaatctgatgaatcccagccgtctcacctacctcttcttcttcgtcgtcgtctaaattctcatcccaaattctctcatctcatccccctgtttcttcttctaagatccctccggtggttcggggccttctcacatctcgccacagagaaaggcgacgggcagaggggcgacgcttcccacctcctgtttcttctttgaccggcgaccggcgacgggcgaccggagcagggccctcccgacgcttcgcctttcccctctccggcggtcgtcttcacctcccaagatctgctccgccacatatctcctgtcccctccggcgacgaggacggccggcggcggaagcgtctgtctttttcctcctcgaccaaggactttttttcagataggatatgtcgtgctttggatgctgtggtgatgaagacactcaaagagcaccagacaacaggaatcaatacccaggaagccatccagcaaggaatgatgcatatcgtactgctgatccaactcccaagggtcctcaacctgtgaaagtgcaaccaattgcagtccccacaattccgatggatgaaattagggaggtgacgaagggtttcggcgatgaagctctgattggtgagggctccttcggcagagtatattttggtgttctaagaaatggcagaagtgctgcagtcaaaaagttagattctagcaagcagccagaccaagaattgttggcacaggtgtctatggtgtcaaggcttaagcatgaaaatgttgtcgagttgcttggttactgtcttgatgggaccacccgtgtccttgcttatgaatttgccactatgggttctcttcatgatatgcttcatggaaggaagggtgttaaaggtgctcaacctggtccagtcttatcatgggtacaacgggtgaagatagctgttggggcagcgaaaggtctagagtatcttcatgagaaagcacagcctcatatcatacacagggacatcaagtccagcaacgtctctttttgatgatgatgtagctaaaatagccgacttcgatttgtcaaaccaagctcctgacatggctgcccggcttcactcgactagggttctcggaacatttggataccatgcacctgagtatgcaatgaccggacaacttagctccaagagcgatgtgtacagtttcggagttgttcttctggagctattgactggaaggaaacctgtcgaccatacattaccgagggggcaacagagccttgtcacatgggccaccccaagactgagtgaagataaggttaggcaatgtgttgactcaagacttggaggggactttcctcctaaagctgtcgcaaagtttgctgccgtcgctgcgttatgcgtccaatacgaggccgattttaggcctaacatgagcatcgtcgtgaaggcgctccaacccctgctgaacgctcgagcagcccacccgggagaacatgctggtcgttaagctccattccaaccttttgtactccgtatgatatagggaaaaggagcatgtggcaggcagtgtgtgtgtgttttgtgattattcttctcgagtttcaaccctcaaaattctagtacagtaccaaaaatactggattcttcctatctgttgcaagattggctattggtgacttgactaacttgcgtatgtctccatggaacattttattattagtcagtaaaaaattaaagaaatgaactctgcagct

SEQ ID NO: 6912 - DNA, 1546 bp, Prunus persica
ctttttcggtatccttatcctacgcactccccttccttccccgcctatcctgcgctgcgcttccctcgccggatttggagctcagatctctccctccctcagacacccactgactgacacacccacccaatactcttgtaattactttacaagcatccacttagcttttccctctctttcagaatcatgagctgcttcggctgttgtgaagatgatgatatgcataaagcgaccgaccatggaggtccatacatggtcaaaaacccagcaggaagtgagggaagccatcacgcctcaggaactgcacctaggggtgctcaagctgtaaaggtccagcctattgaagttcctactataccaatagatgaactaaaggaaattaccgatggctttgggacaagtgctttgattggagagggttcatatggaagagtatactatggcgtactcaaaagtgggcagcatgcagcaatcaagaagttagatgccagcaaacaacctgacgacgaatttctggcgcaggtttctatggtatcaaggctgaaacatgacaattttgttcaattgcttggttattgtgttgatgggagttcccgtgttcttgcctatgagtttgcatctaatggatctcttcatgatattctacatggaaggaaaggtgttaaaggagcacaacctggtccagttttgtcatgggcacagcgtgttaaaattgccgtgggtgctgcaaaagggctcgagtatttgcacgaaaaggctgatccccacatcattcatcgcgacatcaagtctagcaatgtgctaatatttgatgacgatgttgctaagattgcggactttgatttgtccaatcaagctcctgataatgcagcacgtcttcactccactcgtgtgctaggaacttttggttatcatgcccctgaatatgcaatgactggacagttgaatgccaagagtgatgtttacagttttggtgttgttctgcttgaacttttgactggaagaaaacccgttgatcatacattaccaaggggacagcagagtctagtaacatgggctacaccaaaactcagtgaagacaaagttaggcagtgcattgattcaagactaggaggagaatacccaccaaaggcggttgcaaagatggctgcagttgctgccttgtgtgtgcaatatgaagctgatttccgcccaaacatgagcattgttgtcaaagctctccaacccctgttaaacgctcggcagcatggacccacaggggaagtaccaaacttgtgaaaatctctctctctctctctctctctctctctctctctctctctctctctctctctctctctctctatatctgaagatgtgtcatgtgtgcatgtatgagtaattcagcatgcaaaatgtaacaaggggattgttttgagggtggtggtatattgtttgcatggtgttctaaatgcttcattttcattttcgaataggaatgtactatattgcttcattatttgcggtgtatttggtttgttcataatgcaaggggcattttctccta

SEQ ID NO: 6913 - DNA, 602 bp, Senecio madagascariensis
tgcgatgactggacagttgagttcgaagagtgatgtgtacagctttggagtggttctcttggaactcttgactggccgaaagccagttgaccacactttgcctcgtggtcaacagagtctagtcacatgggcaacacctaaactcagtgaagataaggtgaaacagtgtgttgacactagactgaatggtgaatacccgccgaaggccgttgccaagatggcggctgttgcagccctgtgtgtgcaatatgaggcagatttcaggccaaacatgagcattgtggttaaagcgctgcagccattgttgaacgctcgtccgggaccccaaacggaagcaccacacttgtgaattcccccctctgctactactactgcttaatcatgtcattcaagatcatcgtaacagactaatttagcagatatttattatgtttgttgtgtagaataagtctacaccggatacacattctttggtttgactttgtattaatgatttactttaagaatttgtcgtaaatattgaagggatgtaggcgtggttcattttctatgtaccgaaggaacaagttatttgctttctagaaatgttgttcatgtgtttt

SEQ ID NO: 6914 - DNA, 1452 bp, Valeriana officinalis
atactatacattagcagagcagaaaaaccttcctcttcattttctctctacgattgcattgcatgctcttctacttccaactcttgcttccgctgcttcagtggtctctttagtgtaaaccctaagggacgatccgtatacttactgcctactgaaaccacctaccatacttttactacaagtaagaagagtgtaagctatcttaggtctacattttaaacttcaagaaaaaaggaagcatgagctgcttcggctgttgcatagaagatgacatacataaagcttctgatagtggaccattcatggcaaatagtggtgcaggtaatcatggaggttatcgtgacacagaagctgtaccgaaggacacgcagactgtaaatatgcagcctataagtgtccctgaaattcaggtcgatgaattgaaggaaattactgataactttggtacaaaagctttgatcggcgaaggctcatatggaagagtatatcatggtgtgttgaaaagtggccaagctgcggcaataaaaaagttggacactagcaagcaacctgaccaagaatttttatcacaggtttcgatggcgtcgaggcttaaacatgaaaattttgtagagctacttggatattgtatggatggtggtctacgtgcccttgcatatgaatttgcttcaaatggatctcttcacgatattcttcatgggagaaaaggtgtaaaaggtgctcagcctggtccggttctatcatggttgcaaagggttaaaatagctgtaggagcagcaaaaggactcgaatacttgcacgaaaaggcacaacctcatataatccatcgcgatattaagtcgagcaatgttttactttttgatgaagatgtagctaagattgcagatttcgatctgtccaaccaggctcctgatatcgccgcacgtcttcactcaactcgtgttcttggtacttttggctatcacgctcctgagtacgcgatgactggacaactgagctcaaagagtgacgtatacagctttggggtggtcctactggaactgctgacggggcgtaaacctgtcgatcatacattgccacgtggacaacagagtcttgttacatgggcaacaccgaaactgagtgaagataaggtgaaacagtgtattgacactagactcaataacgaataccctcccaaggcagtcgcaaagatggctgcagttgcggcattgtgcgtgcaatatgaagctgatttcagaccaaacatgagcattgtggtcaaagctttgcagccacttttgaatactagaaccggcccttcaaccgaagcaccaaatccctgaattcctttttactttgtatcataatatgtacgttttcttgaatgctgtatcttctattccgtttaatgcttgcggaaaactaaacctgtatcaatttcccagtttatatttcttgcctatggttttt

SEQ ID NO: 6915 - DNA, 1512 bp, Aquilegia formosa
aaaagactaaactaaacttaagacagttcatcatttaatcatacttcttcttcttcttctttagttctttccaccgtttctcttttatattcattaacctacgcactctttgtttcttatcctgcgcatcttaaatcggtttcattcttctcaacatctctttgactaattactactacaaagatcttttcactctatctctcttttctcgaaagtgaattgaaaagaaggaaagtttaaagatagatagccactgaagaaaaagaatatgaattgcttcagctgctgtccagaagatgatatccatagggctaatgataatgtaggcccattcgtggtgaacaatgcagcaggtaaacagggaggatatcatgccacagatcctgcaactaaggctgctcagatagtcaaagtccaacctattgcagttccccctatttcagttgaagaactgaaagaagtgactgataactttgggactaagtctctaattggggagggttcatatggcagagtatattatggagtcttgaaaagtgggcgggctgcagcaataaaaaagttagatgctagtaaacaatcagaccaagaatttacagcacaggtttccatggtatcaagactgaaacatgaaaacgttgttgagctagttggttattgtatagatggaaatctccgtgtccttgcttatgagtttgcaacaatgggatctcttcatgatattcttcatgggaggaaaggtgtgaaaggagcacaacctgggccagttctttcatgggctcaacgagttaagattgctgtaggagcagcaaaaggacttgagtacttgcacgaaaaagcacagccccatgtcatccatcgtgacatcaagtccagcaatgtgctaatttttgatgatgatgtatctaagttgcagactttgatttatcaaacgaagctcctgacaatgcagcacgtcttcattctacacgtgtgctcggaactttcggttatcatgctccagagtatgcaatgacaggacagctgagttcgaagagtgatgtctatagctacggtgttgtgctgttggagctcttgactggccgtaagcctgttgatcatacattgccacgaggacaacagagtcttgtgacttgggcaacaccaagactcagtgaggacaaggttaggcagtgtgttgaccaaagacttgggggagattaccctccaaaggctgttgcgaagatggctgctgttgctgctctctgtgtgcaatatgaagctgatttcaggcctaacatgagcatcgtagtcaaagctttacagcctctgttaaatgctcgaccaggaccccctgctcctggtgaaatccctagttaagatatccttggttcttcctgtctatcctctctctctctcactcttgttctaatattcaaatttatttgttaacaagtgggtggttgtagatttttggctttgtgaaccactattctatacggatcaattatttgaaagtttgggttttcattt

SEQ ID NO: 6916 - DNA, 1601 bp, Hordeum vulgare
cgagacgacgaagccgacgaaagtaagcaacgccgccgacccctcgagtaggggtgaaacaagacaaagagagagtaatgtggcgtcgctgcatttgctgtcaagccgctgagtttgatgagaatgaaaatgggcgtgccaatccaaaggccaaggccccaacaaataacgtagatggaatgaaaaagggtttgaaagattcagctactgtgaaagcagagccacaagattcagctccctctatcaatattcctgttctatctttggatgaattaattgaaaagactgatgattttggggcaaaggctttaataggcgaaggatcttatgggagagtgtactacgctgtgcttgataatgggacaaaaatggcagtgaagaaacttgattctactgaaaatgagcccatatcagaattctcgactcaggtttccttggtttcaagattgaaacatgaaaacttcgtagacatattgggatactgtatggagcgtaaccttcgcatagtagcctatgagtttgccaccatggggtctctgcatgatgttctacatggaagaaaaggagtacaaggtgcacaacctggtccaccacttaattggatgcagcgaatgaaaattgctgttgatgctgccaaaggacttgaatacctgcacgagaaggtccagccttctattgtacatagagatgttagatccagcaacatcctcttatttgaggacttcaaggccaagattgcagatttcaatctttcaaatcaggctccagatatggctgctcggttgcattctactcgtgtgttgggaaccttcggttatcatgccccagagtacgcaatgactggtcagctgacccagaaaagtgatgtgtatagttttggggttgttctcttggaacttctgacaggaagaaagcctgtggaccatacagcgccccgagggcagcagagcctggttacatgggctacaccaagattaaccgaagacaaggtgacggcttgcatagatccccggttggagggtgaatatccgccaaagggagttgcaaagcttggggcggtagcagctctgtgtgtgcaatatgaagccgagttccgtccaagcatgagcattgtggtgaaggctttatctcccctgaccttgagcaggcaaactccacctgcgccaccaacagcgctggacagttgatccacagaattgaccaaagaaataagatatacctcttaactgaagatggtctgcatgaacatagtccgtccgcttgcctcatgctgctatctcttttactgaaagctgatgatatgcaagccaagatatgaagaaattggagcctttacttgtcagatcactttaactaactgaattaagacgtgtggctttggtggaacacagagacgtccttttccatatctgtaaaacttttggaattatctgtagcgaaaaatatctgcattttttacattcatcgagagtggattgtagaacttcctagtctctgctacttttggcctttcttgctatcctctattaccgtccttgggcttatatagtttcttgattcattgtagatcattcactaagcatcgtgtaatcctgcatacg

SEQ ID NO: 6917 - DNA, 1152 bp, Avena sativa
cttgactcaggtttccttggtttcaagattgaaacatgacaacttcgtagatattttggggtactgtatggagcgtaatcttcgtatagtagcctatgaatttgccaccatgggttctctgcatgatgttctacatggaagaaaaggagtacaaggtgcacaacctggtcctgcacttgattggatgcagcgaatgaaaatcgctgttgatgctgccaaaggacttgaatatctgcatgagaaggttcaaccttctatcgtacatagggatatcagatcaagtaatatcctcttatttgaggacttcaaggccaagattgcagacttcaatctctcaaatcaggctccagatatggctgctcggttgcattctactcgtgtgttgggaaccttcggctatcacgctccagagtatgcaatgactggtcagctgacccagaaaagtgatgtatatagtttgggagtcgttctcttggaacttctgacaggaagaaagcccgtggaccatactatgcctagagggcagcagagcctggttacgtgggctacaccgaggttgacggcagaaaaggttaagcagtgcatagatccccggttgaatggtgaatatccacctaaaggagttgcaaagcttgcggcggtagcagctttgtgcgtgcaatatgaagccgagttccgtccgagcatgagcattgtggtgaaggctttatctcccctaaccttgaacaggcaaactccaccttcactgccaccagctctggacagttgattcacacacagatttaaccaaataaataagatacattttaactgaagacggtctcgatgaacatagttcggttgcctgatgctgctgtctcttttaacgaaaagcttggatgttatgcaagtcaagatatatgaagaaaatggagccatttcttgtcacgtctctgcaactaactgaattaagatgtgttttggtggaacacagaaacgccctttgttatgtgtaattacgaaatatctgtagcgaacaatgtctataatttccgctttagctgaaagtgaacggtaaaccttcctggctgactataataggtgtctgaattttcttggccaactatatggatatggatattggatatattgtcatacgtttttgggatccag

SEQ ID NO: 6918 - DNA, 1152 bp, Avena sativa
cttgactcaggtttccttggtttcaagattgaaacatgacaacttcgtagatattttggggtactgtatggagcgtaatcttcgtatagtagcctatgaatttgccaccatgggttctctgcatgatgttctacatggaagaaaaggagtacaaggtgcacaacctggtcctgcacttgattggatgcagcgaatgaaaatcgctgttgatgctgccaaaggacttgaatatctgcatgagaaggttcaaccttctatcgtacatagggatatcagatcaagtaatatcctcttatttgaggacttcaaggccaagattgcagacttcaatctctcaaatcaggctccagatatggctgctcggttgcattctactcgtgtgttgggaaccttcggctatcacgctccagagtatgcaatgactggtcagctgacccagaaaagtgatgtatatagtttgggagtcgttctcttggaacttctgacaggaagaaagcccgtggaccatactatgcctagagggcagcagagcctggttacgtgggctacaccgaggttgacggcagaaaaggttaagcagtgcatagatccccggttgaatggtgaatatccacctaaaggagttgcaaagcttgcggcagtagcagctttgtgcgtgcaatatgaagccgagttccgtccgagcatgagcattgtggtgaaggctttatctcccctaaccttgaacaggcaaactccaccttcactgccaccagctctggacagttgattcacacacagatttaaccaaataaataagatacattttaactgaagacggtctcgatgaacatagttcggttgcctgatgctgctgtctcttttaacgaaaagcttggatgttatgcaagtcaagatatatgaagaaaatggagccatttcttgtcacgtctctgcaactaactgaattaagatgtgttttggtggaacacagaaacgccctttgttatgtgtaattacgaaatatctgtagcgaacaatgtctataatttccgctttagctgaaagtgaacggtaaaccttcctggctgactataataggtgtctgaattttcttggccaactatatggatatggatattggatatattgtcatacgtttttgggatccag

SEQ ID NO: 6919 - DNA, 2056 bp, Pinus taeda
tcacaatctcacagtacatttggctcgacgtctgctgtcagatcatgtgaccagagagagtatcgcgtgactctatgcagtcggtcataaattagactttgaaacgatactgtagtcaagtcaatgctttacggtcacggaaattgcctcttatataaaggactggacgccgttgattgcaggcttacggtgcttcctttctctccccctctaattttcctttctccacagcggggggcattagtaaagggccctgtgttcggttgattgcagtgctgtctgttcccctttaaaagcggaaacatgcgcgcagatcgatccgattggttgaattggagggttgagtggtgggttgtctttgattgagctccattttggacattcagtagtttttctggttgtgagaaacagacacatttctgctggtagaagtttagaaccatggggtgttttggctgctgtgcagaagatgaaattcaaaatgcagctgatggtgcaacaccgattatggtaaatggaaattttcaaggaaatgatggagtttacgaaaatgcaaacacagctctgaggagtggtcaaaatgtaaaacttcagcctattgctgttcctgaaatcacagtggaggaattgagggagataacagaaaactttagttcaaagtcgctgattggagaaggttcttatggtccggtatatcatggtatcttaaaagatggccgtgcttcagctattaaaaagttggatgccagaaaacaaccagatcaggaattgcttgcacaggtttcgatggtttcgaggttgaagcatgaaaatttggttgaattggttgggtattgtgttgatggaagcatgcgagtgcttgcttatgagtttgcacctatggggtcacttcatgacatccttcatggtaaaaaaggagtgaaaggagcactaccaggtcctgttctcacttggatgcagagagtaaaaattgcaataggtgctgcaaaagggcttgagtacctccatgagaaggcacaaccgcctatcattcaccgggatattaagtctagcaatgtcttacttttcgacgactatacagcaaagatagctgattttgatatatcaaaccaatctcctgacatgtcggcacggcttcattccactcgtgtgcttggaacatttggttaccatgctccagaatacgcgatgacaggacaatcgactcaaaaaagtgatgtttacagctttggcattgtcctccttgagctattgactggcagaaaaccagttgatcacacattgccacgtggtcaacagagccttgtcacatgggcaaccccaaggcttagtgaggataaagtgaagcaatgtgtggatccaaggttgaaaggagactatccacctaaagcagtggctaagctggcagcagtagctgccttgtgtgttcagtatgaagctgattttcgtgcaaacatgagtattattgtaaaggctcttcgacctctattgaatacacaatcaagtcctgctggtgggaggccagctgtgtaatctgatgtatacgtcagatgatgtcttatgatatccaaatttttgcattatttagcttttcttgaacataagcaggcatatcttctatctgcttgcatatatctcgatctgtagttttaatattgtaaaggattagattacttatcatgtggaaacagaagggagtcaaggaagcaaacgcatacaattggacatgggcatcatattatgtcttaccttacgatattccaaatttgtgcgttatttagtttttcttcgatacaggcgggcatatcttctatctgcttgcatattactcgacctggaattaaaatattgtaaaggattggattacttaacatgtggaaacagaaggaaatcaagatagcaaatgcatacaattggacatggcaattcaaatttgcaggcacctgctgagtcttcaggatatgcaaatacgatgtctactgtgttgctttctattaggttgtcatgattcatgtttgatgtatattcatacttaagtgtaatatttcataaaaaa

SEQ ID NO: 6920 - DNA, 821 bp, Panicum virgatum
  misc_feature (84)..(84): n is a, c, g, or t
  misc_feature (105)..(105): n is a, c, g, or t
  misc_feature (234)..(234): n is a, c, g, or t
aaaagtgatgtgtatagctttggagttgtgcttttagagcttctaacaggaaggaaaccagtagatcatacaatgcctagaggncagcagagtctggttacatgngcaacacctcgattgactgaggatacagtgaaacaatgtgtagatccaagattgaagggagagtatcctccaaagggtgttgccaagcttgcagcggtggcggcactctgtgtgcaatacgaatctgantttagacccagcatgagcatcgtagtcaaggcactctctccccttctccaacataagccgcaaccaccaccagctgcagctcttgatgcaaaagcaccttcacgtgcctgactttctcagtccgacaagaatgtaaagagataaccacttcctcttcggctgctacaaacttgaggcttttccttgtcattaccgtgtgctaagctgagtggcgtgttgcctttttcgttggccgggcgaggtgtgctttggttggccagcggtcgtgatcacctaattaccgtgttctgggtctattctgtaaaatgggaaggttctaacttctcgtgcttgattcctttttgtttgttttgtctgattttgagctgatacccttctggcgtgcatgctttatgcttgagagttgagattatgcacattgttttcttctgcggaatacacagtagtaacagtagagctagattctgcactcggttgtccgctggaccatctgtctgtccaagtgaaggaaccgttaaagatgtattctgaaagacgtgctggtcatataggttcaatcgatcagctgtctgcggcttttgtgcttt

SEQ ID NO: 6921 - DNA, 1604 bp, Glycine max
agaaaacagggtttgtattatttgcggggcaaatgtcatgattgagataactggccttgctgacataaagtcatcattgaacttacacaccactcccacccattctctctcctttctatataacctcacacccacacggcccctcctatcactccaaaacctaaactccccttgcttttcttaccatctccttcaattctctctcactctcttttttctctcaccaaaacctttcacccaatatcctcaaactactacttctgataaattgctaatttttataaagctagctagagatgatggttcaaaaggaagatttgggtttgagtttaagcctcaacttccctcatcacaataccccaaatcctcaacatccgagtctcatgtcatcctctactcattcctcttctccttctggttgcaaccctcaaaaaccctcttggaacgaggctttcacttcttcggatcgaaactccgacacatgcagaggcgaaacgcgatcgttcctgcgcggaatcgacgtgaaccggttaccttccgccgtggacaccgaggaggaaacgggagtttcgtctccgaacagcaccgtctctagcgtgagtggaaaacgtagcgagagagaagaaccgaacggcgaagaacacgacatggacagagcctgttcccgcggaatcagcgacgaggaagacgctgaaaccgcaaggaaaaaacttagactctccaaagaccaatccgctatactcgaagaaagcttcaaagaacacaacaccctcaaccccaagcaaaaattggcactggcgaaacagctaggacttcgacctagacaagtggaggtgtggttccagaacagaagagcaaggactaagctgaagcaaaccgaggtggactgcgaagtattgaaaaggtgctgcgagaatctgacggaggaaaatagaaggttgcagaaggaggttcaggagcttagagcactgaaactttccccacagttttacatgcaaatgaccccacccacgacgctcaccatgtgcccctcttgcgagcgtgtggctgttccgtcctccgccgtcgatgctgccacgcgtcatcatcccatggcccaggcccaggcccaggcccagattcggcacaggcccattggcccgtgggcttccgcctctcccattacgcaccggccgtttgatgtcttccaccactgatcttgagggtgttttggtcattgtgaaattattattatttactattctgggcctacttgtaccaccgtgtaggtgtgtaaccccaaaaggagagaaaaattgggggaaacagaaagagtgagggagcggtcgaaacagcgtgctgtggaattgtgcggtctaaggatatggtcattagaagaagggatttggtgggtctccaatgttttgtaccagtttgacctatcatcttttgttttgttgggtatgacctatatattagttactagttaggtgtttttttttattcagtttatagtattacttaacttttccccctctaaacagagactttgtgtaaagtgcaattatctagttaaattatatagggtttggttcccgtggcctatttcacttaattgagatcat

SEQ ID NO: 6922 - DNA, 1389 bp, Vigna unguiculata
caactcccctgcttttcatcgtctccttcttacgctctctctctttttctctctcaatctcactctctccataaccagaacctcaattttataaaaccagagatgatggttcaaaaggaagatctgggtttgagtctaagcctcaacttccgtcacaatatacccaatcctcaacatcttactctcatctcctcctctactcattcatcttccccttcaccttcaccttcaaatccttttaaaccctcttggaacgacgctttcgatcgaaactcggacacatgcagaggcgaaacccgatcgttcctgcgcggaatcgacgtgaatcggttaccctcgggcgtggacatggaagaggaagcgggagtttcgtctccgaacagcaccgtttcgagcgtgagcggaaagcgaagcgagcgagaacccaacggtgaagaacacgacatgaacagagcctgttcccgcggaatcagcgacgaagaagacggcgaaacctcaaggaaaaaactcagactctccaaagaccaatcggctattctggaagaaagtttcaaagagcacaataccctcaacccgaagcaaaagctggcactggcaaaacagctaggccttctaccaagacaagttgaggtgtggttccagaaccgaagagcaaggactaagctgaagcaaaccgaggtggactgcgaggtgttgaaaaggtgttgcgagaatctgacggaggaaaatagaaggttgcagaaggaagttcaggagcttagagcactgaaactctcccctcagttttacatgcaaatgactcctcccaccacactcaccatgtgcccttcttgcgagcgggtggctgtgccgtcgtccgccgttgatgccgccgcgcgtcatcatccgatgggccaggcccatgcccacagccggcccatgggcatgggcccgtggggttcggctgcttccattccgcaccggggctttgatggttttcaccactgattgtgaataagaattaatttaatggaatggaggtacttgtagggttaggtgtgtagccgaaaacgagaaacagtgaggtgtggatgtaggatatggtgattagaagaagggatctggtgggtctccaatgttttgtaccactttgactcatcatcttttgtttttgtttggatgacctacattagttaggaggttttcagtttttagtgttacttaaccttttcccatctcaaacactaaacacacacttcgtgtaaactgcaattgtctagttaaattatatagctttctttcactatttctcaaaccattcttttcccacacatactttttagtctctacacttcctaggcatcttataaccacgctttcggataccttaataaacaagtttccttttca

SEQ ID NO: 6923 - DNA, 1191 bp, Trifolium pratense
tctctctctctctctctctatctctctctcaacaaaagcttgttctctttcactcttcctctccttcaaattacaaagcactttagttttctttcttgtattgcaagaacttatattatttagaaatgatggttgaaaaggaagatttgggtttgagcctaagcttgaacttccctcaaaatccaccaccaaatcctcaataccttaatcttatgtcttcttcaactcattcctcttctccttctacctacaatctccaaaaaccatcttccaatgatgctttcacttctaattcagatcgggattcggaaacatgcagaggcgaagaacgatctctactcctccgaggaatcgatgtgaatcggttaccttccggtgctgattgtgaagaagaagcaggagtttcatctccaaacagcacggtttcaagtgtgagtggtaaacgtagcgaaagagaggttactggtgaagatcttgacatggaaagagattgttcaagaggaatcagtgatgaagaagatgctgaaacatcaaggaaaaaacttagactcactaaagatcaatcaattattcttgaagagagtttcaaagaacacaacactcttaaccccaaacaaaagttggcacttgcaaaacaattggggcttcgtgctagacaagttgaagtttggtttcaaaatcgtagagcaaggactaagttgaagcaaacagaggtagattgtgagtttttgaaaaggtgttgtgagaatctgacggatgaaaataggcgattgcaaaaggaagtacaagagctaagagcactgaaactttccccacaattctacatgcaaatgacaccacccacaacacttaccatgtgcccttcttgtgagcgtgttgctgttccaacatcagccgttgatgcatccacgcgtcgtcatcctatggctccaacacaccctcgtgcatttccaatgggcccatgggccacagctgctccaatacaacacaggccctttgatccaatccggcccagatcttaaatgtgtacggctgaacaaacaaacataattttaatgaaacaaaaaaaagtttagttgtaaacatggttccatgaattctgtgttcaaaattaatgtttaagatatggttgttagaagaaatgattttgtgggtctctaatgtttttttatgtttatttgacccttatct

SEQ ID NO: 6924 - DNA, 1343 bp, Medicago truncatula
attgataatcatccatccataatctctctctctctctctctctcaatagaaaaagcttgttctctttcactcttcctctcctctcccccgaattttctttctcccaagtaacctccttcaaaaaacaaagcactttagttttctttcttgtattacaagaacaaagattagaaacaatgagtattgaaaaggaagattttggtttgagcctaagtttgagctttcctcaaaatccaccaaatcctcaataccttaatcttatgtcttcttcaactcattcatattctccttctactttcaatcctcaaaaaccttcttggaatgatgtttttacttcttcagatcgggattcggagacatgcagaatcgaagaacgtcctttaattctccgaggaatcgatgtgaatcggttaccttcaggtgctgattgtgaagaagaagcaggagtttcatcaccaaacagcaccgtttcaagtgtgagtggtaaaagaagcgaaagagaagttaccggtgaagatcttgacatggaaagagattgttcaagaggaatcagtgatgaagaagacgctgaaacttcaaggaaaaaacttagactcaccaaagaccaatcaatcattctcgaagagagtttcaaagaacacaacactcttaatcccaaacaaaaattggcacttgcaaaacaattgggacttcgtgctagacaagttgaagtttggtttcaaaatcgtagagcaaggactaagttgaagcaaacagaggtagattgtgaatttttgaaaagatgttgtgagaatctaacggatgaaaatagacggttgcaaaaagaagtgcaagagttaagagcattgaaactttccccacaattctacatgcaaatgacaccaccaacaacacttaccatgtgcccctcttgtgagcgtgtcgctgttccatcatctgccgttgatgctgccacgcgtcgtcatcctatggcttcaaatcaccctcgtacgttttccgtgggaccatgggccacagctgctccaatccaacataggacctttgatacactccgtcctagatcttaacgtgtatggatgagcaaaaacacaattttaatgaaacaaaagaaacaaaatggttgtaacagcgttccatgaattatgtgttcaatgcactgtttaagatatggttgttagaagaaatgattttgtgggtctctaatgttttttgttttagtttatttgaccccattgtcttcttttggtttggggcatggcctattctagtcctagttctagtttagttagaaattttagttttttttttttttttaatacttatttctttctttctttctagtt

SEQ ID NO: 6925 - DNA, 837 bp, Raphanus sativus
gctcgggccctcgacaatccccgtaccgccacgggagagcactccgtgaagcagttataccacctgttaagtgctctaaatgagcgcggtaaagaggccccagaatttcaggaactcaaaaatagagtgttcctcaagaaaggcggccctgggggggactctatcgcataagtaagcaagctacctttcgggatgggcttttgcttctttctttatttttcgatatgccgcttcttcgccagcaaggagcgagaaaacaaagtgggctgtaatgatgttagaatttgcaccaatttttatctatttagtgattagtctgctagtttctttgatcctactcggtgttccttttctatttgcttccaatagttctacctacccagaaaaattgtcggcctacgaatgtggtttcgatcctttcggtgatgccagaagtcgtttcgatatacgattttatcttgtttcaattttatttttaatctttgatctggaagtcacctttttctttccttgggcagtatctctcaacaagattgatctgtttggattttggtccatgatggcctttttatttattttgacgattggatttctctatgaatggaaaaggggtgctttggattgggagtaaagtgatagggcaaaaaatggggggggaaaaagaaaggaaagagaataatgcctacgttgaatcaattgattcgtcatggtagagaagaaaaacggcgcacggaccgtactcgagctttggataaatgtccccagaagctaggagcatgcctgcgtgtttcaacgagaacaccgaaaaaaccgaattccgctctacgtaagatagcc

SEQ ID NO: 6926 - DNA, 655 bp, Flaveria ramosissima
cgaaaggaacctctcggagaagttccgggcctcggcatcctttcttatctattttcatatataatataaagagaatagaaagcgtactgactctgactgctatctacgatgcgatcaggggggaatagcgcgagggcttaagtcatcgatttaaatcctatcttttttcggtatgccgctccgcgagcaaggagcgagaaaacaaagtgggctgtggtgatgttagaatttgcacctatttgtatctatttagtgatcagtctgctagtttctttgatcttactcggtgtcccttttctatttgcttccaatagttcgacctatccagaaaaattgtcggcctacgaatgtggtttcgatcctttcggtgatgccagaagtcgttttgatataagattttatcttgtttctattttatttattatctttgatctggaagtcacctttttctttccttgggcagtatctctcaacaagattgatctctttggattttggtccatgatggcctttttattgattttgacgattggatttctctatgaatggaaaaggggtgctttggattgggagtaaccactagcgatagggcaaaaatcggggggaaggacaaaagtaaagagcgcgatgcctacattaaatcaattgatttgtc

SEQ ID NO: 6927 - DNA, 357 bp, Carthamus tinctorius
atgttagaatttgcacctatttttatctatttagtgattagtctgctagtttctttgatcttactcggtgttccttttctatttgcttccaatagttcgacctatccagaaaaattgtcggcctacgaatgtggtttcgatccttttggtgatgccagaagtcgttttgatatacgattttatcttgtttctattttatttattatctttgatctggaagtcacctttttttttccttgggcagtatctctcaacaagattgatctctttggattttggtccatgatggcctttttattgattttgacgattggatttctctatgaatggaaaaggggtgctttggattgggagtaa

SEQ ID NO: 6928 - DNA, 1371 bp, Ambrosia trifida
aggacgagttgtccaaaatgcgagcttggagtcgtcaatgcgaaatcgcattgtacgactcgagcaggaaaatagcccttttctgctagataaggcaaagggagcctactggtcggacataaaaagggagctggatcatgccccctctcagagagagtatgcccgtttagtcgcttttgaaaacagggacctcctgctccgagaacaaaagcatgaggctttacgcctttttcaaggaatcttggagcagaatcctcccttggccgaccaggccccatacaacccgcaggaagtctttaaagacttcttggacgagcatggcgaccgactggaccggctccaccagttggacgtataccaacgagacacgttggaactagagtttttagctctggtgaggcaagggctcagaagggatgggcccgcctatatcagagaacgcgttttctagaaagcgtactggctctgactgctatctacgatgcgatcgggggggaatagcgcaagggcttaagtcatcgattcaaatcctatctttttttcggtatgccgctccgcgagcaaggagcgagaaaacaaagtgggctgtggtgatgttagaatttgcacctatttgtatctatttagtgatcagtctgctagtttctttgatcttacttggtgttccttttctatttgcttccaatagttcgacctatccagaaaaattgtcggcctacgaatgtggtttcgaccctttcggtgatgccagaagtcgttttgatatacgattttatcttgtttctattttatttattatctttgatctggaagtcacctttttttttccttgggcagtatctctcaacaagattgatctctttggattttggtccatgatggcctttttattgattttgacgattggatttctctatgaatggaaaaggggtgctttggattgggagtaaccactagcgatagggcaaaaatcggggggaaggacaaaagtaaagagcgtgatgcctacattaaatcaattgattcgtcatggtagagaagaaaaacggcgcacggaccgtactcgagctttggatcaatgtccccagaagcaaggagtatgcctgcgtgtatcaacgagaacaccgaaaaaacctaattcagctctacgtaagatagccaaagtacggttgagcaatcgacatgatatatttgcttacattccgggcgaaggtcataatttgcaggaacattctatagtcttaataagaggaggtagagtgaaagatttgccaggtgtgaaattccattgtattcgaggagtcaaggatttgttgggaattccggatcgaagaaaagggagatcaaaatatggtgcagaaaaaccaaaat

SEQ ID NO: 6929 - DNA, 1700 bp, Cirsium arvense
gttgggaaaggggatcgattacctttcttagctaggagaaagtcactgtcatcgctctctccttgaatcgcttggaaatcgtacctagcctctcgtccataacctagcccgaagctctcaagcgactgatttcacacaagtagtaggaccttcttttatagtggagttagaataggctctagaatagtcgaaattaatggtcagtctcgctctccaccctgctgctagatggggtagggcttttcacatgcttgagataagacagatcttttttaggcattaaataggccgagagaaaagtataatttttacatagatgagcctttagaaatgaatgctcaagtctgtcacttagaagataggatggtatcgacccggacaagggggcaagattcgctggcttagggccccttttagtagggagcagaatcggtaggttcctttccgcccatcgattcaataagatcagttcaatcagtaaaggtcgaattgaaatctattattatcatagacaagacaagggaagatgcccccaatagaaggcaattttttaatgtaccagagaataggcaggtttagagttagaggaatatcaagaattggaatatcagtcagaaattgaataagagaagcaaagacgggttatagtatagtagaatcagtaatcatctagcggggacggtttcacttataggtcaagggtctcgcccatctctattcgcctatcctcaatttgatatcttttttttggtatgccgctccgcgagcaaggagcgagaaaacaaagtgggctgtggtgatgttagaatttgcacctatttttatctatttagtgatcagtctgctagtttctttgatcttactcggtgttccttttctatttgcttccaatagttcgacctatccagaaaaattgtcggcctacgaatgtggtttcgatcctttcggtgatgccagaagtcgttttgatatacgattttatcttgtttctattttatttattatctttgatctggaagtcacctttttctttccttgggcagtatctctcaacaagattgatctctttggattttggtccatgatggcctttttattgattttgacgattggatttctctatgaatggaaaaggggtgctttggattgggagtaaccactagtgatagggcaaaaatcggggggaaggacaaaagaaagagcgatgcctacattaaatcaattgattcgtcatggtagagaagaaaaacggcgcacggaccgtactcgagctttggatcaatgtccccagaagcaaggagtatgcctgcgtgtatcaacgagaacaccgaaaaaacctaattcagctctacgtaagatagccaaagtacggttgagcaatcgacatgatatatttgcttacattccgggcgagggtcagaatttgcaggaacattctatagtcttaataagaggaggtagagtgaaagatttgccaggtgtgaaattccattgtattcgaggagtcaaggatttgttgggaattccggatcgaagaaaagggagatcaaaatatggtgcagaaaaaccaaaatcgatatgaatggaagatgcctctggaactcttttttctccaattttcagtacgaagttactggctctaatctaagaaggcaattgcactaatattggaccgggaataaaaaagaaatagtgtcgaa

SEQ ID NO: 6930 - DNA, 1066 bp, Artemisia annua
cgtgtctctagactggaccggctctacccgttggacgtagaccaacgagacacgtcggaactagagtttttagctctggtgaggcaagggctcagaagggatgggcccgcctatatccgggaacgcattttctagaaagcgtactggctctgactgctatctacgatgcgatcgggggggaatagcgcaagggcttaagtcatcgattcaaatcctatctttttttcggtatgccgctccgcgagcaaggagcgagaaaacaaagtgggctgtggtgatgttagaatttgcacctatttgtatctatttagtgatcagtctgctagtttctttgatcttactcggtgttccttttctatttgcttccaatagttcgacctatccagaaaaattgtcggcctacgaatgtggtttcgatcctttcggtgatgccagaagtcgttttgatatacgattttatcttgtttctattttatttattatctttgatctggaagtcacctttttctttccttgggcagtatctctcaacaagattgatctctttggattttggtccatgatggcctttttattgattttgacgattggatttctctatgaatggaaaaggggtgctttggattgggagtaaccactagtgatagggctcaaatccttcggggggaaggacaaaagtaaagagcgatgcctacattaaatcaattgattcgtcatggtagagaagaaaaacggcgcacggaccgtactcgagctttggatcaatgtccccagaagcaaggagtatgcctgcgtgtatcgacgagaacaccgaaaaaacctaattcagctctacgtaagatagccaaagtacggttgagcaatcgacatgatatatttgcttacattccgggcgaaggtcataatttgcaggaacattctatagtcttaataagaggaggtagagtgaaagatttgccaggtgtgaaattccattgtattcgaggagtcaaggatttgttgggaattccggatcgaagaaaagggagatcaaaatatggtgcagaagatatgaatggaagatgcc

SEQ ID NO: 6931 - DNA, 1044 bp, Setaria italica
gaagaaaagagactttaggcaagtggttctggtagctcagctggttagagcaaaggactgaaaatcctttttagcttgtttcagtgggaagagcaaggggcattgcccttgaaatccttcagtggttcgaatccacatctgagcgtcttttttttttcggtatgccgctccgcgagcaaggagcgccgcgaggagagcgagagaacgaagtgggctttggtgatgttggaatttgcacctatttgtatctatttagtgatcagtctgctagtttctttgattttactcggtgttccttttctatttgcttccaatagttcgacctatccagaaaaattgtcggcctacgaatgtggtttcgatcccttcggtgatgccagaagtcgtttcgatatacgattttatctggtttctattttatttattatctttgatctggaagtcacctttttttttccttgggcagtatctcttaacaagattgatctgtttggattttggtccatgatggcctttttattgattttgacgattggatttctctatgaatggaaaaggggtgctttggattgggagtaaccactagtgaaagggctaaggggggaaggacataggaaagaggaatgcctacaaaaaatcaattgattcgtcatggtagagaagaaaaacggcgcacggaccgtactcgagctttggatcaatgtccccagaagcaaggagtatgcctgcgtgtttcgacgagaacaccgaaaaaacctaattcagctctacgtaagatagcaaaagtacggttgagcaatcgacatgatatatttgcttacattccaggcgaaggtcataatttgcaggaacattctatagtcttagtcagaggaggtagagtgaaagatttgccaggtgtgaaatttcattgtattcgaggagtcaaggatttgctgggaattccggatcgtagaaagggaagatctaaatatggtgcagaaagaccaaaatcgaaatgaatggaagatgcccctggaactttttggttcttttgttcgggag

SEQ ID NO: 6932 - DNA, 1029 bp, Guizotia abyssinica
agacgggaccgaccgaaagccccgcttttgccagcatgacagcaagacaacggcagaaataatggaactgaccgcctacttgaagccatttcataggctcaaatccttttttcactcttgttttaaactttatttcgaggactagtgaatagggcaagggcttaagtcatcgattcaaatcctatcttttttcggtatgccgctccgcgagcaaggagcgagaaaacaaagtgggctgtggtgatgttagaatttgcacctatttgtatctatttagtgatcagtctgctagtttctttgatcttactcggtgttccttttctatttgcttccaatagttcgacctatccagaaaaactgtcggcctacgaatgtggtttcgatcctttcggtgatgccagaagtcgttttgatatacgattttatcttgtttctattttatttattatctttgatctggaagtcaccttttttttttccttgggcagtatctctcaacaagattgatctctttggattttggtccatgatggcctttttattgattttgacgattggatttctctatgaatggaaaaggggtgctttggattgggagtaaccactagcgatagggcaaaaatcggggggaaggacaaaagtaaagagcgcgatgcctacattaaatcaattgattcgtcatggtagagaagaaaaacggcgcacggaccgtactcgagctttggatcaatgtccccagaagcaaggagtatgcctgcgtgtatcaacgagaacaccgaaaaaacctaattcagctctacgtaagatagccaaagtacgcttgagcaatcgacatgatatatttgcttacattccgggcgaaggtcataatttgcaggaacattctatagtcttaataagaggaggtagagtgaaagatttgccaggtgtgaaattcattgtattcgaggagtcaaggatttgttgggaattcggatcgaagaaaaggagatcaaatatggtgcagaaaaccaaatcgagatgaatgga

SEQ ID NO: 6933 - DNA, 831 bp, Pennisetum glaucum
ctttggtgatgttggaatttgcacctatttgtatctatttagtgattagtctgctagtttctttgattttactcggtgttccttttttatttgcttccaatagttcgacctatccagaaaaaattgtcggcctacgaatgtggttttgatcccttcggtgatgccagaagtcgtttcgatatacgattttatctggtttctattttatttattatctttgatctggaagtcacctttttttttccttgggcagtatctcttaacaagattgatctgtttggattttggtccatgatggcctttttattgattttgacgattggatttctctatgaatggaaaaggggtgctttggattgggagtaaccactagtgaaagggctaaggggggaaggacataggaaagaggaatgcctacaaaaaatcaattgattcgtcatggtagagaagaaaaacggcgcacggaccgtactcgagctttggatcaatgtccccagaagcaaggagtatgcctgcgtgtttcgacgagaacaccgaaaaaacctaattcagctctacgtaagatagcaaaagtacggttgagcaatcgacatgatatatttgcttacattccaggcgaaggtcataatttgcaggaacattctatagtcttagtcagaggaggtagagtgaaagatttgccaggtgtgaaattccattgtattcgaggagtcaaggatttgctgggaattccggatcgtagaaagggaagatctaaatatggtgcagaaagaccaaaatcgaaatgaatggaagatgcctctggaactttttggttcttttgttcgggag

SEQ ID NO: 6934 - DNA, 894 bp, Tragopogon dubius
agagaatagaaagcgtactgactctgactgctatctacgatgcgatcaggggggaatagcgcaagggcttaagtcatcgattcaaatcctatctttttttcggtatgccgctccgcgagcaaggagcgagaaaacaaagtgggctgtggtgatgttagaatttgcacctatttttatctatttagtgattagtctgctagtttctttgatcttactcggtgttccttttctatttgcttccaatagttcgacctatccagaaaaattgtcggcctacgaatgtggtttcgatcctttcggtgatgccagaagtcgttttgatatacgattttatcttgtttctattttatttattatctttgatctggaagtcacctttttctttccttgggcagtatctctcaacaagattgatctctttggattttggtccatgatggcctttttattgattttgacgattggatttctctatgaatggaaaaggggtgctttggattgggagtaaacactcgtgacattacagggcaaaaataagggcgaagaacaaaagaaagagcgaccgatgcctacattaaatcaattgattcgtcatggtagagaagaaaaacggcgcacggaccgtactcgagctttggatcaatgtccccagaagcaaggagtatgcctgcgtgtatcaacgagaacaccgaaaaaacctaattcagctctacgtaagatagccaaagtacggttgagcaatcgacatgatatatttgcttacattccgggggaaggtcataatttgcaggaacattctatagtcttaataagaggaggtagagtgaaagatttgccaggtgtgaaattccattgtattcgaggagtcaaggatttgttgggaattccggatcg

SEQ ID NO: 6935 - DNA, 5046 bp, Gossypium hirsutum
tagctagcctgatagtagtagtaagagtaagagagagttctccgtggcttaaacagcttttcgttttagtggagatcctcaaggctagagcactgcacagcttaaacagttcatttttgactaggagctcatttgagaggctaggctaaaaccatgccgataactaagaagtcgtaaaccctgagccctttaaagcgctggcttaatatagtctaggtgaaatccctatttgcctccaagtcaagttcctcactcaaatccttacgccggaaagaaaaagcacttttggatgtaaagacccgctgactcttcactttactactcgcttggtgactaacctaccaaacctacccaatcgtacgcagctccttcgtccctttcctctctttcaacccatctcacatctgcgatatggcttggacccttctttgagtgggagagtgtgttgcaattatcctcgaaagtctccctgccctcgtaaggccaagcgaagacgtcaaggctccacacctgagaaatttttcacgttcctcattcgagctttcttgaccaattatccattttcgtgggttggcgggaacaagctctctttttaattccactagtaggcgggtcctatgaactttgactcaggaagaggcgtaactcgcgctcgtctcgtatttcatccaattttaggttttttatgtaaagcagcgataatgtttaaagagattccagactagaagttgctcgacctggatggagagaacggcctggctgacattgatagaggtcgtcctttttggtctcatggcccaccctaagtgctttaggcagaaaaagtagttaagttccgagaagaggaatgaatatccccccatatagcttctaatttccgagcatggggtatggagtcagggagaaagtttggtctcggttgcctttttgtttatagggagctcggagtgagtcatcacacccttgaaaaaatgttttaacccagtgcgaaaaacaagacactcggttctccttccgccccgcttttggcattaaattaagaaggagccgtcggtatatgtaggactttcagccttcaagaaaaatggcactagctggctcgcccctatccctaaagggcagaaggggcccttactcggcctattaagcccctaactcaaataagtaaaaagaaaacggactaaagcatggaatgtgcaggagcgaacccttagtaagacgatgatttcgaccctgatctttctattgatactaattccgcaaaaataaaataaagaggcaaccactatcaggttagtagcggaacgagctttctctttctctaagaaatttgaagatgagagcaggttcccattcgaggagcgcaatggaaagtcagcctttgagggttcatgtccgaatcagggatgtggtaaggaagcgtagcagctcaatttcaaaggttcgcatcgaaacgaaagggaaggctgaatggacgagaaatgaaagaaagaagaagggcatctcaatctcaaccagcaagagacacatcagcagttgaaggcaaagaaagaggaagagaagaaatggatttggaccagccgtcttgatgatgaaaaggggccgctaggccgctgtcccaagaccgctttcccaataggcaacggagcggaacgagaaggaatgaatgcaagcaggtcaagtacaccccaggggaagagaatccggttaacataaagtctaaaaaagaagaagatcctttgagagatctcatgaaagcaggaaatgaccaatacgagattgaaatagaggagggatcaagcaggcatcgccgaagatagggatttgaaaagagatgaagaatcccgccctgactgaagagaatggtctcgaaggaggagaaaggatatcgaaactccgaaagtagtacttcacttccacatctagatctaggaaattggaagctacatccatctcattgagtatggatccgagttccccagaggctagcaatcaagcagaaatgaatggtatcaggtggaaggacagacccaccatacagtgtagttcgcagctaaaggcacaaaaggaaagagaaaaagagttaagccgcttgacctcaaattggcgaggaattcaaggaatcataggcgcggaaggccaatgaacatcggcttcagaccttaaccttagacgtaccgtacttcctcaagatgaacctgctgtagagatgatccaatccctggactttcgcttctagcactgacatctaattgagtagcgagttgagcccctactatgactaagagaagctcctcgcagaaagaagcccctacgattactcatcgaagttccgagcctttttggtcgcgaggcaatgaccaagagaagctcatcgtccaggagacgaaagcactctacttcccgcttagagcatgaaagggtccggaatcataggatcggaacgagctttctctccaatccacttggcgaaagacatcccatcccagggaaaaagaaagcaagtcagactgagttcaattagtcccgtccttccttcagggaatggtgggaggtataacattcgattctttctctcctcgggcaagaagggaagccgcttcactgattgagttgatgagcgaagccacttgaccgatgaggtgaaggagtgagaactcttactataacagatacacgagcccatctattagaaaagctatttcttgagtagccagaatagtctgtagcgagaagcgttcctcataggccagccaggagctacaagcaactagagcgcagcgataagagcggggacactcattagattagtgctccccttcgatctatcatggattagggggagaagcaagccgcccttgtcgaaagaaagacagatttccacttgcttcagacgtagggaactgaaggtctagcttacgaaggttgccgccgcagtttgtctcaagagggggccgctgaacgactgaaagcccaacccgaaaaaggagttgcagtgcttttgattcttcctataatatgttataccagtcgccttctcgaagtgccttataaacctattcactcaaataacctgatcaccgattagtggccgggctcatccttgcatcgtctgtacttaacagttccctttagtgtagtttctcggagatatctggattatttttttaataaaagaagagtctgggacgaaagagaagaaaaaagggaagaaagatctacgctacgaaaaggagcgagcggagagagcataaagagctataaggtacgagcttagagccttgcgtcactctggtatgctaatcacttcgttgtacgactctggaacggtagtcgcttagtgcgacagcactatgggatgcaaagaagcttcgtcacccttctgtagttgcttgtagttttattttttcgtcgagattgggttggtcatcagtgtactttcttgcttgatgtagttgcttatccttcaatcccatctgtctattagtgaaagtggaatcctctcctgtgcaatcaatcttgggagatactcttttgatttaatgagacagataaagaaaggaaaggaataaggctttcccctctaaatggctgttagattggttaggggctcaaaattacatatataggtgtagagtacataccttagtcccctcctcccatatttttgttgcggggaaaacccccgcgcccaatataaatatagatttaaaagactgactgccatcgcaggtggtcggcggagcttaagtgattagcatttcaaatgcacaaggatctaattctactcaaaacagttaaatctttttgtgaaatagctgtgggggaactggagctccaactaaagtacgacacaggttctccggaaaaagtaagcaaccccctatatgagtccacaaaggacctcctgcatagtgctctccgaaagggcatagccaaaattttggaaaaacaaaacttggcgctccccgagaaaatgacccattctgagctagttgataaattaattgatacgcaagtggtagatcaatttattgtggaacctcctgatctaatgcgtatatacaatcttttggaagatcttattctgtatgatgtgtcgagttcttgctttcatacattgttaaccctattatcggtcagttagtaatcggcgagcctcagtagctggcaccctttatcatttttttccggtatgccgctccgcgagcaaggagcgagagaaccaagtgggctgtggtgatgttagaatttgcacctatttctatctatttagtgattagtctgctagtttctttgatcctacttggtcttccttttctatttgcttccaatagttcgacctatccagaaaaattgtcggcctacgaatgtggtttcgatcctttcggtgatgccagaagtcgtttcgatataagattttatcttgtttcaattttatttattatctttgatctggaagtaacctttttctttccttgggcagtatctctcaacaagattgatctctttggattttggtccatgatggcctttttattgattttgacgattggatttttttatgaatggaaaaggggtgctttggattgggagtaatcactagttttagggctaaaatcggggggaaggacaaaggaaagagcgatgcctacattaaatcaattgattcgtcatggtagagaagaaaaacggcgcacggaccgtactcgagctttggatcaatgtccccagaagcaaggagtatgcctgcgtgttttaacgagaacaccgaaaaaacctaattcagctctacgtaagatagctaaagtacggttgagcaatcgacatgatatatttgcttatattccaggcgaaggtcataatttgcaggaacattctatggtcttaataagaggaggcagagtgaaagatttgccaggtgtgaaattccattgtattcgaggagtcaaggatttgctgggaattccggatcgaagaagaggcagatcaaaatatggtgcagaaaaacccaaatagatatgaatggaagatgcccctggaact

SEQ ID NO: 6936 - DNA, 1003 bp, Helianthus annuus
agcgtactgactctgactgctatctacgatacgatcaggggggaatagcgcaagggcttaagtcatcgattcaaatcctatctttttttcggtatgccgctccgcgagcaaggagcgagaaaacaaagtgggctgtggtgatgttagaatttgcacctatttgtatctatttagtgatcagtctgctagtttctttgatcttactcggtgttccttttctatttgcttccaatagttcgacttatccagaaaaattgtcggcctacgaatgtggtttcgatcctttcggtgatgccagaagtcgttttgatatacgattttatcttgtttctattttatttattatctttgatctggaagtcacctttttctttccttgggcagcatctctcaacaagattgatctctttggattttggtccatgatggcctttttattgattttgacgattggatttctctatgaatggaaaaggggtgctttggattgggagtaaccactagcgatagggcaaaaatcggggggaaggacaaaagtcaagagcgtgatgcctacattaaatcaattgattcgtcatggtagagaagaaaaacggcgcacggaccgtactcgagctttggatcaatgtccccagaagcaaggagtatgcctgcgtgtatcaacgagaacaccgaaaaaacctaattcagctctacgtaagatagccaaagtacggttgagcaatcgacatgatatatttgcttacattccgggcgaaggtcataatttgcaggaacattctatagtcttaataagaggaggtagagtgaaagatttgccaggtgtgaaattccattgtattcgaggagtcaaggatttgttgggaattccggatcgaagaaaagggagatcaaaatatggtgcagaaaaaccaaaatcgagatgaatggaagatgcccctgtcaaatctttcactctacctcctcttattaagactatagaatgttcctgcaaattatgacc

SEQ ID NO: 6937 - DNA, 549 bp, Eucalyptus grandis
ttttttttttcggtatgccgctccgcgagcaaggagcgagagaagcaagtgggctgtgatgatgttagaatttgcacctatttgtatctatttagtgattagtctgctactttctttgatcctactcggtgttccttttctatttgcttccaatagttcgacctacccagaaaaattgtcggcctacgaatgtggtttcgatcctttcggtgatgccagaagtcgtttcgatatacgattttatcttgtttcaattttatttattatctttgatctggaagtcacctttttctttccttgggcagtatctctcaacaagattgatttgtttggattttggtccatgatggcctttttattgattttgacgattggatttctctatgaatggaaaaggggtgctttggattgggagtaatcactagtgatagggcaaaaaccgggggtaaggacaaaggaaagagcgatgcctacattaaatcaattgattcgtcatggtagagaagaaaaacggcgcacggaccgtacctgcccgggcggccgctcgaa

SEQ ID NO: 6938 - DNA, 4415 bp, Papaver somniferum
  misc_feature (302)..(302): n is a, c, g, or t
  misc_feature (3369)..(3369): n is a, c, g, or t
  misc_feature (4262)..(4262): n is a, c, g, or t
  misc_feature (4294)..(4294): n is a, c, g, or t
tagacaatgaaaccattccattactaccaacccagacgacctctctgagatatacggtttatgccggaaaggtacaaagttggactaatttggaaacattgggcaatttactttatacctactattccgtctggtttttggttcctagtctgattttattagtagccatgattggggctatagtactgacaatgcataggactactaaagtgaaaagacaggatgtattccgacgaaatgcaattgattctaggaggactataatgaggaggacgacagatccgctcaaggtgtagcgcagnctggtcaatcacactgatatctttaataggtctaagccttggttgggcagtctttaggcctccctctgataaaagagtgctttttgaagcctatcatgcgatgcaaaaaagacctctcgttgttgtaggttcgaatcgtcggtatatcaatacataataactagcgaaacactatcaaccaagctacaaagaaactacctcagatgtcaacaaaagttcaacaaccgactcatgtcaagtttgaagtttaagcacaactttctcctttatacagctgttttcgctcgatcgcagctataaaaaagagctcaaccacgttttgatctagttgttttatcttaagtagaatcaattcttttctgtattcaatcttcttagactgctgtaaatgagtttcattctttcggaaagttgatcgtaattgtttatataatcaagttcatctggaggcatctaagcaagaggaatacgtcttgaatcgcacattagaaggcagatgtcttcagcagataccgcccccatgctcccacggtccgcttaccgaggaagagaaaggtaggacccggggccagagcaagttgggttggggtatagagccgtaagcgcggtgggggtgacagaggacgtgctcgtacggttcatagcaggggtatgatcaactcgttgattgttgggaactcctctatattcgaaatatgcctttctaggagcattacgatctgcagctcaaatggtctcttatgaagtctctattggtctgattctgattactgtactaatatgtgtaggttcctgtaatttgagtgagattgtcatggcgcaaaagcagatatggttcggtattcccttgttccccgtattggttatgttctttatttcttgtctagcagaaacgaatcgagctccgtttgatctcccagaagcggaagctgaattagttgcaggctataatgtcgaatatgcgcgggatgcgatccttaatagttcactgttggcggaagccaatgtcccggggtcccggggacttattctgactgaaacaaggggtgggtctttaccaacttcaaaatcaaagaacaaggcttaaattcttcattcgaaactcatgaatgtagggtcggggcccttagttccacgggttagttgggtaaagaaagaaaactccctcacatgtaggacatcctcttatcttcgagcctgactctagcaagtcagtaaactccctccttggacgagcacgggcttagtcaagtagaaccgggttgcgctgcttgatgctccgatcgaaaacacttgtatgaatggggccatgcctgtagacagaatatgcgttagaaaggccaatccctctcctaggacaccaaaaaaccgggccgaacttcagcaggcctgcccgcttccatagaacaagatcgtggcaacgtagacctaagtgctcatattggacccttgggaaccatcacaaggacggccggcctatatatttgaaggagaatgccgtgtcgtccagcggagcctagaagaaggtaactcggaacctagaataaggtgactcgcccagacagctgactccttagaaaggaatagccagctgtctggtccatctcataaatcttatcggccggcaacccggagacggacgaccacggtcccaaccttaccagcaccggaggtttactaatcaatgaaagccctactttttatgatgacctggtcgcgagagtacgatacattggtgtaaaagattgagtggtagctatcaaagagatgctgaagggtgccagaaagcacagtatttagatatagtctttcgaggagaataaattataaagaagtgaaactaggcgaggatccaaagaaagaagacaagaaagaactatataaacaattacgagaacacaggaagacactcagctatgccggctacgggccaatcacctggaagcatgggaggcgtatatagggggaagacccaggaaaagaagatggcaattaatgaaagaaaagcaccccttagtggtgttgatccacagcgtgcgagcggtaccaccacttgacgcgggtgctagagtcagtgtagatggctactaacctaagggctctgagagtaaagtctgaaaccgttttcaaagcagtgtaaacaaggccttctcgggaaacctcagaggagaagttccatccaaagttttaaataaatcttcgccaaggtagaaacgatagcataattatgctctagcccttcattgtcatattcatgtagtctacaatcttcggttgttgcacatcttcggtttctagctctccatgcgggggcatctggatcctttcatcctctttatcccgttgctgtagtttctgcaaatctccggttggtaaccaagaaactctatttagtcgaggaagctttcctgctgtcaaaagaagatatgaaacagaataaaaaaaggaaaaatgggtcagtattaagttatgttaggcatggggcctaaagggtatataattttttcatccatgaatcttgggatgcaagagaagaaagttgttcatatcagaggctcggacgattaatacgcggaagtaagcatcctccaatcatctagtcgacttccacatggtcatcggcccagaaggctttctacactattgctcggcttgaatcggtttgggtccacttctctttcttctctcgttccgacagcactgactctttagctgacttgcactgatagaggcctatttggaattaggcgcccatcttcaactaatctctgaaatcttcgactctgatgtgaatgctattccgatctaagaggaattcgtttctggaagtagcgagagcattttaagagatagcgtctgtgatcagcgaggtcattcactagctaaattgagggttttcctttgacttggttgtcgattgaaatgacatcgtcgcgttggattggctccatagagttatggctcgattcgataccggagttccattcttcatattttatttgtttatatagtttgaaatctcttcgtgcctgaacgcgagaagccttgcattaaagaaaactggagntgggagaatctactttttcggtatgccgctccgcgagtaaggaacaccgcgagcagagcgagagaagtaagtgggctgtggtcatgtcagaatttgcacctatttgtatctatttagtgatcagtccgctagtttctttgatctcactaggtcttccttttctatttgcttccaatagttcgacctatccagaaaaattgtcggcctacgaatgtggttccgatccttccggtgatgccagaagtcgtttcgatatacgattttatctggtttctattttatttattatccctgatctggaagtcacctttttctttccttgggcagtctctcccaacaagattgatccctttggatcttggtccatgatggcctttttattgattttgacgattggatctctctatgaatggaaaaggggtgcttcggatcgggagtaaccactacactagtgagagggctcaatgggaaggacaaaggaaagagcgatgcctactcattcgtcatggtagagaagaaaaacggctaagggatccgacgaaggaggatgcttcttcttttgttccttccttgtgggacaagaaagccaggaaactttctagatctcaccagatgcaaaaagtatttgcactttaatttttcacctataatttggctctagactacatgcatatacgataactaggtcaggctcaatttcgggttttctagcttgtgaggtcctaacctaaccatggttgaacatagcggatgataataaagagaaagtactacgtcaggttagtcagagctggtgatcgtgaaagggctggtgatagtaggtcagagtagcagatctgctcatcggctgagctagtactagtttgaatatggtggagaacgtgaagctagancagtgctgtcctttattcataaaactgttcgnctagttatgatggcgaaacttcgttagttggtcagctactcgatagaaatatgcctaggtcaggagagggcctaatccctgggtcatcagtaaaacgggggttgtgaaacaccactctcct

SEQ ID NO: 6939 - DNA, 5878 bp, Lippia dulcis
gaatcatctgcacgacctttcctattttgtaagatgagataatcatactcgtgttggatcagcaggtatctactatgcccttcccctttggattgtaaaattgggatcttcaagtctactcgttcagttttctagatgactcgttcaattccgtaggaagaacttggagggatgaccgtcgtcaatagtgaacccacccgtgtagccacactactcaatgtggtggtgaatcaaagctcgtagagcgtcttaagcggggaagcatcttcttaggacatcgttagctctaaccgagctcaagcggctttcgatctgcgtattggcagatgccctctacctcatctcatcctccatgataagcatttcccaaaggaatttctattcattcaatgtcggcgttggtcttgttcttaaagaatcccccgcttagatagaatagaaagagtctaataggatgcaaataaacggaaggaagaagaaagatcagatgcacagcctcttgctttccttttcactgccaatctttatccctttccggcagtcccttagccaagtgcagttttgaatatcccatctaatttctaattacctgtctcccattgagagtgcccccaccttgccgccttacttcactccccaagctggaaagatgcttattatctacttaaagactatacaggcaccaaagtgaagtgattccagggtgggggaaggggaatctaaatagaaaagaaggccaaggtagttcaaggtcgagatagtcttggcaaagcaattcatctaccttgttcttgtttgtgaggtattattatgaattaggtaataatcgccttatttctttcttgtagtactgtcggtctaaggagaggaatggaagtagtcgtgttggttcttttctttggatctgcttatgtctctacttcggttgattctcatgccagtggactccatgctctgcttttggccttattagcttgatttcataagtgagcatgaagttggaattgaatagatagtgagaaaagcgcctttcgtgatgaaagttgtaagctcagattctggattgagaaagaaatctggaaagcgcagctttagctgaatctattataggaggcgtagggtaggctctttggatagaaaagaattcgtactatgcctagtccattcaggctcgtcttgaccaaccattagtcaagccaaagaggcagcatagtcaacaaccttcgatccggaaagctcaaacgcggatacagctaaaggggcatcatcccctgctaccttagaatgagctatcggagtagactcttatagtcggcttttttctcaaccggcacccgtagccctccttgctaagaaaggagtctccccttttggtcgtaggtccgtaggcaaccactccggaagcagctctagttatatttcttaataaataaggaatagtcttttacatagtctttggctaagcttcctaacaaatatcttcagagataaaatggtacttaagtacatcttgcccctcttcgtcgattagagaaagctcggacagatgcagctaaagagacatccccctttgagaagattgcatgtgctaaaaaccttcgtcctgacaccaccttacgctcctatacatgagtatctgctcctgccttttcttcaatcgaagattagccaatgtagttcaatcctgggcacgaaatctctataggagatagcaaggacattctctcatcgatacaacctatggtacctcttccgagaaaccccagacgcgagatatccataagaaaggggagtggtaggttaagaagaaccaactgcggagtgaataccgtacctctgccctccgtatctctagtgggctggatcacacacataccaggtcgagagtcgatcccctaccgtttatttatataggcgaaaagaggcaaacccttccaatgaaggaaagaccccgttttaagcgctggttaggttttccgaagtctgatcacacgtgacagcgccctaaccaatgttcttcctgacttcttaagtaagatagaatctctgtgtggataaagtcctacttccattaagaggttgctagtcaaaagatctatttgagaagttgtccagcgagattcattcattaccaaagagctaaggatgagttccttagaagtgcatggaagagagactccaaccaggaagtcctttctaaaaaacgagtctaactgctaagtagagggaatggatgaattggtttcaaagaccttgactctactctgttcccgttccgttggctggactcaatgtactaaaggtagcttcgttcctgtcttgctttctgtcaaccagtccgatccgtttctcaaagtccttgtcaacaggtcctaagatagcttcttatgctcccctctgaaaggtctaggaggccgatgttagtaaacaaaaacgtgagtttggaacccctaaaagagaatcccgtgctactacgaagagttcgcagcttgtggaggaggggagacagcacaaatttgagtaggctcggagtgcaacatgtatgcttacgtgcgagtagctattcggccgtagatcgagttctgggctcgaactacccgagtggtatttcgtaatgtaaagcgagtctccaggcactatatttcgctttttttcatttagcatttcgctctcaacgaacgcatgttgcatcggagtctctccgcaagctacgcctttatgagctgagctcacttttgagtattctaaaatcgtacaatacataagggcgcttcggggttatgacgccgagacgcgtcaaaggcataccagagtgctcacgaagcgatgcgagctatcatagaaccgggccacggtcttcttcttccgaatcctctcaatcctttcctggattagggaaggctaaaggctgctaccttcatcttagagcccctccatgattactaaaacactccagaacggctccctcttttcagtctatcagtcaaacaagactgcacactaacataatagacggtccatttatataccttcgggaagaataaggatccggggcaataaaatcaagcaaatagagatattctcgggctagcggggaaaagatttgaaaagggcatttggtaaggaaagtagggaaggacctcatcacctactacaaccaattacttagagatgcggaattacactggtgccccgaatccctgatgggccttggacctctgattggtttagatctattctgccggttcctccgaggcagctttcattgctttcttcatacatacgaggttgtttcaaccaccccactcggcaataggaaatccccttctcgaccaactgatctacgatgtttcgtcacgcatgcaatgacagaaggacagaagcgcgttcgcttcacgatcgtcagtcagttctgggctttccttttagatgtgcattcccgatccttgactttattgtctttgtctcttgaatattcgatttcgagttaagaggtcctctaactgatactccaagccatcccctagccggggcatttgctttggttagaaaaacagctttccctccttctttcttcttttccgaatgaagtgactcactcttgtgtgtcaagaaggctctaaaacatttgattcttgctttagttgttgtaccagaaaaagaagcaagtgctgacttttctttcttccctggatgagcggtgttgaaagagccttttaaattgacaattgaaattcttgttgtaaggattggcagtctgggaagtggcttatgtggttgtgtttccattcccgagagtttctttaagtcgtaggcttgatttgatcctttgtaactcctgaagtgaagggagatcctattgtaatgtaagaggtgtgttcgcattaatgatggctttttcttttgattatacctattgcctttctttttgattgataatgatgtcaggttacaccaactgacagaatccttccgtttttctttcctgggtcggaacacgtacgaagattggctatctttagataggagagcccaaatggcatttgaaatcgaaaggcatatagaagcagctttgcttcaagatggatttcttcctgatataataatatcaaaaatgccccaaattcgaggaattcttttttaccatcatcgccttttgtcagaatcgacactatcagaatatcaaagagaagtaaacgcagatgtacgggaaagtaggccataaaaaaactatataaagctataaatcacagtaatattactctatagtcggctctgttctgggattggctatttggcttaagtctttggtatatcgggttcatttttcaagttatcgtgtcttctggtgtatcgtatcttgtaaacgttcatgattgttcaaaaggaccggtcgaaggttaaggttaagccggagagttgggagataaggaagggcccaactcgattcggagtcgcgtttgaaatatcatatcttaactactttatttagtaattatttagttcaaatgagggatgaaaaagaattctttcttggacgtaaaatccgtacttgactcaatttgagaagcaatggcaggctaaagctaaagagagagtcttttggctatgcagaagaaggagctcttagcaattgaatcagaatagtctgcccttaccccaacataaggtggagccttaacccgacacaagatgggaccctattaggttaggatagtgggcttagtcagcccaacagaagttgtcaaccaaaaaggagaagttcccgtgatttaaggtgaatctttggctttgagaaagagcacgggcttccgcttgtatatattatttatatatccttgatatttgcattatctctcttaggctcttggattcatatatacttttccaacgtagttccggatttaatgaccggcttattcccgttcctgccagtcttgagtgtaggaccgcacgtgggtgatgccggcgcatcaagctcggaggagcgagaaattctgcagggggtccctattcaaaatctgggtatagatgcctgggacgcagtaggctcccctttctattttgccggggtggttcacatccctggtgaaatagaggatccactcaccatagaaaggttatccgcttttaatcacttcttgatcaatttgcgatatgatttttatggtggggttatacagccgggctatacccaatccctccaacgggaattggactgcactcctgcagaagcactcctggctaagttcgactcgatgcttagtcaagagcgcgccaagttttatacccgctaacctaatatgttgtccaagttgccaagaaatcgttttttctttttttttttcggtatgtagctccgcgagcaaggagcgaaagaacgaagtgtgctgtggtgatgtccgaatttgaacctattttgatctatttagtgatcagtttgctagtttctttgattctactcggtcttccttttttattttcttccaatagttcgacctatccagaaaaattgtcggcctacgaatgtggtttcgatcctttcggtgatgccagaagtcgttttgatatacgattttatcttgtttccattttatttattatttttgatctggaagtcacctttttctttccttgggcagtatctctcaacaagattgatctctttggattttggtccatgatggcctttttattgattttgacgattggatttctctatgaatggaaaaggggtgctttggattgggagtaaccactagtgatagggcaaaaataggggggaaggacaaagggaatagcgatgcctacattaaatcaattgattcgtcatggtagagaagaaaaacggcgtacggaccgtactcgagctttggat

SEQ ID NO: 6940 - DNA, 1207 bp, Silene vulgaris
taagatttttattaattcaataatataattataataagacattgagccgtaggacagtagaaagattagaagcttgcctggcttagtagcttttgatgcattccctcagcatctttcttcattttctatatgattaagacatgcaagtctgactatgttttaagtaagagagggtcgatgtaattgagctgatttcttaatagttaactctctgacctgggcatctaaccttaaaagtataaaagcagcgaagcagaaattgtcgtagagaagaaaaaagttcccacggagcactaactagaaatatcatagtgcttgatttcattcgttctcttcttcttttttggtatgccgcccctctctataactataatggagcaaggagcgagaaaaaaaagtggtctgtggtgatgttagaatttgcgcctatttgtatctatttagtgatcagtctgctagtttctttgatcttactcggtgttccttttctattttcttctaatacttcgacttatccagaaaaattgtcggcctacgaatgtggtttcgatcctttcggtgatgccagaagtcgtttcgatatacgattttatcttgtttcaattttatttattatctttgatctggaagtaacctttttctttccttgggcagtatctctcaacaagattgatctgtttggattttggtccatgatggcctttttattgattttaacgataggatttctctatgaatggaaaaggggtgctttggattgggagtaatgataggggaaaaagaaagatatgaaaaagatatagaggagggaggatactgactcgaacgctacctcgccttaaaagatagcagaatgagtgaaccaaacagtttgtttatatagtattaaagtgaaccaagcatatggacatactgaaatgcctagcacgagacacagactgttgacttgacttttgcttttgcatggtttcacttaattatcctgcctttgaaaacaaaagttatgaataaaaacaatatttttagggcacctaacaaacaagcgaaagaatgtagcagcgagtggaggatacgctcaggaagagactcgactaaaaggagagggtattctagctcgaggtaatccgagaggggagataagtacgaccagttagttacgttagtcttagatgttaagaagtgaaatggatctaagcgagtgacgagt

SEQ ID NO: 6941 - DNA, 878 bp, Acacia harpophylla
gatagatatcaggttagaaccaccagtcagataaggggagaaatcctcatcaagcataacggcttttatcactaagataagacatgatctcctgttcaggctaatcaatcaactcaatcgattagcgtagatgaagaaggagattggctcgttgatctttgattcgagagtcttccccgctggcctaactagttgaacccctaagggctaatccatcaagatcgtagctaagccggaaagacgaccctttgcgaaaaaccagatatagagagtgttcagtgagtgatcgttgttgtcgtggaagggttctctttgaacgaatcctatttgaactaagcccgaaagcacgggatgatacttttctttcttctttctttttttttccggtatgccgctccgcgagaaaggaaaggagcgaaacgaaagaaccaagtgggttgtggtaatgttagaatttgcacctatttgtatctatttagtgatcagtctgctagtttctttgatcctactcggtcttccttttctcttttcttccaatagttcgacctatccagaaaaattgtcggcctacgaatgtggtttcgatcctttcggtgatgccagaagtcgttttgatataagattttatcttgtttcaattttatttattatttttgatctggaagtaacctttttctttccttgggcagtatctctcaacaagattgatctgtttggattttggtctatgatggcctttttattgattttgacgattggatttctctatgaatggaaaaggggtgctttggattgggagtaatcactagtgatagggcaaaaatagggaggaaggacaaaggaaagagcgatgcctacattaaatcaattgattcgta

SEQ ID NO: 6942 - DNA, 3313 bp, Amorphophallus konjac
tactcttgtttctacatagaaatgatcaatttctctctacaaagtagatgacctcaaaaatacactacaatttatttagagaaagacgagactcaaacagaagaaaggacagaggaccgcaaccccgttatcaaactagaattagaagcgggtttgccacacaaattgctcagtcaagtcgcttgcgttagccgaactaagtcagttcaatcgaacctgaccaatgttaagatcggaaacctaaccaatgttacaatgttaagattggtcagattggtaaacctactcactcgctttgtctcaaatatagatagcggaaatatgaacatgatgattccaggcaggaatcctttatgaaccaaggcgcgagaaaattagaactttattacgaatgaaaaggcactctaacttatgcaggtttattctgcttacattaacagatctttcggggcggggcagcattaccagggaaaaaattctagagagaataagaaagtgttttacctgcagttccattattatagcacaagaaggattgagtgagaagggacaccactttttcgttggaataaaaaaagcgatgcaagaaaaacaaagcctctcggattctaaaggaggcctttccagagttcgaaggagcacaaatgaatgtgtcttttaatcgacttcgtagatttctctattcatttctatttgtggccattatggttttggttatgtatcttatttgtctgtgtatggggtcaatcaactctttttttgtcctactttcaaaggctggggtctctctaggaggtcgagccctatcgttagctctatgtaagggcttgggctgctccggcggtctggccttagccatggttttgctgctagggccctcttcgctagcgaggcacctgcggccctacctctatttatgaatgaagacgggagtgctggcgcggtcgatgcgtccacaagtggggcctcagacgagagctcaagctcttcctcagaagaagttaagtttttgcatcagaggtcgaggaagtagccgactcgactccggtcgaggaagtagccgagtcgaatccgcagttttgggggaaatgggaagaaccagagatagaactctatgatcgggcaaaatccctcctccttcgggaagaaatagacacggaatactttaacgatattcctataaatatgggcaagtttgccgacctcggcgaggtagcataccaagctaatctcgaatttgaggaattcgaagtcgggatggtagaaaagcggagcgaaataaaggatcggctcatcgatctcttttcgaatgacaacgaccccgaagtggtccaatataggcaagacaaccccaaccccaacccgaggcttcaaagggattttcgcgctttcgatgaagaagcgctttcaggccccattgaaacctgggatcgtaaagccccaggctttcgggagagggccgaaaatcatatagattcatatcataatgccctttttaggaagggaaataattccattacatacatacaattcaaaaaagaggttttcaataaatagtcccgtatagatctcaatgatgagaactcgggaacagcggactaatataatattaaaatcttagtcattgtttggattgtcttttttttttattttttggttatgccgctccgcgagcaaggagcgccgcgagcagagcgagagaacgaagtgggctgtggtgatgttagaatttgcacctatttgtatctatttagtgataagtctgctagtttctttgatcttactcggtcttcctttttattttgcttccaatagttcgacctatccagaaaaattgtcggcctacgaatgtggtttcgatcccttcggtgatgccagaagtcgtttcgatatacgattttatctggtttctattttatttattatctttgatctggaagtcaccttttttttccttgggcagtatctctcaacaagattgatctgtttggattttggtccatgatggcctttttattgattttgacgattggatttctctatgaatggaaaaggggtgctttggattgggagtaaccactagtgagagggcaaaggggggaaggacaaaggaaagagcgatgcctacattaaatcaattgattcgtcatggtagagaagaaaaacggcgcacggaccgtactcgagctttggatcaatgtccccagaagcaaggagtatgcctgcgtgtttcgacgagaagaccgaaaaaaccaaattcagctctacgtaagatagccaaagtacggttgagcaatcgacatgatatatttgcttacattccaggcgaaggtcataatttgcaggaacattctttagtcttaatcagaggaggtagagtgaaagatttgccaggtgtgaaattccattgtattcgaggagtcaaggatttgctgggaattccggatcgaagaaggggaagatctaaatatggtgcagaaagacctaaatcgatatgaatggaagatgcctctggaacgtcgtttttaccggtcagtcgggggattcctaactcatcgctttttgatggaacaacaacccaaattcattgtttcagagataatgaatgggtcctacctaaaagtatccgcctttgcaccctcttatatttctataagttggcaccaacagggtcatcctgtggtgggggagttcgtcactccccggcgtacctgtgcttagtttagtaatcagtgtgttggtgaaaggcactcttatgctccagaggcacccgaatggaacgggtctattgtgagctcctgcttagcgccctctaactatcaatttcataagagaagaaggcgcttgcggcaaagaatcattcggatgaaaagtatgccacaaggctatccgagttcacaggtgtcgttgcttatctatttattcattaagattgggttggtgttcagtctacctatcgattggtagagtacaagatcgaaaggaagatttcctttttttcttggtcaacaatttgcttctacacggaaacgaagacctttgagaacattagacagggaagaaaggggataaagtcaagtctaagcaacatatggcacgaaaaggaaatcctatttcggtaagacttgatctgaatcgtagttcagatccaagttggtttagtgattattattatggtaaattagtgtatcaagatgtcaatcttagatcttattttggttcgatacgtccacctacgataagttcctttggctttcgtctcggtaggtgtattattctacattttccaaaaaggacattcattcatttcttt

SEQ ID NO: 6943 - DNA, 1690 bp, Cirsium arvense
gtataaccttttctcatgcagaacagagaaaggttagtcagactgagggacggaaaaagtaagtttgacttttttttttcatatgctcttgcgatgcgtacctgatacagagaaatctttgccgcagcacgaagccgtagttcatccaaagactacaattccatacgtgacagacagaattcaggaaagcttgaaaggtaacaaggtagttatgaagtcaacagagatgcgcgggttccgttccctctgtccggagggctttcgctttatatagaagcccctcagcacccgtacaatcaaaaaaatggaaattgaattcagtgattgagatagcgacaagttaaagctgagaggacgcacccattcccgaatccactttaattaaatttcgaaggcgcgaaagttcgcatttttcttcaagctttcgcttgtattttcatagagtaagtttagtaatccgctctctagtaaaggcactcgattagctggcaaaagcgctcttctttccattttatgtgatttgaagatagatatagatagaactcgatcgaactaaatgcttttcgtcttatcgtatataagagaaaggttgcttttaggagtgacctttctcgatttcaacaaaacaagccgatggtgatctcactttcgaaagagaatagaaagcgtactgactctgactgctatctacgatgcgatcaggggggaatagcgcaagggcttaagtcatcgattcaaatcctatctttttttcggtatgccgctccgcgagcaaggagcgagaaaacaaagtgggctgtggtgatgttagaatttgcacctatttttatctatttagtgattagtctgctagtttctttgatcctactcggtgttccttttctatttgcttccaatagttcgacctatccagaaaaattgtcggcctacgaatgtggtttcgatcctttcggtgatgccagaagtcgttttgatatacgattttatcttgtttctattttatttattatctttgatccggaagtcacctttttctttccttgggcagtatctctcaacaagattgatccctttggattttggtccatgatggcctttttattgattttgacgattggatttctctatgaatggaaaaggggtgctttggattgggagtaaccactagtgatagggcaaaaatcggggggaaggacaaaagaaagaacgatgcctacattaaatcaattgattcgtcatggtagagaagaaaaacggcgcacggaccgtactcgagctttggatcaatgtccccagaagcaaggagtatgcctgcgtgtatcaacgagaacaccgaaaaaacctaattcagctctacgtaagatagccaaagtacggttgagcaatcgacatgatatatttgcttacattccgggcgaaggtcataattcgcaggaacattctatagtcttaataagaggaggtagagtgaaagatttgccaggtgtgaaattccattgtattcgaggagtcaaggatttgttgggaattccggatcgaagaaaagggagatcaaaatatggtgcagaaaaaccaaaatctctatgaatggaagatgcctctggaactctttttctccaattttcagtacgaagttactggctctaatctaagaaggcaattgcactaatattggaccgggaataaaaag

SEQ ID NO: 6944 - DNA, 1575 bp, Beta vulgaris
tggcctgtggtgatgttagaatttgcgcctatttgtatctatttagtgattagtctgctagtttctttgatcttactcggtgttccttttctattttcttctaatacttcgacttatccagaaaaattgtcggcctacgaatgtggtttcgatcctttcggtgatgccagaagtcgtttcgatatacgattttatcttgtttcaattttatttattatctttgatctggaagtaacctttttctttccttgggcagtatctctcaacaagattgatctgtttggattttggtccatgatggcctttttattgattttaacgataggatttctctatgaatggaaaaggggtgctttggattgggagtaatcactagtgatagggcaaaaataggggggaaggacaaaggaaagagcgatgcctacaataaatcaattgattcgtcatggtagagaagaaaaacggcgcacggaccgtactcgagctttggatcaatgtccccagaagcaaggagtatgcctgcgtgtttcaacgagaacaccgaaaaaacctaattcagctctacgtaagatagccaaagtacggttgagcaatcgacatgatatatttgcttacattccgggcgaaggtcataatttgcaggaacattctatggtcttaataagaggaggtagagtgaaagatttgccaggtgtgaaattccattgtattcgaggagtcaaggatttgctgggaattccggatcgaagaagaggcagatcaaaatatggtgcagaaaaacccaaatcgatatgaatggaagatgcctcttctctttgtcttggtcggtccagggaacccgcgttaggccaaaaaaaactatatggagacaaagaagttcgtattacaccaagaattgacaagcgaatgaatcggctattttttcgtcggtgcgctcattccgaatttctttgtaccgaccagaagagcacaagagaaaagcggatccaataccaagacgacttctttctcaggaagtgcagcaagtacttgagaaatgttggaatatcatgccccacggaaaatagacttaccgacaagagagaacgagactgacccacttaagatagagaaggcaagagtgagttcggattggataatgtttttgggataactgaaaagtacattgaaaaaggatttaggaggaagagttccggtccggcgatgactacaatacaatcgagcgggatccgaagatcaatcgaatttcattgcccaccgaaaagaaggtatggttgtgcctgaagaagggcagtcagaagaggagaaatcagcttgagttcaattagtcccagctttatcagtacaagtagccggaggagtgtaccgagggaggaaaggttgttaattaagagcagtcccagcacgacaagcacaataaagaagatccgagttcagctgcttgtccaaaaggagttgaaaagacaaaaaacacttccatacttgtatccaagtaagcaaataggaattaccttttctacaatattgaattctaggttaagcagcatctaattgcatggatttcaccctcgtgcc

SEQ ID NO: 6945 - DNA, 823 bp, Allium cepa
agcgccgcgagcagagcgagagaacgcagtgagctttggtgatgtcggaattttcacctatttttatctatttagtgatgagtctgctagtttctttgatcctactcggtcttccttttctatttgcttccaatagttcgacctatccagaaaaattgtcggcctacgaatgtggttttgatcccttcggtgatgccaggagtcgtttcgatatacgattttatctggtttctattttatttattatctttgatctggaagtcacctttttttttccttgggcagtatctctcaacaagattgatctgtttggattttggtccatgatggcctttttattgattttgacgattggatttctctatgaatggaaaaggggtgctttggattgggagtaaccactagtgatagggcaaaggggggaaggacatagaaaagatcagatgcctacattcaatcaattgattcgtcatggtagagaagaaaaacggcgcacggaccgtactcgagctttggatcaatgtccccagaagcaaggagtatgcctgcgtgttctgactatcacaccgaaaaaacctaattcagctctacgtaagatagccaaagtacggttgaccaatcgacatgatatatttgcttacattccgggcgaaggtcataattcgcaggaacattctatagtcttagtcagaggaggtagagtgaaagatttgccaggtgtgaaattccattgtattcgaggagtcaaggatttgctgggaattccggatcgaagaagaggcagatctaaatatggtgcggaaaaaccaaaatccaaatgaat

SEQ ID NO: 6946 - DNA, 1177 bp, Amsonia hubrichtii
gaaaatctcaataaccttcatttcttaatcgatacagtgcaagatcttgctacttatggcgcgacgagtgaattcttcattagcaccatccgccttttagaacaaggtggggcttggtaggttagttggttagttaaatatgggttgtagtttgagtcttctttttttcggtatgccgctccgcgagcaaggagcgagagaaccaagtgggctgtggtgatgtccgaattttcacctatttttatctatttagtgatcagtctgctagtttctttgatcctactcggtcttccttttctattttcttccaatagttcgacctatccagaaaattgtcggcctacgaatgtggtttcgatcctttcggtgatgccagaagtcgttttgatatacgattttatcttgtttctattttatttattatttttgatctggaagtaacctttttctttccttgggcagtatctctcaacaagattgatctgtttggattttggtccatgatggcctttttattgattttgacgattggatttctctatgaatggaaaaggggtgctttggattgggagtaaccactagtgatagggcaaaaatcggggggaaggacaaaggaaagagcgatgcctacattaaatcaattgattcgtcatggtagagaagaaaaacggcgcacggaccgtactcgagctttggatcaatgtccccagaagcaaggagtatgcctgcgtgtttcaacgagaacaccgaaaaacctaattcagctctacgtaagatagccaaagtacggttgagcaatcgacatgatatatttgcttacattccaggcgaaggtcataatttgcaggaacattctacggtcttaataagaggaggtagagtgaaagatttgccaggtgtgaaatttcattgtattcgaggagtcaaggatttgctgggaattccggatcgaagaagaggcagatcaaaatatggtgcggaaaaacccaaatctctatgatctctggaacttgttttcttggaaaggaatcacaaagtgctttctaaagcgctggtctgattatgcatctttcttactcccatgctttccgttggtcaacaaccaacattttagttctatccttcttcactactccgactttctttctgtctggagggaatgtttgctcaatgctca

SEQ ID NO: 6947 - DNA, 1177 bp, Pinus pinaster
tgagaatgggaaaaggaaaagggaatcctacgggttggattgctcgtgtgtctacgggacaaatcctatttgaaatggatggtgttagtttgtcagatgctcgacaagctgctacattggcggcgcataaactatgtttgtcaaccaagtttgttcagtggtcgtaatagtggggaaaaaccaggacagacctttcttaggcgaagtgtttggagcgacactaagggagagggatatactcctttctgaatcgccaaaattgtacgacgaacgggcttatcgctccaggcgtacgacccagagacgttcaggttttcaatcttgttcccggttcgaatccaggcgtctctctctacgagggagtgagttttggactactcctagtcagggaggatcaggtcgctagagcaatcgttaccctatttgcttgcacgggcccgctagagagagtacttccgtaagtggagtgccttcctctcacccagccagaaaagagaatgagaaatttgatgatactacttttttgttcgcccatcaagcaagcaaggattttaataaatacatatatatagagcagccaatccttctctttccggtatgtatgccgcgacgcgagcagagcggagcgaacaaagtgggctgtgtaaccaatgatgttggaatttgcacctatttgtatttatttagtaatcagtttgctagtttctttgatcctacttggtgttccttttctatttgcttccaatggttcgacttatccagaaaaattgtcggcctacgaatgtggtttcgatcctttcggtgatgccagaagtcgtttcgatatacgattttatctggtttctattttatttattatctttgatctggaagtaaccttcttttttccttgggcagtctctctcaacaagattgatctgtttggattttggtccatgatggtctttttattgattttgacgattggatttctctatgaatggaagaagggtgctttagattgggagtaaccaccaatgatagggcaacaatcggggggggggaaggacgggaagagcgatgcctacattgaatcaattgattcgtcatggtagagagaaaaaacggcgcacagaccgtacccgagctttggagaaatgtcctcagaagcgaggagtatgcctgcgtgtttcgacga

SEQ ID NO: 6948 - DNA, 688 bp, Triphysaria pusilla
tcaagaaaggccgaaattcttcttttcttttttcggcatgccgctctgcgagcaaggagcgaaagaacgaagtgtgctgtggtgatgtccgaattttcacctatttttatctatttagtgatcagtttgctagtttctttgatcctactcggtcttcctatactattttcttccaatagttcgacctatccagaaaaattgtcggcctacgaatgtggtttcgatcctttcggtgatgccagaagtcgttttgatatacgattttatcttgtttcaattttatttattatttttgatttggaagtcacctttttctttccttgggcagtatctctcaacaagattgatctctttggattttggtccatgatggcctttttattgattttgacgattggatttctctatgaatggaaaaggggtgctttggattgggagtaatcactagtgatagggcaaaaataggggggaaggacaaaggaaatagcgatgcctacattaaatcaattgattcgtcatggtagagaagaaaaacggcgcacggaccgtactcgagctttggatcaatgtctccagaaggaaggagtatgcctgcgtgtttcaacgagaacaccgaacaaaccgaattcagctctacgtaagatagccaaagtacagttgagcaataaacatgatatatttgcttacg

SEQ ID NO: 6949 - DNA, 578 bp, Linum usitatissimum
tggtatgccgccccgcgagcaaggagcgatagaagcaagtgttttgtggtgatgttagaattttcacctatttgtatctatttagtgatcagtctgctattttctttgatcttactcggtcttccttttttatttgcttccaatagttcgacctatccagaaaaattgtcggcctacgaatgtggtttcgatcctttcggtgatgccagaagtcgtttcgatatacgattttatcttgtttccattttatttattatctttgatctggaagtaacctttttctttccttgggcagtatctctcaacaagattgatctgtttggattttggtccatgatggcctttttattgattttgacgattggatttctctatgaatggagaaggggtgctttggattgggagtaatcactagtgatagggaaaaagtcggggggaaggacaaaggaaagagcgatgcttacattaaatcaattgattcgtcatgggagagaagaaaaacggcgcacggaccgtactcgagctttggatcaatgtccccagaagcaaggagtatgcctgcgtgtttcaacgagaac

SEQ ID NO: 6950 - DNA, 1036 bp, Euonymus alatus
cgacattttcttttttttcggcatgccgctccgcgagcaaggagcgaaagaacgaagtgggctgtggtgatgttagaatttgcacctatttttatctatttagtgatcagtccgctagtttctttgatcccactcggtcttccttttttattttcttccaatagttcgacctatccagaaaaattgtcggcctacgaatgtggtttcgatcctttcggtgatgccagaagtcgtttcgatatacgattttatcttgtttcaattttatttattatctttgatcttgaagtaacctttttctttccttgggcagtatctctcaacaagattgatctgtttggattttggtccatgatggcctttttattgattttgacgattggatttctctatgaatggaaaaggggtgctttggattgggagtaatcactagtgatagggcaaaaacgggggggaaggacaaaggaaagagcgatgcctacattaaatcaattgattcgtcatggtagagaagaaaaacggcgcacggaccgtactcgagctttggatcaatgtccccagaagcaaggagtatgcctgcgtgtttcaacgagaacaccgaaaaaacctaattcagctctacgtaagatagccaaagtacggttgagcaatcgacatgatatatttgcttacattccgggcgaaggccataatttgcaggaacattctatggtcttgataagaggtggtagagtgaaagatttgccaggtgtgaaattccattgtattcgaggagtcaaggatttgctgggaattccggaccgaagaagaggcagatcaaaatatggtgcagaaaaaccaaaatgaatatgaatggaagatgcctctggaacttctttttctcagaaagtcgacgacttggctttcaactaatctcttttcttcccaaggctagctgtccaaggggaaaagggtacacagccggtaaaccaatctgtcctctcattctttcattactcatttgaaactttcccacggtgatataataagaaaggac

SEQ ID NO: 6951 - DNA, 902 bp, Quercus alba
tttttttcggtatgccgctccgcgagcaaggagcgagagaaccaagtgggctgtggtgatgttagaatttgcacctatttgtatctatttagtgattagtctgctagtttctttgatcctactcggtgttccttttctatttgcttccaatagttcgacctacccagaaaaatggtcggcctacgaatgcggtttcgatcctttcggtgatgccagaagtcgtttcgatatacgattttatcttgtttcaattttatttattatttttgatctggaagtcatctttttctttccttgggcattatctctcaacaagattgatctgtttggattttggtccatgatggcctttttattgattttgacgattggatttttctatgaatggaaaaggggtgctttggattgggagtaatcactagtgatagggcaaaaatcggggggaaggacaaaggaaagagcgatgcctacattaaatcaattgattcgtcatggtagagaagaaaaacggcgcacggaccgtactcgagctttggatcaatgtcctcagaagcaaggagtatgcctgcgtgtttcaacgagaacaccgaaaaaacctaattcagctctacgtaagatagccaaagtacggttgagcaatcgacatgatatatttgctcacattccaggcgaaggtcataatttgcaggaacattctatggtcttaataagaggaggtagagtgaaagatttgccaggtgtgaaatcccattgtattcgaggagtcaaggatttgctgggaattccggatcgaagaagaggcagatcaaaatatggtgcggaaaaacccaatcgatatgaatggaagatgcctctggtaacttgtttttctcggtcagtcgagggaacaaccacaacgttac

SEQ ID NO: 6952 - DNA, 2177 bp, Citrus sinensis
  misc_feature (350)..(350): n is a, c, g, or t
  misc_feature (353)..(354): n is a, c, g, or t
tctggtatgccgctccgcgagcaaggagcgagagaacaaagtgggctgtggtgatgttagaatttgcacctatttgtatctatttagtgattagtctgctagtttctttaatcttagtcggtcttccttttttattttcttctaatagttcgacctatccagaaaaattgtcggcctacgaatgtggtttcgatcctttcggtgatgccagaagtcgtttcgatatacgattttatcttgtttcaattttatttattatctttgatctggaagtaacctttttctttccttgggcagtatctctcaacaagattgatctgtttggattttggtccatgatggcctttttnttnnttttgacgattggatttctctatgaatggaaaaggggtgctttggattgggagtaatcactagtgatagggcaaaaaccggggggaaggacaaaggaaagagcgatgcctacattaaatcaattgattcgtcatggtagagaagaaaaacggcgcacggaccgtactcgagctttggatcaatgtccccagaagcaaggagtatgcctgcgtgtttcgacgagaacaccgaaaaaacctaattcagctctacgtaagatagccaaagtacggttgagcaatcgacatgatatatttgcttacattccgggcgaaggtcataatttgcaggaacattctatggtcttaataagaggaggtagagtgaaagatttgccaggtgtgaaattccattgtattcgaggagtcaaggatttgctgggaattccggatcgaagaagaggcagatcaaaatatggtgcagaaaaaccaaaatcgatatgaatggaagatgcctcttgaacttgttttttcggtcagtcgagggcaacgttacgccctaaaatagaactatacggagcccttccgattgttagtcttgctacactacacgagtctagggtgaagttgaagcaggagatcgatctcaaaacaaagcctgacctaaacccttaggacaaattagtttgatgcacagaacttaacactcaagctcccttataaattctagtttttaaaaaaatgagtatgaaacccctatcccttaccttgccggaacgggaaagggctctcttgctttgcttgtttgctttgttccttatagcactgtgtcaagttctcctttcattggtctcgggtgaagtatctgttataagcgaatctttccttccttggcggatggtggcatactcccttctggcctatccaagtgcaacttttcattctaaaaaaagagaaagggcgatagctttcacttctctcattcggaggggctcctcaaaggctccccttagagtggaaatttccccgcctgcagagtgtaagtatagagctgggtcctcattccagtgattttcatctccttcttgcggggacaagagaacacgaagattgaaagcatcggctaggcctttctttctctgattaatttccagttcaaagactgagcggatcggagaaggttaccaagttgagtagagggatgtgttgaagggagcaaaagtactgaaatgaaggatatggctaagtttatttataagtataagtttctttttctgagcccccttattgtgtgtgctagggtaactaagctgatggtcgtaaccgtgggatcttctccaaagtgtatcaaaacactaggaagcacgataccacgtcctgctttaggttgtgtcaaacctagagcagacaccaagaaatctgtaccactgataccacccaatacataacctcgcaagtataagcaagcgaggaatgagtccctgctagtattggttggtcttactttatcagacataggattgtggcaagcaagagaaactcaagttagtgtaagggtgcagcgtgaaggccccctcgaattgcaccagaagttgtagggggggagaaccatctatactccattgaggagaggctaaggctgtgggatgctcttttgaatccccactttccggatccccgataacgatatcatcaccgaagaaatttagcattcacgacagagaatttgatctcctttgtcgttgaaaatgattcgagcctggctttttgttatgccagtgttgaaatccatttttttccttctcttctggtctctttgaggcttaaaggggctggctacaggcg

SEQ ID NO: 6953 - DNA, 839 bp, Arachis hypogaea
tgatagagcgattggtacccttttcttttcggtatgccgctccgcgagcaaggagcgaaagaaccaagtgggctgtggtcatgttagaatttgcacctatttgtatctctttagtgatcagtctgctagtttctttgatcttactcggtgttccttttctctttgcttccaatagttggacctatccagaaaaattgtcggcctacgaatgtggtttcgatcctttcggtgatgccagaagtcgtttcgatatacgattttatcttgtttcaattttatttattatttttgatctggaagtcaccttttttttccttgggcagtatctctcaacaagattgatccgtttggatcttggtctatgatggccttttattgattttgacgattggatttctctatgaatggaaaaggggtgctttggattgggagtaatcactagtgatagggcaaaaatagggaggaaggataaaggaaagagcgatgcctacattaaatcaattgattcgtcatggtagagaagaaaaacggcgcacggaccgtactagagcttcggatcaatgtccccagaagcaaggagtacgcccgcgtgtttcaacgagaacaccgaaaaaacctaattcagctctacgtaagatagccaaagtacgattgagcaatcgatatgatatatttgcttacattccgggcgaaggtcataatttgcaggaacattctatggtcttaataagaggaggtagagtgaaagatttgccaggtgtgaaattccattgtattcgaggagtaaaggatttgttgggaatttcggatcgaagaagaggcagatccaaatatggtgc

SEQ ID NO: 6954 - DNA, 1285 bp, Phalaenopsis aphrodite
gcgccttctctcttggatcaaaaaaagagttccgcacccggactttttccagacgaaaaatgagaatgccgaacaaagacacttctccgagggacatggttgggtgcagcccatgtctttcttggttgaaggagtcaaggataggacgggtccgtatactgactgtcatctgtgagtacgcgaagttcgactgttcgcgttctcttttttttccggtatgccgctccgcgagcaaggagcgccgcgagcagagcgagagaacgaagtgttttgtgatgttggaatttgcacctatttttatctatttagtgattagtttgctagtttctttgatcctgctcggtcttccttttctatttgcttccaatagttcgacctatccagaaaaattgtcggcctacgaatgtggtttcgatcccttcggtgatgccagaagtcgtttcgatatacgattttatctggtttctattttctttattatctttgatccggaagtcacctttttttctccttgggcagtatctctcaacaagattgatccgtttggattttggtccatgatggcctttttcttgattttgacgattggatttctctatgaatggaaaaggggtgctttggattgggagtaagcactagtgatagggcaaagggggaaaggacataggaaagagggatgcctactttcaatcaattgattcaccatggtagagaagaaaaacggcgcacagaccgtactcgagctttggatcaagaaaaaacaacggccgaaactgataggcttgggcttgcgggtgcgggcagtttcaagtccattaacttcgtacagagcatcttggaggaagatgagcaatgttcacggaaaaagaacatcaattttgtccatgtcttacttatcaaaaagaagacctttgtgaccgtgacagatgctaaggggaataagaagactggggcctccgcaggttgtttggaggaaagaaaagggcggtctcgtctttctcggtatgctgctgaagcaactgcggaacatgtcgggcgatccgccagaaagatgggtttgaagtcagttgtcatgaaagtgaaaggatctacttttttcaggaaaaagaagaaagtgatcttgagctggagagaaggttttcgaggtgaaggagtaggcgcgaagcgatctccaattatgtacatccacgatgtgacccaactttcacataatggatgccgactccccaaaaaacgtcgtgtttaaatagttccaaccctttttcaatctccattttcacttgac

SEQ ID NO: 6955 - DNA, 342 bp, Populus trichocarpa
cctatttgtatctatttagtgatcagtctgctagtttctttgatcttactcggtcttccttttctatttgcttcccctagttcgacctatccagaaaaattgtcggcctacgaatgtggtttcgaccctttcggtgatgccagaagtcgtttcgatatacgattttatcttgtttccattttatttattatctttgatctggaagtaacctttttctttccttgggcagtctctctcaacaagattgatctgtttggattttggtccatgatggcctttttattgattttgacgattggatttctctatgaatggaaaaggggtgctttggattgggagtaa

SEQ ID NO: 6956 - DNA, 849 bp, Fagopyrum esculentum
tatctatttagtgatcagtctgctagtttctttgatcttactcggtcttccttttccattttcttctaatagttcgacttatccagaaaaattgtcggcctacgaatgtggtttcgatcctttcggtgatgccagaagtcgtttcgatatacgattttatcttgtttcaattttatttattatctttgatctggaagtcacctttttctttccttgggcagtatctctcaacaagattgatctgtttggattttggtccatgatggcctttttattgattttaacgattggatttctctatgaatggaaaaggggtgctttggattgggagtaatcactagtgatagggcaaaaatcggggggaaggacaaaggaaagagcgatgcctacattaaatcaattgattcgtcatggtagagaagaaaaacggcgcacggaccgtactcgagctttggatcaatgcccccagaagcaaggagtatgcctgcgtgtttcaacgagaacaccgaaaaaacctaattcagctctacgtaagatagccaaagtacggttgagcaatcgacatgaaatatttgcttacattccgggcgaaggtcataatttacaggaacattctatggtcttaataagaggaggtagagtgaaagatttgccaggtgtgaaattccattgtattcgaggagtcaaggatttgctgggaattccggatcgaagaagaggcagatccaaatatggtgcggaaaaacccaaatcgatatgaatggaagatgcctcaactggccgtacggattgattaggccttcacttataagtcgatatgctagaagcccagatttcacttttacacat

SEQ ID NO: 6957 - DNA, 527 bp, Distylium racemosum
ttgcacctatttgtatttatttagtgatcagtttgctagtttcttcgatcctacttggtgttcccttcttatttgcttccaatggttcgacttatccagaaaaactgtcggcttacgaatgcggtttcgatcctttcggtgatgccagaagtcgtttcgatatacgattttatctggtttctattctattcattatcttcgatctggaagtcacctttttttttccttgggcagtctctctcaacaagattgatctgtttggattttggtctatgatggtatttttattgattctgacgcttgggtttctctatgaatggaagaagggtgctttggattgggagtaaccaatgagttataggcacattgataggcaatgatggggcaacgggggaatatacgataagggcgatgcctacattcaatcaattgattcgtcatggcagggacaagaaacggcgcacagaccgtacccgagctttgaataaatgtcctcagaagcggggagtatgcctgcgtgtttcgac

SEQ ID NO: 6958 - DNA, 953 bp, Eutrema halophilum
atcattttactcatgataactttgaactttgtagttactgctactgtgacctatcatctgctatagttgaatatgagctctgtttgtggtacgttggatttcaaagatgcaaactttgggatctcgacttcgagccccacgcagtgctctaatggctccaagcattcctcgtttgctggatctgaagattctcaggagtctgatggcgatgaaactggttatataaaccaaactgcgaatgaagaatccgctgagacagatttcggcaaatccactttacctccctcatcttcagatgatgacgacaaggatgagaactttactactacaccagttgttctcatcccggccataaaaggcagtcgggagaagcacggcttgtcactgaggaagtcaagtgtttcgtgggctgaggacgtgtatgatcctcctccctccatagcttcgcacacaagaagcaagaaacagcaacacaaacccaagagcaaagacaaccacaggaagaccggaaagaaaggacagaagagcaaagacaactcttcctctcgtagtggcaaggacaagaagcaagcttctcgcaaacacagtcgcgagaaatttgattgggtaactcagatgcctatagttgcagcatcttcttgattgccattggctgctcataatcaagcacaccttcatcacatctacgagcttggcgtcctcttgttaaataaataatcaacaaatctctttgtgtgtgtgtttcttgtacacagcttttctgtgtgagtttctttttcgggtaatggatgataaaaaacacacatgtgaagttttcttgaagtttgttgcttgtttgtttttttttttttttttatatgggattcagtttcacttttgtgaagaactcaatgaaactttgttattgatgatgttgtcttatttgaagcaaaattagtttataaattgagatc

SEQ ID NO: 6959 - DNA, 1016 bp, Arabidopsis lyrata
attcgtcttctccaattttctcgcgaagaaaactttccaaccaatctaaacgagtcaaaatgcttctcaagactgtctcttcatcttcttcttcagctctctcgctggtgaattttcacggcgtgaagaaggatgtgtctcctttgttatcttccatttcgtggaatcttcgagtttcttctggaaaatctggaaacttatctttctctgttcgcgcatctaagagctcaaccaccgacgcgctaagcggcgtcgtctttgagccgtttaaggaagtgaaaaaggagctcgatctcgtcccaaccagctctcatctctcactcgctcgacaaaagtactcagacgagtgcgaagccgccattaacgagcagatcaatgtggaatacaatgtttcgtatgtgtatcacgctatgtatgcgtacttcgatcgggataacgttgcgcttaaaggtcttgccaagttctttaaggaatcaagcgtggaagaaagagagcacgctgagaagttaatggagtatcagaataaacgtggtgggagagttaggttacagtccattgtaatgcctctttcagagtttgaacatgttgacaaaggagatgctctatatggcatggagctggctctgtcattggagaaactagttaatgagaagctcttaaaccttcacagtgttgcttcgaagaacaatgatgtccacttggcagactttattgagagcgagtttctgaacgagcaggtggaagcaatcaagatgatctcagaatatgtggctcagctgcgacgagttggcaaaggacacggaacatggcatttcaatcagatgcttctggaagggtaagcagctacgagggactcttgtgtcaagtgtgtttctatatgaagctctcttagtttaagttcttcagcttttacgattttgtgaggtagacttctttttttttttttttgtaagagacgaagacatgactttaaattctggtctaaggttcatcaacccacctggtgatcgattcta

SEQ ID NO: 6960 - DNA, 1014 bp, Raphanus sativus
  misc_feature (137)..(137): n is a, c, g, or t
ggatcattctccagttttctcgcgaaagtatctttctcaacagtcagtcaaaatgcttctcaagacggtttcttcttcttcctcttcagctctctcgctcgtgagtttccacggcggaatcaaggacgtttctcctntgttatcatccgtctcgtctccaatcgattcctcctcgaagggaaagctctcagtctctgttcgcgcgtctaaaatctcaaccgccgacgcgctaagcggcgtcgttttccagccgttcgaggaggtgaagaaggagctcgacctcgtcccgacgagctcggatctctcgctcgctcgtcaaaagtactccgacgagtgcgaagctgctattaacgagcagatcaatgtggaatacaatctctcgtatgtgtatcacgccatgtatgcttacttcgatagggataacgtcgcgctcaaaggtcttgccaagttcttcaaggaatcgagtgtggaagaaagagagcatgctgagaagttgatggagtatcagaacaaacgtggtgggaaggttaagttacagtccattgtggtgcctctctcggagtttgaacacgttgataaaggagatgctctttatgggatggagctggctctgtcactggagaaactggttaatgagaagctcttaaacctccacagtgttgcttcaaagaacggagatgtccacttggctgattttattgagagcgagtttctgaccgagcaggtggaagcaatcaagaaaatttcagagtatgtagcccaactacgaagagttggcaaaggacacgggacgtggcatttcaatcagatgcttttggaacagtaaaatctacttcgagggacttatggtcgtgtttactcttgtggtattcagtctatgaagctcactagcaatgtatcaaccagtttgtgtgttagttctgcagcttttgtgatgtagactttttattttgtaagagccgaagagagatgtctttgaattcagttttatgaatgagttcttccaacctacca

SEQ ID NO: 6961 - DNA, 973 bp, Raphanus sativus
ggatctctcaactcaacagtcagtcaaaatgcttctcaagacggtttcttcttcttcttcctccgctctctcgctcgtgagtttccacggcggaatcaaggacgtttctcctttgttatcctccctctcgtctccaatcgattcctcctcgaagggaaagctctcagtctctgttcgcgcatctaaaatctcaaccgccgacgacgcgctaagcggcgtcgttttccagccgttcgaggaggtgaagaagtagctcgacctcgtcccaaccagctctcacgtctcgctcgctcgtcaaaagtactcagacgagtgcgaagctgctattaacgagcagatcaatgtggagtacaatctctcgtatgtatatcacgccatgtatgcttacttcgatagggataacgtcgcgcttaaaggtcttgccaagttctttaaggaatcgagtgtggaagaaagagagcatgctgagaagttgatggagtatcagaacaaacgtggtgggaaggttaagttacagtccattgtagtgcctctctcggagtttgaacacgttgataaaggagatgctctttacgggatggagctggctctgtcactggaaaaactggttaatgagaagctcttaaacctccacagtgttgcttcaaagaacggagatgtccacttggcagattttattgagagcgagtttctgaccgagcaggtggaagcaatcaagaaaatttcagagtatgtagcccaactacgaagagttggcaaaggacacgggacatggcatttcaatcaaatgcttctggaacagtaaaaagttgcttcgaggggttaaggtcgcgtactccatgaagctctctagcacaatgtatcaactagtttgtgtgttagttctgcagcttttgtgaggtagactttttatttgtaagagccgaaagagatatgactttgattccagttgtatgaatgagttcttcgaacc

SEQ ID NO: 6962 - DNA, 1176 bp, Brassica napus
ggggatgataaagtaaccacaagctctccacgcgcatgtatcaatcgtgtccatccacgtgtcaaccatccacagcctcatcatcatcactcgcggtcttcttcatcaagatcatccttgtccagtttttctggcgaaagcatctcaacagtgaaaaatgcttctcaagacggtttcttcgtcttccgctgctctctcgctcgtgagtctccatggcggagtcaaggacgtttctcctctgctatcctccacgaaccttcgagtttcttctggaaaatctgaaaatctctccgtctctgttcgcgcaactaaagactcaaccaccgacgagctaagcggcgtcgttttccagccgtttgaggaggttaagaaggagctcgatctcgtcccaaccagcgctcacgtctcgctcgctcgtcaaaagtactcagacgagtgcgaatccgcgattaacgagcagatcaatgtggagtacaatctctcgtatgtgtatcacgccatgtatgcttacttggatagagataacgtcgcgctcaaaggtcttgccaagttctttaaggaatcgagtgtggaagaaagagagcatgctgagaagttgatggagtatcagaacaaacgtggtgggaaggttaagttacagttcattgtagcgcctctctcggagtttgaacacgttgataaaggagatgctctctatgggatggagctggctctgtcactggagaaactggttaatgagaagctcttaaacctccacaatgttgcttccaagaacggagatgttcacttggctgattttattgagagcgagtttctgaccgagcaggtggaggcaatcaagaaaatttcagagtatgtagctcaactaagaagagttggcaaaggacacgggacatggcatttcaatcaaatgcttctggaacagtaaaagctgcttcaagggaattaaggtctcgcgtactctcgtggggtttactctatgaagctctctagcaatgtatcaactagtttgtgcgttagtttctgaaggttttgtgatgtagactttttttattttgattttgcatgacccgaagagatatgactttgaaagtcagtggtatgaatgagttcttcgagcgcactatggtgactgatgctacgttttgaaagcttgcttacaagaccggttcaatc

SEQ ID NO: 6963 - DNA, 1063 bp, Brassica napus
atccttgtccagtttttctggcgaaagcatctcaacagtgaaaaatgcttctcaagacggtttcttcgtcttccgctgctctctcgctcgtgagtctccatggcggagtcaaggacgtttctcctctgctatcctccacgaaccttcgagtttcttctggaaaatctgaaaatctctccgtctctgttcgcgcaactaaagactcaaccaccgacgagctaagcggcgtcgttttccagccgtttgaggaggttaagaaggagctcgatctcgtcccaaccagcgctcacgtctcgctcgctcgtcaaaagtactcagacgagtgcgaatccgcgattaacgagcagatcaatgtggagtacaatctctcgtatgtgtatcacgccatgtatgcttacttggatagagataacgtcgcgctcaaaggtcttgccaagttctttaaggaatcgagtgtggaagaaagagagcatgctgagaagttgatggagtatcagaacaaacgtggtgggaaggttaagttacagttcattgtagcgcctctctcggagtttgaacacgttgataaaggagatgctctctatgggatggagctggctctgtcactggagaaactggttaatgagaagctcttaaacctccacaatgttgcttccaagaacggagatgttcacttggctgattttattgagagcgagtttctgaccgagcaggtggaggcaatcaagaaaatttcagagtatgtagctcaactaagaagagttggcaaaggacacgggacatggcatttcaatcaaatgcttctggaacagtaaaagctgcttcaagggaattaaggtctcgcgtactctcgtggggtttactctatgaagctctctagcaatgtatcaactagtttgtgcgttagtttctgaaggttttgtgatgtagactttttttattttgattttgcatgacccgaagagatatgactttgaaagtcagtggtatgaatgagttcttcgagcgcactatggtgactgatgctacgttttgaaagcttgcttccaagaccggttcaatc

SEQ ID NO: 6964 - DNA, 858 bp, Eutrema halophilum
attctgcatcctccaattttctcgctgagaaaaactttccactctcacaatctctaacagtcaaaatgcttctcaaggctgcttcttgttcttctgctttctcgctggggatgaaggatgtttctcctttgttatcatccgtttcgtctccaatcgactcctcctcgagtcttcgtgtttcttcttctggtaaatctggaaacctctccttctccgttcgcgcatcgtccaagggatcaaccaccgatgcgcttatcggcgtcgtttttcagccgtttgaggaggtcaagaaggagctcgagctcgtcccaaccagctctcatgtctctctcgcccgacagaaatactcagacgagtgcgaagctgccattaacgagcagatcaatgtggaatacaatctttcgtatgtgtatcacgctatgtatgcttacttcgatcgggataacgtcgcgctcaaaggtcttgccaaattcttcaaggaatcgagtgtcgaagaaagagagcacgctgagaagttgatggagtatcagaacaaacgtggtgggagagttaagttacagtccattgtaatgcctctctcagagtttgaacacgttgataaaggagatgctctatatggcatggagctggctctgtcactggagaaactagttaatgagaagctcttaaacctccacagtgtcgcttccaagaacggtgatgtccacttggcagattttatcgagagcgagttcttgaccgagcaggtggaagcaatcaagaaaatctcagaatatgtagctcaactacgaagagttggcaaaggacatggaacatggcatttcaatcagatgcttctggaagcgtaagccgaaggaa

SEQ ID NO: 6965 - DNA, 826 bp, Eutrema parvulum
catcctccaattttctcgcggaaaaaaaaactttccactgtttctatcttttgactcaaaatgcttcttaagactgtttcttcttctgctttctcgcttgtgaatttccatggcggaatcaaggatatatctcctttgttatcctccgtttcctctccagtcgattcctcctcgagtcttcgagtttctcctggtaaatctggaaacctctctttctctgttcgcgcatccaagggctcaaccaccgacgcgctaagcggcgtcgttttcgagccgttcgaggaggttaaaaaggagctcgatctcgtcccaaccagctctcatctctcgctcgcccgacataagtactcggacgattgcgaagccgccattaacgagcagatcaatgtggaatacaatctctcgtatgtgtatcacgcgatgtatgcttacttcgaccgggataacatcgcactgaaaggtcttgccaagtttttcaaggaatcgagtgtggaagaaagagagcacgctgagaagttaatggagtatcagaacaaacgtggtgggagggttaagttacagtccattgtagtgcctctctcagagtttgagcacgttgataaaggagatgctctgtatggcatggagctggctctgtcactggagaaactagttaatgagaagctcttaaacctacacagtgttgcttccaagaacggagatgttcacttggcagattttattgagagcgagtttctgaccgagcaggtggaagcaatcaagaaaatctcagaatatgtagctcaactacgaagacttggcaaaggacacggtacgagataatctc

SEQ ID NO: 6966 - DNA, 1793 bp, Brassica napus
atcgacagcaagtagcgaaacttataaaatctccttactttgagctcggatctactgagagataagatggcgatgcgaagaatcaccggagcgatcagagcctcctgcgtttcctcctcttcttctggttattttgccagacagtttcatgcttcttctggagatagcaaaaagattgttggagttttctacaaggccaacgaatacgcttcaaagaatcctaacttccttggctgcgtcgagaacgctttaggtatccgcaactggcttgaatcacaaggtcatcactacatcgtcactgacgacaaagaaggtccaaattgcgagcttgagaagcatatcccagaccttcacgtcctaatatccacccccttccacccggcttacgtcaccgccgagagaatcaagaaggccaagaaccttcagcttctcctcacggccggtattggatccgaccacatcgatctgcaggcggctgcggctgctggactgaccgtggctgaagtcacgggaagcaacgttgtctccgtggcagaagacgagctgatgaggatcttgatcctcatgcgcaacttcgttccggggtacaaccaagtcgtgaatggagagtggaacgtggcaggcattgcttacagagcgtacgatctggaaggcaagacagttggaactgtgggagctggtagaatcgggaagctactgctacagaggctgaagccgttcgggtgcaacttgttgtaccatgacaggcttcagatgggaccggagatggagaaggaaactggtgctaagtatgttgagagtcttgatgagatgcttcctaaatgcgatgttgtagtcgtcaacactcctctcacggagaagacaagaggaatgtttaacaaggagatgatagggaaaatgaagaaaggcgttttgattgtgaacaacgcgagaggagccatcatggataggcaagcggtggtggaggcggttgagagcggacacatcggagggtacagcggagacgtgtgggacccgcagccagcgcctaaggaccatccatggcgttacatgccgaaccaagccatgactcctcacatctctggcaccaccattgatgcccagctacgatatgcggcggggacaaaagacatgttggagaagtatttcaagggagaggacttccctgctcagaactacatcgtcaaggatggtgagcttgctcctcaatacaggtaagctgtttcaactttcagcactatcaagtctcgtctccaaagggcaaagcagacggttaaattaaataaattatcaacgttttgtgctttgttcatttgaaaacattgtaataaaccaacaagacatgtatgtaacgctgctatttcgtgacatttatcttgtctatctatgattcatatgttataatttaaaacaaaatatatatattatatatagagtatttattaggaaggattcgaacaggacgttggtggctacaaccattaagacttgtttcatattaattctagtaggtaaggattagaataggacttggtggctacaaccattaaggcttgcttcacaaatatcctaggatataggtacaaaagaagtaacatgacttggtggcaaccacctattaaggcttgtttcatggaagtctgtccaatcttggtcaatgatcttgacaaatataagcagactttgactaggagagaaattagtagagagagaggatatgaactactgtttatctgcaggtccatatacttgtttagaattccttgcatccgtgggatcgactaccccagtcg

SEQ ID NO: 6967 - DNA, 1511 bp, Brassica napus
agctcaggttatcataagcgatatcacttcgtatcagccattacggccgggacttcttcttcgtcttctccgagtagtggttccacaaaaatatcgacagcaagtagcgaaacttataaaatctccttactttgagctcggatctactgagagataagatggcgatgcgaagaatcaccggagcgatcagagcctcctgcgtttcctcctcttcttctggttattttgccagacagtttcatgcttcttctggagatagcaaaaagattgttggagttttctacaaggccaacgaatacgcttcaaagaatcctaacttccttggctgcgtcgagaacgctttaggtatccgcaactggcttgaatcacaaggtcatcactacatcgtcactgacgacaaagaaggtccaaattgcgagcttgagaagcatatcccagaccttcacgtcctaatatccacccccttccacccggcttacgtcaccgccgagagaatcaagaaggccaagaaccttcagcttctcctcacggccggtattggatccgaccacatcgatctgcaggcggctgcggctgctggactgaccgtggctgaagtcacgggaagcaacgttgtctccgtggcagaagacgagctgatgaggatcttgatcctcatgcgcaacttcgttccggggtacaaccaagtcgtgaatggagagtggaacgtggcaggcattgcttacagagcgtacgatctggaaggcaagacagttggaactgtgggagctggtagaatcgggaagctactgctacagaggctgaagccgttcgggtgcaacttgttgtaccatgacaggcttcagatgggaccggagatggagaaggaaactggtgctaagtatgttgagagtcttgatgagatgcttcctaaatgcgatgttgtagtcgtcaacactcctctcacggagaagacaagaggaatgtttaacaaggagatgatagggaaaatgaagaaaggcgttttgattgtgaacaacgcgagaggagccatcatggataggcaagcggtggtggaggcggttgagagcggacacatcggagggtacagcggagacgtgtgggacccgcagccagcgcctaaggaccatccatggcgttacatgccgaaccaagccatgactcctcacatctctggcaccaccattgatgcccagctacgatatgcggcggggacaaaagacatgttggagaagtatttcaagggagaggacttccctgctcagaactacatcgtcaaggatggtgagcttgctcctcaatacaggtaagctgtttcaactttcagcactatcaagtctcgtctccaaagggcaaagcagacggttaaattaaataaattatcaacgttttgtgctttgttcatttgaaaacattgtaataaaccaacaagacatgtatgtaacgctgctatttcgtgacatttatcttgtctatctaaaaaaaaaagaaaaaaactcgaggggggcccg

SEQ ID NO: 6968 - DNA, 1435 bp, Brassica napus
acgggtactggttctacaaaaatatcgacacgaagtagcgaagtgataaaatctcctcctttgagctcggatctactgagagaatatggcgatgagaagagtcaccagagcagcgatcagggcctcctgcgtttcgtcttcatcttctggttattttgccagaaaatttaatgcttcttctggagatagcaaaaagattgttggagttttctacaaggccaacgaatacgcttcaaagaatcctaacttccttggctgcgtcgagaacgctttaggtatcaggaactggcttgaatcacaaggtcatcactacattgtcactgacgacaaagaaggtccaaattgcgagctcgagaagcatatccctgaccttcacgtcctcatatccaccccattccacccggcttacgtcactgcggaaagaatcaagaaggccaagaaccttcagcttctcctcacagccgggatcggatccgaccacatcgatctgcaggcagctgcagctgctggactgacggtcgctgaagtcacgggaagcaacgttgtctccgtggctgaggacgagctcatgaggatcttgatcctcatgcgcaacttcgttccggggtacaaccaagtcgtgaatggagagtggaacgtggcaggcattgcttatagagcgtatgatctggaaggcaagacggtgggaactgtgggagctggtagaatcgggaagcttttgctacagcggttgaagccgttcgggtgcaacttgttgtaccatgacaggctccagatgggaccggagatggagaaggaaactggtgctaagtatgttgagagtcttgatgagatgctccctaaatgcgacgttgtagtcgtcaacacccctctcactgagaagacaagaggaatgtttaacaaggagatgatagggaaaatgaagaaaggcgttttgattgtgaataacgcgagaggagccatcatggataggcaagcggtggtggaggcggtggagagcggacacatcggaggctacagcggagacgtgtgggacccgcagccggcgcctaaggaccatccatggcgttacatgccgaaccaagccatgactcctcacatctctggcaccaccattgatgctcagctacgatatgcggcggggacgaaagacatgttggagaagtatttcaagggagaggacttccctgctcagaactacatcgttaaggatggtgagcttgctcctcaatacaggtaagcttgtttcaactttcagcactatcaagtcttgtctccaaagggcaaagcagacggttaaattaaataaattatcaacgttttgtgctttgttcatttgaaaacattgtaataaaccaacaagacgtgtatgtaacgttgctatttcatgacatttatctttgagtctatctatgattcatatgttatatttgat

SEQ ID NO: 6969 - DNA, 1436 bp, Brassica rapa
gggggtactggttctacaaaaatatcgacacgaagtagcgaagtgataaaatctcctcctttgagctcggatctactgagagaatatggcgatgagaagagtcaccagagcagcgatcagggcctcctgcgtttcgtcttcatcttctggttattttgccagaaaatttaatgcttcttctggagatagcaaaaagattgttggagttttctacaaggccaacgaatacgcttcaaagaatcctaacttccttggctgcgtcgagaacgctttaggtatcaggaactggcttgaatcacaaggtcatcactacattgtcactgacgacaaagaaggtccaaattgcgagctcgagaagcatatccctgaccttcacgtcctcatatccaccccattccacccggcttacgtcactgcggaaagaatcaagaaggccaagaaccttcagcttctcctcacagccgggatcggatccgaccacatcgatctgcaggcagctgcagctgctggactgacggtcgctgaagtcacgggaagcaacgttgtctccgtggctgaggacgagctcatgaggatcttgatcctcatgcgcaacttcgttccggggtacaaccaagtcgtgaatggagagtggaacgtggcaggcattgcttatagagcgtatgatctggaaggcaagacggtgggaactgtgggagctggtagaatcgggaagcttttgctacagcggttgaagccgttcgggtgcaacttgttgtaccatgacaggctccagatgggaccggagatggagaaggaaactggtgctaagtatgttgagagtcttgatgagatgcttcctaaatgcgacgttgtagtcgtcaacacccctctcactgagaagacaagagggatgttcaataaagagatgatagggaaaatgaagaaaggcgttttgattgtgaacaacgcgagaggagccatcatggataggcaagcggtggtggaggcggtggagagcggacacatcggaggctacagcggagacgtgtgggacccgcagccggctcctaaggaccatccatggcgttacatgccgaaccaagccatgactcctcacatctctggcaccaccattgatgctcagctacgatatgcggcggggacgaaagacatgttggagaagtatttcaagggagaggacttccctgctcagaactacatcgttaaggatggtgagcttgctcctcaatacaggtaagcttgtttcaactttcagcactatcaagtcttgtctccaaagggcaaagcagacggttaaattaaataaattatcaacgttttgtgctttgttcatttgaaaacattgtaataaaccaacaagacgtgtatgtaacgttgctatttcatgacatttatctttgagtctatctatatgattcatatgttataaaaaa

SEQ ID NO: 6970 - DNA, 1447 bp, Brassica napus
tcttcctcttctacgggtactggttctacaaaaatatcgacacgaagtagcgaagtgataaaatctcctcctttgagctcggatctactgagagaatatggcgatgagaagagtcaccagagcagcgatcagggcctcctgcgtttcgtcttcatcttctggttattttgccagaaaatttaatgcttcttctggagatagcaaaaagattgttggagttttctacaaggccaacgaatacgcttcaaagaatcctaacttccttggctgcgtcgagaacgctttaggtatcaggaactggcttgaatcacaaggtcatcactacattgtcactgacgacaaagaaggtccaaattgcgagctcgagaagcatatccctgaccttcacgtcctcatatccaccccattccacccggcttacgtcactgcggaaagaatcaagaaggccaagaaccttcagcttctcctcacagccgggatcggatccgaccacatcgatctgcaggcagctgcagctgctggactgacggtcgctgaagtcacgggaagcaacgttgtctccgtggctgaggacgagctcatgaggatcttgatcctcatgcgcaacttcgttccggggtacaaccaagtcgtgaatggagagtggaacgtggcaggcattgcttatagagcgtatgatctggaaggcaagacggtgggaactgtgggagctggtagaatcgggaagcttttgctacagcggttgaagccgttcgggtgcaacttgttgtaccatgacaggctccagatgggaccggagatggagaaggaaactggtgctaagtatgttgagagtcttgatgagatgcttcctaaatgcgacgttgtagtcgtcaacacccctctcactgagaagacaagagggatgttcaataaagagatgatagggaaaatgaagaaaggcgttttgattgtgaacaacgcgagaggagccatcatggataggcaagcggtggtggaggcggtggagagcggacacatcggaggctacagcggagacgtgtgggacccgcagccggctcctaaggaccatccatggcgttacatgccgaaccaagccatgactcctcacatctctggcaccaccattgatgctcagctacgatatgcggcggggacgaaagacatgttggagaagtatttcaagggagaggacttccctgctcagaactacatcgttaaggatggtgagcttgctcctcaatacaggtaagcttgtttcaactttcagcactatcaagtcttgtctccaaagggcaaagcagacggttaaattaaataaattatcaacgttttgtgctttgttcatttgaaaacattgtaataaaccaacaagacgtgtatgtaacgttgctatttcatgacatttatctttgagtctatctatatgattcatatgttatatttg

SEQ ID NO: 6971 - DNA, 1480 bp, Eutrema parvulum
tagtgattctacaaaaaaaacaaagcaagtaacgaaattgataacaatctccttttaaactcttgagagctgatctactgagaagatggcgatgcgacgagccaccggagcagcgatcagagcctgtgtttcctcttcttcttcgggttactttgcgcgccaatttcatgcttcttctggtgatagcaaaaaagttgttggagttttctacaaggccaacgaatatgcttccaaaaaccctaacttccttggctgtgtcgagaatgccttaggaatccgtgactggctagaatcacaaggtcatcactacattgtcaccgacgacaaagaaggcccagactgtgaacttgagaaacatatcccggatcttcacgtcttaatatccaccccttttcacccggcttatgtgactgctgaaagaatcaagaaagccaagaacttgcagcttctcctcacggctggtattggctccgatcacatcgacttgcaggcagctgcagctgctggactgacggtagctgaagtcactggaagcaacgtggtctcggtagcagaagacgagctcatgagaatcctgattctcatgcgcaacttcgtaccagggtacaatcaggtcatcaatggggagtggaacgttgcgggcattgcgtatagagcttatgatctggaagggaagacgataggaactgtaggagcgggaagaattggaaagcttttgctacagcggttgaaaccattcgggtgcaacttattgtaccatgaccggcttcagatggaaccagagctggaaaaagagattggagctaagtacatggagaatctgaatgaaatgctcccaaagtgcgacgttgtagtcgtcaacactcctctcacggagaagacaagaggaatgttcaacagagagatgatagggaaaatgaagaaaggcgttctgatagtgaacaacgcaagaggagccatcatggacagacaagcggttgtggatgcggtggagagtggacacattggagggtacagtggagacgtgtgggacccacagccagctcctaaagaccatccatggcgttacatgcctaaccaagccatgacccctcacatctctggcaccaccatcgatgcccagctgcgatatgccgcggggacgaaagatatgttggagaggtattttaaaggagaagactttcctgcccaaaattacatcgtcaaggacggtgaacttgctcctcagtacaggtaaagcgttctcaactctcaagtcttgtatccagagggcaaagtttacaattaaattaaataaaatgtcctattatttgtccatttgaaaaaaaaaattgtaataaatcaacaagacatgtaacattaacatttcatgacatttaggttgagtctatatctatgatgatgcatttatatatttgctctttgagtttaaccgggaattggtgtagctggttaataatctaattgactgagtgctggt

SEQ ID NO: 6972 - DNA, 1459 bp, Eutrema halophilum
attgataataatctccacttaactttgagagccgatctactcagaagatggcgctgcgacgagccaccagagcagcgatcagagcctgtgtttcctcttcttcttcgggctacttcgcacgtcagttacatgcttcttctggtgatagcaaaaagattgttggggtcttctacaaggccaacgaatacgcttccaagaatcctaacttccttggctgcgtggagaatgctttaggaatccgcaactggctagaatcacaaggtcatcagtacattgtcaccgatgacaaagaaggcccagactgtgaacttgagaaacatatcccggaccttcacgtcttaatatccaccccttttcacccggcttatgtgactgctgaaagaatcaagaaagccaagaacctgcagcttctcctcacggctggtattggctccgatcatatcgatctgcaggcggctgcagctgctggcctgactgtggctgaagtcactggaagcaacgttgtctcggtagcagaagatgagctgatgagaatcctgattctcatgcgaaacttcttaccagggtacaatcaggtcatcaatggagagtggaacgttgctggcattgcctatagggcttatgatctagaagggaagacagtaggaaccgttggagctggaagaatcggaaggcttttgctacagagattgaaacccttcgggtgtaacttattgtaccatgacaggcttcagatggaaccagagctggagaaagagattggtgctaagtacgttgagaatctcaatgaaatgctccctaaatgcgacgtcgtagttgtcaacactcctctcacggagaagacaagaggaatgttcaacagagagatgatagggaaaatgaagagtggcgttttgatagtgaacaacgcaagaggagccatcatggacaggcaagcggtggtggaggcggtcgagagtggacacattggagggtacagcggagacgtgtgggacccacagccagctcctaaggaccatccatggcgttacatgcctaaccaagcaatgacccctcacatctccggcaccaccattgatgctcagctacgatatgcggctgggacaaaagacatgttggagaggtactttaaaggagaagacttccctgcccagaattacatcgtcaaggacggtgaacttgctcctcagtacagataagctttttcaactctcaagtcttttgtatgcaaagggcaaagcttactattaaataaataaatcatctatgatatgatatctcccgttgtcctttcgaaaaattgtaaaagaccaacaagaaatgtaacgttaatattattattacatttatgttgagcctagctatgatgatgcgtatattatatttgatctttgagtcgaacccgaaatcggtggaactcaaaaagacaaaaagactccaattgactgtgggctggttt

SEQ ID NO: 6973 - DNA, 1556 bp, Arabidopsis lyrata
atttcgtcctatataaatcctctcttctccaattagtgaatttcacacaaaaacaaatcgaccaaagtaaccaaattgatatttatctcttctcaaccatggcgatgagacaagccactaaggctgcgatcagagcatgtgtttcctcttcttcttcgggttacttcgctcgacgtcaatttaatgcatcttctggtgatagcaaaaagattgtgggagttttctacaaggccaacgaatacgctaccaagaaccctaacttccttggctgcgtcgagaatgccctaggaatccgcgactggcttgaatcacaaggacatcagtacatcgtcactgatgacaaagaaggccctgactgcgaacttgagaaacatatcccggatcttcacgtcctaatctccactcctttccaccctgcttatgtgactgctgaaagaatcaagaaagccaagaacctcaagcttctcctcacggctggtattggttcagatcacattgatctccaggcagctgcagctgctggcctgacggttgctgaagtcacgggaagcaacgtggtctcagtagccgaagatgagctcatgagaatcctcatcctcatgcgcaacttcgtaccagggtacaaccaggttgtcaaaggcgagtggaacgtcgcgggcattgcatacagagcttatgatcttgaagggaagacgatcggaactgtgggagctggaagaatcggaaagcttttgctgcagcggttgaaaccattcgggtgcaatttattgtaccatgacagacttcagatggcaccagagctggagaaagagattggagctaagttcgttgaggatctgaatgaaatgctccctaaatgtgacgttgtagtcatcaacatgcctcttacggagaagacaagaggaatgttcaacaaagagttgatagggaaattgaagaaaggcgttttgatagtgaacaatgcaagaggtgccatcatggataggcaagcagtggtggaggcggtagagagtggacacattggagggtacagcggagacgtttgggacccacagccagctcctaaggaccatccatggcgttacatgcctaaccaagccatgacccctcatacctccggcaccaccattgacgctcagctacgatatgcggccgggacgaaagacatgttggagaggtactttaagggagaagacttccctgctcagaattacattgtcaaggacggtgaacttgctcctcagtaccggtaagcttttgaggaggtgagattgggaagatgatgagaaacgacctcaacgttcaagaaaacaaataaaaaagtatttcgactttgctaagtcgaataacttggccatcttttcgtttagtttttgttatttcataagcagaataaatataggagggcacttacttcccctgttccgagagtttgtgaacgtattcctttagtagtttaaatcacatacagtttatgtatttgtttccccaattgtaggaactcaatggttccaaatctcattatataaaactttaacaataaaaatgaataaagg

SEQ ID NO: 6974 - DNA, 1758 bp, Brassica napus
gaaatggagaactaaatccgataaatataatagatatcttaattaactcagaaataaatctccagttaatcagtatgaaaaagcaaaaatgcttagaaatctttccctcttaaagattcagagactgagaaaagagagaaatatatgacttgaatacttatgatttggtcatgaaatttacacttaattatcagaaaacatcaataccaaattagtacaatatggctcgatagccgtcggttatatcttctttgccacgtgtcacgttgtagctgggttggacaaagggacgatttggttttggttcatcaggtgcgtgaactttcatcaactaagtgtatataagtagttgtctcttctccttcccattagtaagtctaccaaggaagtaaccaaattgataataaactctcttttatctcttcagctgttctattgagaatgatggctatgagacgtttcaccggggcggcgatcagggcctgttcttcctcttcgtcttctggctactttgctcgccaccttcatgcttcttctggtgagagcaaaaagattgttggagttttctacaaggccaacgaatacgcttccaagaaccctaacttcctcggctgcgtcgagaactccttaggaatccgcaactggcttgaatcacaaggacatcagtacattgtcactaacgacaaagaaggtccagactgcgaacttgagaagcacatcccggatctccatgtcttgatatccaccccatttcacccggcttacgtgactgcggaaaggatcaagaaagccaagaacctgcagcttctcctcactgctggtattggatccgaccacattgacctacaggcagctgcagctgctgaactgacggtggctgaagtcactggaagcaacgtggtctcggtagcagaagatgagctgatgagaatcctgatcctcatgcgcaactttgtaccggggtacaaccaggtcgttaatggggaatggaacgttgcggggattgcgtatagagcgtatgatcttgaagggaagacgataggaaccgtaggagctggaagaatcgggaagcttttgcttcagcggttgaaaccattcgggtgcaacttattgtaccatgacaggcttcagatggagcctgagctggagaaagagattggtgctaactacgttgagaacttgaatgaaatgcttcctaagtgtgatgttgtggttcttaacatgcctctcacggagaagacaagaggaatgttcaacaaagagatgatagggaaaatgaagaagggagttttgatagtgaacaatgcaagaggagccatcatggacaggcaagctgtggtggaagcgatggagagtggacagatcggagggtatagcggagacgtttgggacccacagccagcacctaaggaccatccatggcgttacatgcctaaccaagccatgacccctcacatctctggcaccaccatggatgcacagatacgttatgcggcggggacgaaagacatgttggagaagtacttcaagggagaagacttccttgctcagaattacattgtcaaggatggtgtgattgctcctcagtacatgtaagcagtttttttcaactttcaagtcttgtaagctgtatccaaaggacacaagcttacaatgaaccaaataaattctcaataagttgtccctttttccatttagaaaaaattgtaataagacatgtaatgtaacgtacgttatgatttcatgacatatgttctt

SEQ ID NO: 6975 - DNA, 1182 bp, Eutrema parvulum
tcatatattgaaaaaatggctatgcaattagctaccaaaagagcaatcagaacatgtatttcctcattttcttcaggtcattttacgcgtcatgttcacgcaaattctggtgaaacaaaaaagattgttggagttttctacaaggccaacgaatacgcttccaagaacccaaactttcttggttgtgtcgagaacgctttaggcatccgtgaatggcttgaatcacaaggacatcagtacaccgtcaccgatgacaaagaaggcccaaactgtgaacttgagaaacatatcccggatcttcacgtcttgatatccactcctttccacccggcgtacatgaatgctgaaagaatcaagaaagccaagaacctgaagcttctcctcacggctggtattggatcggatcacgtcgatctgcatgcagctgctgctgctggtctgacagttgctgaggtcactggaagtaatgtggtctctgtagcagaagatgagctcatgagaatcctaatcctcatgcgtaactttgtaaccgggtataaccaagtcgtcaatggtgagtggaacgtggcaggtattgcgtatagagcttatgatctacaagggaagacaataggaactgttggagctggaagaatcggaaagcttctactacaacggttgaaaccgtttggttgtaacttgttgtaccatgatcggcttcagatggaaccagagctggagaaagagattggagctaagcacatggagaatctgaatgaaatgattactaaatgtgacgtagtagtcatcaacatgcctcttacagagaagacaagaggaatgttcaacaaagagatgatcgggaaaatgaagagaggcgttttgattgtaaacaacgcaagagcggccatcacggagaggcaagcggtcgtggaggcgatggagagtggacatattggtgggtacagtggagatgtttgggatccacaaccagctgataaagaccatccatggcgttacatgcctaaccaagccatgactcctcacatctcaggcaccactatcgacgctcagctacgatatgcagcagggacaaaagacatgttggagaaatactttaagggtgaagacttccctattgagaattacatcgtcaaggacggtgaacttgctcctcagtataagtaagcctttttcgattat

SEQ ID NO: 6976 - DNA, 1251 bp, Eutrema halophilum
aaatggcaatgcaacgagccaccggagcaatggtcagagcctgtgcttcctctttttcttcaggttacttggcacgtcactttcatgcatcttccggtgatacaaaaaagattgttggagttttctacaaggccaacaaatacgcttccaagaatcctaacttccttggctgtgtcgagaatgctttaggaatccgcgactggcttgaatcacaaggacatcaatacatcgtcactgatgacaaagaaggcccaaactgcgaacttgagaaacatatcccggatcttcacgtgctaatatcaactcctttcaatccggcatatgtaactgctgaaagaatcaagaaagccaagaacttgcagcttctcctcagagctggcattggctccgatcacatcgacctgaaggcagcagcagctgctggtctaacggttgctgaagtcactggaagcaacgtggtctctgtagcagaagacgagctcatgagaatcctgatcctcatgcgcaacttcgtaccagggcaccagcagatcatcaatggcgagtggaacgtcgcgggcattgcacacagagcttatgatctagaagggaagacggtaggaactgtgggagctggaagaatcggaaggcttcttttacaaaggttgaaaccatttgggcatgaccggcttcagatggaacaagagctggaggaagagattggagctaaacacatggagaatctgaatgaaatggttaccaaatgtgatgtcatagtcatcaacactcctctcacagagaagacaagaggaatgttcaacaaagagatgatagggagaatgaagaaaggggttttgatagtgaacaatgcgagagcagccatcatggagaggcaagcggtggttgaagcggcggagagtggacacattggagggtacagtggagatgtgtgggacccgcaaccagctcctaaggaccatccatggcgttacatgcctaaccaagccatgactcctcacatctccggcaccaccattgatgctcagctacgatatgcagcagggaccaaagacatgttggacaggttctttaaaggggaagacttccctgcgcagaattacatcgtcaaggatggtgaaattgctcctcagtacgtgtgagcttttttcgactattaaaatctcatatccaaactggacaaagcaaagcttactatactaaataaattttgtctatttgaaatcgttgtaataaaacaagaagacgacgtgt

SEQ ID NO: 6977 - DNA, 1459 bp, Mesembryanthemum crystallinum
ttcacttcatagttgtgaggagagagaaaaaacaaaaaagtaaaaatggcgatgaagcgtgctactgcctctgctatcagagctatggtggcttcttctacaaattcatccacaattctcagcaggaatcttcatgcttcttctgatagcaagaagattgttggtgttttctacaaagcaaatgaatatgcagcaatgaatcccaactttgtaggctgcgtggaaggtgccctcggtatacgagaatggctggaatcacagggacaccagtatattgttacagatgataaagatggaccagattctgaactggagaagcatattccagatcttcatgtcctcatcagcacaccttttcacccagcgtatgttacggccgaacgaatcaagagagcaaagaacttgcagctattactcacagctggaattggctctgatcacattgacctgcaagctgctgctgctgcgggtttaacagttgctgaggttactggaagcaatgtggtctccgttgcagaagatgagctgatgaggatcctcatacttgtcaggaacttcgtgccaggataccatcaagttatcaatggtgaatggaacgttgctggtattgcttacagagcttatgaccttgaaggcaaaactattggaactgttggtgctggacggattggcaagcttttgcttcaaagattgaagccattcaattgtaatctactctatcatgaccgaatcaagatggacccagagttggagaatcagacgggggcaaagtatgaggaggatctcgagaagatgcttccgaaatgtgatgttgttgtcatgaacatgcctctcactgagaaaacgaaaggaatgttcaacaaggaaatgattgcaaagatgaagaagggagttctaattgttaacaatgcccggggagcacttatggacacccaagctgtagttgatgcttgctcaagtggtcatattgctggatacagtggggatgtttggtacccacaaccagctcctaaggatcatccatggcgatacatgccaaaccaggccatgacgcctcatatttctggcaccaccattgatgcacagttgcgttatgctgctggtgtcaaggatatgctggacaggtacttcaaaggtgaagccttccctcctcagcattacattgttaacgaaggtgaattggctccccagtatcgctaattgcttggtcgtatgtttgccaagggcttgttcaaccagagcaaccggacgtcttaagaacccgtatatgaaataattgagacctagtgtgggtttcatttgttcttggcatggatttgtaaggctcaaagcgtgtcagatttgtgctaatttatttccctattgttgtgttaatctgtattgtgtgcagtattagtaagtttctattcgatgtcaagaagaaactaactctttccattggatcaaagatttccccgct

SEQ ID NO: 6978 - DNA, 1320 bp, Fraxinus spp
actgtcgttaatataaaaactctcaatcgagatcatggcgatgaagcgtgtaactacttctgcaattcgtgctcttacttcttcaattctcaccagagaactccatgcaacacccgggagcaagaagattgttggggtattttacaaggcaaacgaatatgcatccatgacccaaattttctgggatgcgtcgagaatgcattgggtatacgtaattgttggaatcacaaggtcaccagtacatagttactcctgacaaaaagggccagattgtgaacttgagaaacatattcctgatctccatgtgctgataacgacccccttccacccagcttatgttacggctgaaaggattaaaaaggcaaaaaatctgcaactgttgctcacagctggaattggctcagatcatgttgatctgaaagctgcagctgatgctggtttaactgtggcagaagtcaccgcaagcaatgtcgtctcagttgcagaggatgaactcatgagaactctcattcttgttcggaatttcctccctggacaccatcaggttattactggggattggaatgttgcagctattgctcaccgagcttatgatcttgaaggcaagactgttggaacgtttggagcaggacgtatcggcagacttttgctacagagattgaaaccttttaactgtaatctactctaccatgatcgcattaaaatagatccagagttggagagtcaattaggagctaagtttgaggaagatcttgatgcaatgcttcccaaatgtgacataattgtcattaacacccctcttactgagaaaacaaaagggatgtttaacaaagaaaggatagctaagctgaagaagggagttctaatagtaaacaatgctagaggtgcaatcatggacacacaggcagtagttgatgcgtgctccagtgggcacattgcaggttacagtggggatgtttggaacccgcaaccagctccaaaggatcacccctggcgttacatgccaaaccaagctatgacccctcacatatctggaacaaccattgacgcacagttgcggtatgcagccggaaccaaggacatgctcgagaggtatttcaagggagaggatttccctccacagaactacattgtcaaggacggagaactagccagccagtaccgttagatgcctcaacttgtcgagtcatgtaatatgtagctgtttgctactttaataaatcaatgttgtgggtaataatttccatcccggaaagtagtaacaagagttagttttgtatggatacataattttgtagtatgaccgttctgtcttgtcga

SEQ ID NO: 6979 - DNA, 1344 bp, Phalaenopsis aphrodite
gcagagcactgatcaacgatcaggatgtggcgggcagcatcaaagcaagtgatccggactgtcggttcctccctctccgacctttcgcctctccggaagcagctccatgcttctccagggaaaaagaaaatagtgggcgtgttctataaggggaacgagtatgcagcgaagaaccctaattttttggggacggtggagagggctttgggaatcagagagtggttggaaagtcaaggccaccagtacattgttactgatgataaagatggacccaattccgaacttgagaagcacattcctgacctccatgttctaatcaccacccccttccacccggcatacgtcaccgccgaacgaatcaaaaaagccaaaaacctccaactcctcttaactgccggcatcggctccgatcacattgatctcaaagccgccgccgacgcgaagctcaccgtcgccgaagtcaccggaagcaatgtcgtgtccgtcgccgaagacgagctcatgagaattctcattctcgttcgaaacttcgttcccggttatcaacaggtcatcaatggcgattggaacgtagccgcaatctcttatcgggcttacgacctcgaaggcaagaccgtcggaaccgtcggcgccggccgaataggaaagcttttgctgcagcggttgaagccgtttaattgcaatctcctctatcacgatcggttgaagatcgatccagagttggagaaggagattggagcgaagtttgaggaagatcttgatgtcatgcttcccaaatgtgatgttgttgtgatcaatacacctcttactgagaagacaaagggattgtttgataaggaaagaatttcaaagttgaagaagggagttcttattgttaataatgctagaggagctattatggatactcaggcagtagtggatgcttgcaacagtggacatattgcaggctacagtggtgatgtgtggaatccacagccagctccaaaagatcacccatggagatacatgccaaaccaggccatgactcctcatgtttcaggcacaaccattgatggccaactgaggtatgcggctggggtgaaggacatgcttgacaaatacttcaaaggagaagactttcctcagcagaactatattgtgaaggaaggcaaacttgcaagccagtacctgtgaatctgtgattttcactctctactcggtctgaggggcagctgccttattatatgattatataaataaccctttgctggtggagttagtctggtctctgtattttctcttgtttgatgctttgagtgtgggtgtgaagtagtttctatggtgtttaatgcaaataaaattcta

SEQ ID NO: 6980 - DNA, 1986 bp, Phalaenopsis aphrodite
ccgaaagacctaaacggaaatttacgtaggttaccctaaggtacgtttaaagtaaaacgtaaaactaaagaccacgagtagtagtcgtaacacttaaaaggacgttaggcaaatagcctttaccgttggaaaatggaaatagaggagagacgaaggagagggcaactgccacacggagagcaaatcttcatttttagcactctcccatcactttgcagagcactgatcaacgatcaggatgtggcgggcagcatcaaagcaagtgatccggactgtcggttcctccctctccgacctttcgcctctccggaagcagctccatgcttctcctgggaaaaagaaaatagtgggcgtgttctataaggggaacgagtatgcagcgaagaaccctaattttttggggacggtggagagggctttgggaatcagagagtggttggaaagtcaaggccaccagtacattgttactgatgataaagatggacctaattccgaacttgagaagcacattcctgacctccatgttctaatcaccacccccttccacccggcatacgtcaccgccgaacgaatcaaaaaagccaaaaacctccaactcctcctaaccgccggcatcggctccgaccacattgatctcaaagccgccgccgacgcgaagctcaccgttgccgaagtcaccggaagcaatgttgtgtccgtcgccgaagacgagctcatgagaattctcattctcgttcgaaacttcgttcctggttatcaacaggtcatcaatggcgattggaacgtagccgcaatctcttatcgggcttacgacctcgaaggcaagaccgtcggaaccgtcggcgccggccgaataggaaagcttttgctgcagcggttgaagccgtttaattgcaatctcctctatcacgatcgactgaagatcgatccggagttggagaaggagatcggagcgaagtttgaggaagatcttgatgtcatgcttcccaaatgtgatgttgttgtgatcaatacacctcttactgagaagacaaagggattgtttgataaggaaagaatttcaaagttgaagaagggagttcttattgttaataatgctagaggagctattatggatactcaggcagtagtggatgcttgcaacagtggacatattgcaggctacagtggtgatgtgtggaatccacagccagctccaaaagatcacccatggagatacatgccaaaccaggccatgactcctcatgtttcaggcacaaccattgatggccaactgaggtatgcggctggtgtgaaggacatgcttgacaaatacttcaaaggagaagactttcctcagcagaactatattgtgaaggaaggcaaacttgcaagccagtacctgtgaatctgtgattttgactttctactcggtctgaggggcagctgccttattatatgattatctaaataaccctttgctggtggagttagtctggtctctgtattttctcttgtttgatgctttgagtgtgggtgtgaagtaatttctatggtgtttaatgcaaataaatttctagaaattgttggggtgttattgcctatattactttttatttagtttttgcaatagtatattataggaaaatttgcatagatggtaatatccgttatatccatcaagattgtcaattctaatccagtgattagtgcttcatactctgtttcgttgtttgtacacggctctgtcagatggtagaagaatctcaacatgcatatttctgaaaaattaagacacgtgatatttttatgtggtatgaaagatttggggttactaatgtaaagattaaggtgtaggcggtagatatgtaaatatataaaattggtggtatttgtagatgccctatttatttatgtgtattgctcaattacgaaaatagaagaaaagatggatctatgggaatgtatgtaattttatgtatttatattaacataaagtatgtattc

SEQ ID NO: 6981 - DNA, 1297 bp, Phalaenopsis aphrodite
aacgatcaggatgtggcgggcagcatcaaagcaagtgatccggactgtcggttcctccctctccgacctctcccctctccggaagcagctccatgcttctcctgggaaaaagaaaatagtgggcgtgttctataaggggaacgagtatgcagcgaagaaccctaattttttggggacggtggagagggctttgggaatcagagagtggttggaaagtcaaggccaccagtacattgttactgatgataaagatggacctaattccgaacttgagaagcacattcctgacctccatgttctaatcaccacccccttccacccggcatacgtcaccgccgaacgaatcaaaaaagccaaaaacctccaactcctcctaaccgccggcatcggctccgaccacattgatctcaaagccgccgccgacgcgaagctcaccgttgccgaagtcaccggaagcaatgttgtgtccgtcgccgaagacgagctcatgagaattctcattctcgttcgaaacttcgttcctggttatcaacaggtcatcaatggcgattggaacgtagccgcaatctcttatcgggcttacgacctcgaaggcaagaccgtcggaaccgtcggcgccggccgaataggaaagcttttgctgcagcggttgaagccgtttaattgcaatctcctctatcacgatcgactgaagatcgatccggagttggagaaggagatcggagcgaagtttgaggaagatcttgatgtcatgcttcccaaatgtgatgttgttgtgatcaatacacctcttactgagaagacaaagggattgtttgataaggaaagaatttcaaagttgaagaagggagttcttattgttaataatgctagaggagctattatggatactcaggcagtagtggatgcttgcaacagtggacatattgcaggctacagtggtgatgtgtggaatccacagccagctccaaaagatcacccatggagatacatgccaaaccaggccatgactcctcatgtttcaggcacaaccattgatggccaactgaggtatgcggctggtgtgaaggacatgcttgacaaatacttcaaaggagaagactttcctcagcagaactatattgtgaaggaaggcaaacttgcaagccagtacctgtgaatctgtgattttgactttctactcggtctgaggggcagctgccttattatatgattatctaaataaccctttgctggtggagttagtctggtctctgtattttctcttgtttgatgctttgagtgtgggtgtgaagta

SEQ ID NO: 6982 - DNA, 1752 bp, Brassica napus
gaagaataaagaaactatacacatatttacccaattgcttgtgaatgtataatatactttccatactttccatataatatgattgaattttaaccctcttccaaggaagtatattatatatatatggcatagaatacaagaaacgcccatcatattatcatctcctctctgatccagcgagaaaaacaaaacaaaaagccaaaatgggtgcagacgcaatccaaacgaacggtggtgatcccgccaagttaaccgtcgtagaagggatcaaacggttgagatgcgccgtgaagaactacgagtggggcaaactcgggcacgactcactggttgcgagactccacgaggccaattcagggaaccgtgtcgacccggcggttcctcacgccgagttgtggatgggtactcacgagtcaggcccgagtcacgttgtaaaggaagaggaactcgggtcgggtcatggtgggtccgaatgcatggttacgttgaagtcgtgggtttcggataacccggatgtgctcgggtctagagccgtggacaaatggggatgtgatcttcctttcctcttcaagcttttgtcagtgacaaaagcgttgtcgattcaagcacatccaaacagggcattagcagagaaattgcatagagaagagcctcttctttacagagatgctaaccataagcctgagatcgcgctggcaattactccttttcaagcactttgtggtttcgtatctcttaaggaactaaaggaagtgattgccaatgtaccagagatcacagagctcgttggaagtaaagctgcagatcaaatcttcaccgtcaacgaaaaagacggagacgagagtataaaatccgttgtccgtttgatcttcacacagttaatgtctgcaagtaacaatgagacgaaacgagtcatatctgagatgaagatgcgtctaatcacggagacaaaccaccgtgagctatctgagaaggagaagttaattttggaactagagaaacagtatccaggtgacgtaggcgtgatctcagctttcttttttaactacgtcaagcttaatcccggagaggctttgtatttggatgcggacgagccacacgcttacatctccggcgactgtgtcgagtgtatggcggcttcagacaacgttgttagagcaggtctcactcctaaacaccgcgatgttcagacgctatgctctatgcttacctataaactgggctacccggagattttgaaaggatttcctctgactccatacattacaagatatcttcccccatttgatgaatttgaagtggaccattgtgatcttcctacagggaaatcgacgatttttccggccatacccgggccttcggtttatctggttatagaaggaacagggaaactgcaaaccggttcatctcaattgttggttaaccgaggagatgttttgtttgttccggctcataacgagattcaggtaacaggagaaagtgatgtgataaagctttacagagctggagtcagcagcagattcttccagacactctagccaaagtataaatacatttatacatttgtttctttatttctacatataaccatagggatcaatgcgctgatgtgatcatagtatatcttggtccatgttctttattttcccaatggcctactgcgtattaaggttttaacgagttgttatattttattaacttctgttctttcactttataaccgaatttatatgtaaaatgatttaaaaacga

SEQ ID NO: 6983 - DNA, 1484 bp, Brassica napus
tgcagacgcaatccaaacgaacggtggtgatcccgccaagttaaccgtcgtagaagggatcaaacggttgagatgcgccgtgaagaactacgagtggggcaaactcgggcatgactcactggttgcgagactccacgaggccaattcagggaaccgtgtcgacccggcggttcctcacgccgagttgtggatgggtactcacgagtcaggcccgagtcacgttgtaaaggaagaggaactcgggtcgggtcatggtgggtccgaatgcatggttacgttgaagtcgtgggtttcggataacccggatgtgctcgggtctagagccgtggacaaatggggatgtgatcttcctttcctcttcaagcttttgtcagtgacaaaagcgttgtcgattcaagcacatccaaacagggcattagcagagaaattgcatagagaagagcctcttctttacagagatgctaaccataagcctgagatcgcgctggcaattactccttttcaagcactttgtggtttcgtatctcttaaggaactaaaggaagtgattgccaatgtaccagagatcacagagctcgttggaagtaaagctgcagatcaaatcttcacggtcaacgaaaaagacggagaggagagtgtaaaatctgttgtccgtttgatcttcacacagttaatgtctgcaactaacaatgagacgaagcgagtcatatctgagatgaagatgcgtctaatcacggagacaaaccaccgtgaactatctgagaaggagaagttagttttggaactagagaaacagtatccaggtgacgtaggcgtgatctcagctttcttttttaactacgtcaagcttaatcccggagaggctttgtatttggatgcggacgagccacacgcttacatctccggcgactgtgtcgagtgtatggcggcttcagacaacgttgttagagcaggtctcactcctaaacaccgcgatgtccagacgctatgctctatgcttacctataaactgggctacccggagattttgaaaggatttcctctgactccatacattacaagatatcttcccccatttgatgaatttgaagtggaccattgtgatcttcctacagggaaatcgacgatttttccggccatacccgggccttcggtttatctggttatagaaggaacagggaaactgcaaaccggttcatctcaattgttggttaaccgaggagatgttttgtttgttccggctcataacgagattcaggtaacaggagaaagtgatgtgataaagctttacagagctggagtcagcagcagattcttccagacactctagccaaagtataaatacatttatacatttgtttctttatttctacatataaccatagggatcaatgcgctgatgtgatcatagtatatcttggtccatgttctttattttcccaatggcctactgcgtattaaggttttaacgagttgttatattt

SEQ ID NO: 6984 - DNA, 1739 bp, Eutrema parvulum
caagaataaataaactatacacatatttactccattgcttctgaaatgtataatattctttccatataatatgatatgaaattttaatactcaaacaaggagttatattatatatatagcatataagaaaagcccatcatcatattatcatcttctctgattcaacgagcaaaaactaaataaaaggccaaaaatgggtgcagacgcaatcccaatgaacggtcgtgatcccgcaaagttaaccgtcgtagaagggattcaacggttgagatgcgccgtcaagaactatgaatggggcaaactcggaccggactcactcgttgctagactccatgaggcgaattcagggcagcgagtcgactcgatggttcctcacgccgagttgtggatgggtactcacgagtcaggaccgagtcacgtcgtgaaggaagatgaattcgggtcgggtcatgatgtgtccgttacgttgaaatcgtgggtttcggataatccggatttactcgggtctagagtcgtggaccagtggggttttgatcttcctttcctcttcaaggttttgtcagtgacaaaagcgttgtcgattcaagcacatccaaacaaggctttagcagagacgttgcatagagaagatcctcttctttaccgagatgctaatcataagcctgagattgctctcgcagttactccttttcaagctctttgtggtttcgtatcacttaaggagctgaaggaagtgatcgcgactgtaccagagatcacagagctcgtcggaagtaaagctgcagatcaaatcttcaccgtcaacgagaaagacggagacgagagtattaaatccgtcgtccgtttaatcttcacacagttaatgtctgcaagtaacaatgagacaaagcaagtcatatctcagatgaagattcgtctaatctcggagacaaaacatcgtgaactgtcggagaaggagaagttagttttggaactagagaaacagtatccaggtgacataggcgtgatctcagctttcttctttaactacgtcaagcttaaacccggagaagctttgtatttggacgcgaacgagccgcatgcttacatctccggcgactgtgtagagtgtatggcggcttcagacaacgttgttagagctggtctcactccgaaacaccgtgatgttcaaacgctctgctctatgcttacatataaactggaatacccgaagattttgaaaggatttcttctgactccatacataacgagatatcttcctccatttgatgagtttgaagtggaccattgtgatcttcctacagggaactcaacaatttttccggccatcccggggccatcggtttatctggttatagaaggacaagggaagttgcaaaccggtttatctcaattgttggttaaccgaggagatgttttgtttgttcctgctcataatgagattcacctaacaacaggacaaagtgatgtgatgaagctttacagagctggagttagcagcagattcttccaaacattgtagccaaaaagtacagatatctttaatttgttatctaaatatagctgttgttatcaatgtgctgacctgattattgtccttattggtccatgttctttaataccccaaattgtgaatcaaaggttcaagggtttataatttttgtattaataacataaatgttcctttataaccgattatatatgtaaaatgattaccaaacaattttgttttttctttt

SEQ ID NO: 6985 - DNA, 1787 bp, Eutrema halophilum
caagaataaagaaactacacatatttttactccattgcttctgaatttatataattctttccatttaatatgattgagtttttatccctctaacaaggaaaaatattatatatagatacaaggaaagcccatttcattatctatcttctctttgattcagcgagcgaaataaaaacaaaaggccaaaaatgggtgcagacgcaatccaaacgaacggtcacgatcccgccaagttaaccgccgcgagagggatccaacggttgagatgcgccgtgaagaactacgagtggggcaaactcggaccggactcacttgttgcgaggctccacgaggcgaattcaggggaccgagtcgacccggtggttcctcacgccgagttgtggatgggtactcacgagtcggcaccgagttacgttgtgaaggaagaagaattcgggtcgggtcgtaatggatccgaatgcatggttacattgaaatcatgggttttggattatccgaatttactcgggtctagagtcgtggacaaatggggttgtgatcttcctttcctcttcaaggttttgtcagtgacgaaagcattgtcgattcaagcacatccaaacaaagccttagcagagaaattgcatagagaagatcctcttctttacagagatgctaaccataagcctgagattgctctcgccattactccttttcaagctctttgtggtttcgtatctcttaatgagctgaaggaagccatcgccaatgtaccagaaatcacagagcttgtcggaagtaaagcagcagatcaaatcttcaaagtcaacgaacacgatggagacgaaacaagtgttaaatccgttgtccgtttgattttcacgcaattgatgtctgcaaacatcaatgatacaaagcaagtcatatcacagatgaagattcgtctgatctcagaaacaaaccaccgtgagttatcggagaaggagaagttagtattggaactagagaaacagtatccaggtgacgtgggcgtgatctcagcattcttctttaaccacgtcaagcttaatcccggagaggctttgtatcttgacgccaacgagccacacgcttacatttccggcgactgtgttgagtgtatggcggcttcagacaacgttgttagagctggtctcactccgaaacaccgcgatgttcaaactctgtgttctatgctgacctacaaattgggctacccggagattttgaaaggatttcctctgactccatacattacgagataccttccaccatttgatgagtttgaagtggaccattgtgatcttcctagagagaaatccactgtttttccggccataccagggccatcggtttatctggttattgaaggaaaagggacattgaaaaccggttcatctcaattgttggttaaacgaggagatgttttgtttgttccggcacataacgagattcacgtaaccggagaaagtgatgtgatgaagctttacagagctggagtcagcagcagattctttcaaacaatgtagactaagtaaagatacatatatatatatttaatttgttatctaaatgtaaccatagggatcaaggcattgacgtgatcatagtcaatattggtccatgttctttaatcctacaaatgtcccattacgaatcaagggttcaaggggttgtttttctattaacttttgttgtttcttctacacctttaaaattgaattatatatgtaaaatgattataaaacaatgtttttttttttactttttgctattgtagtgtagtaact

SEQ ID NO: 6986 - DNA, 1632 bp, Arabidopsis lyrata
acaatatttactatattgcttctatattaatattcttctttccatatataaatgattgaattttaaccctcttacaaggaatatatttcatttacattatatatagattacaagaaaagcccatcaatctattattctctgattcagcgaagaaaataaataaataaacggccaaaaaatgggagcagacgcaatccaaacgaacggtcacgatcaaaccaagttaaccggcggtgaagagatccaacggctgagatgtttcgtgaagaactacgaatggggcaaactcggaccagactcattggtggcgagactccaagaggctaatacaggacaaagagtcgacccggagattcctcacgccgagttttggatggggactcatgagtctggaccgagtcatgttgaattcgggtcgttgggtcatggtgggtctgataaatgtatggttacattgaagtcgtgggttttggataatccggatttactcgggtctaaagtcgtggacaagtggggttgtgatcttcctttcctcttcaaggtgttgtcagtgacgaaagcattgtcgattcaagcacatccaaataaagctttagcagagaaattgcatagagaagatcctcttctttacagagacaataaccacaagcctgagattgctcttgctgttactccttttcaagccctttgtggtttcgtacctcttaaggagttgaaggaggttatcaccaatgtaccagagatcacagagcttgtgggaagcaaagctgcagatcaaatcttcaacgtccatgaacacgatgaagacgaaagagtcaaatccgttgtccggttgatcttcacgcagttgatgtccgcaagcaacaatgagacgaagcaagtggtatctcggatgaagaatcgtctgatctcggagaccaaacaccgtgaactgtcggagaaagagaatttggttttggaattggagaaacagtactcaggtgacataggtgtgatttcagcctttttctttaactacgtcaagcttaatcgaggagaggctttgtatttggacgcaaacgacccacacgcttacatttccggcgactgtgtcgagtgtatggcggcttcagacaacgttgttagagctggtctcactccaaaacaccgcgatgttcaaaccctttgctctatgcttacttacaaattgggctacccggagattctgaaaggatttcctctaactccttacgttacaaggtatcttcctccatttgatgagttcgaagtggaccattgcgatctacctggtggaaattcgacggtttttccggcagtaccggggccttcggtttatttggttattgaaggtcaagggaaattgcaaaccggttcatctcaattgttggttaaccgaggagatgttttgtttgttccggctcataacgaggttcacgtaaccggagaaagtgatgtgatgaagctttacagagctggagtcagcagcagattcttccaaacactctaggctaaaaatttaagtatatgatctttactaattactatatatatttataagcattcatagggaccaattttccaaattggtaggaatgtgttgtttaattccccgatggtggcccattgcaaatt

SEQ ID NO: 6987 - DNA, 1750 bp, Arabidopsis thaliana
ataaagaaacacatatttagtctattgcttctctatcaatattcttctttccatatatatatgattgaattttaaccctcttacaaggaatatatttcatttatacattatatatagattacaagaaaaccccatcactctatattatcagattcatcatcgaaggaaaaataaaataaacggccaaaaatgggagcagacgcaatccaaacgaatggtcacgatcaagccaagttaaccggcggtgaagagatccaacggctgagatgttttgtgaagaactacgaatggggcaaactcggaccggagtcattggtggcgagactccaagaggctaatacaggacaacgagtcgattcggagattccttacgctgagttttggatgggtactcatgagtctggaccgagtcatgttgaattcgggtcgggtcatggtgtgtctgataaatgtatggttacattgaaatcgtgggttttggataatccgaatttactcgggtctaaagtcgtggacaaatggggttgtgatcttcctttccttttcaaggttttgtcagtaacgaaagcattgtcgattcaagcacatccaaataaggccttagcagagaaattgcatagagaagatcctcttctttacagagacaataaccacaagcctgagattgctcttgctgttactccttttcaagccctttgtggtttcgtaactcttaaggaactgaaggaggttatcactaatgtaccagagatcacggagcttgtaggaagcaaagctgcagatcaaatcttcaacgtccacgaacacgatgaagacgagagaatcaaatccgttgttcgattgatcttcacacagttgatgtctgcaagtaacaatgagacgaagcaagtggtttctcggatgaagaatcgtctgctcttagagaccaaacaccgtgaactgtcggagaaagagaagttggttttggaactggagaaacagtacactggtgacataggtgtcatctcagccttcttctttaactatgtcaagcttaatcctggagaggctttgtatttggacgctaacgagccacacgcatatatatccggtgattgtgttgagtgtatggcggcttcagacaacgtagttagagctggtcttactcctaaacatcgcgatgttcaaacgctttgctctatgcttacctacaaattgggttacccggagattctgaaaggatttcctctgactccttacgttacaaggtatcttcctccatttgatgagtttgaagtggatcattgtgatcttcctagaggaaaatcgacggtttttccggcagtaccaggtccttcggtttatttggttattgaaggaaaagggcaattgcgaaccggttcatctaaagttttggtaaaccgaggagatgttttgtttgttccggctgatattgagattcacgtaactggagaaagtgatgtgatgaagctttacagagctggagtcagcagcagattcttccaaacattgtaggctaaagtttaagtatattaaatttactaattactatatactatatatatttataagcaatcatagggaccaattctccaaagtgttaggaaatgtgttctttaaatccttgatggcccattgcaaattcaaggagttgtcattttcctatatttaattttgatttaaacgaactatatatgtaaaatgattgtaaaaccatgttatcctaatttaaaatatatttgagatgaaa

SEQ ID NO: 6988 - DNA, 1467 bp, Brassica napus
cggggaagaaagagaggaatggatcggatcaccatgttcctcctggcagctactctcgctgctgtgagatgcggctgcgatgctaattacaccagaaacgatttccctcacgacttcgctttcggatccggcacttctgcttatcagtgggaaggagcttatgatgaagatgggaaaaagcctagcgtctgggatacttatgttcactctcgtaacttagataatggagacataacgtgtgatgggtatcacaagtacaaggaagatgtgcagctgatggtggaaactggcttagatgcattcagattctccatctcttggtctaggcttatacccaatagaagaggtcctgttaacccaaaaggtctacagttctacaagaacttcatccatgaacttgtatcccacggaattgaaccacatgttacactgtaccactacgaccatcctcagtctctcgaggatgagtatggaggatggcttaaccgcagaattatcaaagactttactgcttacgcagatgtttgcttcagagagtttgggaaccacgtcaaactctggacgacgatcaatgaggctaatatattcactattggaggttacgacggtggaggtacaccacctggtcgttgttcaacctgctcgtcaggcaactcttccactgaaccgtatatcgtagcacataacttgcttcttgcgcacgcctctgcttcaaggctatacaagcaaaagtacaaggatacgcaaggaggttctgtaggcttcagcatatttgcaataggatttagaccttctacaaactccaatgatgatgaattggcaattcaaagattcaaagatttcttctacgcctggatgcttgggccacttacatatggagactatccggatggaatgaaaagaatcattggaacaaggctgcctgttttctcagaggaagaatcagaactagttaaaggctcatctgactttgtaggagtcattcactatcttgctgcttctgtctcagacgcccaatccaaaccttttcttccaggagactccaaattcttcgccgacatgggtgtactattgacttacgttgggaatttcactgcctttgagtatgaaattgctccatgggctatggaaggtgtgctggaatatataaagcagagctatggcaatcctcctgtctacattcttgagaatggtaaaccgatgaagcaagatttgcagctgcagcgggaggacacaccaaggattgagttcgtacacgcttacatgggtgctgtcctcaaagccgttaggaatggatcagacacgagaggctacttcgtgtggtcatttatggacctgtatgagttactgagtggatacgagtatagttttggaatttactctgtgaatttcagtgatcctcatcgcaagagatctccaaaactctctgcacattggtactctgcgtttctcaagggtaacaccacc

SEQ ID NO: 6989 - DNA, 2007 bp, Brassica napus
acagttacttgttttattcttgggtcacacagaataactagaagcgggtaggtgtctgtgtctacttaatggtttacacgagccatgcatggagccagccaagaaagagaggaatggatcggatcaccatgttcctcctggcagctactctcgctgctgtgagatgcggctgcgatgctaattacaccagaaacgatttccctcacgacttcgctttcggatccggcacttctgcttatcagtgggaaggagcttatgatgaagatgggaaaaagcctagcgtctgggatacttatgttcactctcgtaacttagataatggagacataacgtgtgatgggtatcacaagtacaaggaagatgtgcagctgatggtagaaactggcttagatgcattcagattctccatctcttggtctaggcttatacccaatagaagaggtcctgttaacccaaaaggtctacagttctacaagaacttcatccatgaacttgtatcccacggaattgaaccacatgttacactgtaccactacgaccatcctcagtctctggaggatgagtatggaggatggcttaaccgcagaattatcaaagactttactgcttacgcagatgtttgcttcagagagtttgggaaccacgtcaaactctggacgacgatcaatgaggctaatatattcactattggaggttacgacggtggaggtacaccacctggtcgttgttcaacctgctcgtcaggcaactcttccactgaaccgtatatcgtagcacataacttgctgcttgcgcacgcctctgcttcaaggctatacaagcaaaagtacaaggatacgcaaggaggttctgtaggcttcagcatatttgcaataggatttagaccttctacaaactccaatgatgatgaattggcaattcaaagattcaaagatttcttctacgcctggatgcttgggccacttacatatggagactatccggatggaatgaaaagaatcattggaacaaggctgcctgttttctcagaggaagaatcagaactagttaaaggctcatctgactttgtaggagtcattcactatcttgctgcttctgtctcagacgcccaatccaaaccttttcttccaggagactccaaattcttcgccgacatgggtgtactattgacttacgttgggaatttcactgcctttgagtatgaaattgctccatgggctatggaaggtgtgctggaatatataaagcagagctatggcaatcctcctgtctacattcttgagaatggtaaaccgatgaagcaagatttgcagctgcagcgggaggacacaccaaggattgagttcgtacacgcttacatgggtgctgtcctcaaagccgttaggaatggatcagacacgagaggctacttcgtgtggtcatttatggacctgtatgagttactgagtggatacgagtatagttttggaatttactctgtgaatttcagtgatcctcatcgcaagagatctccaaaactctctgcacattggtactctgcgtttctcaagggtaacaccacctttcttgattcccaagacatcatgagcaacttgtcttcttcagccacttccttgtagacttgcaaacaatttagtaaaaatattaataatactgggtctgggaatgagttaagtagctcgcgtgatttgactataatgggaatgctgtttcacatttacataaagtctgttgtttttattgaacataaaagacccaacaaacagatacaagttaagaaactggaaagagtgaggatacaatactaaacacaaaacacaaacagaggagggtacaatcattttattagagaaagctcagagatgaaacaaaagccttattactgcttctggaggtcaacgaccttggcccaagcaggcctggcagtgatcttcctgacccactcgacaaaaccttaagggacgaagaactacaaagaagggaccttggagtcggtacccatcaagt

SEQ ID NO: 6990 - DNA, 2066 bp, Brassica rapa
  misc_feature (865)..(865): n is a, c, g, or t
tcacttctctcaccatcttcttcctcctccttcctctctccgcttcacttttcttcaaaattttgaattgctttcatgctctgtaactgaggcttctccagccaaatccggtttcatggctatggcgtttcctctttcatatacgcccgtttctgttaaaccagtaactcactctcggagatcgaaactcgtggttttctcttcttcttctaatggaagagatccctcaccctctgaggagaagtcagtacctaatggagtgaaaagcatcgagaagcttcaagaggagaagcgtcgtgctgagttatctgctcggattgcttctggagccttcactgtacgcaaatccagcttcccatcaacagtaaagaatggtttatctaagcttggagttcccagcaatgttctggatttcatgtttgattggaccggagctaacgaagattacctcaaggttccagaggctaaagggtctattcaggctgtccgtaacgaagctttcttcatccctctctatgagcttttccttacttacggtggtatcttcaggttgacctttggtccaaagtcgttcttgatcgtgtcggatccttctattgctaagcatatattaaaggacaacgctaaagcttactccaaggggattctagctgaaattctagattttgtgatggggaaaggactcatacctgctgatggggagatatggcgtaggagaaggcgtgccatcgtccctgccttgcatatgaagtatgtagcagctatgatcagtttgtttggagaagcttcagataggctttgccagaagcttgatacagctgcatctacaggggaagatgtagagatggaatcactcttctctcgnttgacgcttgatattattggcaaggcggtttttaattacgactttgactccttaaccaatgataccggtgtgatcgaggcagtttacactgttctaagagaagctgaagatagaagtgtttcacctattcctgtttgggacataccaatctggaaagatatttccccacgtcagaggaaagttgctacttctctcaagttgatcaatgacaccctcaatgatttgatcgcaacctgcaagagaatggtagaggaagaggagcttcagtttcacgaggagtatatgaacgaaagagatccaagcatccttcacttcctcttggcttcaggagacgatgtatctagcaagcagctacgtgatgacttgatgacaatgcttatagctggacatgaaacatcagctgcggttttaacatggaccttttatcttcttacaacgaatcccaaagtagtggccaaacttcaagaagaggttgattctgttattggagatagattcccaaccttagaagatatgaagaagctgaaatacacaacccgagtcatgaatgagtcattgagattatatccacaaccaccagtactgatccgtcgttccctagagaacgataaacttggaccgtatcccataaaaagaggagaggatatcttcatttctgtttggaatctacatcgaagtccccttcattgggatgatgcggaagagttcaatccagagagatggcctcttgatggaccaaacccaaatgagacaaaccaaaacttcagttacttgccgtttggtggaggacctcggaaatgcataggcgacatgtttgcttcatttgagaatgtggtagcaatcgcaatgcttattcgaagatttaactttcagactgcaccaggagctcctccggtaaaaatgaccacaggagctacaatacacactacagaaggactgaaattgactgtaacaaagagaacaccacctctctctgttcctatccttccaatggaagctcctcgagatgaagtttcctctgctcggtcttgagtcttcttcatctttgcaaaactgaagaaataaacaagctcaaacaagaacaacaacaaatgtttctaattgtttctctgcattatattatgcagacaagtagaatgtaaagaaaattattattctttgaaaaaagatatacaaagtttcaaatattttctaggacata

SEQ ID NO: 6991 - DNA, 2237 bp, Eutrema halophilum
acacgtcacattttctctcatcttcttcttcttcctctctacttcacactcggactcggtgcaaaaaatctttcctctgtttgtctttcagaatataacacacacagaaaaaaactctcatccaaatttgatttttcaaaatttctgtaatggttttctcgatttggatttagtgtgagctctgtgacctgagatttttgtttttgttccggaggcgtatggctatggcgtttcctctttcttatactccagtttctgtaaaaccggtaacgcatcctcggagaccgaagctcgtagttttctcttctacatctaatggaagagatccctctgaggagaagtcagtgcctaatggcgtgaaaagcttcgagaagcttcaggaggagaagcgtcgtgctgagttatctgctcggattgcttctggagcgttcactgtacgaaaatctagttttccatctacagtaaagagtggtttatcgaagcttggaattcccagcaatgttctggatttcatgtttgactggaccggcactaacgaagactaccccaaggttccagaggctaaaggctcgattcaggcagtccggaacgaagctttcttcatccctttgtatgagcttttccttacttatggtggaattttcaggttgacctttggaccaaagtcattcttgatcgtgtcggatccttctattgctaagcatatattgaaggacaacgcaaaagcttactccaaggggattttagctgaaattctagattttgtgatgggaaaaggactcataccagctgatggggagatatggcgtaggagaagacgtgcgattgtccccgcattgcatcagaagtatgtagcagctatgatcagcttatttggagaagcttcagataggctttgccagaagcttgattctgctgcatccacaggggaagtagtagagatggaatcactcttctctcgtttgacacttgatattattggcaaggcggttttcaattacgactttgactccctaacaaatgataccggtgtgatcgaggcagtttacactgttctaagagaagctgaagatagaagtgtttcacctattcctgtttgggacttaccgatttggaaagatatttccccgcgtcagaggaaagttgctacttctctcaaattgatcaatgacacacttgatgatttgatcgcaacatgcaagagaatggtagaagaagaggaattgcagtttcatgaggaatatatgaacgaaagagatcctagcatccttcactttcttttggcgtcaggagatgatgtctctagcaagcagctccgtgatgacttgatgacaatgcttatagccggacatgaaacatcagctgcagtattaacatggacattttaccttctaacaacggaacctagcgtagttgcgaaactccaagaagaggttgattctgttattggagatagattcccaaccatagaagatatgaagaaactgaaatacacaacacgagtcatgaatgagtcactgagactatatccacaaccaccagtactgatccgtcgttctcttgagaacgatacgcttggaccttaccccataaaaaggggagaggatattttcatctctgtttggaatctacatcgaagtcctcttcattgggatgacgctgaaaagttcaatcctgagagatggcctctagatggaccaaacccaaatgagacaaaccaaaacttcagttacttaccatttggtggaggacctcggaaatgcataggagacatgtttgcttcgtttgagaatgtggtagcaatcgcaatgcttattcgaagatttaactttcagacagcaccaggagctcctccggtgaaaatgactacaggagctacaatacacactacagaagggttgaaactgactgtaacaaagagaacaaaacctctagacgtaccatctgtacagatacttccaatggaagctcctcgagatgaagtttcctctgcttcctcagctctgtcttgagtattcatctttgcaaaacttgaataaattattcgaagaagaagaagaagaagcgagaatcttgtgttaggacaacaattgtagaacttgttgaaacaagaacaatgcctcagattatttttctgcactatcttatgcagacaagtaaaatgtaaagaaagaaagatttattattcttttgaaagaaagaaattgtttttatctgcacagttaagataatacaac

SEQ ID NO: 6992 - DNA, 2087 bp, Eutrema parvulum
tttactccggccaaatcggtttttttttctccgggcggcgtatggctatggcgtttcctctttcatataccccgatttctgttaaaccagtaacgtactctcggaggcagaaactcgtagttttctcgtcgacttctaatggaagagatccctctgaggagaagtcagtgcctaatggagtgaaaagcatcgagaagctccaggaggagaagcgtcgtgctgagttatctgctcggattgcttctggagcgttcactgtacgaaaaactagcttcccatcgacgatcaagaatggtttatctaagcttggagtgcccagcaatgttctggatttcatgtttgattggaccggctctgaccaagactaccccaaggttccagaggctaaagggtcgattcaggctgtccggaacgaagctttcttcatccctttgtatgagcttttccttacttatggtggcattttcaggttgaccttcgggccaaagtcattcttgatcgtgtccgatccttctattgctaagcatatattgaaggacaacgcaaaagggtactcgaaggggattttggctgaaattctagattttgtgatgggaaaaggactcataccggctgatggggagatatggcgtagaagaaggcgtgcgattgtccctgcgttacatcagaagtatgtagctgctatgatcagcttatttggagaagcttcagataggctttgccagaaacttgattctgctgcatctgcaggggaagaagtagaaatggaatcactcttctctcgtttgacacttgatattattggcaaggcggtttttaattacgactttgactccctaacaaatgataccggtgtgatcgaggcagtttacactgttctaagagaagctgaagatagaagtgtttcacctattcctgtttgggacataccgatttggaaggatatttccccacgtcagaggaaagttgctacttctctgaaattgatcaatgacacacttgatgatttgatcgcaacatgcaagagaatggtagaagaagaggagctgcaatttcacgaggaatatatgaacgaacgagatccaagcatccttcactttcttttggcttcaggagacgatgtctctagcaagcaactccgtgatgacttgatgacaatgcttatagctggacatgaaacatcagctgcggttttaacatggacgttttaccttttaacaaagaatcccagcgtagttgccaaacttcaagaagaggttgattctgttattggagatagattcccaactatagaagatatgaagaagctgagatacactacccgagtcatgaatgagtcattgagattatatccacaaccaccagtactgatccgtcgttctctagagaaagatatccttggacagtatcccataaaaaggggagaggatatcttcatctcggtttggaatctacatcgaagtcctcttcattgggatgccgcggaaaagttcaatcccgagagatggcctctagatggaccaaacccaaatgagacaaaccaaaacttcagttatttaccatttggtggaggaccgcggaaatgcataggcgacatgtttgcttcgtttgagaatgtggtagcaatcgcaatgcttattcgaagatttaactttcagactgcaccaggagctcctccggtgaaaatgactactggagctaccatacacactacagaaggattgaaagtgactgtaacaaggagaacaaaacctctcaatataccatccgttccgatacttccaatggaagctcctctagatgaagtttctcctgcttcatctgctctctcttgagtctctccatcattgcagaactgaaatgaacaagctcaaagaggaagaagaaaaaagaagcaaaatcttgtgttagaacaaccaatgtagaacttgttgaatcaagacaaatgcttctgattatttcacggcgctacgttatgcagaagaaaaatgtagagatttattattctttgagaaagagaaaaattgtttttatctgcacagtgaagatataacttttgggttctataaatgttcaaatgttttcta

SEQ ID NO: 6993 - DNA, 2288 bp, Brassica napus
tcaggaaagaaagtaggccattgacattgactaatctacgatgagaatgacgtgaagcattttaacatacgcgcagatttcgcacgtgtaaaacacgtatgtgtttaggaaaagatttgttaaccttaagagtttggagtaacagaactactaaagaagagataatgagtacacgttagtaaaagcgacacgtcacttctctcaccatcttcttcctcctccttcctctctccgcttcacttttcttcaaaattttgaattgctttcatgctctgtaactgaggcttctccagccaaatccggtttcatggctatggcgtttcctctttcatatacgcccgtttctgttaaaccagtaactcactctcggagatcgaaactcgtggttttctcttcttcttctaatggaagagatccctcaccctctgaggagaagtcagtacctaatggagtgaaaagcatcgagaagcttcaagaggagaagcgtcgtgctgagttatctgctcggattgcttctggagccttcactgtacgcaaatccagcttcccatcaacagtaaagaatggtttatctaagcttggagttcccagcaatgttctggatttcatgtttgattggaccggagctaacgaagattacctcaaggttccagaggctaaagggtctattcaggctgtccgtaacgaagctttcttcatccctctctatgagcttttccttacttacggtggtatcttcaggttgacctttggtccaaagtcgttcttgatcgtgtcggatccttctattgctaagcatatattaaaggacaacgctaaagcttactccaaggggattctagctgaaattctagattttgtgatggggaaaggactcatacctgctgatggggagatatggcgtaggagaaggcgtgccatcgtccctgccttgcatatgaagtatgtagcagctatgatcagtttgtttggagaagcttcagataggctttgccagaagcttgatacagctgcatctacaggggaagaagtagagatggaatcactcttctctcgtttgacgcttgatattattggcaaggcggtttttaattacgactttgactccttaaccaatgataccggtgtgatcgaggcagtttacactgttctaagagaagctgaagatcgaagtgtttcacctattcctgtttgggacataccaatctggaaagatatttccccacgtcagaggaaagttgctacttctctcaagttgatcaatgacaccctcaatgatttgatcgcaacgtgcaagagaatggtagaagaagaggagcttcagtttcacgaggagtacatgaacgaaagagatccaagcatccttcactttctcttggcttcaggagacgatgtatctagcaagcagctacgtgatgacttgatgacaatgcttatagctggacatgaaacatcagctgcggttttaacatggaccttttatcttcttacaacgaatcccaaagtagtggccaaacttcaagaagaggttgattctgttattggagatagattcccaaccttagaagatgtgaagaagctgaaatacactacccgagtcatgaatgagtcattgagattatatccacaaccaccagtactgattcgtcgttccctagagaacgataagcttggaccgtatcccataaaaagaggagaggatatcttcatttctgtttggaatctacatcgaagtccccttcattgggatgacgctgaagagttcaatccagagagatggcctcttgatggaccaaacccaaatgagacaaaccaaaacttcagttacttgccgtttggtggaggacctcggaaatgcataggcgacatgtttgcttcatttgaggtaggcctgggactttttaaccggaaccgaataccgaaccggatccgacccgaaatggaccggttcggatcggtttcggataaggcatatttaaccgatgggtaatgtttatgaatatccacgggtatcgggtcggttcgggtttttatccggatccgatcgggtacccgtttaaaccgaaataatgtttaaaaaacatggatttgcgcctcatgggtttcgaacccgggtgggaaagttgaaagtacatcaacttttaccactgcaccacttctatttcgttgtagttactttcaaactatacatatatatccgatttggattaaactattttaaaaaaaataaaataaaaatagaaaatataaaatacataaaatattagtttgtttaataattaatatcg

SEQ ID NO: 6994 - DNA, 2052 bp, Arabidopsis lyrata
tattttgcggtggcgtcttatggcggctatggcgtttcctctttcctatactccgatttctgttaaaccagtaacgtactctcggagatcgaacttcgtagttttcgcatcgaattctaatggaagagatccttctgagaataattcagttcctgatggcgtgaaaagcttggagaaggttcaagaggaaaagcgtcgtgctgagttatctgctcggattgcttctggagctttcactgtacgaaaatctagttttctatcgacagtgaagaatggtttatctaaggttgggaattccaagcaatgttcttgatttcatgtttgattggactggttctgacgaagactacctcaaggttcctgaggctaaaggctcgattcaggcggtccggaacgaagctttctttatccctttgtatgagcttttccttacttatggtggcattttcaggttgacctttgggcctaagtcgttcttgatcgtgtcggatccttctattgctaagcatatattgaaggacaatgcaaaagcttactccaagggaattttagctgaaattctagattttgtgatgggaaaaggactcataccggctgatggggagatatggcgtagacgaagacgtgccattgttcctgcattgcatcaaaagtatgtagcagctatgattagcttatttggagaagcttcagataggctttgccagaagcttgatgctgctgcattgaaaggggaagaagtagagatggaatcactcttctctcgtttgacacttgatattattggcaaggcggttttcaattacgactttgactccctaactaatgataccggtgtgatcgaggcagtttacactgttctgagagaagctgaagacagaagtgtttcacctattcctgtttgggacataccgatttggaaagatatttccccgcgtcagaggaaagttgctacttctctgaaattgatcaatgacacgcttgatgatttgatcgccacatgcaagagaatggtagaagaagaggagttgcagtttcatgaggagtatatgaacgaacgagatcctagcatccttcactttcttttggcttcaggagatgatgtctctagcaagcagctccgtgatgacttgatgacaatgcttatagccggacatgaaacatcggcggcagtattaacatggaccttttaccttttaacaacggaacccagtgtagttgccaaactccaagaagaggttgattctgttattggagatagattcccaaccatagaagatatgaaaaagctgaaatacactactcgagtcatgaatgagtcattgagactatatccacaaccaccagtactgatccgtcgttctctagagaacgatatgcttggacagtatcccataaaaaggggagaggatatcttcatctcggtttggaatctacatcgaagtcctcttcattgggatgatgcggaaaagtttaatcccgagagatggcctttggatggaccaaacccaaatgagacaaaccaaaacttcagttacttacctttcggtggaggaccgcggaaatgtataggcgacatgtttgcttcctttgagaatgtggtcgcaatcgcaatgcttattcgaagatttgactttcagactgcaccaggagctcctccggtaaaaatgactacaggagctacaatacataccacagaaggattgagattgacagtaacaaagaggacaaaacctcttgacataccacccgtaccgatacttccaattgaagcttcccgggatgaagtttcatctgctctgtcttaagtcttcacctttgcaaaactgaaaacaaacaaactcaaatgaagaagcaaaaatcttgttttagaacaacaaatgtagaatttgttggaacttgaccaatgcttctgattatttctctgcactagttgtgcagacaagtaaaaattgtgaagatttattattctttgaaaaaaaaaatgtttttctctgcacagtgaagatgatataacttttggattctataaaagttcaaatatttctagga

SEQ ID NO: 6995 - DNA, 1930 bp, Brassica napus
ggaccggtccggaatctcgggtcgacccacgcgtccgaatcccaattctgaatcgtcttggcggatatggctttcaaggttactctcgtctccacatcccccatcgatggccagaaacccggaacctctggtctccgtaagaaggtgaaagtgttcaagcaacccaattacctggagaattttgtccaagcaacgtttaatgcgcttactccggagaaagtcaaaggtgccacactcgtggtctctggtgatggtcgttattactcaaaggatgctgttcagattataattaagatggcagcagctaatggtgtacgccgtgtgtgggttggtaaaaacactctgatgtcaacccctgctgtatcagctgtgattcgtgaaagatcaggggctgatggatcgaaagcaactggagcatttatcttaacagcaagtcacaaccctggtggccctactgaggattttggaatcaaatacaatatggaaaatggaggccctgctcctgaatccattactgataagatttacgagaacactaagacaatcaaggagtaccctatagcagaagatctacccaatgttgatatttctgccgttggtgtaacgagttttgagggacctgaaggaaaatttgatgttgaagtttttgattctgctgatgactacgttaaactaatgaagtcaatcttcgactttgagtccatccgaaagttactttcatctccacaatttacgttctgctacgatgccttgcacggtgttgctggggcctatgcgcatcgcatctttgtggaagaactcggtgcgcaagaaagtgccttgttgaactgcgtacccaaggaggactttggcggaggacatccagatcccaatctgacatatgctaaggagcttgtagcacggatgggactaggtaaatccgacaccggaggtgaacctccagagtttggtgccgctgctgatggtgatgcagaccgtaacatgatccttggtaaaaggttctttgtaactccttcggattcagttgccattattgctgcaaatgccattgaagccataccatacttcagctctggtttgaaaggtgttgcaaggagcatgccaacctcagctgctctagatgttgttgcaaaaagcttgaatttgaagttttttgaggttccaacaggctggaagttttttggtaacctgatggatgccgggatgtgttccgtctgtggtgaagaaagttttggaactggctccgatcatatccgtgagaaagatgggatatgggcagttcttgcgtggatgtccatacttgctcacaagaacaaggatagcattgacggtgacactaaactggtgacggttgaagacattgtccgccagcactgggctacctatggccgtcactactacactcgttacgactatgagaatgtagacgcaggtaaagccaaggaactgatggagcatttggttaaattgcaatcttcaattcctgaagtcaacaagattgtgaaaggaattcgttcggacgtggcgaatgtctccagtgcggatgagttcgagtacaaagatccagttgatggttccatctcaaagcaccagggtatccgttacttgtttgaggatggatcgcgacttgttttccgtctgtctggaactggctcggaaggagcaaccatcaggctctacattgaacagtacgagaaggatgcttcgaagattggacgagagtcccaggaagctctgtctcctctggttgacatagctctgaagctgtccaagatggaggagttcacgggccgatcagcccccaccgtcataacttaagatggtggtcacaagtacaaacgatctcaaatcttgcacttatgtctgtgtctaagggatactttcttctcactctatatgaataaatagtctcagggagacttcacatttc

SEQ ID NO: 6996 - DNA, 2043 bp, Brassica napus
gctttttttatcatcactctcttcttctcattctctcttcatcccaattctgaatatcgtctcggcggatatggctttcaaggttactctcgtctccacatcccccatcgatggccagaaacccggtacctctggtctccgtaagaaggtgaaagtgttcaagcagcccaattacttagagaattttgtgcaagcaacgtttaatgctcttactcctgagaaagtcaaaggtgccacgctcgtggtctctggtgatggtcgttattactcaaaggatgctgttcagatcataattaagatggcagcagctaatggtgtacgccgtgtgtgggttggtaaaaacactctgatgtcaacccctgctgtatcagctgtgattcgtgaaagatcaggggctgatggatcgaaagcaactggagcatttatcttaacagcaagtcacaaccctggtggccctactgaggattttggaatcaaatacaatatggaaaatggaggccctgctcctgaatccattactgataagatttacgagaacactaagacaatcaaggagtacccaatagcagaagatttacccaatgttgatgtttctgccattggtgtaacgagttttgaaggacctgaaggaaaatttgatgttgaagtttttgattccgcagatgactacgttaaactaatgaagtcaatcttcggctttgagtccatccggaaattactttcatctccaaaatttacgttctgctacgatgccttgcacggtgttgctggggcctatgcgcatcgcatctttgtggaagaactcggtgcgcaagaaagtgccttgttgaactgcgtacccaaggaggactttggaggaggccatccggatcccaatctgacctatgctaaggagcttgtggcacgaatgggactaggtaaatccgacactggaggtgaacctccagagttcggtgcggctgctgatggtgatgcagaccgtaacatgatcctcggtaaaaggttctttgttactccttctgattcagttgccataattgcggcaaatgccattgaagccataccctacttcagctctggtttgaaaggtgttgcaaggagcatgccgacctcagctgctctagatgttgttgcaaaaagcttgaatctgaagttctttgaggttccaacaggctggaagttttttggtaatctgatggatgccgggatgtgttccgtctgtggggaagaaagttttggaactggctccgatcatatccgtgagaaagatgggatatgggcagttctagcgtggatgtccatacttgctcacaagaacaaggatagcattgacggcgacactaaactggtgacggttgaagacattgtccgccagcactgggctacctatggccgtcactactacactcgttacgactatgagaatgtagacgcaggtaaagccaaggaactgatggagcatttggtcaaactgcaatcttcaattcctgaagtcaacaagattgtgaaaggaattcgttcggacgtggcaaatgtctccagtgccgatgagttcgagtacaaagatccagttgatggatctatctcaaagcaccagggtatccgttacttgtttgaggatggatcgcgacttgttttccgcttgtctggaactggctcggaaggagcaaccatcaggctctacattgaacagtacgagaaggatgcttcgaagattggacgagagtcccaggaagctctgtctcctctggttgacatagctctgaagctgtccaagatggaggagttcacgggccgatcagcccccaccgtcataacttaagatggtggtcacaagtacaaacgatctcaaatcttacacttatgtctgtgtctaagagatactttcttctcactctatatgaataataagacttcacatttcttttcggaatattgaacaagcctgttttgagttatcgcgaagagctttatacttgtttggatttgagttttctcggttttgttttcttgttttacatctattaaatgatataagatttt

SEQ ID NO: 6997 - DNA, 2039 bp, Brassica napus
atcgtcttggcggatatggctttcaaggttactctcgtctccacatcccccatcgatggccagaaacccggaacctctggtctccgtaagaaggtgaaagtgttcaagcaacccaattacctggagaattttgtccaagcaacgtttaatgcgcttactccggagaaagtcaaaggtgccacactcgtggtctctggtgatggtcgttattactcaaaggatgctgttcagattataattaagatggcagcagctaatggtgtacgccgtgtgtgggttggtaaaaacactctgatgtcaacccctgctgtatcagctgtgattcgtgaaagatcaggggctgatggatcgaaagcaactggagcatttatcttaacagcaagtcacaaccctggtggccctactgaggattttggaatcaaatacaatatggaaaatggaggccctgctcctgaatccattactgataagatttacgagaacactaagacaatcaaggagtaccctatagcagaagatctacccaatgttgatatttctgccgttggtgtaacgagttttgagggacctgaaggaaaatttgatgttgaagtttttgattctgctgatgactacgttaaactaatgaagtcaatcttcgactttgagtccatccgaaagttactttcatctccacaatttacgttctgctacgatgccttgcacggtgttgctggggcctatgcgcatcgcatctttgtggaagaactcggtgcgcaagaaagtgccttgttgaactgcgtacccaaggaggactttggaggaggacatccagatcccaatctgacatatgctaaggagcttgtagcacggatgggactaagtaaatccgacaccggaggtgaacctccagagtttggtgccgctgctgatggtgatgcagaccgtaacatgatccttggtaaaaggttctttgtaactccttcggattcagttgccataattgctgcaaatgccattgaagccataccatacttcagctctggtttaaaaggtgttgcaaggagcatgccgacctcagctgctctagatgttgttgcaaaaagcttgaatttgaagttttttgaggttccaacaggctggaagttttttggtaacctgatggatgccgggatgtgttccgtctgtggtgaagaaagttttggaactggctccgatcatatccgtgagaaagatgggatatgggcagttcttgcgtggatgtccatacttgctcacaagaacaaggatagcattgacggtgacactaaactggtgacggttgaagacattgtccgccagcactgggctacctatggccgtcactactacactcgctacgactacgagaatgtagacgcaggtaaagccaaggaactgatggagcatttggtcaaattgcaatcttcaattcctgaagtcaacaagattgtgaaaggaattcgttcggatgtggcgaatgtctccagtgcggatgaattcgagtacaaagatccagttgatggatccatctcaaagcaccagggtatccgttacttgtttgaggatggatcgcgacttgttttccgtctgtctggaactggctcggaaggagcaaccatcagactctacatcgaacagtacgagaaggatgcttcgaagattggacgagagtcccaggaagctctgtctcctctggttgagatagctctgaagctgtccaagatggaggagttcacgggccgatcagcccccaccgtcataacttaagatggtggtcacaagtacaaacgatctcaaatcttgcacttatgtctgtgtctaagggatactttcttctcactctatatgaataaatagtctcagggagacttcacatttcttttcggaatctttgaacaagcctgttttgagttatcgcgaagagctttatacttgtttggatttgacttttctcggttttgttttcttagttttacatctattacgtgatataagattttgttattacagttcaaacgagtttgcaagttttcatcccg

SEQ ID NO: 6998 - DNA, 2053 bp, Eutrema halophilum
ctaacaatccatagtccagactaaaatccaattctgatcctcgaggcggatatggttttcaaggtttctctcgtctcaacatcacctatcgatggccagaaaccgggaacttctggtcttcgtaagaaggtgaaagtgttcaagcaacccaattacctagagaattttgtccaagcgacattcaatgctcttacaccagagaaagtcaaaggtgccactctcgtggtctctggtgatggccgttattactcaaaggatgctgttcagatcataattaagatggcagcagctaatggtgtacgacgcgtgtgggttggtaaaaacactctgttatcaactcctgctgtgtcagctgtgattcgtgaaagatcaggggctgatggatcaaaagcaaccggagcatttatcttaacagcaagtcacaatcctggtggccctacagaggattttggaatcaaatacaatatggaaaatggaggaccagctcctgaatcaatcactgataagatttacgagaacactaagacaatcaaggagtacccaatagcagatttacccaatgttgatatttcttccgtcggtgtaaccagttttgaaggacctgaaggaaaatttgatgttgaagtttttgattccgcagatgactacgttaaattaatgaagtcaatcttcgactttgaatccatccggaaattgctttcgtctccaaagtttacattctgctatgatgcattgcatggagttgctggagcctatgcacatcgcatctttgttgaagagctcggtgcacaagaaagtgcgttattgaactgcatacccaaggaggactttggtggagggcatccagatcccaatctgacatatgctaaggagcttgtggcacgaatgggattaggtaaatccgacaccggcgttgaacctccagaatttggtgcggctgctgatggtgatgcagaccgtaacatgatccttggtaaaaggttctttgtaactccttcagattcagttgccataattgctgcaaatgctattggggccataccgtacttcagctctggtttgaaaggtgttgcaaggagcatgccaacctcagctgctctggatgtcgttgcaaaaagcttgaatctgaagttctttgaggttccaacgggctggaagttttttggtaatctgatggatgctgggatgtgttctgtttgtggggaagaaagttttggaactggatcggatcatatccgcgagaaagacgggatttgggcagttcttgcatggatgtccatacttgctcataagaacaaggaaaatcttgacggtaacactaaactggtgaccgttgaagacattgtccgccagcattgggctacgtacggccgtcactattacactcgttatgactatgagaatgtagacgcaggtaaagcaaaggacctgatggagcatttgatcaaattgcaatcttcaattcctgaagtcaacaagattgtgaaaggaattcgttcggatgtggcgaacgtctccagtgctgatgaattcgagtacaaagatccagttgatggctccatctccaagcaccagggaatccgttacttgtttgaggatggttcgcgacttgttttccgtctctctggaactggctcggaaggagcaaccatccgactctacattgaacagtacgagagggatgcttcaaaaaccggacgagagtcccatgaagctctgtctcctctggttgaattagctctgaagctatccaagatggaggaattcaccggccgatcagcccccaccgtcataacataaagaacgcggtcaagttcaacgatctcaaatcatacactttttttctttctctgcacctatatatgggatgctttcttctcattatatgaataattaagtctcagggagactttgtatttcttgacggaattttgaacaatcctggccaacatcctgagttttcgtaaagcttatacttctccggattttgttttctctcttttgcatgattaagttttgttattgcagttttgtaactataagtatgagtttg

SEQ ID NO: 6999 - DNA, 2280 bp, Eutrema parvulum
aaaacgagagaaacgttccacttcacacacttgggccaaggtgaaaaagcgacgagccacacgtgtcgcggtctcgtttagcttaagcaacttctttgcgacgatcatactctggtctctctctcaaacagctctataatatatcatcactctcctctctttctctctgcatcaacactaatccaaattctgatcttgttcttctcctcaaagaaggatatggttttcaaggtctctctcgtctcaacatcgcctatcgatggccagaaacctggaacttctggtctccgtaagaaggtgaaagtgttcaagcaacctaattacctggagaattttgtccaagccacatttaatgctcttactccagagaaagtcaaaggtgccacactcgtggtctctggtgatggccgttattactcaaaggatgctgttcagatcataattaagatggcagcagctaacggtgtaagacgtgtgtgggttggtaaaaacaccctgttatcaactcctgctgtatcagctgtgattcgtgaaagagcaggggctgatggatcaaaagcgacgggaggatttatcttaacagcaagtcacaatcctggtggccctactgaggattttggaatcaaatacaatatggaaaatgggggacctgctcctgaatcaatcactgataagatttacgagaacacaaagacaatcaaggagtacccgatagcagaagatctacccaatgttgatatatctgccattggtgtaaccagttttgaaggagctgaaggaaaatttgatgttgaagtttttgatcccgcagatgactacgttaaattaatgaagtcaatcttcgactttgaatccatccggaaattgctttcgtctccaaagtttacattctgctatgatgcattgcatggagttgctggagcctatgcacatcggatctttgttgaagaactcggtgcgcaagaaaattctttattgaattgcgtacccaaggaggactttggaggagggcatccggatcccaatctgacctatgcaaaggagcttgtggcacgtatgggattaggtaaatctgacaccggagttgaacctccagaatttggtgctgctgctgatggtgatgcagaccgtaacatgatccttggtaaaaggttctttgtaactccttctgattcagttgccataattgctgcaaatgctgttggggccataccgtacttcagctctggtttaaaaggtgttgcaaggagcatgccgacctcagctgctcttgatgtcgttgcaaaaagcttgaatttgaagttttttgaggttccaacaggttggaagttttttggtaatctgatggatgctgggatgtgttctgtttgtggagaagaaagttttggaactggctctgatcatatccgcgagaaagacgggatctgggcagttcttgcgtggatgtccatacttgctcacaagaacaaggaaaatattgagggtaacactaaactagtgacggttgaagacattgtccgccagcactgggctacctacggccgtcactattacactcgctacgactatgagaatgtagacgcagctaaagctaaggaactgatggagcatttggtgaaattgcaatcttcaattcctgaagttaacaagattgtgaaaggaattcgttcggacgtggcaaatgtctccagtgcggatgaatttgagtacaaagatccagttgatggctccatctcgaagcaccagggaatccgttacttgtttgaggatgggtcgcgacttgttttccgtctctctggaactggctcggaaggtgcaaccatccgtctttacattgaacaatatgagaaggattcttcgaaaaccggacgggagtcccaggaagctctgtctcctctggttgacttagctctgaagctgtccaagatggaggagttcaccggccgatcaacccccacagtcataacataagaaggcggtcaggttcaacgatctcaaatcatacacttttgtctgcgtctttgggatgcttttcttctcattatatggtattatgaataattagtctcaaggggagacttcttttcggaattttgaacaatcctgacgatttcccgagttttggtgaagctttttatctattacatgattaatatttgttattgctgttcaacgattttgcaagtttggtctcttaacaaactttatatctattacatgattaattgatacctcaacatgtttaaggttggtttgcgtagctttctacaaatgcatgcg

SEQ ID NO: 7000 - DNA, 2112 bp, Arabidopsis thaliana
atttaagagctgcttgcttttatcatcatcactctctctgcgtccaaattttgatctttgttcttctcaaagcgaatatggttttcaaggtttctaccgtatccacatctcctattgatggccagaaaccaggaacttctggtcttcgtaagaaggtgaaagtgttcaagcaacccaattatctagagaattttgtccaagcaacattcaatgctcttacggcggagaaagttaaaggtgccacacttgtggtctctggtgatggtcgttattactcaaaggatgctgttcagatcataattaagatggcagcagctaatggtgtacgacgtgtgtgggttggtaaaaacactctgttatcaactcctgctgtatcagctgtgattcgtgaaagatcaggggctgatggatcgaaagcaactggagcatttatcttaacagcaagccacaatcctggtggccctactgaggattttggaatcaaatacaatatggaaaatggaggacctgctcctgaatcaatcactgataaaatttacgagaacactaagacaatcaaggagtacccaatagcacaagatctacccaatgttgatatttctgctgttggtgtaaccagttttgaaggacctgaaggaaaatttgatgttgaagtttttgatcccgcagatgactacgttaaattaatgaagtcaatcttcgattttgaagccatccggaaattgctatcatctccaaagtttacattctgctatgatgcattgcatggagttgctggagcctatgcacatcgcatctttgtcgaagaactcggtgcgcaagaaagcgcattattgaactgcactcccaaggaggactttggaggagggcatccggatcccaatttgacctatgctaaggagcttgtggcacgaatgggattaggtaaatccgacactggaggtgaacctccagagtttggcgccgctgctgatggtgatgcagaccgtaacatgatccttggtaaaaggttctttgtaactccttcggattcagttgccataattgctgcaaatgctattggtgccatcccgtacttcagctctggtttgaaaggtgttgcaaggagcatgccaacctcagctgctcttgatgtcgttgcaaaaagcttgaatttgaagttctttgaggttccaacaggctggaagttttttggtaatctgatggatgctgggatgtgttctgtttgtggagaagaaagttttggaactggctcggatcatatccgtgagaaagacggaatatgggcagttcttgcatggatgtctatacttgctcacaagaacaagggaaatattgacggtaacgctaaactggtgtcagttgaagacattgtccgccagcattgggctacctacggtcgtcactattacactcgttacgactatgagaatgtagacgcaggtaaagctaaggaactgatggagcatttggtcaaattgcaatcttcaattcctgaagttaacaagattgtgaaaggaattcgttcggacgtggcaagcgtcgccagtgctgatgaattcgagtacaaagatccagttgatggatccatttcgaagcaccagggaatccgttacttgtttgaagacggatcacgacttgttttccgtctctctggaactggctcagaaggagcaaccatccggctttacatcgaacagtacgaaaaggatgcttcaaaaaccggccgagaatcccaggaagctttgtctcctctggttgacttagctctaaagctgtcgaagatggaagagttcacaggccgatcagcccccaccgtcataacataagaagggtcaagctcaacgactcaaaccattcaccttttcgtctatatgatgttttcttcttatactatccaagttacattataagaataattagtctcagggagaatttgtatttctcatcagaattctgaacaaccaagactgatttcttgagttgttgtgaggcttatacttgtacggatttggctttctcagttttgttctctcttgtttccgtattttggcgagtatactctcttaacatctaagttcattgatacctcaaagcatgctacgaccatcc

SEQ ID NO: 7001 - DNA, 2104 bp, Arabidopsis lyrata
catcactttctctgcgttcaattttgatctttgttctcttcaagacgaatatggttttcaaggtttctaccgtttcaacatctcctattgatggccagaaaccaggaacgtctggtctccgtaagaaggtgaaagtgttcaagcaacccaattatctagagaattttgtgcaagcaacattcaatgctcttacggcgcagaaggttaaaggtgccactcttgtggtctccggtgatggtcgttattattcaaaggatgctgttcagatcataattaagatggcagcagctaatggtgtacggagtgtgtgggttggtaaaaacactctgttatcaactcctgctgtatcagctgtgattcgtgaaagatcaggggctgatggatcgaaagcaactggagcctttatcttaacagcaagtcacaatcctggtggccctactgaggattttggaatcaaatacaatatggaaaacggaggacctgctccggaatcaatcactgataaaatttacgagaacactaagacaatcaaggagtacccaatagcagacgatctacccaatgttgatatttctaccatcggtgtaactagctttgaaggacctgatggcaaatttgatgttgaagttttcgactctgcagatgactacgttaaattgatgaagtcaatcttcgattttgaatcaatccggaaattgctttcatctccaaagtttacattctgctatgatgcattgcatggagttgctggagcctatgcacatcgcatttttgtcgaagaactcggtgcgcaagaaagcgcattattgaactgcacacccaaggaggactttggaggagggcatccggatcccaatttgacctatgctaaggagcttgtggcacgaatgggactaagtaaatccgacactggaggtgaacctccagagtttggcgccgctgctgatggtgatgcagaccgtaacatgatccttggtaaaaggttttttgtaactccttcagattcagttgccataattgctgcaaatgctattggggccattccgtacttcagctctggtttgaaaggtgttgctaggagtatgcccacctcagctgctctcgatgtcgttgcaaaaagcttgaatttgaagttctttgaggttccaacaggctggaagttttttggtaatctgatggatgctgggatgtgttctgtttgtggggaagaaagttttggaaccggctcggatcatatccgcgagaaagacgggatttgggcagttcttgcgtggatgtccatacttgctcacaagaacaagggaaatattgacggtaatgctaaactggtgtcggttgaagacattgtccgccagcattgggctacctacggccgtcactattacactcgttacgactatgagaatgtagacgcaggtaaagctaaggaactgatggagcatttggtcaaattgcaatcttcaattcctgaagttaacaagattgtgaaaggaattcgttcccatgtggcgaacgtcgccagtgccgatgaattcgagtacaaagatccagttgatggatccatttcgaagcaccagggaatccgttacttgtttgaagacggatcacgacttgttttccgtctctctggaactggctcagaaggagcaaccatcaggctctacattgaacagtacgagaaggatgcttcaaaaaccggccgagaatcccaggaagctttgtctcctctggttgacttagctctaaagctgtctaagatggaggagttcaccggccgatcagccccaaccgtcataacatgagaatggtcaagctcaacgactcgaatcatacacttttttttcctgcatctatatgatgctttcttcttatactatccaagttccattgtaagaataattagtctcagggagaatttgtatctcttatcggaattctgaacaaccaagaacgatttcttgagttgtcgtgaggcttatatatacttgtacggatttggctttctcggttttgttttctcttgtttccatcttttgcatgattaagattctcttaacatctaacttcattgatacctcaacatttaagcatgctacgaacatcc

SEQ ID NO: 7002 - DNA, 2047 bp, Brassica rapa
gaacctctccatgaactaatcgaaatctgatcttcttcttcttcttcacctcaaagaaggatatggttttcaaggtctctctcgtctcaacctcccccatcgatggccagaaacctggtacctctggtctccgtaagaaggtgaaagtgttcaagcaacccaattacctacacaactttgtccaatcaacttttaatgctcttactccagagaaagtcaaaggtgccactcttgtggtctctggtgatggccgttattactcaaatgatgctgttcagatcattattaagatggcagcagctaacggtgtgcgacgtgtgtgggttggtaaaaacactctcttatcaactcctgctgtatcggctgtgattcgtgaaagatcaggagctgatggatcgaaggcaacaggaggatttattttaacagcaagtcacaatcctggtggccctactgaggattttggaatcaaatacaatatggaaaacgggggacctgctcctgaatcaatcactgataagatttacgagaacactaagacgatcaaggagtacccaatagcagaagatctacccattgttgatatatctgccattggcgtatccagttttgaaggacctgaaggaaagtttgatgttgaagtttttgattccgctgatgactacgttaaactaatgaagtcaatcttcgactttgaatccatccggaagttgctttcatctccaaagttttcattctgctatgatgcaatgcatggagttgctggagcctatgcacatcggatctttgtcgaagaacttggtgcgcaagaaagttctctattgaactgcgtacccaaggaggactttggtggaggtcatcccgatcccaatctgacctatgctaaggagcttgtggcacgaatgggattaggtaaatccgacaccggagttgaacctccagagtttggtgctgcggctgatggtgatgcagaccgtaacatgatccttggtaaaaggttctttgtaactccatctgattcggttgctataattgctgcaaatgctgttggggccataccttacttcagcactggtttgaaaggtgttgcaaggagcatgccgacctcagcagctcttgatgtcgttgcaaagagcttgaatttgaagttctttgaggttccaacaggctggaagttttttggtaatctgatggatgctggaatgtgttctgtttgtggggaagaaagttttggaactgggtcggaccatatccgtgagaaagatgggatttgggcagttcttgcgtggctgtccatacttgctcacaagaacaaggaaactcttgatggtgacgctaaattggtgacggttgaagacattgtccgcaaacactgggcaacctatggccgtcactattacactcgttacgactatgagaatgtagacgcaggtaaagctaaggaactgatggagcatttggtcaaattgcaatcttcaatccctgaagtcaacaagatggtgaaaggaattcgttcggacgtggctaacgtctcgagtgcggatgaattcgagtacaaagatccagttgatggctccatctccaagcaccagggaatccgttacttgtttgaagatggatcacgacttgttttccgtctgtctggaactggctctgaaggagcaaccatccgactctacattgaacagtacgagaaggatgcttctaaaaccggacgagagtcccatgaagctctgtctcctctggtggacatagctctgaaactgtccaagatggaggagttcacgggccgatcagcccccaccgtcataacataaaaaggcggctcaagtgcaacggtctcaaatcatacacttctttgtctagttctttgggatgctttgtttcttctcatttaaatgaaactatgaataattaagagtctcggggaggctttcatatttcatgagttatcgtgaagcttatacttggatttgtctttctcggttttgttattttacatgtattacgtacatgattaagatttgttattgcagttcaatgattttgc

SEQ ID NO: 7003 - DNA, 2042 bp, Brassica napus
actaatcgaaatctgatcttcttcttcttcacctcaaagaaggatatggtgttcaaggtctctctcgtctcaacctcccccatcgatggccagaaacctggtacctctggtctccgtaagaaggtgaaagtgttcaagcaacccaattacctacacaactttgtccaatcaacttttaatgctcttactccagagaaagtcaaaggtgccactcttgtggtctctggtgatggccgttattactcaaatgatgctgttcagatcattattaagatggcagcagctaacggtgtgcgacgtgtgtgggttggtaaaaacactctcttatcaactcctgctgtatcggctgtgattcgtgaaagatcaggagctgatggatcgaaggcaacaggaggatttattttaacagcaagtcacaatcctggtggccctactgaggattttggaatcaaatacaatatggaaaacgggggacctgctcctgaatcaatcactgataagatttacgagaacactaagacgatcaaggagtacccaatagcagaagatctacccattgttgatatatctgccattggcgtatccagttttgaaggacctgaaggaaagtttgatgttgaagtttttgattccgctgatgactacgttaaactaatgaagtcaatcttcgactttgaatccatccggaagttgctttcatctccaaagttttcattctgctatgatgcaatgcatggagttgctggagcctatgcacatcggatctttgtcgaagaactcggtgcgcaagaaagttctctattgaactgcgtacccaaggaggactttggtggaggtcatcccgatcccaatctgacctatgctaaggagcttgtggcacgaatgggattaggtaaatccgacaccggagttgaacctccagagtttggtgctgcggctgatggtgatgcagaccgtaacatgatccttggtaaaaggttctttgtaactccatctgattcggttgctataattgctgcaaatgctgttggggccataccttacttcagcactggtttgaaaggtgttgcaaggagcatgccgacctcagcagctcttgatgtcgttgcaaagagcttgaatttgaagttctttgaggttccaacaggctggaagttttttggtaatctgatggatgctggaatgtgttctgtttgtggggaagaaagttttggaactgggtcggatcatatccgtgagaaagatgggatttgggcagttcttgcgtggctgtccatacttgctcacaagaacaaggaaactcttgatggtgacgctaaattggtgacggttgaagacattgtccgcaaacactgggctacctatggccgtcactattacactcgttacgactatgagaatgtagatgcaggtaaagctaaggaactgatggagcatttggtcaaattgcaatcttcaatccctgaagtcaacaagatggtgaaaggaattcgctcggacgtggcgaatgtatccagtgcagatgaattcgagtacaaagatccagttgacggctccatctcgaagcaccagggaatccgttacctgtttgaagatggatcacgacttgttttccgtctgtctggaactggctcggaaggagcaaccatccgactctacattgaacagtacgagaaggatgcttctaaaaccggacgagagtcccatgaagctctgtctcctctggtggacatagctctgaaactgtccaagatggaggagttcacgggccgatcagcccccaccgtcataacataagaaggcgggtcaagtgcaacggtctcaaatcatacacttctttgtctacttctttgggacgctttgtttcttctcatttaaatgaaactatgaataattaagagtctcggggaggctttcatatttcatgagttatcgtgaagcttatacttggatttgtcttttctcggttttgttattgcagttcaatgattttgcatgtttcgtctcttaacatctaacaactttattgataactcaacgtg

SEQ ID NO: 7004 - DNA, 2054 bp, Brassica napus
aatctgatcttcttcttcttcacctcaaagaaggatatggtgttcaaggtctctctcgtctcaacctcccccatcgatggccagaaacctggtacctctggtctccgtaagaaggtgaaagtgttcaagcaacccaattacctacacaactttgtccaatcaacttttaatgctcttactccagagaaagtcaaaggtgccactcttgtggtctctggtgatggccgttattactcaaatgatgctgttcagatcattattaagatggcagcagctaacggtgtgcgacgtgtgtgggttggtaaaaacactctcttatcaactcctgctgtatcggctgtgattcgtgaaagatcaggagctgatggatcgaaggcaacaggaggatttattttaacagcaagtcacaatcctggtggccctactgaggattttggaatcaaatacaatatggaaaacgggggacctgctcctgaatcaatcactgataagatttacgagaacactaagacgatcaaggagtacccaatagcagaagatctacccattgttgatatatctgccattggcgtatccagttttgaaggacctgaaggaaagtttgatgttgaagtttttgattccgctgatgactacgttaaactaatgaagtcaatcttcgactttgaatccatccggaagttgctttcatctccaaagttttcattctgctatgatgcaatgcatggagttgctggagcctatgcacatcggatctttgtcgaagaactcggtgcgcaagaaagttctctattgaactgcgtacccaaggaggactttggtggaggtcatcccgatcccaatctgacctatgctaaggagcttgtggcacgaatgggattaggtaaatccgacaccggacttgaacctccagagtttggtgctgctgctgatggtgatgcagaccgtaacatgatccttggtaaaaggttctttgtaactccatctgattcggttgctataattgctgcaaatgctgttggggccataccttacttcagcactggtttgaaaggtgttgcaaggagcatgccgacctcagcagctcttgatgtcgttgcaaagagcttgaatttgaagttctttgaggttccaacaggctggaagttttttggtaatctgatggatgctggaatgtgttctgtttgtggggaagaaagttttggaactgggtcggaccatatccgtgagaaagatgggatttgggcagttcttgcgtggctgtccatacttgctcacaagaacaaggaaactcttgatggtgacgctaaattggtgacggttgaagacattgtccgcaaacactgggcaacctatggccgtcactattacactcgttacgactatgagaatgtagacgcaggtaaagctaaggaactgatggagcatttggtcaaattgcaatcttcaatccctgaagtcaacaagatggtgaaaggaattcgttcggacgtggctaacgtctcgagtgcggatgaattcgagtacaaagatccagttgatggctccatctccaagcaccagggaatccgttacttgtttgaagatggatcacgacttgttttccgtctgtctggaactggctcggaaggagcaaccatccgactctacattgaacagtacgagaaggatgcttctaaaaccggacgagagtcccatgaagctctgtctcctctggtggacatagctctgaaactgtccaagatggaggagttcacaggccgatcagcccccaccgtcataacataagaaggcgggtcaagtgcaacggtctcaaatcatacacttctttgtctacttctttgggatgctttgtttcttcttatttaaatgaaactatgaataactaagagtctcggggagcctttcatatttcatgagttatcgtgaagcttatacttggatttgtctttctcggttttgttattttacatgtattacgtacatgattaatatttgttattgcagttcaatgaaaaaaaaaaaaacccaactcgagactagttctctctctc

SEQ ID NO: 7005 - DNA, 2102 bp, Brassica napus
gtctctccagtcactaatcgaaatctgatcttcttcttcttcacctcaaagaagggatatggttttcaaggtctctctcgtctcaacctcccctatcgatggccagaaacctggcacctctggtctccgtaagaaggtgaaagtgttcaagcaacccaattacctacagaactttgtccaatcaacttttaatgctcttactccagcgaaagtcaaaggtgccacactcgtggtctctggtgatggccgttattactcaaatgatgctgttcagatcattattaagatggcagcagctaacggtgtgcgacgtgtgtgggttggtaaaaacactctcttatcaactcctgccgtatcggctgtgattcgtgaaagatcaggagctgatggatcgaaggcaacaggaggatttattttaacagcaagtcacaatcctggtggccctactgaggattttggaatcaaatacaatatggaaaacgggggacctgctcctgaatcaatcactgataagatttacgagaacactaagacgatcaaggagtacccaatagcagaagatctacccattgttgatatatctgccattggcgtatccagttttgaaggacctgaaggaaagtttgatgttgaagtttttgattccgctgatgactacgttaaactaatgaagtccatcttcgactttgaatccatccggaagttgctttcatctccaaagttttcattctgctatgatgcaatgcatggagttgctggagcctatgcccatcggatctttgtcgaagaactcggttcgcaagaaaattctctattgaactgcgtacccaaggaggactttggtggaggtcaccccgatcccaatctgacctatgctaaggagcttgtggcacgaatgggattagggaaatccgacaccggagttgaacctccagagtttggtgctgctgctgatggtgatgcagaccgtaacatgatccttggtaaaaggttctttgtaactccatctgattcggttgctataattgctgcaaatgctgttggggccataccttacttcagcactggtttgaaaggtgttgcaaggagcatgccgacctcagcagctcttgatgtcgttgcaaagagcttgaatttgaagttctttgaggttccaacaggctggaagttttttggtaatctgatggatgctggaatgtgttctgtttgtggggaagaaagttttggaactgggtcggatcatatccgtgagaaagatgggatttgggcagttcttgcgtggctgtccatacttgctcacaagaacaaggaaactcttgatggtgacgctaaattggtgacggttgaagacattgtccgcaaacactgggctacctatggccgtcactattacactcgttacgactatgagaatgtagatgcaggtaaagctaaggaactgatggagcatttggtcaaactccaatcttcaatccctgaagtcaacaagatggtgaaaggaattcgctcggacgtggcgaatgtatccagtgccgatgaattcgattacaaagatccagttgatggctccatctctaagcaccagggaatccgttacctgtttgaagatggatcacgacttgttttccgtctgtctggaactggctcggaaggagcaaccatccgactctacattgaacagtacgagaaggatgcttctaaaaccggacgagagtcccatgaagctctgtctcctctggtggacatagctctgaaactgtccaagatggaggagttcacgggccgatcagcccccaccgtcataacataagaaggcgggtcaagtgcaacggtctcaaatcatacacttctttgtctacttctttgggacgctttgtttcttctcatttaaatgaaactatgaataattaagagtctcggggaggctttcatatttcatgagttatcgtgaagcttatacttggatttgtcttttctcggttttgttattgcagttcaatgattttgcatgtttcgtctcttaacatctaacaactttattgataaaaaaaaaaaaaaagggcagccgctcgcgatctagaactagtagttctagatcgcga

SEQ ID NO: 7006 - DNA, 2035 bp, Brassica napus
ggtctctccagtcactaatcgaaatctgatcttcttcttcttcacctcaaagaagggatatggttttcaaggtctctctcgtctcaacctcccctatcgatggccagaaacctggcacctctggtctccgtaagaaggtgaaagtgttcaagcaacccaattacctacagaactttgtccaatcaacttttaatgctcttactccagcgaaagtcaaaggtgccacactcgtggtctctggtgatggccgttattactcaaatgatgctgttcagatcattattaagatggcagcagctaacggtgtgcgacgtgtgtgggttggtaaaaacactctcttatcaactcctgccgtatcggctgtgattcgtgaaagatcaggacctgatggatccaaggcaacaggaggatttattttaacagcaagtcacaatcctggtggccctactgaggattttggaatcaaatacaatatggaaaacgggggacctgctcctgaatcaatcactgataagatttacgagaacactaagacgatcaaggagtacccaatagcagaagatctacccattgttgatatatctgccattggcgtatccagttttgaaggacctgaaggaaagtttgatgttgaagtttttgattccgcggatgactacgttaaactaatgaagtccatcttcgactttgaatccatccggaagttgctttcatctccaaagttttcattctgctatgatgcaatgcatggagttgctggagcctatgcccatcggatctttgtcgaagaactcggttcgcaagaaaattctctattgaactgcgtacccaaggaggactttggtggaggtcaccccgatcccaatctgacctatgctaaggagcttgtggcacgaatgggattacgtcaatccgacaccggagttgaacctccagagtttggtgctgctgctgatggtgatgcagaccgtaacatgatccttggtaaaaggttctttgtaactccatctgattcggttgctataattgctgcaaatgctgttggggccataccttacttcagcactggtttgaaaggtgttgcaaggagcatgccgacctcagcagctcttgatgtcgttgcaaagagcttgaatttgaagttctttgaggttccaacaggctggaagttttttggtaatctgatggatgctggaatgtgttctgtttgtggggaagaaagttttggaactgggtcggaccatatccgtgagaaagatgggatttgggcagttcttgcgtggctgtccatacttgctcacaagaacaaggaaactcttgatggtgacgctaaattggtgacggttgaagacattgtccgcaaacactgggcaacctatggccgtcactattacactcgttacgactatgagaatgtagacgcaggtaaagctaaggaactgatggagcatttggtcaaattgcaatctacaatccctgaagtcaacaagatggtgaaaggaattcgttcggacgtggctaacgtctcgagtgcggatgaattcgagtacaaagatccagttgatggctccatctccaagcaccagggaatccgttacttgtttgaagatggatcacgacttgttttccgtctgtctggaactggctcggaaggagcaaccatccgactctacattgagcagtacgagaaggatgcttctaaaaccggacgagagtcccatgaagctctgtctcctctggtggacatagctctgaagctgtccaaaatggaggagttcacgggccgatcagcccccaccgtcataacataagaaggcgggtcaagtgcaacggtctcaaatcatacacttctttgtctacttctttgggatgctttgtttcttcttatttaaatgaaactatgaataactaagagtctcggggagcctttcatatttcatgagttatcgtgaagcttatacttggatttgtctttctcggttttgttattttacatgtattacgtacatgattaatatttgttattgcagttcaa

SEQ ID NO: 7007 - DNA, 2022 bp, Eutrema halophilum
cgaattcaagagacgagccacacgcgtcaccttcccgtttagcttactctccttctcataacttctttaagggatttttcatcatcctcctccgttcatcttctttcagattgaaaatggtgtcgttcaaggtctctgtcgtctctacttcgcctatcgatggccagaaacctggaacttctggactccgtaagaaggtgaaagtgttcaagcaacccaattacttagaaaattttgtccaggcaacgttcaatgctctcactccagagaaagtcaaaggtgcgacacttgtggtctctggtgatggtcgttattattcggaggaggctattcagattataatcaagttggcagcagcaaatggtgttagacgggtgtgggttggtcaaaacagtctgctatcaactcctgctgtatcagctgttattcgtgaaagagtaggaaatgatggatctaaagccacaggggcatttatattaacagcaagtcataatcctggtggccctactgaggattttggaattaaatacaatatggaaaatggtggaccagctcctgaatctatcactgataagatttacgagaacacaaagacaattaaggagtacccaatagcggaagatctacccagtgttgatatttctgctattggtacaaccagctttgagggaccggaaggaaaattcgacgttgaagtttttgattccgcagatgactacgtcaaattgatgaagtcaatcttcgactttgaatccatcaagaagctgctttcatctccaaaatttacattctgctatgatgcattgcatggagttgctggagcctatgcacaccgtatctttgtcgaagaactcggcgcacaagaaagttcgttgttgaactgcacacccaagaaagattttggaggaggtcatccagatcccaaccttacctatgctaaggagctcgtggcacgaatgggattgagtaaaattgatcctggagttgagcctccagagtttggcgctgctgctgatggtgatgcagatcgtaacatgatccttggtaaaaggtttttcgtaactccttcggattcagttgccataattgctgcaaatgctgttggagccataccgtacttcagctctggtttaaaaggtgttgcaaggagcatgccgacctctgctgctcttgatgtcgttgcaaaaaacttgaacctgaaattctttgaggttccaacaggctggaaattttttggcaatcttatggatgctgggatgtgctctgtatgtggtgaagaaagctttggaaccggttcggatcatatccgcgagaaagacgggatctgggcagttcttgcttggctgtctatactggctcacaagaacaaggaaacccttgatgggaatgcaaaactagtgacagtggaagacatcgttcgccagcactgggctacttatggccgtcactattacactcgttacgactatgagaacgtagacgcagctgcagctaaagaactcatggcgctcttggttaagttgcagtcttcgcttcctgaagtgaacaagattgtgaaggaaatccatccgaacgtggcaaatgttgcaagcgctgatgaatttgaatacaaagatccagtagatggctctgtttcaaagcaccaagggatccgatacttgttcgaggatggatcacgacttgtgttccgtctctcgggaactggctcagaaggagcaacaatcaggctctacattgaacagtacgagaaggacgcctcaaagaccggccgagattctcaggatgctcttgctcctctggttgatgttgctttaaagctgtcgaagatgcaagagttcactggccgatcatccccaaccgtcattacataagacagcttgccgataatgctgtctcctatactactcttgttccaacttcgattcttatgaatttgggtttttactttttttttgtcttacaaaactatacatacttccaaacatctatcataatggaaaatacagattggtggcaattgaa

SEQ ID NO: 7008 - DNA, 1844 bp, Arabidopsis lyrata
ggcttcgttcagatttgaaaatggtgtcgttcaaggtctctgtagtctctacttcgcctattgatggccagaaacctggaacttctgggctccgtaagaaggtgaaagtgtttaagcaaccaaactaccttgaaaattttgttcaggcaacgttcaatgctcttactcctgagaaagttaaaggtgccacacttgtggtctctggtgatggtcgttattattcagagcaagctattcagattatagttaagatggcagcggctaatggtgttagacgcgtgtgggttggtcaaaacagtctgctatcaactcctgctgtatcagctattatccgtgaaagagtaggggctgatggatctaaagccaccggagcatttatattaactgcaagtcataatcctggtggcccaactgaggatttcggaattaagtacaatatggagaatggtggaccagctcctgaatcaattacagataagatttacgagaacacaaagacaatcaaggagtacccaatagcggaagatctacccagggttgatatttctaccataggtataaccagctttgagggacctgaaggaaagtttgacgtcgaagtttttgattccgcagatgactatgttaaactaatgaagtcaatcttcgactttgaatccatcaagaaattgctatcatctccaaaatttacgttctgctatgatgcattgcatggagtggctggagcctatgcacaccgcatctttgtcgaagaactaggtgcagaagaaagttcgttgttgaactgcgtacccaaggaggactttggaggaggtcatccggatcccaatcttacctatgctaaggagcttgtggcacgcatgggattgagtaaaactgatgatgccggaggcgagcctccagagtttggcgccgctgctgatggtgatgcagaccgaaacatgatccttggtaaaaggtttttcgtaactccttcggattcagttgccataattgctgcaaatgctgttggggccataccatacttctgctctggtttgaaaggtgttgcaaggagcatgcccacctcagctgcccttgatgtcgttgcaaaaaacttgggtttgaagttctttgaggttccaacaggctggaaatttttcggcaatctaatggatgctgggatgtgctctgtatgcggagaagaaagctttggaactggttcggatcatatccgtgagaaagatgggatctgggcagttcttgcttggctatcaatactggctcacaagaacaaggaaacccttgatgggaatgcaaaactggtgacggttgaagacatcgtccgccagcactgggctacatatggccgtcactattacactcgatacgactatgagaacgtagatgcaactaaagctaaagaactcatggggctcttggtgaagttgcaatcttcacttcctgaagtcaacaagattataaagggaattcatccggaggttgcaaatgttgcgagtgcagatgaatttgagtacaaagatccagtagatggctctgtttcaaagcaccaagggatccgatacttattcgaggatgggtcacgacttgtgttccgtctctcgggaactggctcagaaggagcaacaataaggctctacattgaacagtatgaaaaggacgcctcaaagatcggccgagattctcaggatgctcttgctcctttggttgatgttgctttaaagctgtcgaaaatgcaagagttcaccggccgatcatcaccaactgttattacataagacagctttcagacgatgctgtctcgaatactatcattccaacttcacttcttatgagtttgggtt

SEQ ID NO: 7009 - DNA, 2146 bp, Arabidopsis thaliana
atgttcctcttggttacttcttgctttctacctgattcaggttcttcagttaaagtttctcttttcatttttgggacgaaaagagatcctaccaaaaaaaaaaacgaaaagagacgagccacacgcgtcaccttctcgtttagcctcttcatctcctttcctcagactcactgtgtaaaaaggcttttattttatcatcttcaggcttattcgattttcttcagatttgaaatggtgtcgttcaaggtctctctcgtctctacttcgcctattgatggccagaaacctgggacttctggactccgtaagaaggtgaaagtgtttaagcaaccaaattaccttgaaaattttgtccaggcaacgttcaatgctcttactacagagaaagttaaaggtgcgacacttgtggtttctggtgatggtcgttattattcagagcaagctattcagattatagtaaagatggcagcagctaatggtgttagacgtgtgtgggttggtcaaaacagtctgctatcaactcctgcagtatcagctattattcgtgaaagagtaggggctgatggatctaaagccacaggagcatttatcttaacagcaagtcataatcctggtggcccaactgaggatttcggaattaagtacaatatggaaaatggtggaccagctcctgaatcaatcactgataagatttacgagaacacaaagacaatcaaggagtacccaatagcggaagatctacccagggttgatatttctactattggtataaccagctttgaaggacctgaaggaaagtttgacgtcgaagtttttgattctgcagatgactatgttaaactaatgaagtcaatcttcgactttgaatccatcaagaaattgctatcttatccaaaatttactttctgctatgatgcattgcatggagtggctggagcatatgcacatcgcatctttgtcgaagaactaggtgcaccagaaagttcgttgttgaactgcgtacccaaggaggactttggagggggccacccggatcccaatcttacctatgctaaggagctcgtggcacgcatgggattgagtaaaactgatgatgctggtggcgagcctccagagtttggcgccgctgctgatggtgatgcagaccgaaacatgatcctcggtaaaaggtttttcgtaactccttcggattcagttgctataattgctgcaaatgctgttggggccataccatacttcagctctggtttaaaaggtgttgctaggagcatgccgacctcagctgcacttgatgtcgttgcaaaaaacttgggtttgaagttctttgaggttccaacaggctggaaattctttggcaatctaatggatgctgggatgtgctctgtatgcggagaagaaagttttggaaccggttcggatcatatccgtgagaaagatgggatctgggcagttcttgcttggctatcaatactggctcacaagaacaaggaaacccttgatgggaatgcaaaactggtgacggttgaagacattgtccgccagcactgggctacatatggccgtcactattacactcgatacgactatgagaacgtagacgcaactgcagctaaagaactcatgggacttttggttaagttgcaatcttcacttcccgaagtcaacaagattataaagggaattcatccagaggtggcaaatgttgcaagcgcagatgagttcgagtacaaagatccagtagatggctctgtttcaaagcaccaagggatccgatacttattcgaggatggatcacgacttgtgttccgtctctcgggaactggctcagaaggagcaacaataaggctatacattgaacaatacgagaaggacgcctcaaagatcggccgagattctcaggatgctcttggtcccctggttgatgttgcattaaagctgtcgaaaatgcaagagttcaccggccgatcatcaccaactgttattacataagacagctttcagaagacgctgtctccaatactactctcattccaacttcatttcttatgaatttgggttttgcttttttcctgttatctgttatcttacacaagtatacttcaatacatataattttaatggaatatacattaggttggcaattgaa

SEQ ID NO: 7010 - DNA, 2061 bp, Eutrema parvulum
aaaagccgaaaagagacgagccacacgcgtcaccttctcgtttagcctcactatactctcctcctcaaaactgctgctaaaagcgtgctctttcatcatcttcttccttcactttcagagtcattcgatttttttcttcttttactttcagattgatatggtttcgttcaaggtctctctcgtctctacttctcctattgatggccagaaaccgggaacttctgggctccgtaagaaggtgaaagtattcaagcaacccaattacctggaaaattttgtgcaggcaacgttcaatgctcttactgcagagaaagtcaaaggcgccacacttgtggtctctggtgatggtcgttattactcggaggaagctattcagattatgcttaagttggcagcagcaaatggtgttagacgtgtgtgggttggtcaaaacactctgctatcaactcctgctctatcggctattattcgtgaaagagtaggaaacgatggatctaaagccaatgggggatttatattaacagcaagtcataatcctggtggccctactgaggatttcggaattaaatacaatatggaaaatggtggcccggctcctgaatcaatcactgataagatttacgagaacacaaagacaatcaaggagtatcctatagcggaagatctacccagtgttgatatctctgctactggtgtaaccagcttcgacggaccagaaggaaaatttgacgttgaagtttttgattctgcagacgactatgtgaaattaatgaagtcaatcttcgactttgaatccatcaagaagctactttcgtctccaaaatttacgttctgctatgatgcaatgcatggagttgctggagcctatgcacaccgcatctttgtcgaagaactcggcgcacaagaaagttcgttgttgaactgcacaccgaagaaagactttggaggaggtcatccggatcccaatcttacctatgctaaggaacttgtggcgcgaatggggttgagtaaaactgatgctggagttgagcctccagagtttggcgccgctgctgatggtgatgcagaccgtaacatgattcttgggaaaaggtttttcgtaactccttcggattcagttgccataattgctgcaaatgctgttggcgccataccgtacttcagctctggtctaaaaggtgttgcaaggagcatgccgacctcagctgctctggatgtcgttgcaaaaaacttggatttgaagttctttgaggttccaacagggtggaaattttttggcaatcttatggatgctgggatgtgttctatctgtggggaagaaagctttggaaccggttcggatcatatccgtgagaaagacgggatctgggcagttcttgcttggctgtctatattggctcacaagaacaaggaaactcttgatgggaatgcaaacctggtgacggttgaagacattgttcgccagcactgggctacttatggccgtcactattacactcgatacgactatgagaacgtagacgcagctgcagctaaagaactcatggcgctcttagttaagttgcagtcttcacttcctgaagtgaacaagattgtgaagggtcttcacccggaggtggcaaatgttgcaagtgcggatgaattcgaatacaaagatccagtagatggctctgtttcgaagcaccaagggatccgatacttgttcgaggatggctcacgacttgtgttccgtctttcgggaactggctcggaaggagcaactatcaggctctacattgaacagtatgagaaggatgccgcaaagacgggccgagattctcaggatgctctctctcctctggttgatgttgctttgacgctatcgaagatgcaagagttgaccggccgatcatccccgactgttattacataagacaactttccgacgatgctgtcttcaatactactcttattccaacttcatttcttatgaatttgggttttgcttttcttgttaaattactcgaattatctgttgttatcttacagaattacttctaaacatatatatgttaatgggaa

SEQ ID NO: 7011 - DNA, 2196 bp, Cucumis melo
attgttccccctctacgtgtcgttataactcaacatttctcacttccgtttcgcttcccttatttgtacaaatacaaaaccgcagaatcaagcaaacccatcccccccccgcactcatcgcccactgcttcctctctatattaatctcccttctcccccatttccccctatctcccttcaattccctccacttttcttctcatcaacccatggctcgcttcaatgtcaccaagaagctcacatcccccatcgatggccagaaacccggtacttccggcctccgcaagaaggttaaagtattcattcaaccgaactacttggagaattttgttcaatcaacatttaatgcattgactactgaaaaagtcagaggggctacacttgttgtatctggagatggacgctattattcaaaggatgctattcagataataattaagatggctgcggcaaatggggtacgccgtatttgggttggtcaaaatggtttgctttcaacccctgctgtgtctgctgtcatacgtgaaagagttggtgttgatggatcccgagcatcaggagcatttattttgactgcaagtcacaatccaggaggtcctcatgaggattttgggattaaatacaacatggaaaatggcggccctgcaccagagggaattactgataagatctatgaaaacacaaaaaccataaaggagtacctaattgctgaagatctacctaacgtggatatttccgcaataggtgtttctagctttggtggacctgaaggacaatttgatgttgaggtttttgattcagctagtgactacgtgaagttgatgaagtcaatatttgattttgaatctatccgcaagcttctaacctctcccaaattttcgttctgttatgatgctctacatggtgttgctggagcatatgcaaaacgtattttcgtggaagagcttggtgcacaagaaagctcattactgaactgcgtacctaaggaggactttggaggaggtcatcctgaccccaatttgacttatgccaaggaattagttgatcgtatgggattgggtaaatcaagctctggagaacctccagaatttggtgctgctgctgatggtgatgcagatcgtaatatggtccttggtaaaaggttttttgtcactccttcggactctgttgccattattgctgctaatgctgttgaagctattccatacttctctgctggtttgaagggtgttgccaggagcatgccaacctctgctgcactagacgtggttgccaaaaacttgaagttgaaattttttgaggttcctactggttggaaatttttggtaatttaatggatgcaggaatgtgctcagtctgtggggaagaaagttttggaactggatctgaccatattcgtgaaaaagatggaatttgggcagttttggcttggttatccattcttgcttataaaaacaagggaaaccttgatggtgggaagctcgtttcagtcgaagacatagttcgccaacattgggccacctatggtcgtcattattataccagatatgattacgagaatgttgatgccggagcagcaaaggaactgatggcaaatctggtgaaactgcaatcttcacttgacgaagtgaatggaattgtcaagggaatccgttcagatgtggcaaaggttgtccatggtgatgaatttgagtataaagatccggttgatggttccatctccaagcaccagggtattcgatatttgtttgaggatggttcacgactggtcttccgcctatctggaactggctctgaaggtgcaacaattcggctctacatcgagcaatatgagaaagatccatcaaaaaccgggagagattctcaggaagcccttgctcccctggtggaagttgctcttaagctctcaaaaatgcaagagttcaccgggagatccgcacccaccgtcattacataaatggagtttatacacaaccttgatttttgaagaaataattgttgcttagcttgcggtggcgcaagatataatcttaaaacatcactgtaagtgcttccagagtgtttgtttgtttggcgggaaaactttagcctacataaattttggtgtttgtgttaataatcttgatgcttcttgtgaagctcgactaagttacagaatataaatatatatatatatacacttcatatcaaaaaaaa

SEQ ID NO: 7012 - DNA, 2141 bp, Citrullus lanatus
acccacccccccccccccccactcatcgcccacttcttccttcttcttcttcttctcctctctctattaatcctccttctcctctttctcccctttccccttcccccatcttccttccttctcttccagtcatggttcgcttcaatgtcaccaggaagctcacatcccccatcgacggccagaagcccggtacttccggcctccgcaagaaggtaaaagtattcattcaaccgaactacttggagaattttgttcagtcaacatttaatgcattgactgctgaaaaagtcagaggggctacacttgttgtatctggagatggacgctattattcaaaggatgctattcagataatagttaagatggctgcagcaaatggggtacgacgtatttgggttggtcaaaatggtttgctttcaactccagctgtgtcagctgttatacgtgaaagagttggggttgatggatcccgagcatcaggagcatttattttgactgcaagtcacaatccaggaggtcctaatgaggattttgggattaaatacaacatggaaaatggcggccctgcaccagagggaattactgataagatctatgaaaacacaaaatccataaaggagtacttaattgctgaggatctacctaacgtggatatttccgcaataggtgtttctagctttggcggacctgaaggacaatttgatgttgaggtttttgattcagctagtgactatgtgaagttgatgaagtcaatatttgattttgaatctattcgcaagcttctatcctcccccaaattctcattctgttatgatgctctacatggtgttgctggagcttatgcaaaacgtatttttgtggaagagcttggtgcacaagaaagctcattactgaactgcgtgcctaaggaggacttcggaggaggtcatcctgaccccaatctgacttatgccaaggaattggttgctcgtatgggattgggtaaatcaagctctggagaagaacctccagaatttggtgctgctgctgatggtgatgcagatcgcaatatggtccttggtaaaaggttttttgtcactccttcagactctgttgccattattgctgctaatgctgttgaagctattccatacttctctgctggtttgaagggtgttgccaggagcatgccaacctctgctgcactagatgtggttgccaaaaacttgaacttgaagttttttgaggttcccaccggctggaaattttttggtaatttaatggatgcaggaatgtgctctgtatgtggggaagaaagttttggaactggttctgaccatattcgtgagaaagatggaatttgggcagttttggcttggttatctattcttgcttataaaaacaagggaaaccttgatggtggaaagcttgtgacagtcgaagacatagttcgccaacattgggccacctatggtcgtcattattatactagatacgattacgagaatgttgacgctggagcagcaaaggagctaatggcaaatctggtgaagctgcaatcttcacttgccgaagttaatggaattgtccaaggaatccgctcggatgtgtcaaaggttgtccatggtgatgaatttgagtataaagatccagttgatggttccatctccaagcaccagggaattcgatatttgtttgaggatggttcacgactggtcttccgcctatctggaactggctctgaaggtgcaacaattcggctctacatcgagcaatatgagaaagatccgtcaaaaactgggagagattctcaggaagctcttgctcctctggtggaagttgctcttaagctctcaaaaatgcaagaattcaccggccgatccgcccctaccgtcattacataaatgaatttatacacacccatgattttgaagaaatacttgttgctagcttgcggtggcgcaagataaatatcttataacatcgatgtaagtgcttccagagtgtttgtttggcgggaaaactttagcctacttaaatttttgggttttgattgtgttaataatttgatgcttcttatgaagctcgactaagttatagaatatatatatataatatacacacttaaatgtgattttacccatttttgttatacctttacc

SEQ ID NO: 7013 - DNA, 1988 bp, Manihot esculenta
acatggtggtgttcaaggtttctcgtgtggagactacgcctttcgatggccagaaaccgggaacttctggccttcggaagaaggtgaaagtttttattcagcctaattacttggaaaattttgttcaatcaacattcaatgccctgactgcagaaaaagttagaggcgctacacttgttgtttctggtgatggccgctattactcaaagaccgctattcagattattattaagatggcagctgcaaatggggtcaggcgtgtttgggttggtcagaatggattactttcaactcctgctgtgtcagctgtaatccgtgaaagggttggaatagatggatcaaaagcaacaggagcatttatattgacagcaagtcataatccaggtggtccacatgaggattttggtattaaatataacatggaaaatggcggacctgctcctgagggaatcacagataagatctatgagaacacaacatcaataaaagagtacctaattgctgatctgcctgatgtggatattgcagcaattggtgtgactaattttggcgggcctgagggacaatttgatgttgaggtctttgattcagcaagtgattatgtgaaattgatgaaatctatctttgattttgagtctataaggaagctgctttcatctccaaaattcacattctgttatgatgcattacatggtgttgctggggcttatgcaaaacgtatttttgtggaggagctcggtgcacaagagagctcattgttgaactgtgttcccaaggaggactttggaggaggtcatccagatcccaatctcacttatgcaaaagagttggttgctcgcatgggattgagtaaatcaaattctcaagttgaacccccggaatttggtgctgctgctgatggtgatgcagatcgtaacatgatccttggtaaaaggttctttgtaactccatcggattctgttgcaatcattgctgccaatgcagttgaagccataccttatttctctgctggtctaaagggggttgccaggagtatgccgacatcggctgcccttgatgttgtggccaaacatctgaatttgaaattctttgaggtccccactggctggaagttttttggcaatttgatggatgcaggattgtgttcagtttgtggggaagaaagttttggaacggggtctgaccatatacgtgagaaagatggcatttgggcagttctggcctggctatctatactggcatacaaaaataaggaaaatctcaatggaggaaagcttgtgactgttgaagatatagttcgcaatcattgggctacctatggccgccattattatactcgatatgactatgagaacgttgatgcaagtgcagcaaaggaactaatggcaaacttggttaagctgcagccttccctcggtgaagttaacgagattgtcaaggggataagatcagatgtatcaaaggtggtccatgctgatgaatttgaatacaaagaccctgttgatggttcaatctcaaagcaccagggtattcgatatttgtttgaggatggctctcgactggttttccgcctctcaggaactggctcagaaggtgcaaccatacgtctttatattgaacaatatgagaaggattcatcaaaaactggaagagattctcaagaagcactcgctcctcttgtggatgttgctctcaaactttctaagatgcaggaattcacaggccgatctgcgccaactgttattacttagatgcacaacggtacatgcaaattttgatatcaaattcccatttgaacttgaacaaatatggttgtgctttggtaattatgaaccgatttaaggaaactttgtttaagctattggtccttgacctgaatgtatcctagaagtaccaggtattcaagtgtatgagattatactatgccataaaacatgccgaccttgatttttgatgtgagaataatacaaagtatctcatttctgggc

SEQ ID NO: 7014 - DNA, 2101 bp, Castanea mollissima
ctcactctcacccaagaatatagtttatttttggccaacttttcttttatctccaccttcagtccgcacctctcagcgtctctctttctctcagccatggtgttcaaggtttctcgcgtcgagaccaagccaatcgatggccaaaagcctggtacctctggtctccgcaagaaggtgaaagttttcatacaacctcattacttgcacaatttcgttcaatcaacattcaatgcccttactccagaaaaagtcagaggtgctacacttgttgtatctggtgatggccgctactactcaaaagatgctattcagatcattaccaagatgtctgcagcaaatggagtaagacgtgtttgggttggtcaaaatggattgctttcgactcctgctgtatcggcagttatacgtgaaagagttggagtagatggatccagggcatcaggagcttttatattgacagcaagtcacaatccaggtggtcctcatgaggattttgggattaaatataacatggaaaatggtggacctgctccagagggaatcactgataagatatatgagaacacgaaaacaataaaggagtattttattgcagaagatctgcctgatgtggatatctcagcagaaggtgtaaccagctttgcagggcccgagggacaatttgatgttgaggtttttgattcagcgagtgattatgtgaaattaatgaagtctatttttgattttgagtctatcaggaagctaatctcatctccaaaattcacattttgttatgatgcgctacatggggttgctggagcttatgcaaaacgtatttttgttgaagaacttggtgcgcaagaaagctcattgctgaattgcattcccaaggaagattttggtgggggccatccagatcccaatctcacttatgcaaaagagttggttgctcgcatgggactaggaaaatcaagctctcaaggtgaacccccagaatttggtgcggctgctgatggtgatgcggaccgtaatatgatccttggtaaaaggttctttgttaccccatcggattctgtggccatcattgctgcaaatgcagttgaatctataccctacttctctgctggtctaaagggagttgccaggagcatgccgacctcagctgcccttgatgttgtagctaaaaatttaaatttaaaattttttgaggtacccactggctggaaattctttggtaatttaatggatgctggattatgttcagtttgtggtgaagaaagttttggaactggctcagaccatatacgtgaaaaagatggaatctgggcagttttggcttggctctctatcctcgctcataagaataaggaaaatcttggaggggaaaagcttgtgtctgttgaagacatagtgcgccagcattggaccacttatggtcgccactattatactcgatatgattatgagaatgtggatgctggtgcagccaaggaactaatggcatatttggtcaaactgcaatcctcccttcctgaagttaatgaaattgtgaaaggaacacgctcagatgtgtcaaaagttgtcaatgctgatgaatttgaatacaaagatcctgttgatggctccatctcaaagcaccagggtattcgatatttgtttgaggatgggtcacgattggttttccgtctttcaggaactggctcggaaggtgcaaccatccgtctatacattgagcagtatgagaaagatccatcaaaaactggccgagattctcaagatgcactcgctcctcttgttgaggttgctttgaaactttctaagatgcaggaattcactggccgaactgcccctactgttatcacatagaggcacacagggtgatagtgccattgtatgttgtttgttttaatgctgttccatttacaatggaaaacttctttggaagtttgataccagctacatatatctgtatcattttgcagtctttcggatgccggatatgagagtattgttgagtaataagatactttaccaatctttttttttggatcttcaaaaatgtatgaacgttctattactttgctgaatgtcctaatcgacaagaattagattttctgcaaaa

SEQ ID NO: 7015 - DNA, 2121 bp, Manihot esculenta
tttaattatagggactgaaagaatggtggtattcaaggtttcgcgagtggagactcagcccatcgatggccagaaacccggaacttctggccttcgcaagaaggtgaaagttttcattcagcctcattacctgcaaaatttcgttcagtcaacattcaatgctctgactgcagagaaagttagaggtgctacacttgtcgtttctggtgatggccgctattactcaaaggacgccattcagattattattaagatggcagctgcaaatggagtaaggcgtgtttgggttggtcagaatggattactttcaacgcctgctgtgtcagctgtgatccgtgaaagagttggggtagatggatcaaaagcaactggagcatttatattgacagcaagtcataatccaggtggtccacaagaggattttggtatcaaatataacatggaaaatggtggacctgctcctgaggggattacagacaagatctatgagaacacaaaaacaataaaggagtacttaactgctgatctgcctgatgtggatattacaacaattggtgtaactaattttggtggtcctgagggacaatttgatgtagaggtctttgattcagcaagcgattatgtgaaattgatgaaatctatctttgattttgagtctataaggaagctgctttcatctccaaaattcacattctgttatgatgcattacatggagttgctggggcttatgcaaaacgcatttttgttgaggagctcggtgcacaggagagctcattgctgaactgtgtaccaaaggaggactttggaggaggccatccagatcccaatcttacttatgcaaaagagttggttgctcgcatgggattgagtaaatcaagctctcaagttgaaccaccagagtttggtgctgctgctgatggtgatgcagatcgtaatatggtccttggtaaaaggttctttgtaactccgtcggattctgttgcaatcatcgcagccaatgcagtagaagctattccttatttctcttctggtctgaagggggttgccaggagcatgccaacatcagctgcccttgatgttgtggccaaacatctgaagttgaaattttttgaggttcccactggctggaagttttttggcaatttgatggatgcaggattatgttcagtttgtggggaagaaagttttggaactggctcagaccatatccgtgagaaagatggcatttgggcagttttggcttggctatctatattggcttacaagaacaaggaaaatctaaatggaggaaagcttgtgactgtcgaagatatagtacgcaatcattgggctacatatggccgtcactactatactcggtatgactatgagaatgttgacgcaagttctgcaaaggaactgatggcgcacttggttaagttgcagtcttctcttggtgaagtcaacgagatagtgaaggggataagatcagatgtgtcaaaggtggtaaatgctgatgaatttgaatacaaagatcctgttgatggttccatctcaaagcaccagggtattcgatatttgtttgaggatggctctcgactggttttccgtctttctggaactggctcagaaggtgcaaccatccgtctctacattgaacaatatgagaaggattcatcaaaaacaggaagagattctcaagaagcacttgctcctcttgtcgaggttgctctcaaactttctaagatgcaggaattcacagggcgatctgcaccaactgttattacatagattaccaacgctgcatggaaaagttgaggttgaatatcctcttcaacaagaaaaagtatggctatgattgagttgacccttgttatttaattttgagtggttgtacctttgacctatatatcctacatatgccttctcttgactgtcagatgccaagtgcatgagagttagtgccgtaaaacatgcttatctaaatttttgatgtgaaaataaagcaaaatatcttatgcttggtgtttaatgcctattcacgtaccggatttcagctagtttgagatgaaggcttaggttttttatttgttaattgaaaccgtttaaattcatttattaaaattgttttatgttgtgct

SEQ ID NO: 7016 - DNA, 2269 bp, Citrus sinensis
gttagctccactgagctattttccaaacccgaatccactgggaagacaatccaatttccgaaatcaatcgaattcacgaaatggtgatgttcaacgttacgcgaaaggaaaccgcgcctatcgacggccagaagcctggaacttctggtctccgtaagaaggtgaaagtgtttacgcaaccaaattaccttcacaattttgttcagtctactttcaatgccctgtcggcagaaaaagttagaggtgctacacttgttgtttctggtgatggccggtactactccaaggatgccattcagattataactaaaatggcagctgcaaatggagtacgacgtgtatggattggtcaaaacggattgctttcaactcctgctgtatcagcagtaattcgcgaaagggttgggtctgatggatccaaggcaacgggggcttttatattgactgcaagccacaatccaggtggtcctaatgaggattttggtattaaatacaacatggataatggaggacctgctccggagggaatcaccgataagatctatgagaacacaaaaacaataaatgagtactcaattgcagaagatctaccagatgtggatatctctgctgcaggtgtaaccagctttggggggcctgagggacaatttgatgttgaagtttttgattcagctagtgactatgtgaaattgatgaagtcaatttttgacttcgaggcgatccgcaagctactttcatctccaaaattcacattctgctatgatgcactacatggagttgccggtgcatatgccaaacgcatatttgtagaagagcttggtgcacaagaaagctcgttgttaaactgcacaccaaaggaggactttgggggagggcatccagatcccaatttgacttatgcaaaagagttggttgctcgtatgggattgggtaaatcaaacactcaagatgaaccgccagagtttggtgctgctgctgatggtgatgcggatcgtaacatgatccttggcaaaaggttttttgttactccatcagattcagttgccatcattgctgcaaatgcagttgaatccataccctacttttctgctggtttgaagggagttgccaggagtatgccaacctcagctgccctagatgttgtagccaagaacttgaatttgaagttctttgaggtaccaacagggtggaaattttttggtaatttgatggatgctgggttatgttcaatttgtggggaagaaagttttggaactggctcagaccatattcgtgagaaagatggaatctgggctgttctggcctggttatccattcttgctcataaaaataaggaaaaccttgatgggggaaagcttgtgacagttgaagatatagttcgcaagcattgggctacttacggtcgccactactacactcgatatgactatgagaatgtggatgcaggtgcagcaaaggaattgatggcaaatttggtcaaaatgcagtcttcacttcctgaagttaatgatattgtgaaggggatccgttcagatgtgtcaaaggttgtcaatgcagacgaatttgaatacaaagatcctgttgatggttccatctcaaaacaccagggtatccgatatttgtttgaggacggatcgcgattggttttccgcctctcggggactggttctgaaggtgcaaccatccgtctctatattgagcagtatgagaaggatccttcaaaaattggcagagattctcaggaggcgcttgctcctcttgtggaggttgctctaaagctttctaaaatggagcagttcactggccgatcagcgcctaccgtcattacataaacacatagtgctgctacacgtgatccatccatgagatggaaagtccattttggcaataaacgaggttttgtcttgatgatgtcaggcattatacaactgaactgtcagctgaaacttgcatactctgtccttgacccagttacaaatgtttttttatgtttgtcattctgcctactttgacataaacacgagagtatctggaacaaagagtatctgcagtttaaaatttttgatgttcaaaataatttggatgttgttaattaactaacaaaccatctgttttgtctattaaattttctaacgttatgatatctgagacaagcgtgtaaggatgggtttagctttctgatgttatatacggtttctaggcaggggatcttgttaagcctataaatgctgtaaatgctgggactactatatatatataatcattcttg

SEQ ID NO: 7017 - DNA, 2275 bp, Gossypium hirsutum
gagcaactaactcctttgcataagtcagattggtttcaaatcgcccccctgtctaatctcatcctggcctcaatcttcaccgttcgcgtttctttcacttcaaatcaaaaaagaaaagaaacaatatattattaaaaagaaggtaatacgggtcacttcctcactttgccagcttattctcaaaactaacgcatttcaatttgatctccccaacgatcgtagaaagcaaagaaatggtgttcaaggtttccaaagtctcgacgacgccgatcgacggccagaagcctggaacttctggcctccgtaagaaggtgaaagttttcattcagcctcattatttgcaaaatttcgttcagtcaacattcaatgcccttacaccagaaaaagttagaggtgctacacttgttgtttctggtgacggtcgttatttttcaaaggatgctattcagataataattaagatgtcagctgcaaatggagtaagacgcgtatgggttggtcaaaatggattgctttcaactcctgctgtatcagctgtaatacgtgaaagagttggtgtcgatggatccaaagcaactggtgcctttattttgacagctagtcataaccctggcggtcctcatgaggattttggaattaaatacaacatggaaaatggtggacctgctccagaggctatcactgataagatctttgagaacacaaaaacaataacagaatacttgattgctgaagatctaccaaatatagacattagtacaattggtgttgcaaacttctcggggcctgagggacagtttgatgttgaggtttttgattcagcaagtgactatgtgaaactgatgaagtcaatttttgactttgagcttattcgcaagctgctttcctcttcgaagtttacattctgctatgatgcactgcatggagttgctggagcttatgctcatcgcatttttgtggaagagcttggggcacaagaaagctcactgttgaactgtgtacccaaggaggactttggaggagggcatcctgatcccaatctgacttatgcaaaggagttagttgctcgaatgggattaggaaaatcggactctgcagttgaccccccagagtttggtgctgctgctgatggtgatgctgatcgtaacatgatactgggaaaaaggttctttgtcactccatcagattcagttgccatcattgctgccaatgctgttaatgcaattccttacttttcttctggtttgaagggagttgccaggagtatgcctacttcagctgcccttgatgttgttgccaagaacttgaacttaaaattttttgaggtacccaccggctggaaattttttggcaacttaatggatgctggattatgttcgatttgtggagaagaaagttttggaactggctctgaccatatacgtgagaaagatggaatttgggctgttttggcttggctttcaatacttgcttttaaaaataaggaaaatctcaatggggataagcttgtgactgttgaggatattgttcgtcagcattgggctatctatggtcgacactattacactcgatatgactatgagaatgtggatgctggtgcagcaaaggatttaatggcctatctggtcaaattgcaatcatctcttgatgaaatcaatagtagtgtgaagggggctcgttcagatgtgtcaaatgttgtcaatgctgatgaatttgaatacaaggatcctgttgatggctctgtttcaaagcaccagggtattcggtttttgttcgaggatggatcgcgattggttttccgtctctctggaactggttcagaaggtgcaactatccgcctctacattgaacaatacgaaaaggactcatcaaaaactggaagagattcccaagaagcgcttgctcctcttgtggaggttgctctaaaactttctaaaatgctggagttcactggccgatccgcacctacagttatcacataaactcatacccctataagggttgtctgataaggcacggtactactttggaggaaagtgaaaaaatgaataagctgttcaaggcctgtctagataacctacgtacatctttgttattctgcgtctgtctatgactacattggagtatcctaagtgactgataatactgtagcaaaatttttgacagggttcataaaaaataatttgaacgttacagatgcctatactcgtatcttttttggttgaattgtcgtctaaatttcatttctagaaggtatggcgattcatcttgtggt

SEQ ID NO: 7018 - DNA, 2066 bp, Quercus alba
atatactcatctcttgacactcgtcaccccttctagtttatttttggcaaacttttcttttcctctttatatatatagagacttcacttctatcaccatctccaatcctcaccactaagcgtctctctctctctctcatattctctcagcaatggtgttcaaggtttctcgtgtcgagaccaagccaatcgatggccaaaagcctggtacctctggtctccgcaagaaggtgaaagttttcatacaacctcattacttgcacaatttcgttcaatcaacattcaatgccctcactccagaaaaagtcagaggtgctacacttgttgtatctggtgatggccgctactactcaaaagatgctattcagatcatcactaagatgtctgcagcaaatggagtcagacgtgtttgggttggtcaaaatggattgctttcaactcctgctgtatcggcagttatacgtgaaagagttggagtagatggatccagggcatcaggagcttttatattgacagcaagtcacaatccaggtggtcctaatgaggattttgggattaaatataacatggaaaatggtggacctgctccagagggaatcactgataagatatatgagaacacaaaaacaataaaggagtacttcatttcagaagatctgcctgatgtggatatctcagcagtaggtgtaaccagctttgcagggcctgagggacaatttgatgttgaagtttttgattcagcgagtgattatgtgaaattaatgaagtctatttttgattttgagtctatcaggaagctaatctcatctccaaaattcacattttgttatgatgcgctacatggggttgctggagcttatgcaaaacgtatttttgttgaagaacttggtgcgcaagaaagctcattgctgaactgcactcccaaggaagattttggtgggggccatccagatcccaatctcacttatgcaaaagagttggttgctcgcatgggactaggaaaatcaagctctcaaggtgaacccccagaatttggtgcggctgctgatggtgatgcggaccgtaatatgatccttggtaaaaggttctttgttaccccatcggattctgtggccatcattgctgcaaatgcagtcgaatctataccctacttctctgctggtctaaagggagttgccaggagcatgccgacctcagctgcccttgatgttgtagctaaacatttaaatttaaagttttttgaggtacccactggctggaaattctttggtaatttaatggatgctggattatgttcagtttgtggtgaagaaagttttggaactggctcagaccatatacgtgaaaaagatggaatctgggcagttttggcttggctctctatcctcgctcataagaataaggaaaatcttggagaggaaaagcttgtgtctgttgaagacatagtgcgccagcattggaccacttatggtcgccactattatactcgatatgattatgagaatgtggatgctggtgcagccaaggaactaatggcatatttggtcaaactgcaatcctcccttcctgaagttaatgaaattgtgaaaggaacacgctcagatgtgtcaaaagttgtcaatgctgatgaattcgaatacaaagatcccgttgatggctccatctcaaagcaccagggtattcgatatttgtttgaggatgggtcacgattggttttccgtctttcaggaactggctcggaaggtgcaaccatccgtctatacattgagcagtatgagaaagatccatcaaaaactggccgagattctcaagatgcactcgctcctcttgttgaggttgctttgaaactttctaagatgcaggaattcactggccgaactgcccctactgttatcacatagaggcacacagggtgatagtgccattgtatgttgtttgttttaatgctgctccatttacaatggaaaacttccttgtaagtttgataccctacatatatctgtatcattttgcagtctttcggatgacggatatgagagtatgtcgactaataagatacttaccaat

SEQ ID NO: 7019 - DNA, 2037 bp, Tropaeolum majus
agacactacttgtttcgccagctttctctcttattcatatacggaagtgaaacccatatccaaaatggtgatgttcaaggtttcacgcgtggaaactacgcctattgatggccagaaaccaggaacctctggtctccgaaagaaggtgaaagtttttaaggagcctcattacttggaaaattttgttcaggcaacattcaatgcccttacagtggagaaagttagaggtgctacacttgttgtttcaggtgatggccgttattactcagaggatgccattcagatcataattaagatggcagccgcaaatggagtaagacgaatatgggttggtcaaaaggggttgctgtcaacccctgctgtatcggctgtaatacgagaaagagttggggcagatggctccaaggcaacaggagcgtttatattaactgcaagtcacaaccctggtggacccacggaggattttggaataaaatataacatggaaaatggtgggcctgcgccagagggaatcaccgataagatatacgagaatacaaaaacaataaaggagtacttaattgcagaagatttaccaaatgtggatatcactagtacaggtgtaaccaactttgggggagctgaggggcaatttgatgttgaagtttttgactcagctagtgactatgtaaaacttatgaagtcgatttttgattttgagtccataagggcgttgctttcatcaccaacatttactttctgctatgatgcactacatggagttgcaggagcttatgcaaagcgtatctttgtggaagagcttggtgcacaagaaagctcgttgttgaactgcacacccaaggaggattttggaggtgggcatcctgatcctaatctgacttatgcaaaggagttagttgctcgtatgggcttgagtaagtcagatagtggtgttgaaccaccagagtttggtgccgctgctgatggtgacgctgatcgtaacatgatccttggtaaaaggttctttgttactccatcagattctgtagctattattgctgcaaacgcagttgaaaccataccatatttttcagctggtctaaagggtgttgccaggagcatgccaacctcagctgctcttgatgttgtggctaaaaacttgaatttgaaattttttgaggttcctactgggtggaaattttttggtaacttgatggatgctggactatgttcagtttgtggggaagaaagttttggaactggctctgatcatatacgcgagaaggatggaatctgggctgttcttgcttggctttccatacttgctcataaaaacaaggaaaacctcaatgggggaaagcttgtaaccgttgaagacatagttcgtcagcattgggctacttatggtcgtcattattatactcgatatgactacgagaatgtggatgcaactggtgctaaggatttgatgtcatatttggtcaaattgcagtcttcacttcctgaagtaaatgaaattgtcaagggagtacgctctgatgtggcaaatgttatcaatgctgatgagttcgaatacaaagatcctgttgatggttctgtatcaaaaaaccaaggtgttcgatatatgtttgaggatggatcgagactgatattccgtttgtcaggaactggctctgaaggtgcaacaattcggctctacattgagcaatacgagaaggactcatcaaaaacgggaagagattctcaagaagcacttggtcctcttgtagaggctgctttgaagctttccaagatgcaggagttcactggccgatctgcacccactgttataacatagataaaaaatctatactctataccgaaaaataaggtaccttttttttaaaatattaagggatatatgttcactgtactacccagattgggtcataaacatgttgtctattctcatggaccacttgagatatattaacattaagcacataaaagagggatgctatctcttaaaattgtactatttgccaagaattttgatgtttacaataatatttagtttac

SEQ ID NO: 7020 - DNA, 2762 bp, Theobroma cacao
atgattcgaaaatgacattaaacatatttatctttaaagatttaatacatctcattgcaataagaaaagtgaatacaggacaaaggaatatacaaagcgagatgccatctgtgcagtaaaaatgagcgaagtagatctcaactgtagaaagcgaaggaatcgttcatccaaacagacaaagaaaatacgtgaggttttaaattcccccctatccaatcgcaccctcccaactcaaactcgccccagaggccgtagccattatcctgctctcctccgttccttccacttagcactctctagaaaaaaacaagagaaaaaagagaaaggaatatagaagtagtagtcttaaaaaacactagtcactccctcgttttgccagcttagcgttctcaatagtaacgcattttgctttgatctctccaacaaagcaaaaaatggtgttcaaggtgtcgaaagtaccaacgacgccgtacgatggccagaagcctggaacttctggcctccgcaagaaggtgaaagtttttgtgcaacctcattatttgcaaaatttcgttcagtcaacattcaatgcccttacaccagagaaagttagaggtgccacacttgttgtttctggtgatggtcgttatttctcaaaggatgctattcagataataattaagatggcagctgcaaatggagtaagacgtatatgggttggtcagaatggattgctttcaactccagctgtatcagctgtaatacgtgaaaggattggtgtggatggatcgaaagcaactggagcctttattttgacagcaagtcacaatccaggtggccctcatgaggattttggaataaaatacaacatggaaaatggtggacctgctccagaggctattactgataagatctttgagaacacaaaaacaataacagaatacttgattgctgaggatttaccaaatgtagacattagtgcaattggtgttacaagctttggggggcctgaggcacagtttgatgttgaggtttttgattcagcaagtgactatgtgaaattgatgaagtcaatttttgacttcgagcttattcgccagctgctttcatctccgaagtttacattctgctatgatgcactgcatggagttgctggagcttatgcacatcgcatctttgtggaagagcttggggcaaaagaaagctcactgttgaactgtgttcccaaggaggactttggaggagggcatcctgatccaaatctgacttatgcaaaggagttggttgctcgcatgggattgggcaaatcaaactctggagttgaaccaccagagtttggtgctgctgctgatggtgatgctgatcgtaacatgattctgggcaaaaggttctttgtcactccatcagattcagttgccatcattgctgcaaacgctgttgatgcaattccttacttctcttctggtttgaagggagttgccaggagtatgcccacctcagctgcccttgatgttgtggccaagaacttggaactgaaattttttgaggtacccactggctggaaattttttggcaatttaatggatgctggattatgttctgtttgtggagaagaaagttttggaactggctctgaccatattcgtgagaaagatggaatctgggctgttttagcttggctttcgatacttgcatataaaaataaggaaaatcttgacggggataagcttgtgactgttgaggatatagttcgccagcattgggctacctatggtcgacactattatactcgatatgactatgagaatgtggatgctggtgcagcaaaggatttaatggcatatctggtcaagttgcagtcatcccttggtgatgttaatactattgtgaatgaggctcattcagatgtatcaaatgttgtcaatgctgatgaatttgaatataaggatcctgttgatggttctgtttcaaaacaccagggtattcggtttttgtttgaggatggatcacgattggttttccgtctctctggaactggctcagaaggtgctactatccgactctacattgagcagtatgaaaaggatccatcgaaaactggaagagattctcaagaagcacttgctcctcttgtggaagttgctctaaaactttctaagatgcaggagttcactggccgatctgcacctacggttatcacatagatttatactgctacaagttaagggttgtctgagaagtcaaagtaccattttgaggaatggaaacataaatacactgttcaaggcatggttagataacctacatatatatatatatatatatatatttgtcgttctacatccgtaccaagagtacatgagagtatcataaatgacagatatacccactaatcaaaattttctgagagggttcgtaaaataatttgaataatgttgcactactcgggatcgtatgtcctatctatacgcctttcgtcttggattttcattttggttgaattgtatccgaaatttcatttccatgtgactggtgggtttatctcctttttatgttatattaatgaaatggtgagtaagggtctgacatgatctttttatttcctttccatgtcttatggaagcctatcgatttgctactctctctagggaggatttatccctttctggtagtgctcgggcttttattgactcagataggttgttacttatgtcatatgcttttggatgtttatgtttggacacaagtgaatgatgaaggattaataatagaactggataata

SEQ ID NO: 7021 - DNA, 2107 bp, Ricinus communis
tccaatccaacgttaaaatatagttcataaatagaatcagtgcactcctttttattatctctatctaacacattagctttcgtttcttttattttgataattaacagaaaaaagtaatggtgttcgaggtatcgcgagtgtctactacccctttcgatggccagaaacctggaacttctggccttcgcaagaaggtgaaagtgttcacgcagcctaattacttgcataattttgttcagtcaacattcgatgccctgactgcagagaaagttagaggtgctactctggttgtttctggtgatggccgctatttctcaaaggatgccattcagattattattaagatgtcagctgcaaatggtgtgcggcgtgtttgggttggtcagaatggattactttcaactcctgctgtgtcagctgtaattcgtgaaagagtagggttagatggatccaaagcaactggagcatttatattgactgcaagtcataatccaggtggtccacatgaggattttggaataaaatataacatggaaaatggtggacctgctcctgaggggatcacagataagatttatgagaacacaaaaacaataaaggagtatttaatttctgatctccctgatgtcgacatcagtgcaattggtgtaactaattttagtgggcctgagggacaatttgatgttgacgtttttgactcggcagacgactatgtgaagttgatgaagtctatatttgactttgagtccatcaaaaagctgatttcatctcccaatttcaccttctgttatgatgcattacatggagttgctggtgcttatgcaaaacgtatctttgtggaggagctttgtgcgcaagagagctcattattgaactgtgtacccaaggaggactttggaggggggcatccagatccaaatcttacttatgcaaaagagttggttgctcgcatgggattgggtaaatcaaactcagaagtcgaaccaccagaatttggtgccgctgcagatggcgatgcagatcgtaacatgatccttggtaaaaggttttttgttactccatcagattctgttgctatcattgctgccaatgcagttgaagctataccatatttctctgctggtctaaagggggttgccaggagcatgcccacatcagctgcccttgatattgtagccaaacatctgaatttaaagttctttgaggttcctactggctggaaattttttggaaatttgatggatgcaggattatgttcagtttgtggggaagaaagttttggaactggctctgatcatatacgtgagaaggatggaatctgggcagttctggcttggctatctattctggcttacaaaaataaggaaaatctcaatggaggaaagcttgtgagtgttgaagatatagttcgcaaccattgggctacttacggccgccactattatactcgatatgattatgagaatgttgatgctggtgcagcaaaggaactgatggcacacttggtcaagctgcaatcttctcttggtgaagttaacgagattgttaaggggataagatcagatgtggcaaaggttgttcatggtgatgaatttgaatacaaagatcctgtcgacggctccatctcaagtcaccagggcatacgatatttgtttgaggatggctctcgactggttttccgtctctcaggaactggctcagaaggtgccaccatccgtctctacattgagcagtacgagaaggattcttcaaaaacaggaagagattctcaagaagcgcttgcccctctcgttgaggttgctctgaaactttccaagatgcaggaattcacaggccgatctgcaccaactgttatcacatagattcttgctgctacaacgaaagttgagattgaatatcctctgcaatatccagaagtattgtgttgacgagttattatgtggtcttatgagacttatttaaaaagaaaatatagctttttcaagtatgtatcctattgtcttctgcatccttgccagagccatgagagtataatgtgccattaaaacgagcggatataaatttttgacgtgcaaaatatatgaatatcttgttgtttggcgagctt

SEQ ID NO: 7022 - DNA, 2342 bp, Ricinus communis
tccaatccaacgttaaaatatagttcataaatagaatcagtgcactcctttttattatctctatctaacacattagctttcgtttcttttattttgataattaacagaaaaaagtaatggtgttcgaggtatcgcgagtgtctactacccctttcgatggccagaaacctggaacttctggccttcgcaagaaggtgaaagtgttcacgcagcctaattacttgcataattttgttcagtcaacattcgatgccctgactgcagagaaagttagaggtgctactctggttgtttctggtgatggccgctatttctcaaaggatgccattcagattattattaagatgtcagctgcaaatggtgtgcggcgtgtttgggttggtcagaatggattactttcaactcctgctgtgtcagctgtaattcgtgaaagagtagggttagatggatccaaagcaactggagcatttatattgactgcaagtcataatccaggtggtccacatgaggattttggaataaaatataacatggaaaatggtggacctgctcctgaggggatcacagataagatttatgagaacacaaaaacaataaaggagtatttaatttctgatctccctgatgtcgacatcagtgcaattggtgtaactaattttagtgggcctgagggacaatttgatgttgacgtttttgactcggcagacgactatgtgaagttgatgaagtctatatttgactttgagtccatcaaaaagctgatttcatctcccaatttcaccttctgttatgatgcattacatggagttgctggtgcttatgcaaaacgtatctttgtggaggagctttgtgcgcaagagagctcattattgaactgtgtacccaaggaggactttggaggggggcatccagatccaaatcttacttatgcaaaagagttggttgctcgcatgggattgggtaaatcaaactcagaagtcgaaccaccagaatttggtgccgctgcagatggcgatgcagatcgtaacatgatccttggtaaaaggttttttgttactccatcagattctgttgctatcattgctgccaatgcagttgaagctataccatatttctctgctggtctaaagggggttgccaggagcatgcccacatcagctgcccttgatattgtagccaaacatctgaatttaaagttctttgaggttcctactggctggaaattttttggaaatttgatggatgcaggattatgttcagtttgtggggaagaaagttttggaactggctctgatcatatacgtgagaaggatggaatctgggcagttctggcttggctatctattctggcttacaaaaataaggaaaatctcaatggaggaaagcttgtgagtgttgaagatatagttcgcaaccattgggctacttacggccgccactattatactcgatatgattatgagaatgttgatgctggtgcagcaaaggaactgatggcacacttggtcaagctgcaatcttctcttggtgaagttaacgagattgttaaggggataagatcagatgtggcaaaggttgttcatggtgatgaatttgaatacaaagatcctgtcgacggctccatctcaagtcaccagggcatacgatatttgtttgaggatggctctcgactggttttccgtctctcaggaactggctcagaaggtgccaccatccgtctctacattgagcagtacgagaaggattcttcaaaaacaggaagagattctcaagaagcgcttgcccctctcgttgaggttgctctgaaactttccaagatgcaggaattcacaggccgatctgcaccaactgttatcacatagattcttgctgctacaacgaaagttgagattgaatatcctctgcaatatccagaagtattgtgttgacgagttattatgtggtcttatgagacttatttaaaaagaaaatatagctttttcaagtatgtatcctattgtcttctgcatccttgccagagccatgagagtataatgtgccattaaaacgagcggatataaatttttgacgtgcaaaatatatgaatatcttgttgtttggcgagcttaaaatcctctgaattaacgagaagtgcaaaatacttgagttaatatgatcatggatgatatgtagcaggcagcttgaagaggggcgtggaaataagcagatggccctcagaaagtggatctatttggtaatacatatgccaaggaaatttgtgaaatgtcaagataagttcctaaaatattcatcatagtttggtatacttgataaagtttgctagttattcgcattgagaaaaa

SEQ ID NO: 7023 - DNA, 2060 bp, Cucumis sativus
atctcccttcaattacctccaccctttcttctcatcataccatggctcgcttcagtgtcaccaagaagctcacatcccccatcgatggccagaaacccggtacttccggcctccgcaagaaggtaaaagtattcattcaaccgaactacttggagaattttgttcaatcaacatttaatgcattgactgctgaaaatgtcagaggggctacacttgttgtatctggagatggacgctattattcaaaggatgctattcagataataactaagatggctgcagccaatggggtacgacgtatttgggttggtcaaaatggtttgctttcaacccctgctgtgtctgctgtcatacgtgaaagagttggtgttgatggatcccgagcatcaggagcatttattttgactgcaagtcacaatccaggaggtcctcatgaggattttgggattaaatacaacatggaaaatggtggccctgcaccggagggaattactgataagatctatgaaaacacgaaaaccataaaggagtacctaattgctgaagatcttcctaatgtggatatttccacaataggtgtttctagctttggtggacctgaaggacaatttgatgttgaggtttttgattcagctagtgactacgtgaagttgatgaagtcaatatttgattttgaatctatccgcaagcttctaacttctcccaaattctcattctgttttgatgctctacatggtgttggtggagcttatgcaaaacgtatttttgtggaagagcttggtgcacaagaaagctcattactgaactgtgtacctaaggaggactttggaggaggtcatcctgaccccaatttgacttatgccaaggaattggttgctcgtatgggattgggtaaatcaagctctggagaacctccagaatttggtgctgctgctgatggtgatgcagatcgtaatatggtccttggtaaaaggttttttgtcactccttcggactctgttgccattattgctgctaatgctgttgaagctattccatacttctctgctggtttgaagggtgttgccaggtgttagagcatgccaacctctgctgcactagacgtggtcgccaaaaacttgaagttgaagttttttgaggttcccactggttggaaattttttggtaatttaatggatgcaggaatgtgctcagtctgtggggaagaaagttttggaactggatctgaccatattcgtgaaaaagatggaatatgggcagttctggcttggttatccattcttgcttataaaaacaagggaaaccttgatggtgggaagcttgtttcagttgaagacatagttcgccaacattgggccacctatggtcgtcattattatactagatacgattatgagaatgttgacgctggagcagcaaaggaactgatggaaaatctggtgaagctgcaatcttcacttgccgaagtgaatggaattatcaagggaatccgttcagatgtgtcaaaggttgtccatggtgatgaatttgagtataaagatccggttgatggttccatctccaagcaccagggtattcgatatttgtttgaggatggttcacgactggtgttccgcctatctggaactggttctgaaggtgcaacaattcggctctacatcgagcaatatgagaaagatccatcaaaaatcgggagagattctcaggaagctcttgctcccctggtggaagttgctcttaagctatcaaaaatgcaagaattcactggccgatcctcccccactgtcattacataaatgaagtacatacagaacccatgatttttgaagaaataattgttgcttagcttgcggtggcgcaagatataatcttaaaacatcactgtaagtggttccagagtgtttgtttggcgggaaaactttagcctacatagattttggggtttaattgtcctaataatcttgatgcttcttatgaagctcgactaagttacaaaatataattatatatacacacttgtatcaatctggttttaatcatatttcataactctttccata

SEQ ID NO: 7024 - DNA, 2280 bp, Citrus clementina
aaaggcagttagctccactgagctattttccaaacccgaatccactgggaagacaatccaatttccgaaatcaatcgaattcacgaaatggtgatgttcaacgttacgcgaaaggaaaccgcgcctatcgacggccagaagcctggaacttctggtctccgtaagaaggtgaaagtgtttacgcaaccaaattaccttcacaattttgttcagtctactttcaatgccctgtcggcagaaaaagttagaggtgctacacttgttgtttctggtgatggccggtactactccaaggatgccattcagattataactaaaatggcagctgcaaatggagtacgacgtgtatggattggtcaaaacggattgctttcaactcctgctgtatcagcagtaattcgcgaaagggttgggtctgatggatccaaggcaacgggggcttttatattgactgcaagccacaatccaggtggtcctaatgaggattttggtattaaatacaacatggataatggaggacctgctccggagggaatcaccgataagatctatgagaacacaaaaacaataaatgagtactcaattgcagaagatctaccagatgtggatatctctgctgcaggtgtaaccagctttggggggcctgagggacaatttgatgttgaagtttttgattcagctagtgactatgtgaaattgatgaagtcaatttttgactttgaggcgatccgcaagctactttcatctccaaaattcacattctgctatgatgcactacatggagttgccggtgcatatgccaaacgcatatttgtagaagagcttggtgcacaagaaagctcgttgttaaactgcacaccaaaggaggactttgggggagggcatccagatcccaatttgacttatgcaaaagagttggttgctcgtatgggattgggtaaatcaaacactcaagatgaaccgccagagtttggtgctgctgctgatggtgatgcggatcgtaacatgatccttggcaaaaggttttttgttactccatcagattcagttgccatcattgctgcaaatgcagttgaatccataccctacttttctgctggtttgaagggagttgccaggagtatgccaacctcagctgccctagatgttgtagccaagaacttgaatttgaagttctttgaggtaccaacagggtggaaattttttggtaatttgatggatgatgggttatgttcaatttgtggggaagaaagttttggaactggctcagaccatatacgtgagaaagatggaatctgggctgttctggcctggttatccattcttgctcataaaaataaggaaaaccttggtgggggaaagcttgtgacagttgaagatatagttcgcaagcattgggctacttatggtcgccactactacactcgatatgactatgagaatgtggatgcaggtgcagcaaaggaattgatggcaaatttggtcaaaatgcagtcttcacttcctgaagttaatgatattgtgaaggggatctgttcagatgtgtcgaaggttgtcaatgcagacgaatttgaatacaaagatcctgttgatggttccatctcaaaacaccagggtatccgatatttgtttgaggacggatcgcgattggttttccgcctctcggggactggttctgaaggtgcaaccatccgtctctatattgagcagtatgagaaggatccttcaaaaactggcagagattctcaggaggcgcttgctcctcttgtggaggttgctctaaagctttctaaaatggagcagttcactggccgatcagcgcctaccgtcattacataaacacatagtgctgctacacgtgagccatccatgagatggaaagtccattttggcaataaacggggttttgtcttgatgatgtcaggcattatacaactgaactgtcagctgaaacttgcatactctgcccttgacccagttacaaatgtttttttatgtttgtcattctgcctactttgacataaacacgagagtatctggaacaaagagtatctgcagtttaaaatttttgatgttcaaaataatttggatgttgttaattaactaacaaaccatctgttttgtctattaaattttctaacgttatgatatctgagacaagcgtgtaaggatgggtttagctttctgatgttatatacggtttctaggcaggggatcttgttaagcctataaatgctgtaaatgctgggactactatatatatatataatcattctgcaa

SEQ ID NO: 7025 - DNA, 2249 bp, Gossypium hirsutum
aacgaaccgggtttgtcaaataccagcgaaggactcgttcatccgaaacaaacaaacaaataagagaggtttttaaattccactcgatccaattgcaaccttccagttctctccattgccataatccacaaaaataaataaataaataaacactgtcgctttctcattagccagcttcgaagaatcgcatattactttgatctctccaacgaaatttaagtaataaaaatggtgttcgaggtgatgaaagtgccaacgacgccgtttgaaggccagaagccaggcacttctggtcttcgtaagaaggtgaaagtttttgttcagcctcattatttgcagaatttcgttcaagcaacattcaatgcccttacacccgagaaagttaagggtgccacacttgtcgtttctggtgatggtcgttatttctcaaaggatgctgttcagataataatcaagatgtcagctgcaaatggagtaaggcgtgtatgggttggtcaaaacggattactttctactccagctgtatcagctgtaatacgcgaaagggttggtgcagatggatccaaagcaactggtgcctttattttgacagctagtcacaatcccggtggccctaatgaggattttggaattaaatacaacatggaaaatgggggacctgctccagaggccctcactgataagatctttgagaacacaaaaacaattaaagagtacttgattgctgatgagctacgagaagtagacattagtacaattggtgttaccaacttttcggggcctgatggaccgtttgatgtcgaggtttttgattcagcaagtgactatgtgaaattgatgaagtcaatctttgacttcgagcttatccgcaagctgctttcatctccgaagtttacattctgctatgatgcacttcatggtgttgctggagcttatgcaaatcgcatctttgtggaagagcttggggcacaacaaagctcacttttgaactgcacacccaaggaggactttggtggaggacatccggatcccaatctgacttacgccaaggagttggttgagcgcatgggattgggaaaatcgaactctggtgttgaaccaccagagtttggtgctgctgctgatggtgatgctgatcgtaacatgatcttgggtaaaaggttctttgtcactccatcagattcagtagccatcattgctgcaaatgctgttggtgcaattccttacttttcttctggtttgaagggagttgccaggagtatgcccacatcagctgcccttgacgtcgtggccaagagcttgaacctgaaatttttcgaggtacctactggctggaaattttttgggaatttaatggatgctggacaatgttctatttgcggggaagaaagttttggaactggctctgaccatatacgtgagaaagatggaatctgggctgttttagcctggctttcaatccttgcgtataaaaacaaggataatatcaatggggataagcttgtgactgttgaggatatagttcgtcagcattgggctacctatggtcgacactattatactcgatatgactatgagaatgtggatgctggtggagcaaaggatttaatggcaaatatggttaaaatgatgtcatcccttgatgaagttaataccatcgtgaagggggctcgatcagatgtgtcaaaagttgtcaacgctgatgagtttgaatacaaggatcccgttgatggttcagtttcaaagcatcaaggtattcggtttttgttcgaggacggatcacgattggtcttccgtctctctggaactggttcagaaggtgcaactatccgtctgtacatcgagcaatatgaaaaggatccatcaaaaataggaagagattcccaagaagctcttgcccctcttgtggaagttgctctaaaactttcgaagatgcaggagttcaccggccgatccgcaccaactgttatcacatagattcattctgctacatgttaaggtgtgtttgatttaattttgagcaaaagggaacataaataaagtcctcataagatacgctatatatatatctatgtcagtgtgcatccttgccatgagtacttgagaatggcaaatggcaataatgcttactcatcaaaatttttgacaatattatttgaggatttatttgaatattaattgtttttcaagtattgaataattttaggtttaatgcttgattgggtctgtatcatttctggtttgaattg

SEQ ID NO: 7026 - DNA, 2089 bp, Arachis hypogaea
actctcgcccgataaattccctgtcgcacaagcgtcatcccagcagcaactcaacacttccaagctggtgacatagccatggttgtcttcaaagtttctcgcgttcagacctctcccttcgatggccagaagcccggaacctctggtctccgcaagaaggtgaaggtgttcgtgcaacctaattacttgcataacttcgttcaggccaccttcaatgcactcactgctgaaaaagttaggggtgctacactggttgtatccggtgatggtcgttatttttcaaaggatgctattcagataattactaaaatggcagctgcaaatggagtaagacgagtttgggttggtcagaatggactgctttcaactcctgctgtatcttgcgttatacgtgaacgagttggccctgatggttccaaggcaacaggtgcattcatactgactgcaagtcacaatcctggtggccctcatgaggattttggtattaagtataacatggaaaatggtgggcctgcacccgagggaattactgataagatatataaaaatacaactacaattacagagtacttgattgctgaagatctgccagatgtggatatctccgcattaggtgttacaaactttacaggccctgaaggaccatttgatgttgaggtgtttgactcagcaaccgattatgtaaaattgatgaagtcaatttttgattttgaatctatcaggaaactgttgacatctcctaaattctcattctgttatgatgcactacatggagttgctggagcatatgcaaagcgtatttttgtggatgaacttggggcacaagaaaactctttacttaactgtgtaccaaaggaagactttggaggaggacatccagatcccaatttgacttatgcaaaagaattggttgctcggatgggattgggcaattcagaaacacaaggtgagccaccagagtttggtgctgctgccgatggtgatgcagatcgcaacatgatacttggtaaaaggttttttgtcactccttcagattctgtggccattattgctgcaaatgctgttgaagctataccatacttttctgctggcttaaagggagttgccaggagcatgccaacctctgctgccctggatgttgtggccaagcatctgaatctgaaattttttgaggttccgacaggttggaagttctttggtaatttaatggatgctggtttatgttcaatctgtggtgaagaaagttttggaactggttcggaccatattcgtgagaaagatggaatctgggcagttttggcctggctttccatacttgcatataaaaataaagataaactccaggacaagcttgtaacagttgaagacatagttcgcaaccattgggctacttatgggcgtcactattatactcgatatgactatgaaaatgtagatgcaggtgcagcaaaggagctgatggcatatttggtcaaactgcagtcctccctcccagaagtcaataagattgttaagggagtaagatcggatgtttcgaacgttgtcaatgctgatgaatttgaatataaagatcctgtggatggttccatttcgtcacatcagggaatccggtatttgtttgaggatggatcaagattgattttccgtctctctggaactggatcagaaggtgcaactattcgactatacattgagcagtacgagaaggatccatcaaaaactgggagactttcccatgaagcccttgctcctcttgtggacgttgcattgaaactttcgaagatgcaggaatacaccggtcgatctgctccaacagtcattacataagtgaatatcggttttaatccaaggcttgcgcaagtcgtttcttgtctatcttcattttaatcttctgagtgcccaacctttgctgtttgggtgtttgccgtccccggcgcttgagtggaacataaattactgcaactaagttttgatgtgctcaataatttaaaactgccgtgtatgtgttgattatacacgttttgcgatttctttttacaataatgctctgcattcaagtaacttctctaatcaagtccaaccatgttat

SEQ ID NO: 7027 - DNA, 2150 bp, Euonymus alatus
ctctgctttccttatatacgaaacgcactgtgaaactctcttttcatttcatcgaacacctctgagtctcctctgtctccgagcttattctgatctctttgttatcagaaaatggtgatgttcaaggtttctcgtgtggagacgacgccgtacgatggccaaaagcctggcacttctggtctccgtaagaaggtgaaagttttcatccaaccacactacttgcacaactttgttcagtcgacattcaatgccctttcagcagaaaaagtcagaggtgcgactcttgttgtttctggtgatggtcgctatttctcgaaggatgccattcagatcataactaagatggcagctgcgaatggtgtaagacgtgtttggattggtcaaaatggacttctttcaactccagctgtatcagctgtgattcgagaaagagttggtgtagatggatccagagggacaggagcatttatattgactgcaagccacaatccgggtggtcctcatgaggactttggaataaaatataacatggaaaatggtggacctgctcctgagggaatcacggataagatttacgagaacactaagactatcaaggagtacttaattgcagaagatcttcctgatgtggatatcggtgcaattggtgtcaccagctttagcgggcctgagggacagttcaatgttgaagtctttgattcagcaagtgactatgtaaagttgatgaagtcaatctttgacttcgaatccatccggaagctacttgcatctccaaaattcaccttctgttatgacgcactccatggagtcggcggagcttatgcaaaacctatttttgtagaagagcttggcgcaaatgagagctcgttgttgaactgcacacccaaggaagactttgggggaggacatccagatccaaatttgacttatgccaaggagttggttgcccgtatgggattggggaaattggattctaaaggtgaacctccggagtttggtgctgcagctgatggtgatgcagatcgtaatatgatccttggtaaaaggttttttgtcactccatcagactctgttgccatcattgctgcaaatgcggttgaagcaataccatatttctctgctggtctgaagggggttgccaggagcatgccaacatcagcagctcttgatgttgtggctaaacatctgaatttgaaattttttgaggtgcccactggttggaagttttttggtaatttgatggatgctggattatgttcagtatgtggagaagaaagttttggaactggctcagaccatatacgtgagaaagatggaatttgggcagttctggcttggctatccatacttgcccacaaaaataaggggaagcttgatggagataaacttgtgagtgttgaagatatagttcgccagcattggggtacatatggtcgccactactatactcgatatgactatgagaatgtggatgctggcgccgcaaaggaattaatggcacatttggtcaaactgcagtcttctctttcggaagttaacgatattgtaaaggggatacgttctgacgtggcaaaggttgtccatgcggatgagttcgagtacaaggatcctgttgatggttctatctcaaggcaccagggtattcgttatttatttgaggacggttctcgattggtcttccgcctctcaggaactggctcagaaggtgcaaccatccgtctatacatcgagcagtatgaaaaggatccatcgaaaactgggagggaatctcatgaagcacttgctcctcttgtggaggttgctctcaagctttccaagttgaaggaattcactggacgatctgctccaaccgtcatcacataaacgtatactaccagctgggaatttacatattaaaacgtgcagtcttgttgctgctacttttaatacagctaataagatccatttaggcttcctaaacatctgccactgcagccttggcagaggcgagtataaatcaagtattatttactgaaactataagaggatcttaagttttggtactcgaaataaaattgaagttttctcctaatttgttaccaacataatgtttgatagtagttcaaaaaggtaaccttgatatattgtcttcatagtaagatgaaaaccta

SEQ ID NO: 7028 - DNA, 1817 bp, Flaveria ramosissima
gaagaaagcttaactaatggcgactttcaaggttaatcgtgtcgaatcttcgccgattgaaggccaaaagcctgggacatctggactcaggaagaaggttaaagtattcactcaacctcattacttgcacaactttgttcaatcaacatttaatgccctttctgctgagaaagttaaaggttctacacttgttgtttcgggtgatggacgttactattcaaaggatgcaatccagattataattaaaatggcagctgcaaatggtgtaagacgtgtttgggttggtcaaaatggacttctctccacacctgctgtatcagccgttgtacgtgaacgagttggcgctgatggttccaaagcaaatggggcatttattttgacagctagtcacaacccaggtggtcccaatgaggattttggaattaagtacaatatggaaaatggtgggccagcacctgaaggaattactgataaaatctatgagaacactaaaacaataaaggagtattttattgcagaaggccttcctgatgtggatatctcagcaattgggatttcaagcttttcaggtcctgatggtcaatttgacgttgatgtttttgactcatcaagtgactatgtgaaattgatgaaatcgatctttgatttccagtccatcaaaaagctaattgcatctccacaatttagtttttgttatgatgctcttcatggagttgctggagcttatgctaaacgtatatttgtcgaagagcttggtgcaaaagagagctcattattgaattgtgttcccaaggaagacttcggtggcggacatcctgatcccaatcttacatatgcaaaagagttggtagcaagaatgggattgggtaaaaaccctgaaagtaacccaccagaattcggtgctgctgctgatggtgatgctgacaggaacatgatccttggtaaaaggttttttgttacgccatcagattctgttgctatcattgctgccaatgcagtccaatccataccctacttttcatctgggttaaagggtgttgccaggagcatgccaacatctgctgctcttgacgtcgtagccaaaagtttgaacttaaagttttttgaggtaccaaccggctggaaattctttggtaacttgatggatgctgggttatgttcagtttgtggtgaagaaagttttggaacgggatcggaccatatccgtgaaaaagatggaatctgggctgtcttggcttggttatccattcttgctcataaaaacaaggacaacctcaatggtgggaaacttgtgacggttgaagacatcgtgacacggcactgggctacctttggacgccactattatactcgttatgattatgagaatgtcgatgcaggtgctgcaaaagaactaatggctcacttggtcaagttgcagtcttctattagtgatgttaacaaaatcataaaggaaacacgatctgatgtggcaaatgttgcaagcgctgacgagtttgaatacaaagatcctgttgatggttcaatctctaagaatcagggaatccgttatttattcgaagatgggtcacgtttggttttccgtttatcagggactgggtcagaaggtgccacaattcgtctttacattgaacaatacgaaaaagatgcaacaaaaattggaagagattctcaagaagcacttgctcctctggtggaggttgcactaaagttgtcaaagatgcaagaattcacaggtcgttctgcccctaccgtgattacataaataaatatactcatgctgctggctgtctacaatctgggcttgtttgttagtt

SEQ ID NO: 7029 - DNA, 2672 bp, Eucalyptus grandis
atggtgtttacctcaccaaggaagaggactcatttcacaggagcttctatggcctatcctcttgtgagaatttgcagacaagatttgaaaaaactgtcatctcgccttgctcacttcctcaccacctttcctggcaccatcatcgacatcctccctgtttatgcgaatcggcagaaaatggtgacgttccaggtgtcgcgagtggagaccgcgcccttcgatggccagaagcccggcacctccggcctccgcaagaaggtgaaagtttttgtccagccccattacttgcaaaattttgtgcaatcaacattctatgccctttcagctgagaaagtccaaggagctacactcgttgtttctggtgatgggcgttatttctcgaaggatgctatccagatcataataaagatgtcagctgcaaatggagtaaggcgtgtctgggtaggtcagaatggattactttccactcctgccgtgtcagctgtgatccgcgaaagagttgggcatgatggatccaaggctacaggagcatttattctgacggcaagtcataatcccggtggtccccatgaggattttggaatcaagtataacatggaaaatggtggacctgctcctgaggcgatcactgataagatgtatgaaaatacaaaaacaataaaagaatatctaattgcagaaaatctccctgatgtggatattgctgcaattggtgtcacaagctttacggggccagagggtcaattcgatgttgaggttttggattcagccagtgactatgttaaattaatgaagtcaatttttgacttccaggcgatccgaaagctgctttcatctccaaattttaccttctgctatgatgcgctccatggagttgctggagcatatgccaaccgcatatttgtagaagagcttggcgcacaagagagctcattattgaactgcacacctaaggaggattttggagggggtcacccagatccaaatttgacatatgcaaaggagctggtggcacggatgggtttgggcaagtcaagtcctcagcatgagccaccagaatttggtgctgctgctgatggtgatgctgatcgtaatatggttctcggaaaaaggttctttgttactccatcagattctgttgctattattgctgcaaatgctgttgaagcaataccctacttctccggaggcttaaagggagttgccaggagcatgccaacatcagctgccttggatgttgttgctaaacatttaaatttgaagttttttgaggttccaacgggctggaaattctttggtaacttaatggatgctggattatgttcagtttgtggggaagaaagtttcggaactgggtcagaccatatacgtgaaaaagatggtatctgggctgttttggcatggctttccatccttgcgtacaagaacaaggaaaatatcaatggtggaaagcttgtatcagttgaagatattgttcaccagcactgggcaacttatggtcgccactattacactcgttatgattatgagaatgttgacgcaggggcagcaaaggaactaatggcatacttggtccggttgcaatcttcccttggtgaagttaatgagattgtcaagggagtatgttcggatgtgtcaaatgttgttcatgctgatgagtttgaatacaaagatcctgttgatggttccatatcgaagcaccagggcattcgttatttgtttgaagatgggtcgcgcctgattttccgtctctcaggaaccggctcagaaggggcaaccattcgtctttacattgagcaatatgagaaggatccctcaaaaactgggagagattctcaagaagctttagctcctctggtggatgtcgcactcaagctctccaagatggaggaatttactggccgatctgctcccacggtcatcacatgatgggcttgctaactaaatgacaggaagagcagactcaacgaatatgagagatttctctaaacagttggcaaccctgctagacctttcacatgtttgtttcatatgggtgacttcatgagaggcgcatcttgatctctctattatctttaacaataagttctcgaaataatttgtgctattcagtcttattgcataattgagctgcgcatactgaatctgttgtgccaaagtgctccttccataagactaagaggcatatttttggctgttatatagttccagtgtactttggacattcgttcggggcccaaaaatgaaatattccctttaggcgacttatttgcagggcaaactgcaagctggcatggtcccgttacaggtacgacgtcgatggtatttgacagaaactcctgcgcgatgcttggaataatcgcaagatcccaagcaacgaatttggtgggtggtcaatttatcagcctttggagtttgatgtgatcggtaggtgctcaaattctctgctcatttcgtggcttgcccatctttgtgattggaaaactgtgagtcgtgccagacgctgtagtccttgtgttccttcctgcattccaatatctcaagggccgagcaaccaagaacctatgctaggcttgggacaagagcaacgcagagtggctcgctgtatcctcttttgttttgtcagtacggtttggcattgtctttcgttctctcaaatttgtgtggaggct

SEQ ID NO: 7030 - DNA, 1933 bp, Flaveria ramosissima
gaagaaaaagcttaactaatggcgactttcaaggttaatcgtgtcgaatcttcgccgattgaaggccagaagcctgggacatctggactcaggaagaaggttaaagtattcactcaacctcattacttgcacaactttgttcaatcaacatttaatgccctttctgctgagaaagttaaaggttctacacttgttgtttcgggtgatggacgttactattcaaaggatgcaatccagattataattaaaatggcagctgcaaatggtgtaagacgtgtttgggtcggtcaaaatggacttctatccacacctgctgtatcagccgttgtacgtgaacgagttggcgctgatggttccaaagcaaatggggcatttattttgacagctagtcacaacccaggtggtcccaatgaggattttggaattaagtacaatatggaaaatggtgggccagcacctgaaggaattactgataaaatctatgagaacactaaaacaataaaggagtattttattgcagaaggccttcctgatgtggatatctcagcaattgggatttcaagcttttcaggtcctgatggtcaatttgacgttgatgtttttgactcatcaagtgactatgtgaaattgatgaaatcgatctttgatttccagtccatcaaaaagctaattgcatctccacaatttagtttttgttatgatgctcttcatggagttgctggagcttatgctaaacgtatatttgtcgaagagcttggtgcaaatgagagctcattattgaattgtgttcccaaggaagacttcggtggcggacatcctgatcccaatcttacatatgcaaaagagttggtagcaagaatgggattgggtaaaaaccctgacagtaacccaccagaattcggtgctgctgctgatggtgatgctgacaggaacatggtccttggtaaaaggttttttgttacaccatcagattctgttgctatcattgctgccaatgcagtccaatccataccctacttttcatctgggttaaagggggttgccaggagcatgccaacatctgctgctcttgacgtcgtagccaaaagtttgaacttaaagttttttgaggtaccgactggctggaaattctttggtaacttgatggatgctggattatgttcagtttgtggtgaagaaagttttggaacaggatcggaccatatccgtgaaaaggatggaatctgggctgtcttggcttggttatccattcttgctcataagaacaaggacaacctcaatggtgggaaacttgtgacggtcgaagacatcgtgacgctgcactgggctacctttggacgccactattatactcgttatgattatgagaatgtcgatgcaggtgctgcaaaagaactaatggctcacttggttaagttgcaatcttctattagtgatgttaacaaaatcataaaggaaacacgatctgatgttgcaaatgttgcaagcgctgacgagtttgaatacaaagatcctgttgatggttcaatctctaagaatcagggaatccgttatttatttgaagatgggtcacgtttggttttccgtttatcagggactgggtcagaaggtgccacaattcgtctttacattgaacaatacgaaaaagatgcaacaaaaattggaagagattctcaagaagcacttgctcctctggtggaggttgcactaaagttgtcaaagatgcaagaattcacaggtcgttccgcccctaccgtgattacataaataaatatactcgtgctgctggctgtctgaaatctgggcttgtttgttagttacaaaagcatcgtcttgtttgttaaatgtttgatgatttacaaagtttttatttcggttaataattcagttgtatcttgagagcatttaccaacaatatcttggaattgcggct

SEQ ID NO: 7031 - DNA, 1806 bp, Flaveria ramosissima
catcactcgccaaccttaatctctctgaagaaagcttaactaatggcgactttcaaggttattcgagtcgaatcttcgccgattgaaggccagaagcctgggacttctggactcaggaagaaggttaaagtattcactcaacctcattacttgcataactttgttcaatcaacatttaatgccctctctgctgagaaagttaaaggttctacacttgttgtttcgggtgatggacgttactattcaaaggatgcaatccagattataatcaaaatggcagctgcaaatggtgtaagacgtgtttgggttggtcaaaatggacttctatccacacctgctgtatcagcagttgtacgtgaacgagttggtgcagatggttccaaagcaaatggggcatttattttgacagctagtcacaaccctggtggtcccaatgaggattttggaattaaatacaatatggaaaatggtgggccagcacctgaaggaattactgataaaatctatgagaacactaaaacaataaaggagtattttattgcagaaggccttcctgatgtggatatctcagcaattgggatttcaagcttttcaggtcctgatggtcaatttgacgttgatgtttttgactcatcaagtgactatgtgaaattgatgaaatcgatctttgatttccagtccatcaaaaagctaattacatctccgcaatttagtttttgttatgatgctcttcatggagttgctggagcttatgctaaacgtatatttgtcgaagagcttggtgcaaaagagagctcattattgaattgtgttcccaaggaagactttggtggcggacatcctgatcccaatctcacatatgcaaaagagttggtagcaagaatgggattgggtaaaaaccctgatagtaacccaccagaattcggtgctgctgctgatggtgatgctgacaggaacatgatccttggtaaaaggttttttgttacaccatcagattctgttgctatcattgctgccaacgcagtccaatccataccctacttttcatctgggttaaagggtgttgccaggagcatgccaacatctgctgctcttgatgttgtagccaaaagtttgaacttaaagttttttgaggtaccgactggctggaaattttttggtaacttgatggatgctgggttatgttcagtttgtggtgaagaaagttttggaactggatcggaccacatccgtgaaaaggatggaatctgggctgtcttggcttggttatccattcttgctcataagaacaaggacaacctcaatggtgggaaacttgtgactgtcgaagacattgtgacactgcactgggctacctttggacgccactattatactcgttatgattatgagaacgtcgatgcaggtgctgcaaaagaactaatggctcacttggtcaagttgcaatcttctattagtgatgttaacaaaatcataaaggaaacccgatctgatgtggcaaatgttgcaaacgctgatgagtttgaatacaaagatcctgttgatggttcaatctctaagaatcagggaattcgttatctatttgaagatgggtcacgtttggttttccgtttatcagggactgggtcagaaggtgccacaattcgtctttacattgaacaatacgaaaaagatgcaacaaaaattggaagagattctcaagaagcacttgctcctctggtggaggttgcactaaagttgtcaaagatgcaagaattcacaggtcgttccgcccctaccgtgattacataaataaatataatcgtg

SEQ ID NO: 7032 - DNA, 2040 bp, Aquilegia formosa
tttcgctacattttctttctaaccagtgagattctctctccttcgttctgaatctctgttgaatcgctgttgttgttgttgattcgagcttggaagaaatggtgttcaaggtttctcgagttgaaacatcacctattgatggccaaaaaccaggaacttctggtttgaggaagaaggtgaaagtattcaagcagcctcattacttgcacaactttgttcaagcaacattcaatgccctttctgctgataaagtgagaggtgctacgcttgttgtttctggtgatggtcgttattattcaaaagatgctattcagatcataattaagatggcagctgctaacggcgtaagaggtgtatggataggacagaatggactactttcgacacctgctgtatcagctgttataagggaaagagttgatgcgaatgggtcgaaagcatcaggaggatttatattgacagcaagtcacaacccaggtggtccaaatgaggattttggtatcaagtacaacatggaaaatggtggacctgctcctgagggaatcactgataaaatctatgagaacacaaaaacaataacggaatatttcattgcagaggatctcccagatgtggatatttcttctattggcgtaacaagctttggaggccctgagggacaatttgatgtcgatgtttttgattcagccagtgattatgttaaattgatgaagtctatttttgattttcaatctatccaaaagctggttacatctcccaaattcaccctctgttatgatgcactccatggtgttggtggagcttatgccaaccgtatatttgtagaagagcttggtgctcaagaaagttcattaataaactgcacaccaaaggaagattttggtggagggcacccagatcccaacctgacctatgcaaaggagttagttgcacgtatgggtttggataagtcaaagcctcaaagtgaccctccagaattcggcgctgctgctgatggtgatgcagatcgtaatatgatccttggtaaacgattttttgtgactccatcagattctgttgcgattattgctgcaaatgcagttgaagcaattccttacttctcttctggtttaaagggagttgccaggagcatgcctacatcagctgctcttgatgtggtagcaaagcatttgaatctgaagttctttgaagttcccactggctggaagtttttcggaaacttgatggatgctgggatgtgctcagtttgtggtgaagaaagttttggaactggttcagatcatattcgagagaaagatggaatctgggcagttttagcttggctctctattcttgccttcaagaacaaggacaaccttgatgggaaagatcttgtcactgttgaagacatagttcgtcagcactgggctacttttggtcgccactattatactcgatatgactatgaaaatgttgatgcaggtgcagcgaaggagctgatggcgaatttggttaaactgcagtcttcacttcctgatgtgaataagattatcgagggaatacgatcagatgtatcagaagtcgtccaagccgatgagtttgaatacaaagatcctgtcgatggctccatctcaaagcaccagggtattcggtatctatttaaagacggatcaagattggttttccgtctctccggaactggttccgaaggtgcaactatccgactttacattgaacaatatgagaaggattcttcaaagattgggagagagtcgtcagaagcccttgctcctcttgtggaggttgctctcaagctttccaagatgcaagaattcactggccgttctgcccccacagttatcacctagattaacctttagattcaagtttttgtttatatttcagctggactgttctattttgtagtatgagaaaattttctgagccatgatacttgacatgaactcaagtgagatatcgttctacatgtatatgttctaataaacagtcttaccatatcatcaacagagcagaaatctgtatgaccataatcctggcaag

SEQ ID NO: 7033 - DNA, 2076 bp, Euonymus alatus
gtctctacaacgacaaacatttggtgcaactctcctttctctataaagaaagagcacccgcgcatagcgcacctcgtctcgccatctttgctttccttaaatacaaaacgcacagtgatcactgaaaatggtgatgttcaaggtttctcgtgtggagtcgacgccgtacgacggacaaaagcctggcacttctggtctccgcaagaaggtgaaagttttcatccaaccacactacttgcaaaactttgttcagtcaactttcaatgccctttcagctgaaaaagtcagaggtgcaactcttgttgtttctggtgatggtcgctatttctcaaaggatgccatccagatcataactaagatggcagctgctaatggtgtgagacgtgtttggattggtcaaaatggactgctttcaactccagccgtatcagctgtgattcgtgaaagggttggtgtagatggatccaggggaacaggagcatttatattgactgcaagccacaatccaggtggtcctcatgaggactttggaataaaatataacatggaaaatggtggacctgctcctgagggaatcacggataagatctacgagaacactaaaactatcaaggagtacttaattgcagaagatcttcctgatgtggatattggcacagtaggtgtcaccagctttagaggccctgagggacagtttgatgttgaagtttttgattcagcaagtgactatgtgaagttgatgaagtcaatctttgactttgaatccatccggaagctacttacatctccaaaattcagtttctgttacgatgcaatgcatggagttggtggagcttatgcggaacctatttttgtagaagagcttggtgcacaagagagctcgttgttgaactgcacacccaaggaggactttggaggagggcatcctgatccaaatcttacttatgccaaggagttggttgcccgtatgggattggggaaatcagattctcaaggtgaaccaccggagtttggtgctgcatctgatggtgatgcagatcgtaatatgatccttggtaaaaggtttttcgttacgccatcagactctgttgctatcattgctgcaaatgcagttgaagcaataccgtatttctctgctggtctgaagggggttgccaggagcatgccaacttcagcagctcttgatgttgtggctaaacatctgaatctgaaattttttgaggtgcccactggttggaagttttttggaaatctgatggatgctggattatgttcagtatgtggagaagaaagttttggaactggctcagaccatatacgtgagaaagatgggatttgggcggttctggcttggctatccatacttgcccacaaaaataagggaaaacttgatggagaaaaatttgttagtgttgaagatattgttcgccagcactgggctacatatggtcgccactactacactcgatatgactatgagaatgtggatgcaggcgctgcaaaggaattaatggcacatttggtcaaactgcagtcttccctttcagaagttaatgatattgtgaaggggataagttctgatgtgtcaaaggttgtccatgctgatgagttcgagtacaaggatcctgttgatggttctatctcaaagcaccagggtattcgttatttgtttgaggacggttctcgattggtcttccgcctctcaggaactgggtcagaaggcgcaaccattcgtctatacatcgagcagtatgaaaaggatccatcaaagactgggagggaatctcatgaagcactcgctcctcttgtggaggttgctctcaagctttctaagatgctggaattcaccggacgatctgctccaaccgtaattacataaatgtatacttccagcggggaatttacatactaagaagtgttttcttgttgtgtcatgtactttgaaaagttgcaggaacttttacaagctcctaataagatccatttttaggcttccagaaagtgagcctgttttatgcaatgtggcttgtttctaattaagttcccaggttgggaagaatcctaagatgaagttga

SEQ ID NO: 7034 - DNA, 2045 bp, Chelidonium majus
ttacttgcttaacaaacactcgtcattccttcattttgccaccttcttcttctgtactcctttccaattctgaaccattaatctgcggaaacgatggtgatgttcaaagttaccaaagttggtaccacgcctttcgtcggccaaaaaccaggaacttctggattgaggaagaaggtaaaagtgttcaagcaacctcattacttgcacaattttgttcaagcaacattcaacgcacttccagctgacgaagtgaaaggtgctacaatcgttgtttctggcgatggtcgttatttctcaaaggatgccattcagattataattaagatggcagcggcaaatggagtaagaggtgtttgggttggacagaatggattactctcaactcctgctgtatcggctgtcatacgtgaaagagttggcgctgatggatccaaggcatcaggagcttttatattgacagcaagtcataatcctggtggtccaactgaggattttggaatcaagtacaacatgggaaatggtgggcctgctcctgaaggaattacggacaagatctatgcgaacaccacagcaataaaagaatacttcattgcagaagatctaccagacgtggatatttctactgtaggagtaacaaaatttggaggacctgagggagaatttgatgtcgatgttttcgattcagccagtgactatgtgaagctgatgaagtcaatttttgatttcgagtctatccagaagctgcttgcttctccgaaattcactttctgttatgatgcacttcatggagttgccggagcttatgccaaccgtattttcgtccaagaacttggtgcacaagaaagttccttaataaactgcacgcccaaggaagactttggaggagggcatccagatcccaacctgacctatgcaaaggagttggttgtgcgtatgggattgagtaaagataacccccaagacaatccaccggaatttggtgctgctgctgatggtgatgctgaccgtaacatgatccttggtaaaagattttttgtgactccatcagactctgttgccataattgctgcaaatgctgttcaagcaattccttatttttcttccggtttgaagggggttgccaggagcatgcctacatcagctgcccttgatgttgtagcaaaacatttaaatctcaagttcttcgaggtacccactggctggaaattttttgggaacttgatggacgctggattatgttcagtgtgtggtgaagaaagttttggaactggttccgaccatatacgtgagaaagatggaatatgggcagttttagcttggttatccattcttgctttcaaaaacaaggacaatctgggtggagataatcttgtcactgttgaagacatagttcgtcagcattgggctacttttggccgacactattacacccgatatgactatgaaaatgttgatgctggtgcagccaaggagttaatggcaaacttagtcaatctgcaatcttccattcctgatgttaacaagatcataaagggaatcaggtcagatgtttcagatgtcgtccaagccgatgaatttgaatacaaagatcctgttgatggctccatttcaaagcaccagggtatccgatatctgtttgcagatggatcacgattggttttccgtctttctggaaccggttcagaaggtgcaaccatccgtctttacattgagcaatatgagaaggattcttcaaagattggaagggaatctcaagaagcactttctcctctggtggaagttgctcttaagctttctaagatggaagaattcaccggccgatcaactcctacagttattacatagatagatcaacttttctctctacacaaggcttatttagtcttcggtttttgcctcttaagatactatatggtatcaacttcaccaagagtctttttctttttattattggtaattgtaacatgagaaacttctgagcccatgatactttttatccatgactccattcgtgttatcctacataaatttacaattacttaact

SEQ ID NO: 7035 - DNA, 2042 bp, Helianthus annuus
ctctttctctctctagaaccgacatcactcactttctctccattttcgccaaccttcttacacactctctctctgaaaacagtttaactaatggcgaatttcactgttaatcgcgtcgaaacctcgccgattgaaggccaaaagcctggcacttctggactcaggaagaaggtcaaagtattcacccaaccgcattacttgcataactttgttcagtcgacatttaacgctctttctgcggagaacgttaaaggttctaccctagttgtttccggtgatggtcgttactactcaaaggatgcgatccagattattatcaaaatggcagctgcaaatggagtaagacgtgtttgggttggtcaaaacggacttttatccacacctgctgtatcagcagttgtacgtgaacgagttggggctgatggttccaaagcaaacggggcgtttattttgacagccagtcacaacccaggtggtcccaatgaggattttggaatcaaatacaatatgggaaatggtgggccagcacctgaaggaattaccgacaaaatctttgagaacactaaaacaataaaggagtattttatcgcagaaggcctaccggatgtggatatctcggcaattggagtttcaaacttttcaggtcctgacggtcaatttgacgttgatgttttcgactcgtcaagtgactatgtgaaattgatgaaatcgatctttgatttccagtccatccaaaagctaattacctctccacaatttagtttctgttatgatgcacttcatggagttgctggagcttatgctaaacgtatatttgttgaggagcttggtgcaaaagagagctcgttattgaactgtgttcccaaggaagatttcggtggtggacatcctgatcccaaccttacttacgcaaaagagctggtagcaagaatgggattgggtaaaaaccctgatagtaacccaccggaattcggtgctgccgctgatggtgatgctgataggaacatgatccttggtaaaaggttttttgttacaccgtcagattctgttgctatcattgccgccaatgcagtccaatctataccctacttttcatctggattaaagggtgttgccaggagtatgccaacgtctgctgctcttgatgttgtagccaaaagtttgaacttgaagttttttgaggtaccaactggctggaaattctttggtaacttgatggatgctggattatgttcagtttgtggtgaagaaagtttcggaacaggatcggatcacatccgtgagaaggatggaatctgggctgtcttggcttggttatccattcttgctcataaaaacaaggacaaccttaacagtgggacccttgtaactgttgaagacattgtaaaacagcactgggctacctttggacgccactactacactcgctatgattacgagaatgtcgatgcaggtgctgcaaaagaactaatggcacacttggtcaagttgcaatcctctattagtgacattaacgaaaccataaaaggaatacgatctgatgtggcgaatgttgcaagtgctgatgaatttgaatacaaagatcctgttgacggttcaatctctaagcatcagggaattcgttatttatttgaagacggttcacgtttggttttccgtttatcagggacggggtcagaaggcgccacaattcgtctttacatcgagcaatacgaaaaggattcatccaaaactggaagagattctcaagaagcacttgctcctctggtggaggttgcactaaagctgtcaaagatgcaagaattcacaggtcgttccgcccccactgtgattacataaataaatacacatacatgctgtcgctgttgctgtcgctgtcgcctacagggtatgtattttgagtgctcttatagaaataaagtttagcttttcgggatcacatgtctagtttgttaaatgtttgaagatttacaatttttgttgcccttaataattcagttgtatcatgagagtatttaccaacaatgtcctgaagttacggc

SEQ ID NO: 7036 - DNA, 2152 bp, Platanus occidentalis
agcagatccaatccgaaccagtgagctccgaagagatggtgatgttcaaggtttcccgggtagaaacagctcctattgatggccagaagccaggaacttctgggctcaggaagaaggtaaaagtgttcaagcatcctaattacttgcataattttgttcaatcaacattcaacgcactatcagctgacaaagtgaagggtgctacaattgttgtttctggtgatggccgttatttctcaaaagatgccattcagattataattaaaatggcagctgcaaatggagtaagacgtgtttgggttggacaaaatggattactgtccacacctgccgtatcagctgtaatccgtgaaagagttggggctgacggatccaaggcaacgggtgcttttatattgactgcaagtcacaacccaggtggtccacatgaggattttggaatcaaatacaacatggaaaatggcggacctgctcctgaggcaattacagataagatctatgagaacacaaaatcgattaaggaatacttcattgctgaagatctaccagatgtggatatttctactataggtgtaacaagctttggggggtccgagggacaatttgacatcgatgtgtttgattcagctactgattatgtgaaattgatgaagtcaatttttgattttgagtctatccagaagctgcttgcatctccaaaatttacattctgttatgatgcgcttcatggagtggctggagcttatgccaaacgtatttttgtagaagagcttggtgcagatgaaagttcattaatgaactgcacacccaaggaagactttggaggagggcatccagatcccaacctgacttatgcaaaggaattggttgcacgtatgggattgggtaaaacaagcccacaacatgaaccaccagaatttggtgctgctgcagatggtgatgcagatcgtaacatggtccttggtaaaagattttttgttacaccatcagattctgttgccatcattgctgcaaatgcagttcaagccattccttacttttcagctggtttaaagggagttgctaggagcatgcctacatcagctgcacttgatgttgtagcaaaacatttaaatctaaagttttttgaggtacccacaggctggaaattttttggtaacttaatggatgctggattatgttcagtttgtggtgaagaaagttttggaaccggttcggatcatatacgagagaaagatggaatctgggcagttttagcttggctatctatccttgccttaaaaaataaggacaatctcaatggagaaaaactggtgactgttgaagaaatagtttgtcagcattggggtacttatggtcgtcactattatactcgatacgactatgaaaatgttgatgcagatgcagcaaaggagctaatggcatatctggtcaaactgcaatcttctcttcctgatgttaacaaaattataaagggaataaggccagatgtatcagatgtcgtccaagctgatgaatttgaatataaagatcctgttgatggctcgatctcaaagcaccagggtattcgatatctgtttaaagatggatcacgattggtttttcgcctctctggaacgggctcggaaggtgcgaccatccgtctttacatcgaacaatatgagaaggattcttcaaagactggaagggattctcaagaagcacttgctcctcttgtggaagtcgctctaaagctttcaaagatgcaggaattcaccagccgttctgcccccactgttattacataagtcaactgctacatacagcagtgaggttttggtttaacttaaaatatataaaaaggtatgtcctgatgtcatgtattgtgatgagaaattttgagccatgacagtcaatgactcaatcagatatctgatgtacattttccaattatgctaccatacctgatcaccaatgcagcggagtattatgaacttgagtatgttggtcgaattaattttgttcattttcagaataatttgaaaatcccatgttcctaccatatgctagggtgttatagaagatatggccctggagagagtagaatggcagaacagtacatttgtacgcaaacccaaataattgggataaggctttattattattattatca

SEQ ID NO: 7037 - DNA, 1950 bp, Flaveria ramosissima
tcgaattaatggcgaatttcaaggttactcgcgtcgaatcatcgccgattgaaggccaaaagcctggcacttctggactcaggaagaaggttaaagtattcacccaaccacattacttgcataattttgttcaatcgacgttcaacgctctttctgccgagaaagttaaaggttctacgcttgttgtttctggtgatggtcggtactactcaaaggaggcaatccagattataattaaaatggcagctgcaaatggtgtaaggcgcgtttgggttggccagaatggacttttatccacacctgctgtatcagcagttgtacgtgaacgagttggcgctgatggttccaaagcaaatggtgctttcatattgacagctagtcacaaccctggtgggcccaatgaggattttggaataaaatacaatatggagaatggtgggccagcacccgaaggaattactgataaaatctttgagaacactaaaacaataaaggagtattttatctcagaagacctacctgatgtggatatctcagcaattggaatttcaaacttttcaggtcctgatggtcagtttgatgttgatgtttttgactcagcaagcgactacgtgaagttgatgaagtcaatctttgacttccagtccatccaaaagttaattgcatctccacaatttagtttctgttatgatgcattgcatggagttgctggagcttatgctaaacgtatatttgttgaagagcttggtgcaaaggagagctcattattgaactgtgttcccaaggaggactttggtggaggacatcctgatcccaacctaacctatgcaaaagaattggtagcaagaatgggattgggtaaaaaccctgatagcaacccaccagaatttggtgctgctgctgatggcgatgctgataggaacatgattcttggtaaaaggttttttgttacaccttcagattctgtcgctatcattgctgccaatgcagtccaagccataccctacttttcatctggattaaagggtgttgccaggagcatgccaacatctgctgctctcgatgtcgtagctaaaagtctgaaccttaagttttttgaggtgccaactggctggaaattcttcggtaacttgatggatgcgggattatgttcagtttgtggtgaagaaagttttggaactgggtcggatcatatacgtgagaaggatggaatctgggctgtgttggcttggttatccatccttgcttataaaaacaaggacaacctcaatggtgggaaccttgtaacggttgaagatattgtgaagcaacactgggctacttttggacggcactattatactcgctatgattatgagaatgttgatgcaggtgctgcaaaggaagttatggctcacttggtcaagctgcaatcctccattagtgatgttaacaataccataaagggaatgcggtcagatgtggcagatgttgtcagtgctgatgaatttgaatacaaagatccggtagatggttcagtctctaaaaatcagggaattcgttatttattcgaagacgggtcacgcctggttttccgtttatctggtaccgggtcagaaggtgccacaattcgtctctacatcgagcaatacgaaaaagattcatccaaaactggaagagattctcaagaagcacttgctcctttggttgatgttgcactaaagctgtcaaagatgaaagaatacactggccgttctgccccgactgtgatcacataaatatatatatacatgctgctgctatcatcaacaacgtatgtattttcgtgttttatagcaataaagttagcctttgagtggtgcgggttttggcctatgagtttcgcaggcatcactttgttgaatgtttattgatttacaaagttttgttgccggtaatcgttcagttgtatgttgagaatcttttacttac

SEQ ID NO: 7038 - DNA, 2059 bp, Lippia dulcis
ttttgaacaaagatggtgatgttcacggtcagccgcgtcgagacgactccgttcgatggacagaagcctgggacttctggtcttaggaagaaggtcaaggtattcaaggaaccacattacttgcaaaactttgtgcaagccacatttaacgcccttggagctgataaagtcagaggtgctactcttgttgtctctggtgatggccgttacttttcaaaggatgctgtccagatcattattaaaatgtctgctgcaaatggagtaaggcgcatttgggttggtcagaacggtttgctgtcaactcctgctgtatcagctgttatacgtgagagagtaggcgcagatggatccaaggcaaatggggcattcatacttacagcaagccacaacccaggggggcctactgaggattttggaattaagtacaacatggaaaacggtggacctgcaccagaaggaatcaccaataagatttttgagaacaccaccacaattaaggagtacttgattgcagaaggcctgccagatgtggatatctcgaccataggtgtaactagctttgctggtccagaggggcagtttgatgttgatgtttttgattcagcaagtgattatgtcaaactgatgaagtccattttcgacttccaatccatccagaagttactgtcttctccaaaattcactttctgctacgatgcacttcatggagttgctggagcttatgccaaacgcatatttgtagaagagctaggtgcacaagaatcatctttactcaattgtgtacccaaggaggatttcggtggaggtcatcctgatcccaatcttacctatgcaaaagaattagttgctcgtatgggattgagtaaggaaaaatctgaacaggatccaccagaatttggcgctgctgctgatggagatgcggaccgtaatatgattcttggcaaaaggtttttcgtcacaccatctgactctgttgctatcatagctgcaaatgcagtcgaagctattccttacttctctggtggtctgaaaggagttgcaaggagcatgcccacgtctgctgctcttgatgttgttgctaaaagcctgaatctgaaattttttgaggtgccaactggctggaaattcttcggtaatttgatggatgctggaatgtgttccatctgtggtgaagaaagttttgggactggctcagaccacatacgtgagaaagacggaatatgggccgttttggcctggctgtctattctcgcctataagaacaaagacagtctagggggaggagagaaacttgtcagtgttgaagacattgttcgctcgcattggtcaagatatgggcgccattattacactcgatatgattatgagaatgttgatgcaggtgctgctaaggaactcatggcttatttggtcaaactgcaatctgaccttgctgaagttaacgacattataaagggaatccgctcggatgtctcaaaagtcgttaatgctgatgaatttgagtacaaagatcctgtcgatggatccatttcaaagcatcagggcatcagatatctgtttgaagatggatcccgattggttttccgactctctggaactggttcagagggtgctactatccgtctgtacatagagcaatatgagaatgatgcatctaagactggaagagattctcaagaagctctcgctcctcttgttgatgtagctcttaagctctctaagatgcaagagttcactggccgctctactccgactgttattacataaatgctgcaacaaagagtttgttatatacgtctcgaaataagaaatgagtatcgtgccgtaatatggattgtttctgggagatacgctctcagattttaagtacactctagatatttgggatatttagcataaatttgaatccatgacggtacgtcgtgaagaagtcatgaaatgagatgtgtgttgacacaattttgttgcgaaaaataaacaatgctattactttcttggtgaaaccatattttgggattctgtttgaaggttttactctaatgtttaacgtatgttcgaa

SEQ ID NO: 7039 - DNA, 2020 bp, Trigonella foenum-graecum
aatcattttattttcttccagaaccaacacactctcgtaaggtaacaaaccatggtgctcttcaatgtctcacgtattgaaactactccattcgatggacagaagcctggaacctctggtctccgcaaaaaggtgaaagtatttgtgcaacctcattaccttgaaaactttgttcaggcatcattcaatgcactaactgaagaaaaagttagaggtgcaacactagttgtatctggtgatggtcgttattattcggagcaagcaattcagattataactaaaatggcagcagcaaatggagttagacgtatttgggttggtctaaatgggatgctttcaactcctgcagtatctgctgttatacgtgaaagagttggggttgatggatccaaggcaacaggagcatttatactgacagcaagtcacaaccctggcggtcctaatgaggattttgggattaaatataacatggaaaatggtggacctgcaccagagggaattactaacaaaatatatgaatacacaacaacaatcaaggagtacttgattgctccagatctgccaaatgtggatatcaccacagcaggtgtcacaaactttacagggcctgaaggaccatttgatgttgaggtttttgattcagcaagcgattatataaagttgatgaagtcaatttttgactttggatctatcaggaaactgctgtcatctcctaaattcacattctgttatgatgcgttacatggagttgctggagcttatgctaagcgtatttttgtggatgagcttggggcacaagaaagctctttgctgaactgtgtaccaaaggaagactttggagggggacacccagaccccaatttgacatatgcaaaagaattggttgctcgtatgggactgggcaaatcagaatcacaaggtgagcccccagagtttggtgctgctgctgatggtgatgcagatcgcaacatgatacttggtaaaaggttttttgtcactccttcggattctgtggccattattgccgcaaatgctgttgaagcaataccatacttttctgctggcttaaagggagttgccaggagcatgccaacatctgctgccctggatgttgtagccaaacatctgaatttgaaattttttgaggtccccacgggttggaagttctttggtaatttaatggacgctggattgtgttcagtttgcggtgaagaaagttttggaactggttcggatcacattcgtgagaaggatggaatctgggcggttttggcctggctatctatacttgcatataaaaataaagataatcttgaagacaagcttgtaactgttgaagacatagttcgtcagcattgggctaaatatgggcgccactattatactcgatatgactacgaaaatgtggatgcaggtgcagcaaaggaactgatggcacatttagtcaaactgcagtcctcactttcagaagtcaatgggattgttaaaggggcaagttcagatgtttcaaatgttgtccacggtgatgaatttgaatataatgatcctgtggatggttccatttcatcacatcagggcatccgatatttgtttgaggatggatcacgattgattttccgcctctctggaactggatcagaaggggcaactattcggctatacattgagcaatatgagaaggatccatcaaagattgggagactttcacatgaagcacttgctcctcttgtggaggctgcattgaaactttcaaagatggaggagttcaccggtcgatctgctcccacagtcatcacataaatacatactgccggaaccaagtcatttcttattgtctgtcaaaatcttcatccaatgttaattttgagtaaccaacctgtactgttggttgttttcgggccttatatatgggcccttgagtggaatttgcattacttaactaaattttgatgcgataaataatttgaaactgccgagtgctgattatatatatgcgctcttaatataatgtctccacttt

SEQ ID NO: 7040 - DNA, 2406 bp, Vitis vinifera
gaaagaaatggcagtgggatttgcgaaccatcaagagaagagtagcgatggaagcgctctctaaagggagcttaaaaatgcgtgagcttcggaggtcctcatcactaatgtgcggcccaaacggaacccaaaccccaccctatttctctcgttgtaaataaatgctcattcgtgcgtttttaacactcactttcactagagctgtacacttgtatcctctcccgtcttgacatctcccaaatcaaagcttcttctgtcatcccctataagggaagcaatggtgatgttcaaggtttctcgagtcacaacttcgccgtttgatggccagaaaccgggaacttctggcctcaggaagaaggtgaaagtattcaagcaacaaaattacttgcacaattttgttcagtcaacattcaatgccctttcacaagacaaaataagaggcatgacacttgttgtttctggtgatggccgctatttctcgaaggatgccattcagattataattaagatggcagctgcaaatggagtgagatctgtctgggttggtcaaaatgggttgctttcaactcctgctgtatcagctgtcatccgtgaaagagtggggaaagatggaaccaaggcatcaggagcatttatactgacagcaagtcacaatccaggtggtcccaacgaggattttggaattaagtacaacatggaaaatggtggacctgctcaagaggcaattactgataagatctatgagaacacaaaatccataaaggagtatataattgcagaagatcttcctgatgtggatatctctgcaataggcattacaaacttcacggggcctgagggacaatttgatgtcgaggtttttgattcagcatttgattatgtgaaattgatgaagtcgatttttgatttccaatctatccaaaagctgctctcatcaccaaaattcacattctgttatgatgcactgcatggagttggtggagcttatgcaaagcgaatatttgttgaagagcttggtgcacaagaaagctcattgctgaactgcgttcccaaggaagactttggaggagggcatccagatcctaatctaacctatgcaaaggagttggttgcatgtatgggattgggtaaatcagatgctaaaaatgagccaccagagtttggtgccgcttctgatggtgatgcagatcgtaacatgatccttggcaaaaggttttttgttactccatcagattctgttgctatcattgctgcaaatgcagttgacgcaataccctatttctctgctggtttaaagggagttgccaggagtatgcccacatctgctgctcttgatgttgtagccaaacatttaaatctgaaattctttgaggtcccaactggctggaaattttttggtaacttaatggatgctggattatgttcaatttgtggtgaagaaagttttggaactggttcggaccacattcgtgagaaagatggaatctgggctgttttagcttggctttctattctcgcttatgaaaataaggaaaaccttggtggagcaaagcttgttactgttgaagaaatagttcgcaatcattgggctacctatggccgccactattatactcgatatgactatgagaatgttgatgcaggtgctgcaaaagaactaatggcatatttggtcaaacttcaatcttcccttccagaagttaataagatcataaaaggaatacactcagatgtctcaaatgttgcgaaagctgatgaatttgaatacaaagatcctgttgatggttccatctcaaagcatcagggtattcgatatatgtttgaagatgggtcacgattgattttccgcctctcgggaactggctcagaaggtgcaaccatccgtgtctatattgagcagtatgagaaggattcgtcaaagactgggagggattctcaagaagcccttggtcctcttgtggaggttgctctcaagctttctaagatgcaggaattcacaggccgttctgctcccactgttatcacatagatgcacactgctgctgtacacaacaaaaagattgtaagtttaattattaaggggctattcctggtgtcattttgtaccttctgaggttttgtcaactctatcataccaaattagatacctacataagcggtcattctgtggtctgagcaccgacgaccaaaaaaatgctttgctgattttgttttctgatattcagaataatgttaagagttccccgacttcgctatcaattttgtaatcttcagaataacgaggattgaactcacttggtcctctttgttgggcctctagtctcttataagcattcatttacagtaaaatctcgataaatgaatatttgataaattaataatcttgctaaatgcatgagatgctaa

SEQ ID NO: 7041 - DNA, 2070 bp, Vitis vinifera
actttcactagagctgtacacttgtatcctctcccgtcttgacatctcccaaatcaaagcttcttctgtcatcccctataagggaagcaatggtgatgttcaaggtttctcgagtcacaacttcgccgtttgatggccagaaaccgggaacttctggcctcaggaagaaggtgaaagtattcaagcaacaaaattacttgcacaattttgttcagtcaacattcaatgccctttcacaagacaaaataagaggcatgacacttgttgtttctggtgatggccgctatttctcgaaggatgccattcagattataattaagatggcagctgcaaatggagtgagatctgtctgggttggtcaaaatgggttgctttcaactcctgctgtatcagctgtcatccgtgaaagagtggggaaagatggaaccaaggcatcaggagcatttatactgacagcaagtcacaatccaggtggtcccaacgaggattttggaattaagtacaacatggaaaatggtggacctgctcaagaggcaattactgataagatctatgagaacacaaaatccataaaggagtatataattgcagaagatcttcctgatgtggatatctctgcaataggcattacaaacttcacggggcctgagggacaatttgatgtcgaggtttttgattcagcatttgattatgtgaaattgatgaagtcgatttttgatttccaatctatccaaaagctgctctcatcaccaaaattcacattctgttatgatgcactgcatggagttggtggagcttatgcaaagcgaatatttgttgaagagcttggtgcacaagaaagctcattgctgaactgcgttcccaaggaagactttggaggagggcatccagatcctaatctaacctatgcaaaggagttggttgcatgtatgggattgggtaaatcagatgctaaaaatgagccaccagagtttggtgccgcttctgatggtgatgcagatcgtaacatgatccttggcaaaaggttttttgttactccatcagattctgttgctatcattgctgcaaatgcagttgacgcaataccctatttctctgctggtttaaagggagttgccaggagtatgcccacatctgctgctcttgatgttgtagccaaacatttaaatctgaaattctttgaggtcccaactggctggaaattttttggtaacttaatggatgctggattatgttcaatttgtggtgaagaaagttttggaactggttcggaccacattcgtgagaaagatggaatctgggctgttttagcttggctttctattctcgcttatgaaaataaggaaaaccttggtggagcaaagcttgttactgttgaagaaatagttcgcaatcattgggctacctatggccgccactattatactcgatatgactatgagaatgttgatgcaggtgctgcaaaagaactaatggcatatttggtcaaacttcaatcttcccttccagaagttaataagatcataaaaggaatacactcagatgtctcaaatgttgcgaaagctgatgaatttgaatacaaagatcctgttgatggttccatctcaaagcatcagggtattcgatatatgtttgaagatgggtcacgattgattttccgcctctcgggaactggctcagaaggtgcaaccatccgtgtctatattgagcagtatgagaaggattcgtcaaagactgggagggattctcaagaagcccttggtcctcttgtggaggttgctctcaagctttctaagatgcaggaattcacaggccgttctgctcccactgttatcacatagatgcacactgctgctgtacacaacaaaaagattgtaagtttaattattaaggggctattcctggtgtcattttgtaccttctgaggttttgtcaactctatcataccaaattagatacctacataagcggtcattctgtggtctgagcaccgacgaccaaaaaaatgctttgctgattttgttttctgatattcagaataatgttaagagttccccgacttcgctatca

SEQ ID NO: 7042 - DNA, 2013 bp, Amsonia hubrichtii
ttgaagttggcaaaagaaatggtgttcaaggttgttcgcgtcgaaacaaagccgtttgatggccagaagcctggtacttccggcctccggaagaaggtgaaggtctttacgcaacctcactacttgcaaaattttgtccagtccacttttaatgctcttggagccgacaaagtcagaggtgctacacttgtagtttctggtgatggtcgctattactcaaaagatgcgatccagatcatcatcaaaatgtcagcagcaaatggagtaagacgtgtttgggttggtcaaaacggtctgctatctactcctgctgtatcttgtgttgtacgtgaaagagttggggctgatggatctaaggctactggagcatttatattgacagcaagccacaacccaggtggtccccatgaggattttggaattaaatacaacatggaaaatggaggacctgcaccagaatcagttacaaataagatctatgaaaatactacaactataaaggagtacttaattgcagaagaactgccagatgtggatatcagtaccatagcagtttcaagctttgccggtccagaggggcaatttgatgttgatgttttcgattcaactagtgactatgtgaaattgatgaagtccatttttgatttccagtctatccagaagctgctttcatcttcaaactttactttctgttatgatgcgcttcatggggttgctggtgtttatgctaaacgcatttttgttgaagagcttggtgctcaagaaagttctttgttgaattgtgtacctaaggaggactttggtggtggacatccagatcccaatcttacctatgcaaaggagttagtcgaatgtatgggattggggaagacaaacaatggaaaagagccaccagaatttggtgctgctgctgatggagatgctgaccgcaacatgatccttgggaaaaggttttttgttactccatctgattctgttgctatcatagccgcaaatgcggttgaagccatcccttacttttcgggcggtttgaaaggagttgccaggagcatgcccacatcagctgctcttgatgttgtagctcaacatcttaaactgaaattctttgaggtgcctactggctggaaattctttggtaatttaatggatgccggaatgtgttcagtttgtggtgaagaaagttttggaactggctcggatcatatacgtgagaaagatggtatctgggctgttttggcttggttatctattcttgcctacaaaaataaagatagcttgggtgggggaaagcttgtaagtgttgaagacattgttcgccagcactgggcaacttatggacgccactattatacacgatatgattatgagggtgttgatgctggtggtgcaaaggaattgatggcacatttggtcaagctgcaatcctccttaagtgaagtgaacaagattataaagggtatacgttcagacgttgcaaatgttgtcaatgctgatgagttcgaatataaagatcctgtggacggttccatctctaagaatcagggaattcggtacatgtttgaggatggttcgcgactggtcttccgtctctctggaactggatcagagggtgctactatccgtttgtatattgaacagtatgaaaaggattcgagcaaaattggcagagattctcaagatgcacttgctcctctggttgaagttgctcttaagctttctaagatgcaagagttcactggccgatctgcccccactgttatcacataaatccaaagcttcagttacgtctaattataaaataaaacaataagatgttactcttattatttcgaagagttctgctaatgacttttgttttacttttggtccttttagatttcggcataaagtttggtttcgtgtaaccttctacaatgagcatatgagatgagagtattgcagatggatgattctattatcacattttgtttgaaacaattccagttttgttgttttaactaattcatatgatac

SEQ ID NO: 7043 - DNA, 2023 bp, Cirsium arvense
cacacactctccacaaccatcactcatctctctctttattcatccttcccccaatcttctgatctaatggcgactttcaaggttactcgcgtcgaaacctcgcctatcgaaggccaaaagcctggtacttctggactcaggaagaaggtaaaggtattcatgcaaccacattacttgcacaattttgttcagtccacactcaacgccctttctgcagagaaagttaaaggctctacacttgttgtttcgggtgatggacgatattactcaaaggatgcagtccagataataattaaaatggcagctgcaaatggagtaagacgtgtatgggttggtctaaattcgcttatggcaacacctgctgtatcagcaattgtacgtgaaagagttggcgctgatggatccaaggcaaatggggcatttatattgacagcaagtcacaacccaggtggtcccaatgaggatttcggaattaaatacaatatgggaaatggggggccggcacctgaaggagttactgataaaatctttgagaacactaagacaataaaggagtattttattgcagaaggcctacctgatgtgaacatctcggcagttggcatttcaaacttctcaggtcctgacggtcaatttgacgttgatgtgtttgactcggcagatgactatgtgaaattgttgaagtcaatttttgacttccaatccatcaagaagttggttacatccccgcaatttagtttttgttatgatgcccttagtggagttgctggagcttatgctaaacgtatatttgttgaagagcttggtgcaaaagagagctcgttgttgaactgtgttcccaaggaagattttggtggtggacatcccgatcccaatctaacatacgcgaaagaattggtagcacgaatgggattgggtaagacccctgatagtaacccaccagaatttggtgctgctgcagatggtgatgctgataggaacatgatccttggtaaaaggttctttgttaccccttcggattctgttgctatcattgctgccaatgctgtccaagccataccctacttttcttctggtttaaagggtgttgccaggagtatgccaacatctgctgctcttgatgttgtggccaaacacctgaacttgaagttctttgaggtaccaaccggctggaagttctttggtaacttgatggatgctggactatgctcggtttgtggtgaagagagttttggaactgggtcggaccatattcgtgagaaggatggaatctgggctgtgttggcttggttgtccattctcgcatttaaaaacaaagacagcctcagtggtgggaagcttgtgacagttgaagacattgtaaagcagcactgggctacctttggacgccactattatactcgctacgattatgagaatgttgatgcaggtgctgccaaggacctcatggcacacttggttaagttgcagtcttctataagcgatgttaacaaaacgataaagggaattcgatcggatgtggcaaatgttgccagtgctgatgaatttgaatacaaagatccagttgatggttcggtttctaagaatcagggaatccgctatttattcgaagacgggtcacgtttggtattccgtttatctgggacagggtcggaaggagccacaattcgtctttacattgagcaatatgagaaagattcatccaagactggaagagattctcaggaagcacttggtcctttggtggacgttgctttaaagctgtcgaagatgcaagaattcaccggccgttcagcccctaccgtcatcacttaaatatacacacacatgctgcctttgtccacaacctatgtatttttggtgtttcaatagcaataataaggttagcttttttggtggtgtttgttagtttcaggcatcttgttgaatgctttgatgatttacagagttgtgtttgtcatcaataattcagttgtaatttgagaacctttttaccaacattatacttgtaatttgagtaacc

SEQ ID NO: 7044 - DNA, 1990 bp, Valeriana officinalis
ttcttatctctctacttggaatcaaatctcctctgtataaatcccctacccgctctctgatttctcacagatacacttcctcttatctaccaatggtgatgttcaaggtttctcgtgttgaaaccgctccaatcgatggccagaaaccggggacttctggtctgcgtaagaaggtaaaggtcttcacacaacctcattacttgcataactttgttcaggccacattgaatgccctttcagccgacaaagtcagaggtgctacacttgttgtttctggtgatggccgttactattcaaaggatgctatccagattattataaaaatggcagctgcaaatggagtaaggcgtgtttgggttggtctaaatggattaatgtctacacctgctgtatcagctgttatacgtgaaagagttgggcacgatggatctaaggcaaatggtgcattcatattgacggcaagtcacaaccctgggggtccaaatgaggattttggaattaaatataacatggaaaatggtggtccggctccggaaggaattactgacaagatatatgagaatactacaacaataaaggagtacttccttgcagaagacctaccagatgttgacatctctgcagtcggcgtcacatcttttcagggtcccgaggggcaattcgacgttgatgtttttgactcggctattgaatacgtgaagctaatgaagtcaatatttgacttccagtctatccagaagttactttcgtcgccaaaatttacattttgctacgatgcacttcatggagttgctggtgcttatgctaaacgtatatttgtcgaagagctcggtgcaaaagaaagctcattgttaaattgtgtacccaaggaagattttggtggaggtcatccagatcccaacctgacctatgcaaaggaattagttcagcgtatgggactgggcaagtcagctgaacaggatccaccagaatttggtgcggccgctgatggtgatgctgaccgtaatatggtccttggtaaaaggtttttcgtcactccctctgattctgttgctatcattgccgcaaatgcagttcaagcaatcccatatttctcttctggtttgaagggagttgccaggagtatgcctacgtctgctgcccttgatgttgttgcaaagcatttgaacttgaaattttttgaggtccccactggatggaaattctttggtaacttgatggatgctggaatgtgttcagtttgcggtgaagagagttttggcactggatcggaccacatacgcgagaaagatggaatatgggccgttttggcatggctgtctattattgcttataaaaacaaggccagtctcagctcggacagtaagcttgtgactgttgaagatattgttcgtcagcattgggctaagtatggacgtcattactacacgcgttatgattatgagaatgttgatgcaggtgctgcaaaggaactaatgacaaacttgatccagcagcaatcttccctaggtgaagttaacaaaaccataaagggaatacggtcagatgtttcgaatgttgcaagcgctgatgagtttgaatacaaagatcctgttgacggttcagtctcaaaacaccaaggggttcgatatctgttcgaagatggttcacgactggtattccgtttatctggaactgggtcagagggagctactattcgtctttacatcgaacaattcgagaaggatccttccgggagagagtctcaagatgttcttgcccctcttgtggaggttgctcttaagctgtctaagatgcaagaactcaccggccgatctgcccccaccgtcattacatagatatgtttctatatccacactacaatgtctctgtgtttttctaatatgtaatgtaataaaatcagtgacctcgaatcaggccttttgtcacttgggaaaaatgtggtgtgttaaatacttgggtcgaagttttggtcgttggttccagtaat

SEQ ID NO: 7045 - DNA, 2129 bp, Mimulus guttatus
aaatcacacctgtcaccccctccatcatcttccttccctttctcttggagttttgattaaagatggtgatgttcaaggtttcccgtgtcgagactactccgtttgatgggcagaagcctggaacttctggtcttcggaagaaggttaaggtcttcgtgcaaccccattacttggaaaattttgttcaatccacgtttaatgcccttggagctgataaagtaacaggtgcaactcttgttgtctctggtgatggccgttactattcaaaggatgctatccagatcattattaaaatggctgctgctaatggagtgaggcgtatctgggttggtcagaatggattgctgtctactcctgctgtatctgccgttatacgtgaaagagtaggcgcagatggatccaaggcaactggggcatttattcttacagcaagccacaacccagggggccccactgaggattttggaataaaatataacatggaaaatggtggacctgcaccagaaggaatcacagataagatatactcgaacaccactacgattaaggaatacttgattgcagaaggcctgccagatgtggacatctctatcacaggcgtaactagctttgcgggtcctgaggggcagtttgatgttgatgtttttgattcagcaagtgattatgtcaaattgatgaagtccatttttgatttccaagctatccagaagttaatatcatctccaaaatttagtttctgttatgacgcactccatggagttggtggtgcttatgctaaacctatattcgttgacgagctaggtgcacaagaaagctctttgctgaattgtgtacccaaggaagatttcggtgggggccaccctgatcccaatctgacctatgcaaaagaattagttgctcgcatgggattgggtaagacaagcactgaagagccacctgaattcggtgctgctgctgatggagatgcagaccgtaacatggtccttggcaaaaggtttttcgtcactccctctgattctgttgctataatagctgcgaatgctgtccaatcgatcccttacttttctggtggactaaaaggagttgcaaggagcatgcccacatcagctgctctagatgttgtagccaaaaacctgaatctaaaattctttgaggtgcccactggctggaaattctttggcaacttgatggatgccggaatgtgttctgtttgtggtgaagaaagtttcggaactggctcagaccacattcgtgaaaaagatggaatatgggctgttttggcatggttatccattcttgcctataagaacaaagacaatcttgggggagagaaacttgtcagtgtggaagacattgttcgtcagcattggtccacatacgggcgccattattacactcgatatgattacgagaatgttgatgcagctagtgcaaaggaacttatggcctatctggtcaagctggaatcctccctttctgaagttaacgacattataaagggaatccgttcagatgtgtcaaaggttgtccatgctgatgaatttgagtacaaagatcctgttgacggttccatttcaaagcatcagggcatcagatatctgtttgaagatggatcccgattggttttccgtctttctggaactgggtcggagggtgccaccatccgtctttacatagagcaatacgaacaggatccttcgaagattgggagagagtcgcaagacgcacttgctcctttggttgaggttgcgctgaagctttctaagatgcaagagttcaccggccgatctgctccaaccgttattacataattttgaagttattggtgtgacgatgaaaatgttgacataattttgctccgaaaaaaaataaaaaataaactggggcgaggtgatcttatcatctcttcagctcttgtgtcttgttgtatccattttatggaggtcatattttcagaacactctttctttacttatgtttacttggggcttaatttttaggctcttgagaatgtattaagtattcgccatttgacccacacaaaggtataatatatataacatatggcttgtatcgtattttcggtttattgatgcccactttcttcaaaaatttcttttccttttcat

SEQ ID NO: 7046 - DNA, 2066 bp, Triphysaria pusilla
tctctctaaaacacccgttacccacacccctctcatcttcccgtactcgttagaatttatccgcgtttgagtaaagatggtggtctttaaggttgcgcgcgtggagactacgccatttgatgggcagaaacctggaacttctggtctcaggaagaaggttaaagtattcaagcaaccccattacctggaaaattttgttcaagccacacttaatgcacttggagctgataaagtcagaggtgctacgcttgtggtctctggtgatggccgttactattcaaaggatgccatccagatcattattaaaatggctgctgccaatggagtgagacgcatctgggttggtctgaatggattgatgtctactccagctgtatcagctgttatacgagaaagagtaggcgcagatgggtccaaagcaaatgggtcgtttatacttacagcaagtcacaacccagggggtccaaatgaggactttggaatcaaatacaacatggaaaatggtggacctgcaccagaagggattacagacaagatatatgcaaacacaaccacaattaaggagtacttgattgccgaaggcctgccagatgtggatatctccataacaggcgtaaccaccttttccgggcccgagggccaattcgatgttgacgtctttgattcagcaaatgactatgtgaaattgatgaagtccatttttgattttcaatctatccagaagttaatagcatctccgaaattcagtttctgttacgatgcccttcatggagttgctggggcttatgctaaacgtatatttgttgaggagctgggtgctgatgaaaactctttgctgaactgtgttcccaaggaggattttggtggagggcatcctgatcccaatctgacttacgctaaagaattagttgctcgtatgggattgggtaagacgaactccgcggacgagccaccggaattcggggctgcagccgatggagatgctgaccgcaatatggttcttggcaaaaggttttttgtcacaccatctgattccgttgctatcatagcggcgaatgctgtccaagcaataccttacttttctggtggtttaaaaggagttgcaaggagcatgcccacatcagctgctcttgatgtggttgctaaaaacctgaatctgaaattctttgaggtgccaactggctggaaattctttggcaacttgatggatgctggaatgtgttcggtttgtggtgaagaaagttttggaactggctcagaccacatacgtgagaaagatggaatctgggctgttttagcttggctgtctattcttgcctataagaacaaagacaatcttggaggagataaacttgtcagtgtcgaagacattgtccgccagcattggtccacatatggccgtcactattacactcgatatgattatgagaatgttgatgcaggtaaggcaaaggatttgatggcctatttggtccaactgcaatctaacctttctgaagttaacaacattataaagggtatccgcccagacgtcgcaaaggtcgtcaatgctgatgaatttgagtacaaagatcctgttgatggttccatttcaaaacatcagggtatcagatatctgtttgaagatggctcccgattggttttccgactttctggaactggttcagagggtgcaactattcgtctctacatagaacaatacgaacaagatccgtccaaaatcggaagagattctcaagaagcacttgctcccttggttgaggtagctcttaagctgtctaagatgcaagagtacactggccgatctgctcccaccgttattacatagatgctgcagattgtgctctaaagttacttcaatttttgttgaggaaaataattaatcaatgctgataatctttatcagctcttatgcacttgcgttgcaaatttcggcaaacttttgttttggaaaactgttatgtactttgatattcttactttgtacgagggtccatgaaaagtgtttctggttatatacatcattttgacccataagaacttaatttgatatgggttttatctct

SEQ ID NO: 7047 - DNA, 2079 bp, Ambrosia trifida
gcgctcgctctgcatcgacgtgcggttgctaataacagaataacccacgccacgtgtttcccaatatatcatatctcactctcatcactcactcttcatcttccctaacctttgcattctctctgaaaataataagttatggcgaatttcaccgttaaacgcgtcgatacctcgccaattgaaggacagaagcctggcacatctggactcaggaagaaggttaaagtattcacccaacctcattacttgcataattttgttcaatcgacgttcaacgccctttctgcagagaaagttaaaggttccacacttgttgtgtcgggtgatggacggtactactcaaaggatgcaatccagattataattaaaatggctgctgcaaatggtgttagacgtgtttgggttggccaaaatggacttttatccacacctgctgtatcagcagttgtacgggaacgagttggggctgatggttccaaagcaaatggggcattcatattgacagctagtcacaaccctggcgggcccaatgaggattttggaattaaatacaacatgggaaatggtgggccagcacccgaaggaattactgataaaatctttgagaacacaaaaacaataaaggagtattttattgcagaaggcctacctgatgtggatatctcagcaattggggtttcaaacttttctggtcctgctggtcaatttgatgttgatgtctttgactcagcaagcgactatgtgaaattgatgaagtcaatctttgacttccagtccatcaaaaagttaattgcatctccacaatttagtttctgttttgatgcacttcatggagttggcggagcttatgctaaacgtatgtttgttgaagagcttggtgcaaaggagagctcattgttgaactgtgttcccaaggaagactttggtggtggacatcctgatcctaacctaacctatgcaaaagagttggtagcaagaatgggattgggtagtaaccctgatagtaacccaccagagtttggtgctgctgctgatggtgatgctgataggaacatgatccttggtaaaaggttttttgttacaccttcggattctgtcgccatcattgctgccaatgccgtccaagccataccctacttttcgtctggattgaagggagtggccaggagcatgccaacatctgctgctcttgatgttgtagctaaaagcctcaaccttaagttttttgaggtaccaactggctggaaattctttggtaacttgatggatgctggtttatgttcaatttgtggcgaagaaagttttggaacggggtcggatcatattcgtgaaaaagatggaatctgggctgtgttggcttggttatccattctggcccataaaaacaaggacaacctcgatggcgggaagcttgtgactgttgaagatattgtgaagcaacattgggctacttttggccgccactattatactcgctatgattatgagaacgtcgatgcgggtgctgcaaaggaagtaatgactcacttagtcgaccttcaatcctctatcagtggtgttaacacgaccataaagggaatacgatcagatgtggcagatgtcatcagtgctgatgaatttgaatacaaagatccggttgacggttcagtctctaaaaatcagggaattcgttatttattcgaagacgggtcacgtttggtcttccgtttatctgggactgggtcagaaggtgccacaattcgtctttacattgagcaatatgaaaaagattcatccaaaaccggaagagattctcaagaagcacttgctcctttggttgatgttgcactaaagctgtcaaagatgctagaatataccggacgttctgcgcctactgtgatcacataagtatatatacgtgctgctgctatgatcgacatcgtatgtattatttttgtgtttatagaaataaagtttaacttttcagtggtgcgggttttgcttgttactttcacaggcatcgctttgttgaatgcttgatgatttacaaagttttgttgtgctaataattcagtctggaccttgagaactttttgacaa

SEQ ID NO: 7048 - DNA, 2112 bp, Centaurea maculosa
  misc_feature (37)..(38): n is a, c, g, or t
  misc_feature (968)..(968): n is a, c, g, or t
  misc_feature (1417)..(1419): n is a, c, g, or t
  misc_feature (1513)..(1513): n is a, c, g, or t
  misc_feature (1981)..(1981): n is a, c, g, or t
  misc_feature (2015)..(2015): n is a, c, g, or t
  misc_feature (2020)..(2020): n is a, c, g, or t
gttctacggatcccaataatagagaatatccatctcnnctcaccaaaaagcttatattacactctccacaaccatcactcatctctctcttcttcatcttcatcttcatcttcatcttcatcttcccccaatcttccttctgatccaacgcaaagttatggccactttcaaggtgaatcgcgtcgaaaccacgccaatcgaaggccaaaagcctggcacttctggactcaggaagaaggtaaaagtattcatgcaaccacattacttgcacaattttgttcagtccacactcaatgccctttctgcagagaaagttaaaggctctacacttgttgtttctggtgatggacggtattactcaaaggatgcaatccagataataattaaaatggcagctgccaatggagtaagacgtgtatgggttggtctaaatgggcttatggcaacacctgctgtatcagcaattgtacgtgaaagagttggcgctgatggatccaaggcaaatggggcatttatattgacagcaagtcacaacccaggtggtcccactgaggatttcggaattaaatacaatatgggaaatgggggcccggcacctgaaggagttactgataaaatctttgagaacactaagacaataaaggagtattttatcgcagaaggcctacctgatgtgaatatctcggcagttggcatttcaaacttctcaggtcctgacggtcaatttgacgttgatgtgtttgactcggcagatgactatgtgaaattgttgaagtcaatttttgacttcgaatccatcaagaagttgattgcatccccacaatttagtttttgttatgatgcccttagtggagttgctggagcttatgctaaacgtatatttgttgaagagcttggtgcaaaagagagctcgttgttgaactgtgttcccaaggaagatttcggtggtggacatcctgatcccaatntaacatacgcgaaagaattggtagcacgaatgggattgggtaagacccctgatagtaacccaccagaatttggtgctgctgcagatggtgatgctgataggaacatgatccttggcaaaaggttctttgttaccccttcggattctgttgctatcattgctgccaatgctgtccaagccataccctacttttcttctggtttaaagggtgttgccaggagtatgccaacatctgctgctcttgatgttgtggccaaacacctgaacttgaagttctttgaggtaccgaccggctggaagttctttggaaacttgatggatgctggactatgctcggtttgtggtgaagagagttttggaactgggtcggaccatattcgtgagaaggatggaatctgggctgtgttggcttggttgtccattctcgcatttaaaaacaaagacagcctnnntggtgggaagcttgtgacagttgaagacattgtaaagcagcactgggctacctttggacgccactattatactcgctacgattatgagaatgtngatgcaggtgctgccaaggacctcatggctcacttggttaagttgcagtcttctctaagtgatgttaacaaaacgataaagggaattcgatcagatgtggcaaatgttgccagtgccgatgaatttgaatacaaagatcctgttgatggttcggtttctaagaatcaaggaatccgctatttatttgaagacgggtcacgtttggtattccgtttatctgggacagggtcggaaggagccacaattcgtctttacattgagcaatacgagaaagattcatccaagaccggaagagagtctcaggaagcacttggtcctctggtggaggttgctctaaagctgtcgaagatgcaagaattcactggccgttcagcccctaccgtcatcacttaaatatatacacacatgctgccgttgtccacaacctatgtatttttggtgtttctatagcaataataaaggttaggntttttggtgttgtttgttagtttcaggcatcttntgtcnttgttgaatgcttgatgatttacagagttgtgttgtcataatttgagaacctttttaccaacattatactaaatttacagcctttagtttgg

SEQ ID NO: 7049 - DNA, 2627 bp, Populus trichocarpa
actcaatcgacaataagtatatagcttggagactaaaattttggttttcaaaaagataaagaaaaaaaaaccccgagggaatcggtcttttgcttcactgtcactctcagaaaggttaccagacaccgctccactgttaaccatcgagccagctgaatcataaaggacatggtttcaaacttggaaggttacgtggggagttacgtggggggtttaaattgtccatccacatcgaataatcctcgtcatagatccttcctttctctcaactcttcttttaagcaccagaattttgtagtgcagacgctttctgtttacgtttcgctttcttcttcttattctctctgtaccaaaaaaagaaaaaaatggtgctgttcaatgtttcacgagtggagactacgcctttcgatggccagaaacctggaacttctggccttcgcaagaaggtgaaggtgttcaagcaacctaattatctggagaattttgtccaatcaaccttcaatgcacttactccacaaaaagttagaggtgccacacttgttgtttctggtgatggtcgctatttctcaaaggatgccattcagataattatgaagatggcagctggaaatggagtacgacgtgtctgggttggtcagaacggactgctttcaactcctgctgtgtctgctgtaatacgtgaaagagttggggtagatggatccagagcaacaggagcatttatattgacagcaagtcacaatccaggtggtccaaatgaggattttgggatcaaatataacatggaaaatggtggacctgctcctgagggaataacagatgagatttatgagaacactaaagcaataaaggagtacttaactgcagatctgcctgctgtggatattacagcaattggtgtaaccagctttggtgggcctgatggacagtttgatgttgaggtttttgactcggcaagcgattatgtcaaattgatgaagtcgatttttgactttgagtccatccagaagctcctttcctctccaaatttcactttctgctatgatgcgctacatggagttgctggggcttatgcaaaacgcatttttgtggaggagcttggagcacaagagagttccttaatgaactgtgtacccaaggaggactttggaggagggcatccagatcccaatctcacatatgcaaaggaattggttgctcgcatgggattgggtaaatctaactctgaagttgaaccgccagaatttggtgctgctgctgatggtgatgcagatcgcaatatgatccttggtaaaaggttctttgttactccatcagattctgtttccattattgctgcaaatgcagtggaggccataccatatttctctgcaggtctaaaaggagttgcaaggagcatgccaacttcttctggccttgacattgtggcaaaaaatctaaacttaaagttttttgaggttccaactggatggaaattttttggtaatttgatggatgctggtttatgttcaatctgcggggaagagagttttggaactggctcagaccacatacgcgagaaggatggaatttgggcagttctggcttggctatccatactggcgttcaagaataaagaaaatcttggtggtggagagcttgtaacagttgaagatatagttcgcaaccattgggctacctatggtcgccactactatactcgatatgactacgagaatgttgatgcaggtgcagcaaaggaactaatggcatacttagtcaagctgcaatcttcccttgctgaagttaacgagattgtcggtgggatacgatcagatgtgtcgaaggttgttcatgctgacgagtttgaatacaaagatcctattgatggttctatttcaaaacaccagggtattcgatacttgttcgaggatggctcaagactggttttccgcctctcaggaactggttcagaaggtgcaaccatcaggctctacattgagcaatacgaaaaagatccatcaaaaactggaagagattctcaagatgcacttgctcctcttgtggcagttgctcttggtctttctaagatgcaggaattcactggccgatctgcaccaactgtcattacatagattttcactgctatgcgcagcggtggggactgatcgccttgaacatggaaagtgcatgcttcataagccgtgcttttatgtgatcaaacttttataagaaacccagttaagtataccaaatatgctttacctttttttgccttaccgaagtcaaagttttgacgttcaaaataaataagccaactcttctcatgttatcctacatgtaatatggggattaatgcggaaactggctgtcattgatgtggtgccctgctgttttggagcttgtaagcatgaaagatgcctgttgatgtcttgacctgcggttttcaacacgagtatgcacgcgttacgttctgatttgaaccaagctcgaataaacattttaataatggagacttatcatttaaaaaatagtgataatacaaacttaataattattatttttgttgctggcccgtggtcacgttgcgctccttaagtttctttgatgacgtaagatcacttttcttctaaagctagtttttattc

SEQ ID NO: 7050 - DNA, 1972 bp, Arnica chamissonis
ttacgtatatatcactcatctctctcgataaccatcactcaccttctcaccttattcgccaaccttactctctctgaaaaaagcttaactaatggcgagtttcaaggttaatcgtgtcgaatcctcgccaattgaaggccaaaagcctggcacttctggactcaggaagaaggttaaagtattcacccaaccgcattacttgcaaaattttgttcaatcaacatttaacgccctttctgcagagaaagtgaaaggttctacacttgttgtttcgggtgatggacgttactactcaaaggatgcaatccagattataattaaaatggcagctgcaaatggtgtaagacgagtttgggttggtcaaaatggacttctatccacacctgctgtatcagcagttgtacgtgaacgagttggtgctgatggttccaaagcagatggggcatttattttgacagctagtcacaacccaggtggtcccagtgaggattttggaattaaatacaatatgggaaatggcgggccagcacctgaaggaattactgataaaatctttgagaacacaaaaacaataaaggagtattttattgcagaaggcctacctgaggtggatatctcagcaattgggatttcaaacttttcaggtcctgatggtcaatttgatgttgatgtttttgactcgtcaagtgactatgtgaagttgatgaaatcgatctttgatttccagtccatccaaaagctaattgcatctccacaatttagtttttgttatgatgctcttcatggagttgctggagcttatgctaaatgtatatttgttgaagagcttggtgcaaaagagaactcattattgaactgtgttcctaaggaagacttcggtggtggacatcctgatcccaaccttacctatgcaaaagagttggtagcaagaatgggattgggtaaaaaccctgatagtaacccaccagaatttggggctgctgctgatggtgatgctgataggaacatgatccttggtaaaaggttttttgttacaccatcagattctgttgctatcattgccgccaatgcagtccaatctataccttacttttcatctggattaaagggtgttgccaggagcatgccaacatctgctgctcttgatgttgtagccaaaagtttgaacttaaagttttttgaggtaccaactggctggaaattctttggtaacttgatggatgctggattatgttcagtttgtggtgaagaaagtttcggaacaggatcggaccatatccgcgagaaggatggaatctgggctgtcttggcttggttatctattcttgcttataaaaacaaggacaacctcaacggtgggaaccttgtgactgttgaagacatcgtgaaacagcactgggctacctttggacgccactattatacccgctatgattatgagaatgtcgatgcaggtgctgcaacagaactaatggctcacttggtcaagttgcaatcttctattagtgatgtcaaccaaaccataaaaggaatacgatctgatgtggcaaatattgcaagtgctgatgaatttgagtacaaagatcctgttgatggttcaatctctaagaaccagggaattcgctatttattcgaagacgggtcacgtttggttttccgtttatcagggaccgggtcagaaggtgccacaattcgtctttacatcgagcaatatgaaaaggattcatctaaaaccggaagagattctcaagatgcactcgctcctctggtggaggttgcactaaagctgtcaaagatgcaagaattcacaggtcgttccgcccccactgtgattacataaataaatacacacatgctgctgctgctgctggctgcagtcttgtttgttgaatgtttgatgatttacgaagttttgttgtcgtgaataaatctggttgtatcatgagggcatttaccaacaatatcctgaaat

SEQ ID NO: 7051 - DNA, 2091 bp, Cynara scolymus
  misc_feature (1352)..(1352): n is a, c, g, or t
gcggttcgaatatagaattcccccgccacgttatatctctctctcactcactcactatctctttctctctcgacaaccatcactcatctctcttcatcttcgccaatcggaacaaacgcaagtaatggcgactttcaaggttaatcgtgttgaatcatcccctatcgaaggccaaaagcctggcacttctggactcaggaagaaggtaaaagtattcacacaaccacattacttgcacaattttgttcaatcaacattcaacgccctttctgcagagaaagttaaaggttctacacttgttgtttcgggtgatggacggtacttctcaaaggatgcaatccagataataattaaaatggcagctgcaaatggagtaagacgcgtatgggttggtctaaatgggcttatggcaacacctgctgtatcagcaattgtacgagaaagagttggcgctgatggatccaaggcgaatggggcatttatattgacagccagtcacaacccaggtggtcccaatgaggatttcggaattaaatacaatatgggaaatggggggccggcacctgaaggaattaccgataaaatctttgagaacactaaaacaataaaggagtattttattgcagaaggcctacctgatgtggatatctcggcaattggcatttcaaacttttcgggtcctgacggtcaatttgacgttgatgtgtttgactccgcaagtgactatgtgaaattgttgaagtcaatttttgacttccagttcatccaaaagttggttacatctccgcaatttagtttttgttatgatgcccttagcggagttgctggagcttatgctaaacgtatatttgttgaagagcttggtgcaaaagagagctcattgttgaactgtgttcccaaggaagatttcggtggtggacatcctgatcccaatctaacctacgcgaaagagttggtagcacgaatgggattgggtaagaaccctgacagcaacccgccagaatttggtgctgctgcagatggtgatgctgataggaacatgattcttggtaaaaggttttttgttaccccttcggattctgttgctatcattgctgccaatgcagtccaagccataccctacttttcttctggtttaaagggtgttgccaggagtatgccaacatctgctgctcttgatgttgtggctaaacatctgaacttgaagttttttgaggtaccaacaggctggaaattctttggtaacttgatggatgctggactatgttcagtttgtggtgaagagagttttggaactgggtcggaccatattcgagagaaggatggaatctgggctgtgttggcttggttgnccattcttgcttttaaaaacaaggacagcctcaatggtgggaagcttgtgactgttgaagacattgtaaagcagcactgggctaccttcggacgccactattatactcgctatgattacgagaatgtcgatgcaggtgctgcgaaggaactcatggctcacttggtgaagttgcagtcatctcttggtgaagttaacaaaacaataaagggaattcgatcagatgtggcaaatgttgccaatgctgatgaatttgaatacaaagatcctgttgatggttcagtttctaagaatcagggaattcgctatttatttgaagacgggtcacgtttggtcttccgtttatctgggacagggtcggaaggagccacaattcgtctttacatcgagcaatacgagaaagattcatccaagactggaagagattctcaggaagcacttggtcctctggtggaggttgctctaaagctgtcgaagatgcaagaattcactggccgttctgcccccaccgtcatcacttaaatatatacatgctgcctctgttgtccacaacctatgtatttttggtgtttctataacacaataaggttaggttttttggggttgtttgttagtttcacaggcatctactgtcttgttgaatgctggatgagttgcaaagttatgttgtcatcaataattcagttgtaatttgagaaccttttataacaatataccaatttgcggcctttagtttgata

SEQ ID NO: 7052 - DNA, 2572 bp, Glycine max
ataagcattcattttcatcaactgctaagctaactgaactctctctcgttgttcccttggcctctcgctctataaatacacatcgcatcattctctcacttgcacattgaaatctgaaccttccggatttcgttttgctttgttcaggtagccagccagtcatggtgctcttcaatgtttcacgcgtagagaccactcccttcgatggccagaagcctggaacctctggtctccgcaagaaggtgaaagtgttcgtgcaacctcattacctccataactttgttcagtcaacattcaatgcattaactgtggaaaaagttagaggtgcaacgctagttgtatctggtgatggtcgttatttttcaaaggaagctattcagattataactaaaatgtcagcagcaaatggagtaagacgtgtttggattggtcaaaatggattgctttcaactcctgcagtatctgctgttatacgtgaaagagttggagctgatggatccagggcaacaggtgcatttatactgacagcaagtcacaatcctggtggccctcatgaggattttggaattaaatataatatggaaaacggtggacctgcaccagagggaattactgacaagatatatgaaaacacaacaacaattaatgagtacttgattgcatcagatctgccagatgtggatatcaccacaacaggtgttacaagctttacaggccctgaaggaccatttgatgttgaggtttttgattcagcaagtgattatataaaattgatgaagtcaatttttgattttgaatctatcaggaaactgctgtcatctcctaaattcacattctgttatgatgcactacatggggttggtggagcatatgcaaagagtatatttgtggatgagcttggggcacaagaaagctctttactgaactgtacaccaaaggaagactttggaggaggacacccagaccccaatttgacatatgcaaaagagttggttgctcgtatgggattgggcaaatccgaaccacaagatgatcccccagagtttggtgctgcttctgatggtgatgcagatcgcaacatgatacttggtaaaaggttttttgtcactccttcagattccgtggccattatcgctgcaaatgccgttgaagctataccatacttttctgctggtttaaagggtgttgccaggagcatgccaacctctgctgccctggatgttgtagccaaacatctgaatttgaaattttttgaggtccccacgggttggaagttctttggtaatttaatggatgctggattatgttcagtctgtggtgaagaaagttttgggactggttctgaccatattcgtgagaaagatggaatctgggcagttttggcctggctatctatacttgcatataaaaataaagataaacttgaagacaagcttgtcactgttgaagacatagttcgccagcattgggctacttatgggcgccattattatactcgatatgactatgaaaatgtggatgcaggtgcagcaaaggaactgatggcatatttggtcaagctgcagtcctcactttcagaagtcaatcagattattaaggggataaggtcagatgtttcgaatgttgttcacggtgatgaatttgagtacaatgatcctgtggatggttccatctcatcacatcagggaatccgatatttgtttgaggatggatcacgattgattttccgcctatctggaactggatcagaaggtgcaacaattcgactatacattgagcaatatgagaaggatccatcaaagattgggagactttcaaatgaagcccttgctcctcttgtggaagttgcattgaaactttcgaagatggaagaattcactggtcgatccgctccaacagtcattacatgaacacatacaggtggaaggtggttagatcctgaagtttctcccagtcatttcttctttgttcagtttcttacggatggccgaacactagtgttggttgtttgcagcctttgctatgggcacttgagtggaatttgatcagttactttatcaaaattttgatgtgctgaataagttgcaactgccgagtgctaattctattatatagtcttaatatgatggctcctcttgtattggcgttttattaggagcattctttccttccttttttttttggtccctgcggtgagatttgacttctctcctaaactaactttggaagaagatagatggccaccaccagctgaacaaaggctagccgtttcgttgcaaatatatttttatttttaggtttatgggtcattccagataaattcttgcttatgtgaacacacccccgttatctagcattacgtgctagcattgcagaaagcttttgaagaaaaaataatacattaccaacatcagtccttggaggaggatgtgaaaaaaagtgttggtatttttcaagtgaccaattttaatataatacttagttaagcaaaatagctggataatatttttagtgaagattttttttttgtacttaaacttgatttttcgtgtttaatgaaagatatttgcat

SEQ ID NO: 7053 - DNA, 1991 bp, Ambrosia trifida
agaccagcagcgtaaataattaacgcgaaaatccaccgccacgtctttccctatatcttactcttcttcagacaaccatcactcactttctgtccatattcgcaacttcttctgaaactgatggcgaatttcacggttaatcgtgtcgaaacatcgccgattgaaggccaaaagcctggcacttctggactcaggaagaaggttaaggtgttcacccaaccgcattacttgcataattttgttcaatcgacatttaacgccctttctgcagagagcgttaaaggttctacactcgttgtttcgggtgatggacgctactactcaaaagatgcaatccagattataatcaaaatggcagccgcaaatggtgtaagaagtgtttgggttggtcaaaatggacttttatccacacctgctgtatcagcagttgtacgtgaacgagttggcgccgacggtgccaaagcaaacggggcatttattttgacagctagtcacaacccaggtggccccaatgaggattttggaattaaatacaatatggggaatggtgggccagcgcctgaaggaattactgataaaatctttgagaacactaaaacaataaaggagtattttattgcagaaggcctacctgatgtggatatctcagcaattggaatttcaaacttttcaggtcctgacggtcaatttgacgttgatgtttttgactcgtcaagtgactacgtgaaattgatgaagtcgatctttgatttccagtccatccaaaagctaattacatctccacagtttagtttttgttatgatgcacttcatggagttgctggtgcttatgctaatcgtatatttgttgaagagcttggtgcaaaagagagctcactattaaactgcgttcccaaggaagacttcggtggtggacatcctgatcccaaccttacttatgcaaaagagttggtagcaagaatgggattgggtaaaaaccctgatagtaacccaccagagtttggcgctgctgctgatggtgatgctgataggaacatgatccttggtaaaaggttttttgttacaccatcagattccgttgctatcattgccgccaatgcagtccagtctataccctacttttcatctgggttaaagggtgttgccaggagcatgccgacatctgctgctcttgatgttgtagccaagagtttgaacttaaagtttttcgaggtaccaaccggctggaagttctttggtaacttgatggatgctggattatgttcagtttgtggtgaagaaagttttggaactggatcggaccatatccgtgagaaggatggaatctgggctgtcttggcttggttatccattcttgctcataaaaataaggacaacctcaatggtgggaaccttgtgactgttgaagacattgtgaaacagcactgggctacctttggacgccattactacactcgctatgattatgagaatgtcgatgcaggtgctgcaaaagaactaatggctcacttggtcgagttgcaatcttctattagtgatgttaacaaaatcatcaaggagatacgacctgatgtggcaaatgttgcaagtgctgatgaatttgaatacaaagatcctgtcgacggttcaatctctaagcatcagggcattcgttatttattcgaagacgggtcacgtttggttttccgtttatcagggactgggtcagaaggcgccacaattcgtctttacattgagcaatatgaaaaagattcatccaaaactggaagagattctcaagaagcacttgctcctctggtggaagttgctctaaagctgtcaaagatgcaagaattcaccggtcgctcagcccccatgtaattacataaacataataataaacgcatgccgttgctgctgctgctgctgttactgtctgacaatatggtcttgtttagttagtttaacatgctattcgttcttgtgtgtcttgtaattgtttagattagtaa

SEQ ID NO: 7054 - DNA, 2035 bp, Vinca minor
actcattcgttaactcaactcttctcgaatctcacactcgtcaccctatccttcaactttaaatttcgtccaggaatggtgttcaaagtcgttcgtgtggaaactaagccgttcgatggccagaagcctggtacttccggtcttcgtaagaaggtgaaggtctttacgcaacctcactacttggaaaattttgtccagtccacttttaatgcccttggagctgacaaagtcagaggtgctacacttgtagtttctggtgatggtcgctactactcaaaagatgcgatccagatcatcatcaagatgtcagctgctaatggagtgagacgtgtttgggttggtcaaaatggtctgctatctactcctgctgtatcttgtgttgtacgtgagagggttggggctgatggatctaagggtacaggagcatttatattgacagcaagccacaacccaggtggccctcatgaggattttggaattaaatacaacatggaaaatggaggacctgcaccagaatcagttaccaataagatatatgaaaataccacaactataaaggagtacttaattgcagaaggactgccagatgtggatatctgtaccatagcagtttcagactttgctggtccggaggggcaatttgacgttgacgttttcgattcagctagtgattatttgaaattgatgaagtcaatttttgatttccagtcaatccagaagtttctttcatctccaaactttaccttctgttttgatgcgcttcatggggttgctggagcatatgctaagcgcatttttgttgaagagcttggtgcaaaagaaagttctttgttgaattgcgtacctaaggaagactttggtggtgggcatccggatcccaatcttacgtatgctaaagagttagttcaatgtatgggattgggtaagacagacggtggaaaagagccaccagaatttggtgctgctgctgacggagatgctgaccgcaacatggtccttgggaaaaggttttttgttactccatcggattctgttgctatcatagctgcaaatgcggttgacaccatcccttacttttccagtggtctgaaaggagttgccaggagcatgcccacatcagctgctcttgatgtcgtagctaaacatcttgacctaaaattctttgaggtgcctactgggtggaaattttttggtaatttgatggatgctggaatgtgttcagtttgtggtgaagaaagttttggaactggctcggatcatattcgtgagaaagatggtatttgggctgttttggcttggctatctattctcgcctacaaaaacaaagacaacttgggtggggggaagcttgtaactgttgaagacattgttcgccagcactgggcaacttatggacgccactattatacacgatatgattatgagggtgttgatgcaggtggtgcaaaggaattaatggcacatttggtcaagctgcaatcctccttaagtgaagtgaacaagatgataaaggatattcgtccagatgttgcaaacgttgccagtgctgatgagttcgagtataaagatcctgttgatggttccatctctaagaatcagggaatccgttacatgtttgaggacggttcgcgactggttttccgtctttctggaactggatcagagggtgctactatccgtttgtacattgaacaatacgaaaaagattcgagcaagaccggaagagattcccaagatgcccttgctcctctggttgaagttgctcttaaactctccaagatgcaagagttcactggtcgatcttccccaactgtcatcacataaatcccttctatacggcatctgattgtgtacgccttactataaaataattcagcacgatattactcttgtattatcccgaaagagttatgctaatagcttttgttacttaataacccttttagatttcggtataaaaactttggtttcatgtacctttctacaatgagcaccaaagctgagagtatagcagatgtatgatcttattattgag

SEQ ID NO: 7055 - DNA, 2053 bp, Vinca minor
gtatatatgtattggtggattgaatttcatatatataacaattgagctactgatttgcagttaaaagtttcgtcccataaatggtgttcaaggtcgttcgtgtcgaaactaagccgtttgatggccagaagcctggtacttccggtcttcgtaagaaggtgaaggtctttacacaacctcactacttggaaaattttgtccagtccacttttaatgcccttggagctgacaaagtcagaggtgctacacttgtagtttctggtgatggtcgctactactcgaaagatgcgatccagatcatcatcaagatgtcagccgctaatggagtgagacgtgtttgggttggtcaaaacgggctgctatctactccagctgtatcttgtgttgtacgtgagagagtgggggctgatggatctaaggctacaggagcatttatattgacagcaagccacaacccaggtggccctaatgaggattttggaattaaatacaacatggaaaatggaggacctgcaccagaatctgttacaaataagatctatgaaaatactacaactataaatgagtacttaattgcagaaggactgccagatgtggatatcagtaccatagcagtttcaaactttgctggtccagaggggcaatttgatgttgatgttttcgattcagctaatgattatttgaagttgatgaagtcaattttttatttccagtcgatccagaagttgctttcatctccaaactttaccttctgttatgatgctcttcatggggttgctggagcgtatgctaaacgcatttttgttgaagagcttggtgcaaaagaaagttctttgttgaattgtgtacctaaggaggactttggcggtgggcatccggatcccaatcttacctatgcaaaagagttagttgaatgtatgggattgggcaagacatacagtggaaaagagccaccagaatttggtgctgctgctgacggagatgctgaccgcaacatggtccttgggaaaaggttttttgttactccatcggattctgttgctatcatagctgcaaatgcggttgaagccatcccttacttttccagtggtctgaaaggagttgccaggagcatgcccacatcagctgctctggatgtcgtagctaaaaatcttgacctgaaattctttgaggtgcctactgggtggaaattttttggtaatttgatggatgctggaatgtgttcagtttgtggtgaagaaagttttggaactggctcggatcatatacgggagaaagatggtatttgggctgttttggcttggctatcaattcttgcctacaaaaacaaggacaacttgggtggggggaagctggtaactgttgaagaaattgttcgtcagcactgggcaacttatggacgccactattatacacgatatgattatgagggtgttgatgcaggtggcgcaaaggaattgatggtgcatttggtcaagctacaatcctccttaagtgaagtgaacaagatgataaaggatgttcgtccagatgttgcaaatgttgccactgctgatgagttcgaatataaagatcctgttgatggttccatctccaagaatcagggaattcggtacatgtttgaggacggttcacgactggtcttccgtctctctggaactggatcagagggtgctactattcgtgtgtacattgaacaatatgaaaaagattcgagcaagattggcagagattctcaagatgcccttgctcctctggttgaagttgctcttaaactctctaagatgcaagaattcactggccgatctgccccaactgtcatcacataaatcctgctatgtcgcatctaattgtgtacaccttactataaaacaattcagcatgatattgctcttataatatcccaaaagagttctgctaataactttttgtttacttaatagcccttttagatttcggtataaaaacttcagtttcttgtaactttctacaataagcacagaaggtgagagtataggagatttatgatcttattattgagctttttgaatcg

SEQ ID NO: 7056 - DNA, 2217 bp, Lactuca sativa
ataatcgaatatcctccccaccaagtttttccgtatatctctcgacacaaccatcactcactcttcgccaaccttactctttctgaaacactcaactaatggcgactttcaaggttaagcgtgtcgaatcttcgccaattgaaggccaaaagcctggcacttctggactcaggaagaaggtaaaagttttcacacaaccgcattacttgcataattttgttcaatcaacattcaacgccctttctgcagaaaaaattaaaggttctacacttgttgtatcaggtgatggacgatactactcaaaggatgctatccagataataattaaaatggcagctgcaaatggtgcaagacgtatctgggttggtcaaaatggtcttttgtcaacacctgctgtatcagcagttgtacgtgaaagagttggtgctgatggttctaaagcaaatggagcatttattttgacagccagtcacaacccaggtggccccaatgaggattttggaattaaatacaatatggaaaatggtgggccagcacctgaaggagttactgataaaatctttgagaacactaaaacaataaaggagtattttattgctgaaggcttacctgatgttgatatctctgcaattggcgtttcctccttttcaggccctgatggccaattcgatgttgatgtttttgatgcagcaagtgactacgtgaaattgatgaagtcaatctttgacttccaggcaatccaaaagttgattgcatgcccacaattctctttttgttatgatgcgcttcatggagttgctggagcttatgctagtcgtatatttgttgaagagcttggtgcaaaagagagctcattgttaaactgtgtccctaaggaagattttggtggtggacatcctgaccccaatctaacatacgcgaaagagttggtagcacgaatgggattgggcaaaacccctgatagcaaccctcctgaatttggtgcagctgcagatggtgatgctgatagaaacatggtccttggtaaaaggtttttcgttaccccttccgattccgtcgccatcattgctgccaatgcagtccaatccattccctacttttcttccggtttaaagggcgttgccaggagcatgccaacatctgctgctcttgatgttgtagcaaaaagtctcaacttaaagttttttgaagtcccaaccggatggaaattctttggtaacttgatggatgctggactatgctctgtttgtggtgaagaaagtttcggaactggatcagaccatatacgtgaaaaggacggaatctgggctgttttagcttggatgtcgattcttgcttataaaaacaaagacaatctcactagtggaaagcttgtcactgttgaagacattgtgaagcaacactgggccaaattcggacgccattattacacacgatacgattacgagaatgtggatgcaggtgctgctaaagaactaatggcccacttggtcaaattacagtcttctcttggtgaagtcaacaaattgataaagggagtacgatctgatgtggcgaatgttgcaagtgctgacgaattcgaatacaaagatcctgttgatggttcggtttctaagaatcaaggaattcgttatttgtttgaagacgggtcacgtttggttttccgtttatctggaacaggatctgaaggtgcgacaattcgtctgtacatcgaacaatacgaaaaggattcatcaaagactggaagagattcacaggaagcactttctcctttggtggaggttgcattgaagctgtcaaaaatgcaagaattcacaggacgtgatgcccctactgtgattacataaatatatatattcatacacacatcacatgacatgaatgacaaggttcgtgtccacagcacaacacaacccaacctatatatgtatttttcgtcttctttcttatagtaataaagttagggtttcagtggtatgttatgggcttgttttgtttttctagttttacaagtcagaggtatgggtgttgtgttgttgagtgctttaatgatttacagtgtattgttttgttttgttgtggttaataatcgtgttgtatgctgagaacctttctttctttaccacaatctctcagttttacagcttctttaatttcataaaaaaaaatcatgtacataaataaaaattcaactctaccaggaacgttataatgtgg

SEQ ID NO: 7057 - DNA, 2387 bp, Prunus persica
attcgcacaaacatcatccgatctcatattcctccccctctcccacctcccggtctcccatcttttacgtgtatcactcactcacttctcttccgcaaagcaaaattaaaaatagcgtaaatcctacaacgttgccacctttcatttcactataaatcactctctaaactcgatctccaacctctgagcctcgccttgtatctctccctttgtctttgctttgcgtgctccgatttgaatcgcggtttgttctcgggaagcaaaaatgcagtcgggccaggttaagcgggtcgagaccacgcctttcgaaggccaaaagcctggaacctctggtctccgcaagaaggtgaaagtttttacgcaaccccattacttgcaaaattttgttcagtcaacattcaatgcccttccagcagataaagttaaaggcgctagaattgttgtatctggtgatggtcgctattattcaaaggaagctattcagatcataattaagatggcagcaggcaatggagtaagaagtgtttgggttggtcaaaatgggttgctttcaactcctgctgtatcagctgtcgtacgtgaaagagttggtgctgatggatcaaaggcatcaggagcatttatactgacagcaagtcacaatccaggtggcccaaatgaggattttgggattaaatacaacatggaaaatggtggacctgctccagagtcgatcactgacaaaatatatgagaacacgacaaaaataaaggagtatttgacggtcgagctacctgatgtggatatcgctaaagtaggtgtaaccaccttttcagtggatggaggaacttttgatgttgatgtttttgattcagcgagtgattatgtgaagttgatgaaatcaatctttgattttgagtttatccggaagctgctatcgtctccaaaattcacattctgttatgacgcgctacatggagttgctggagcttatgcaaaacgtatttttgtggaagagcttggtgcaaaagaaagctcattattaaactgtgtacccaaggaagactttggaggagggcatccagatcctaatctcacctatgcaaaggagttggttgcgcgaatgggattgggtaaatcaactactcaagatgagcccccagaatttggtgctgctgctgatggtgatgcagatcgtaacatgatcctcggtaaaaggtttttcgttaccccatcggattctgtagccatcattgctgcaaatgcagttgaagccataccttacttctctgctggtctgaagggagttgccaggagcatgcctacctctgctgcccttgatgttgtagcccaacatttaaatttgaaattttttgaggtacccactggctggaaattttttggtaatttgatggatgctgggttatgttcagtttgtggggaagaaagttttggaacaggttcggatcatatacgtgagaaagatggtatctgggcagttttagcttggttatctatacttgcttataaaaataaggaaaatcttggtggggagaagcttgtcagtgttgaagacatagttcgtcagcattgggctacctttggtcgccattattatactcgatatgattatgagaatgtggatgcaggtgcagcaaaggaactgatggcatctttggtgaaattgcaatcttccctttctgaagtcaatcagattgtgaagggcatacgttcagatgtctccagtgttgtcaacgctgatgaatttgaatacaaggatcctgttgatggctccatatcaaaacaccagggcattcggtacttgtttgaggatggatcacgattggttttccgcctctcaggcactggctcagaaggtgccacaatccgactatacattgagcagtacgagaaggatccatcaaaaattggcagagaatctcaagaagcacttggtcctcttgtggaggttgctcttaagctttccaagatgcaagaattcactggtcgatctgcccctactgttattacatagatgcacatctctaaaattttaaaaaaagtgacatggtgcttcgttttgaatatgaaaaaggactggctgggtttcttcaaatgtattagtaataagaacccttttttgtaatttggtggtctgcttatgactacggaagtaagccggtagcaagatttttgacttttcaaaataaatgtgtgctgctggcaaatgagagtgttgttgacaagtaaaactactcgctgatataatttttgacttttcaaaataaatgtgaattttaaattatactctgcgttcgtgtccattctcgtgaacttcttcaactaatttgtaatttactttgtggtttagagcttatttagcttataatggttggcacaaattttat

SEQ ID NO: 7058 - DNA, 2281 bp, Glycine max
gcataaaattcctcgtcgcacaaatgtcatccatcccaaaagcattcatcaataaactgctaagctaactgaactctccctctctccttcctcgttcctttcgcctctcactacaaatacacatctcatctcatccgtctctcacttttaatttttctctgcaatctgaaccttccggatttcgtttttctttgttccggtagccagccagccagccatggtgctcttcaatgtttcacgcgttgagaccactcccttcgatggacagaagcctggaacctctggtctccgcaagaaggtgaaagtattcgtgcaacctcattacctccataactttgttcagtcaacattcaatgcattaactgtggaaaaagttagaggtgcaacgctagttgtatctggtgatggtcgttatttttcaaaggaagctattcagattataactaaaatgtcagcagcaaatggagtaagacgtgtttggattggtcaaaatggattactttccactcctgcagtatctgctgttatacgtgaaaaacttggagctgatggatccagggcaacaggtgcatttatactgacagcaagtcacaatcccggtggccctaatgaggattttgggattaaatataatatggaaaacggtggacctgcaccagagggaattactgacaagatatatgaaaacacaacaacaattaatgagtacttgattgcttcagatctgccagatgtggatattacctcaacaggtgttacaagctttacaggccccggaggaccatttgatgttgaggtttttgattcagcaagtgattatataaaattgatgaagtcaatttttgattttgaatctatcaggaaactgctgtcatctcctaaattcacattctgttatgatgcactacatggggttggtggagcatatgcaaagagtatttttgtggatgagcttggagcacaagaaagctctttactgaactgtacaccaaaggaagacttcggaggaggacacccagaccccaatttgacatatgcaaaagagttggttgctcgtatgggattgggcaaatccgaaccccaagaagagcccccagagtttggtgctgcttctgatggtgatgcagatcgcaacatggttcttggtaaaaggttttttgtcactccttcagattccgtggccattatcgctgcaaatgctgttgaagctataccatacttttctgctggtttaaagggtgttgccaggagcatgccaacctctgctgccctggatgttgttgccaaacatctgaatttgaaattttttgaggtccccacgggttggaagttctttggtaatttaatggatgctggattatgttcagtctgtggtgaagaaagttttgggactggttctgaccatattcgtgagaaagatggaatctgggcagttttggcctggctatctatacttgcatataaaaataaagataaacttgaagacaagcttgtcactgttgaagacatagttcgccagcattgggctacttatgggcgccattattatactcgatatgactatgaaaacgtggatgcaggtgcagcaaaggaactgatggcatatttggtcaagctgcagtcctcactttcagaagtcaatcagattgttaaggggataaggtcagatgtttcgaatgttgtccacggtgatgaatttgagtacaatgatcctgtggatggttccatctcatcacatcagggaatccgatatttgtttgaggatggatcacgattgattttccgcctatctggaactggatcagaaggtgcaacaattcgattatacattgagcaatatgagaaggatccatcaaagattgggagactttcaaacgaagcacttgctcctcttgtggaagttgcgttgaaactttcgaagatggaagaattcactggtcgatccgctccaacagtcattacatgaacacattcaagtggaaggtggttagatcctgaagcttctcccagtcatttcatttcttctttgtccagtatcttacggatagccgaacagtagatttggttgtttgcagcctttgctatgggaaattgagtggaatttgagtttctttatctaaattttgatatgctgaataatttgcaacagccgagtgctaattatatagtcttaatataatggtttctcttgtattggctttttatttttaggtttatagatctggatacaaacatagtgcatttttataaagtaattgaattataaatagtttagaactct

SEQ ID NO: 7059 - DNA, 2513 bp, Vigna unguiculata
ggagcacactttctctttaatctcaaccttctggatttccttttcctttcttcaggtaaccgtccatggtgctcttcaacgtttcacgcgtggacaccactcccttcgatggccagaagcctggaacctctggtctccgcaagaaggtgaaagtatttgttcagcctcattacctccataactttgttcaggcatcgttcaatgcattaactgaggaaaaagtcagaggtgcaacactagttgtatccggtgatggtcgttatttttcaaaggaagccattcagattataactaaaatgtcagcagcaaatggtgtaagacgtgtttggattggtcaaaatggattgctttcaactcctgctgtgtctgctgtcatacgtgaaagagttggagctgatggatccaaggcaacaggtgcatttatactgacagcaagtcacaatcccggtggtcctgatgaggattttggtattaaatataatatggaaaacggtggacctgcaccagagggaattactaacaagatatatgaattcactacaacaattaaggagtacctgattgctgcagatcttccagatgtggacatcaccacaacaggcgttacaaactttacaggccctgaaggaccatttgacgttgaggtttttgattcagcaagtgattatataaaattgatgaagtcaatttttgattttgaatctatcaagaaactgctgtcctctcctaagttcacattctgttatgatgcacttcatggggttgctggagcatatgcaaagagtatttttgtggatgaacttggagcacaagaaagctctttactgaactgtacacctaaggaagactttggaggaggacacccagaccccaatttgacttatgcgaaagagttggttgctcgtatgggattgggcaaatccgaaccacaagatgagcccccagagtttggtgctgctgctgatggtgatgcagatcgcaacatggtacttggtaaaaggttttttgtcactccttcagattccgtggccattattgctgcaaatgctgttgacgctataccatacttctctactggtttaaagggtgttgccaggagcatgccaacctctgctgccctggatgttgtagccaaacatctgaatttgaaattttttgaggtcccaacaggttggaagttctttggtaatttaatggatgctggattatgttcagtctgtggtgaagaaagttttgggactggttctgaccatattcgtgagaaagatggaatctgggcagttctggcctggctatctatacttgcctataaaaataaagataaacttgaagacaagcttgtcactgttgaagacatagttcgccagcattgggctacttatgggcgtcattattatactcgatatgactacgaaaacgtggatgcaggtgcagccaaggaactgatggcttatttggtcaagctgcagtcctcgctttcagaagtcaacgagattatcaatggggtgaggtcagatgtttcgaaggtttccaacgctgatgaatttgagtacaaagatcctgtggatggttccgtctcatcacatcagggaatccgatatttatttgaggatggatcgcgattgattttccgtctgtctggaactggatcagaaggtgctactattcgactatacattgagcaatacgaaaaggatccatcaaaaattgggagactttcaaatgaggcgcttgctcctcttgtggaagttgcattgaaactttcaaaaatggaggaattcactggtcgatctgcaccaactgtgattacatgaacgcataaaagtggaaggtggttagatccgaagcctctcagaatgtgatttcttttttgttgttgagtttctatccagtgttacggatagccgacctgtaccttgggttgtttgaagcctttgctatgggcacttgagtggagtttgaattactttatctaaattttgatgtgctgaataatttgcaactgctgagtgctaattatagtcttaatataatggttcctcttggggggggcagtcccttcttctttaggttcccctgccgtcatatttgacttctctcctaaactttggaagaactggcagaacaaacaacggctagctgtttcgttgcaaatgtcttgtgtacggcttcatgggccattttagataatttttcctttgtgaatctattgtcatttcctatcatttagcctaagtattttctttagaaaataaatacgctcccaacaacagtcatttgaggaggacgtcaaaaaggttgagatttttcaagtgaagtatagcaatttctggtgaaaaagtgttgcaaaaagaaatccgtagaatgaaagaatggtggccagagttttatggggtaaagcaagaataccctttacgggctctttcttcctgcacctccacaaaacccttaatcccattctggctccattgggtgaagaagaaagttcatgaaagggatgcccggaattggaa

SEQ ID NO: 7060 - DNA, 2049 bp, Medicago truncatula
aaacacaatctcaaatcatttttcttacggaacctctcactcactcactcactcgtaatcaatcaaccatggtgctcttcaatgtctcccgtattgaaactactcctttcgatggacagaagcctggaacctctggtctccgcaaaaaggtgaaagtctttgtgcaaactcattaccttgaaaactttgttcaggcatcattcaatgcactaactgaagaaaaagttagaggtgcaacactagttgtatctggtgatggtcgttattactcggagcaagcaattcaggttataactaaaatggctgcagcaaatggagttagacgtatttgggttggtctaaatgggttgctttcaactcctgcagtatctgctgttatacgtgaaagagttggggttgatggatccaaggcaacaggagcatttatactgacagcaagtcacaaccctggcggtcctaatgaggattttgggattaaatataacatggaaaatggtggacctgcaccagagggaattaccaacaaaatatatgaatacacaacaacaatcaaggagtacttgattgctccagatctgccaaatgtggatatcaccacagtaggtgtcacaaactttacagggcctgaaggaccatttgacgttgaggtttttgattcagcaagcgattatataaagttgatgaagtcaatttttgactttggatctatcaggaaactgctgtcatctcctaaattcacattctgttttgatgggttacatggagttgctggagcttatgcaaagcgtatttttgtggatgaacttggagcacaagaaagctctttgctgaactgtgtaccaaaggaagactttggtgggggacacccagaccccaatttgacatatgcaaaagaattggttgctcgtatggggttgggaaaatcagaatcagaaggtgagcccccggagtttggtgctgctgctgatggtgatgcagatcgcaacatgatacttggtaaaaggttttttgtcactccttcggattctgtggccattatcgctgcaaatgctgttgaagcaataccatacttttctgctggcttaaagggagttgccaggagcatgccaacctccgctgccctggatgttgtagccaaacatctgaatttgaaattttttgaggtccccacaggttggaagttctttggtaatttaatggatgctggattgtgttcagtttgcggtgaagaaagttttgggacaggttcggatcacattcgtgagaaggatggaatctgggcagttttggcctggctatctatacttgcatataaaaataaagataatattgaagacaagcttgtaacagttgaagacatagttcgccagcattgggctaagtatgggcgccactattatactcgatatgactacgaaaatgtggatgcaggtgcagcaaaggaattgatggcacatttagtcaaactgcagtcctcactttcagaagccaatgggattgttaagggggcaagttcagatgtttcaaatgttgtccacggcgatgaatttgaatacaatgatcctgtggatggttccatttcatcacatcagggcatccgatatttgtttgaggatggatcccgattgattttccgcctctctggaactggatcagaaggtgcaactattagactatacattgagcaatatgagaagaatccatcaaagatcgggagactttcacatgaagcacttgctcctcttgtggaggctgcattgaaactttcaaagatggaagagttcaccggtcgatctgctcccacagtcatcacataaatacattacttccgaaaccaagtcatttcttattgttaaatcttcatccaatgttaattttgagtagcctacctgtactgttggttgttttcggcccctatatataggcacttgagtggaatttgtattacttaactaaattttgatgtgataaataatttgaaactgctgagttctgatattatatatatatatgcactcttaatataatgtctccacttttgctggcttt

SEQ ID NO: 7061 - DNA, 3199 bp, Cirsium arvense
aaggttaatcgtgtcgaatcctcgccaatcgaaggccaaaagcctggcacttctggactcaggaagaaggtaaaagtattcatgcaaccacattacttgcacaattttgttcaatcgacattcaacgccctttctgcagagaaagttaaaggttctacgcttgttgtttcgggtgatggacgatacttctcaaaggatgcaatccagataattattaaaatggcagctgcaaatggagtaagacgcatatgggttggtttaaatgggcttatggcaacacctgctgtatcagcaattgtacgtgaaagagttggagctgatggatccaaagcgaatggggcatttatattgacagccagtcacaacccaggtggtcccactgaggatttcggaattaaatacaatatgggaaatggggggccggcacctgaaggaattactgataaaatctttgagaacactaagacaataaaggagtattttattgcagaaggcctacctgatgtgaatatctcggcaattggcatttcaaacttttcaggtcctgacggtcaatttgacgttgatgtgtttgactcggcaattgactatgtcaaattgttgaagtcaatttttgacttccagtccatccaaaagttgattacatctccacaatttagtttttgttacgatgcccttagcggagttgctggagcttatgctaaacgtatatttgttgaagagcttggtgcaaaagagagctcattgttgaactgtgttcccaaggaagatttcggtggtggacatcctgatcccaatctaacctatgcgaaagagttggtagcacgaatgggattgggtaagacccctgatagtaacccaccagaatttggtgctgctgcagacggtgatgctgataggaacatgatccttggtaaaaggttttttgttaccccttcggattctgttgctatcattgctgccaatgccgtccaagccattccctacttttcttctggtttaaagggtgttgccaggagcatgccaacatctgctgctcttgatgttgtggctaaacatctgaacttgaagttttttgaggtaccaaccggctggaaattctttggtaacttgatggatgctggactatgttcagtttgtggtgaagagagttttggaactgggtcggaccatattcgtgagaaggatggaatttgggctgtattggcttggttgtccattcttgcttttaaaaacaaggacagtctgaatggtgggaagcttgtgacagttgaagacattgtgaagcagcactgggctacattcggccgccactattatactcgctatgattatgagaatgtggatgcaggtgctgcaaaggacctcatggctcacttggtgaagttacagtctaatcttagtgaagttaataaaacaataaagggaattcgatcagatgtggcaaatgttgccagtgctgatgaatttgaatacaaagatcctgttgatggttcagtttctaagaatcagggaattcgctatttatttgaagacgggtcacgtttggttttccgtttatctgggacagggtcagaaggagccacaattcgtctttacatcgagcaatacgagaaagatccatccaagactggaagagattctcaggaagcacttggtcctctggtggaggttgctctaaagctatcgaagatgcaagaattcactggtcgttctgcccccaccgtcatcacttaaatatatacatacatacatgctactgctgctgttgttgacaagctatgcatttttggtgtttctataacaaaataaggttaggttttttggggttgtttgttaaggcatcttctgtcttgttgaatgcttgatgattgtgttgtcgtcaataattcagttgtaatttgagaaactatttccgaacaaaaaagaaaaaagtaccgactgcgactctagattttgaaaatctagagtcgacttagttatttaaaaagcaaggaaatcacaacaacagcagcactagtagcaacagcaataacaagtaccaaaatataattcgaagaatatgatagaggacaattgtagaccagccatttgagatgaaaccattgacatcaatctgaataagcttcgatgatggattcaattgcaggaatcttgatgacattgtaacgataaaagccggcttctttcaatatcttcttccattcaacttcagtcctttcttttccagtttcgtataatgggagcatcataagatcgtgagcaatacgtgtatcgtcaaatgcatcatctcctccatgattcaagatgatatccactataataacttttcctgtttttgcaggtatggaatcccgacaatttttaagtaactgaatacactcagcatcgccccagttatgcagaattgacttcatgaagattgaatctccaggggggatggctttaaacatgtcacctccaacatggacaattctttcatatgttggtgcagtggaaataacttgaggcaggtcataattaatacctttaagatgtggatatgcagtgacaatttcatttatggcagccccaagaccaccaccaacatcaaccaaagttcctttcaactcctcaaatccatacttggacatgagtgcatccatagtaattcttgttctgcatgccattccttcattgaagatcttgttagtttgagggttggcagaaaggaaactccaaaagtcgagtccaaaagtcttcatggtcgctgtacccccttctgcaatggatttacttaggttatccaaaagcaaacgtagagacgtgtctgtaaccaccattaccaaaggtgcaatggtggtcttgggatcttgtaggagccatttagaacaagggttcaggctgtaaagtggttccttggtctgtggttgatgcacttgatcgaatatttgtctatcaaccaaaaacgccatgagtcgtgaaagaccatcaacatttagtgatggagagttgatcccctcagcgagttgagccaaggtaacagggccatcgtgattgtttattatgtctgcaatgtggagctctaacgcacatcggatagcaacaacatctaaactagcatacatatggtgcaaacactttgcaagacctcgggacgttgcatcatgttcttctttcataaatgcactcatttctctatgaaagcaagctataaaaa

SEQ ID NO: 7062 - DNA, 2301 bp, Eucalyptus grandis
gctcccctccgttcccattcaccttcgcgtcatcaacatcccttccctcccatctgacagtcgctcgccgatccgtttctccgcgcacgcagccgcatcgccatcgccattcgcgtagacgttctccgtggcttgctcgggtgaatcgccggcgaccaggcggggcgaaacatggtgacgttcacggtgtccagggtggaaaccgcgcccatcgatggccagaagcccggcacttccggcctccgtaagaaggtgaaagtgttcgtgcaacctcattacttgcaaaattttgttcagtcaacgttctacgccctttctgctgaaaaagttagaggagccacacttgttgtttctggagatggtcgctattattctaaagatgcaattcagatcatactgaagatggcagctgccaatggagtaagacgtgtttgggttggtcagaatggtttgctatcaactcctgccgtatcagcagtaattcgtgagagaactgggcatgatggagctagggcatcaggtgcatttattctgacagcaagccacaatccaggaggtccccatgaggattttgggatcaagtataacatggaaaatggtggacctgctcctgagggtattactgataagatctatgagaataccaaaactataaaggaatatttaatagcggaagaccttcctaatgttgacattactactttgggtgtcacaagcttcactggacctgaagagccgtttgatgttgaagtctttgattcagctgtggattatgtaaaactgatgaagtcaatatttgatttccagttgattagcaaattgctttcatgtccgaaattctccttctgctatgatgcactacatggagttgctggagcttatgctaagcgtatatttgtggaagagcttggtgctaatgagggctttctgcttaactgcacacctaaggaggacttcggaggagggcatccagatcctaatttaacctatgcaaaggagttggtagcacggatgggtttgggaaagtcagctcctgaaaatgaaccacccgagtttggtgctgctgctgatggagatgcagatcgcaatatgatccttggtaaaaggttctttgttactccatcagattctgttgctatcattgcagcaaatgctgttgaagccataccctacttttctggcggtctcaagggagttgccaggagcatgcctacatcagctgcccttgatgtggttgctcaacatctaaatctgaagttttttgaggtgcctacagggtggaaattctttggtaacttgatggatgctggattatgctcggtttgtggagaggaaagttttggaactggctctgatcatattcgtgagaaagatgggatatgggctgtgcttgcttggttatctattctcgcttacaaaaataaggagaacttaagtggagaaaagcttgtatctgttgaggacattgtccgtcagcattgggtgacatatggtcgtcattattataccagatatgattatgagaatgttgattcaggagcagcaaaggaactgatgggatacttggtccaactgcaatcttctctctctgaagtcaaccagattgtcaagggggtttgtcctgatgcatcaaatgttgttcatgctgatgaatttgaatataaggatcctgttgatggttccatttctaagcaccagggtattcgatatttattcgaagatgggtcacgacttgtttttcgcctctcgggaacaggctcggaaggtgcaaccattcgtctttacatagagcagtatgagaaggatccagcaaaaactgggagagattctcaggaagcattggctcctcttgtggaagttgctctcaagctttcaaaaatgcaggaatttactgggcgatctgccccaaccgtgatcacatagatcccgctttcgccacagtaagatttttaccgacccctcatgtaaacagttttgcgagcatggtgcaccttcagagtgtatggtttttcattcacgagtctttttgcacttgcctatttggcctgcggcattgtccggctatgaaatgcgacataattctggtgtcagaataaaatgactctggcaataatccagctgatgcaacctgatcggtatgtaaaatcaagatgtggattgcttcaatatgtgcgtacttctattaacgtcctgatctggttttcatcgtgcttttgagggttctgttgtccctagtatttgcttcctaaactcacggttacttcactttgcaaaactaaagttagtcgttggaaacaaaaa

SEQ ID NO: 7063 - DNA, 1847 bp, Flaveria ramosissima
gcgtcgaatcatcgccgattgaaggccaaaagcctggcacatctggactcaggaagaaggttaaagtattcacccaaccacattacttgcataattttgttcaatcgacgttcaacgccctttctgccgagaaagttaaaggttctacgcttgttgtttctggtgatgggcggtactactcaaaggaggcaatccagattataattaaaatggcagctgcaaatggtgtaaggcgcgtttgggttggccagaatggacttttatccacgcctgctgtatcagcagttgtacgtgaacgagttggcgctgatggttccaaagcaaatggggcattcatattgacagctagtcacaaccctggtgggcccaacgaggattttggaataaaatacaatatggagaatggtgggccagcacctgaaggaattactgataaaatctttgagaacactaaaacaataaatgagtattttatcgcagaagacctacctgatgtggatatctcagcagttggaatttcaaacttttcaggccctgatggtcagtttgatgttgatgtttttgactcagcaagcgactacgtgaaattgatgaagtcaatctttgacttccagtccatccaaaggttaattgcatctccacaatttagtttctgttatgatgcattgcatggagttgctggagcttatgctagacgtatatttgttgaagagcttggtgcaaaagagagctcattattgaactgtgttcccaaggaggactttggtggaggacatcctgatcccaacctaacctatgcaaaagagttggtagcaagaatgggattgggtaaaaaccctgatagcaacccaccagaatttggtgctgctgctgatggtgatgctgataggaacatgattcttggtaaaaggttttttgttacaccttcagattctgtcgctatcattgctgccaatgcagtccaagccataccctacttttcatctggattaaagggtgttgccaggagcatgccaacatctgctgctctcgatgttgtagctaaaagtctgaaccttaagttttttgaggtgccaactggctggaaattcttcggtaacttgatggatgcgggattatgttcagtttgtggtgaagaaagttttggaactgggtcggatcatatacgtgagaaggatggaatctgggctgtgttggcttggttatccatccttgctcataaaaacaaggacaacctcaatggtgggaaccttgtaacggttgaagatattgtaaagcaacactgggctacttttggacgacactattatactcgctatgattatgagaatgttgatgcaggtgctgcaaaggaagttatgactcacttggtcaagctgcaatcctccattagtgatgttaacaataccataaagggaatgcggtcagatgtggcagatgtcgtcagtgctgatgaatttgaatacaaagatccggtagatggttcagtctctaagaatcagggaattcgttatttattcgaagacgggtcacgcctggttttccgtctatctggtaccgggtcagaaggtgccacaattcgtctctacatcgagcaatacgaaaaagattcatccaaaactggaagagattctcaagaagcacttgctcctttggttgatgttgcactaaagctgtcaaagatgaaagaatacactggccgttctgccccgactgtgatcacataaatatatatgcattttgctgctatgatcgacaacgtatgtattttcgtgttttatagcaataaagttagcctttgagtggtgcgggttttggcctatgagtttcgcaggcatcactttgtt

SEQ ID NO: 7064 - DNA, 2183 bp, Cichorium intybus
cgcgggggggccagagtcgaatgggtgtctctcagatctaagtcgacagatcaccgtctgattcgctctctagcgtgcggttcgcgaataatcgaatatccccaccaagtttttccgtatatctctcgacaaccatcactcactcttcgccaaccttactccttctgaaaaacttaagtaatggcgactttcaaggttaaacgtgtcgaatcttctccaattgaaggccaaaagcctggcacttctggactcaggaagaaggtaaaagttttcacgcaaccgcattacttgcataattttgttcagtcaacattcaacgcactttctgcagaaaaaatcaaaggttctacacttgttgtttcaggtgatggacgatactactcaaaggatgcaatccagattataattaaaatggcagctgcaaatggtgcaagacgtatttgggttggtcaaaaaggacttttgtcaacacctgctgtgtcagcagttgtacgcgaaagagtcggtgctgatggttctaaagcaaatggtgcatttatattgacagccagtcacaacccaggtggtccaaatgaggattttggaattaaatacaatatggaaaacggtgggccagcacctgaaggagttactgataaaatctttgagaacactaaaacaatcaaggagtatttcattgcagaaggcttacctgatgtggacatctctgcaattggcgtttcatccttttcaggccctgatggtcaatttgatgttgatgtttttgactgcgcaagcgactatgtgaaattaatgaagtcaatctttgacttccagtcaatcaaaaagttgattgcatgcccacagttttctttttgttatgatgcgcttcatggagttggtggagcttatgctagccgtatattcgttgaagagcttggtgcaaaagagagctcgttgttaaactgtgttcctaaggaagattttggtggtggacatcctgaccccaatttaacttacgccaaagagttggtggcacgaatgggattgggtaaaacccctgacagcaaccctccagaatttggtgcagctgcagatggtgatgctgatagaaacatgatccttggtaaaaggtttttcgtcaccccttccgattccgtcgccatcattgctgccaatgcagtccaatccattccctacttctcttccggcttaaagggcgtcgccaggagcatgcctacatctgctgcccttgatgttgtagcaaaaagtctcaacttgaagttctttgaagtaccaacaggctggaaattctttggtaacttgatggatgctggactatgttctgtttgtggtgaagaaagtttcggaactggatcggaccatattcgtgaaaaggacggaatctgggctgttttagcttggttgtctattattgcatataaaaacaaagacaatctcactagtgggaagcttgtaactgttgaagacattgtaaaacaacactgggccacctacggacgccattactatactcgatacgattacgagaatgtcgatgcaggtgctgcgaaagaactaatggctcatttggtgaaattgcagtcatctcttagtgaagttaacaaaatgataaaggggattcgatctgacgtggcgaatgttgcgaatgctgatgaatttgaatacaaagatcctgtagatggttcggtttctaagaatcaaggaattcgttatttgtttgaagacgggtcacgtttggttttccgtttatctgggacgggttcagaaggtgcgacaattcgtctatacatcgagcaatacgaaaaggattcatcaaagactggaagagattcacaggacgcacttgctcctttggtggaggttgctttgaagttgtcaaagatgcaagaattcacgggacgtaatgccccaactgtgattacataaatatatacatgatgctgttcatgtgcgcaacctatgtatttttggtgttcttatacaaataaagttagggtttcagtggtatcggcttgtttcttagtttcagaggcatccttcttgttgaatgcttggttggtgatttgcagtgttttgttgtggttaataattcagttgtatgttgagaacctttacctacaatctccccattttacgcctttttaatttgataggaatcatgtaaactgaaattgaaaaaa

SEQ ID NO: 7065 - DNA, 1774 bp, Pisum sativum
cactctcctaaggtaacaatggcgctattcactgtttcacgcattcaaactacaccgttcgatggacagaagcctggaacctctggtctccgcaaaaaggtgaaagtatttgtgcaacctcattaccttgaaaactttgttcaggcatcattcaatgcactaactgaaggaaaagttagaggtgcaacactagttgtatctggtgatggtcgttattattcagagcaagcaattcagattataactaaaatggcagcagcaaatggagtaagacgtatttggattggtcaaaatgggttgctttcaactcctgcagtctctgctgttatacgtgaaagagttggagttgacggatccaaggcaacaggatcatttatactgacagcaagtcacaaccctggaggtcctaatgaggactttgggattaaatataacatggaaaatggtggacccgcacccgagggaattactaacaaaatatatgagaatacaacaacaatcaaggagtacttgattgcaccagatctgccaaatgtggatatcaccacagtaggtgtcacaaactttacaggacctgaaggaccatttgatattgaggtttttgattcagcaagcgattatataaagttgatgaagtcaatttttgactttgaatctatcaggaaactgctgacatctcctaaattcagtttctgttatgatgcattacatggagttgctggagcttatgcaaaacgcatttttgtggatgagcttggggcacaagaaaactctttgataaactgtgtaccaaaggaagactttggagggggacacccagaccccaatttgacatatgcaaaagagttggttgctcgtatgggattgggaaaatcagaaccagaaggtgaggtcccggagtttggtgctgctgctgatggtgatgcagatcgcaacatggttcttggaaaaaggttttttgtcactccttcggattctgtggccattattgctgcaaatgctgtcgaagcaattccatacttttctgctggcttaaagggagttgccaggagcatgccaacctctgctgctctggatgttgtcgccaaacatctgaacttgaagttttttgaggttcccacgggttggaaattctttggtaatttaatggatgctggattatgttcagtttgcggtgaagaaagttttgggactggttcggaccacattcgtgagaaggatggaatctgggcagttttggcctggctatccatacttgcatataaaaccaaagataatcttgaaagcaagcttgtatcagttgaagacattgttcgccagcattgggctacttatggacgccactactatactcgatatgactacgaaaatgtggatgcaggtgcagctaaggaactgatggcacatttggtcaaactgcagtcttcactcccagaagtcaatgagattattaagggagcaagttcagatgtttcaaaggttgtccacggtgatgaatttgaatacaatgatcctgtggatggttccatttcatcacaccagggcatccgatatttgtttgaggatggatcccgattgatcttccgtctctctggaactggatcagaaggtgcgactattcgactatacattgagcaatacgagaaggatccatcaaagattggaagactttcacatgaagcacttgctcctcttgtggaggctgcattgaaactttcaaagatggaggagttcaccggccgatctgcccccacagtcatcacataaatgcata

SEQ ID NO: 7066 - DNA, 1821 bp, Pisum sativum
cactctcctaaggtaacaatggcgctattcactgtttcacgcattcaaactacaccgttcgatggacagaagcctggaacctctggtctccgcaaaaaggtgaaagtatttgtgcaacctcattaccttgaaaactttgttcaggcatcattcaatgcactaactgaaggaaaagttagaggtgcaacactagttgtatctggtgatggtcgttattattcagagcaagcaattcagattataactaaaatggcagcagcaaatggagtaagacgtatttggattggtcaaaatgggttgctttcaactcctgcagtctctgctgttatacgtgaaagagttggagttgacggatccaaggcaacaggatcatttatactgacagcaagtcacaaccctggaggtcctaatgaggactttgggattaaatataacatggaaaatggtggacccgcacccgagggaattactaacaaaatatatgagaatacaacaacaatcaaggagtacttgattgcaccagatctgccaaatgtggatatcaccacagtaggtgtcacaaactttacaggacctgaaggaccatttgatattgaggtttttgattcagcaagcgattatataaagttgatgaagtcaatttttgactttgaatctatcaggaaactgctgacatctcctaaattcagtttctgttatgatgcattacatggagttgctggagcttatgcaaaacgcatttttgtggatgagcttggggcacaagaaaactctttgataaactgtgtaccaaaggaagactttggagggggacacccagaccccaatttgacatatgcaaaagagttggttgctcgtatgggattgggaaaatcagaaccagaaggtgaggtcccggagtttggtgctgctgctgatggtgatgcagatcgcaacatggttcttggaaaaaggttttttgtcactccttcggattctgtggccattattgctgcaaatgctgtcgaagcaattccatacttttctgctggcttaaagggagttgccaggagcatgccaacctctgctgccctggatgttgtcgccaaacatctgaacttgaagttttttgaggttcccacgggttggaaattctttggtaatttaatggatgctggattatgttcagtttgcggtgaagaaagttttgggactggttcggaccacattcgtgagaaggatggaatctgggcagttttggcctggctatccatacttgcatataaaaccaaagataatcttgaaagcaagcttgtatcagttgaagacattgttcgccagcattgggctacttatggacgccactactatactcgatatgactacgaaaatgtggatgcaggtgcagctaaggaactgatggcacatttggtcaaactgcagtcttcactcccagaagtcaatgagattattaagggagcaagttcagatgtttcaaaggttgtccacggtgatgaatttgaatacaatgatcctgtggatggttccatttcatcacaccagggcatccgatatttgtttgaggatggatcccgattgatcttccgtctctctggaactggatcagaaggtgcgactattcgactatacattgagcaatacgagaaggatccatcaaagattggaagactttcacatgaagcacttgctcctcttgtggaggctgcattgaaactttcaaagatggaggagttcaccggccgatctgcccccacagtcatcacataaatgcatactcgaggaaccaagtcatttcttattgtctgtacaaaattccaatcc

SEQ ID NO: 7067 - DNA, 2278 bp, Fragaria vesca
cacagtatttccctctgaaaagaagaaaaaacaaaagggaaaatttagcgtaaatcctacacactacactttgccacctttcattcccatcctcctcctcattcgttcgttacaaccacctttcgttataaatccatctctcgcgacggaaatgtcgatcaagcgagtccagacgacgccgttcgacggccagaagcctggtacctctggtctccgcaagaaggtgaaagttttcatacaacccaattacctgcaaaattttgttcaatcaacattcaatgcccttccagcagatcaagttaaaggtgctcgacttgttgtatctggcgatggtcgctactattcaaaggaagcaattcagatcataatcaagatggcagcaggaaatggtgtaaaaagtgtttgggttggtacaaatggattgctttcaactcctgctgtatcagctgttgtacgtgaaagagtgggggcagatggatccaaagcatcaggtgcatttattctcacagccagtcacaatccaggcggtcctaatgaggattttgggattaaatacaacatgggaaatggtggacctgctccagagtcgatcactaataagatatacgagaacacaacacaaataaaggagtacttaactgttgatctacctgaggtagatatcactaaaccaggtgtaacaagctttgaggttgaagggggaacttttactgttgatgtttttgactctgcgagtgactatgtgaaattgttgaagtcaatttttgatttcgattctatccgaaagcttttatcatctccaaagttcacattctgttttgatgcactacatggagttgggggagcttatgcaaaacatatttttgtggaagagcttggtgcaaaagaagactctttactcaactgtgtacccaaggaagactttggaggagggcatccagaccctaatctgacctatgcaaaggagttggttgctcgtatgggattgggtaaatcagatactcaagatcccccggaatttggggctgctgctgatggtgatgcagatcgtaacatgatccttggcaaaaggttctttgttacaccatcagattctgtagctatcattgctgcaaatgcagttgaagccataccttacttctcttctggtctgaaaggagttgccaggagcatgcccacttctgctgccctagatgttgtagccaaacatttgaatttgaaattttttgaggtacccactggctggaaattctttggtaatctaatggatgctggtttatgttcaatttgtggggaagaaagttttggaacagggtctgatcatatacgcgagaaagatggtatctgggcagttttagcttggttatctatccttgcttataaaaataaggataatattggtggggacaaacttgtgactgttgaggacatagttcgcaaccactggtctacttatggtcgccattattatactcgatatgactacgagaatgtggatgcagggaaggcaaaggaactgatggcatctttagtgaatttgcaatcttccattcctgaagtcaacaagattgtgaaaggcgtatgctctgatgttgctaatgttgctgggggtgatgaatttgaatacaaggatcctgttgatggctctatctctagccaccagggtatccggtacttgtttgaggatggatcacgattggttttccgcctctcaggcactggctcagaaggtgcaaccattcgtctctatattgaacagtatgagaaggatccatcaaaaattagcagagaatcttcagaagcacttgctcctcttgttgcggttgctcttaagctttccaagatgcaagaattcaccggccgatctgccccaactgttatcacataaatggagagtgccaaaatcacattaacggtgtggtttattttgctcatctaaaacgacatgagcttggtgtcttcaaatgtattaataataagaccatgtagtaattttgatgttttcagcagccttgctacagaaggcaaatgagagtcatgatgagtaaaaatacttctcgatataattttgattttcagaataatgcgacttgagttatactttgtgatcgtatccagctcttgtgttagtgtataatttcattatctgcatcttcttagttacaacagcaaggtgtggaaagattggatcagaaatccacaaagaagtcatgactggtttgttgtggattgcattatgtggtactgggaaactccagtacaaaagggaattacaatt

SEQ ID NO: 7068 - DNA, 1907 bp, Tabernaemontana elegans
tcctttcttcctcgctttcactttgaagtttggcaaaaatggtgttcaaggttgtttgcgtcgaaacaaagccgtttgatggccagaagcctggtacttccggtctccggaagaaggtgaaggtctttacacaacctcactacttgcaaaattttgtccagtccacttttaatgcacttggagctgacaaagtcagaggtgctacacttgtagtttctggtgatggtcgctacttctcaaaagacgcgatccagatcatcatcaagatgtcagctgcaagcggagtaagacgtgtttgggttggtcaaaatggtctgctatctactcctgctgtatcttgtgttgtacgtgagagagttggggctgatggatctaaggctaccggagcatttatattaactgcaagccacaacccaggtggccccaatgaggattttggaattaaatacaatatggaaaatggaggacctgcaccggaatcggttacaaataagatctatgaaaacaccacaacaataaaggagtacttaattgcagatggactgccagatgtggatatcagtaccatagcagtttcaagctttgctggtccagaggggcaatttgatgttgatgtttttgattcaactagtgactatgtgaaattgatgaagtcaatttttgatttccagtctatccagaagctgctttcatcgcccaacttcactttctgttatgatgcgcttcatggagttgctggagtttatgctaaacgcatttttgttgaagaacttggtgcatcagaaagttctttgttgaattgtgaacctaaggaggactttggtggtgggcatccagatcccaatctcacctatgcaaaggagttagttgcacgtatgggtttgggcaagacagacactggaaaagagccaccagaatttggtgctgctgctgatggagatgctgaccgcaatatggtccttgggaaaaggttttttgttactccctcggattctgttgctatcatagctgcaaatgcagttgaagccatcccttacttttcggatggtctgaaaggagttgccaggagcatgcccacatcagctgctcttgatgttgtagctaaacatcttaatctgaaattctttgaggtgcccactggctggaaattctttggtaatttaatggatgctggaatgtgttcaatttgtggtgaagaaagttttggaactggctcggatcatatacgtgagaaagatggtgtctgggctgttttggcttggctatctattcttgcctacaaaaacaaagaccacttgggcgggggaaatcttgtaactgttgaagacattgttcgcaagcactgggcaacttatgggcgtcactattatacacgatatgattatgagggtgttgatgcaggtggtgcaaaggaattgatggcacatttggtccagctgcaatcctccttaagtgaagtgaacaaggttataaaggacacacgttcggacgttgcaaatgttgtcaatgctgatgaatttgaatataaagatcctgtggatggttccatttctaagaatcagggaattcggtatatgtttgaggatggttcacgactggtcttccgtctctctggaactggatcagagggtgctactatccgtgtgtatattgaacaatatgaaaaggattcgaccaaaactggcagagattctcaagatgcacttgctcctttggttgaagttgctcttaaactttcgaagatgcaagagttcactggtcgatctgcccccactgtcatcacataaacctaaccttctgtggcagcgtctaattgtacgtctcattataaaacaatacaatatgatattactcttattatgcagaagagttctgctaataacttttgttcacttttgtccttttag

SEQ ID NO: 7069 - DNA, 2169 bp, Catharanthus roseus
ccttcactgtaagcatctctctcatcgctgtcatctttctcctctctctgtgtataaatataagtgtattggtggtgtatgtgtagtgaatttcatatataacattaagctaacgattctcagttaaagtttggcaagaaatggtgttcaaggttgttcgcgtcgaaacaaagccatttgatggccagaagcctggtacttcgggtctccggaagaaggtgaaggtctttacacaacctcactacttgcaaaattttgtccagtccacttttaatgcccttggagctgacaaagtcagaggtgctacacttgtagtttctggtgatgggcgctacttctccaaagatgctatccagataatcatcaagatgtcagcagctaatggagtgagacgtgtttgggttggtcaaaatggtctgctatctactcctgctgtatcttgtgttgtacgtgagagggttgcagctgatggatctaaggccaccggagcatttatattaacagcaagtcataacccaggtggccctcatgaggattttggaattaaatacaacatggaaaatggaggacctgcaccagaatcagttacgaacaagatctatgaaaatactacaacaataaaggagtacttaactgcagaaggactgccagacgtggatatcagtaccgtagcagtttcaagctttcctggtccagaggggcagttcgatgttgacgttttcgattcaacgagtgattatgtaaaattgatgaagtccatttttgatttccagtcaatccagaagttgctttcatctccaaactttagcttctgctttgatgcgcttcatggggttgctggagtttatgctaaacgcatttttgttgaagagcttggtgcaaatgaaggttctttgttgaattgtgtgcctaaggaggactttggtggtgggcatccggatcccaatcttacctatgcaaaggagttggtcgcagttatgggattgggaaagacaaacactggaaaggagcctccagaatttggtgctgctgctgatggagatgctgaccgcaacatggttgttgggaaaaggttttttgtgactccatcggattctgttgctatcatagctgcaaatgcagttgaatcgatcccctatttttcgggtggtctgaaaggagttgccaggagcatgcccacatcagctgcgcttgatgtcgtagctacacatcttaatctgaaattctttgaggtgcctactggctggaaattctttggtaatttgatggatgctggaatgtgttcagtttgtggtgaagaaagttttggaactggctcggatcatatacgtgaaaaagatggtatctgggctgttttggcttggctatctattcttgcctacaaaaacaaagacaacttgggtggtggaaagcttgtgaccgttgaagatattgttcgccagcactgggcaacttatggacgccactattatacacgatatgattatgagggtgttgatgcaagtggcgcaaaggaattgatggcacacttggtcaagctgcaatcctccttaagtgaagtgaacaagattataaagggcattcgttcagacgttccaaatgttgtcaatgctgatgagtttgaatataaagacccggtagatggttccatctctaaaaatcagggaatccggtacatgtttgaggatggttcgcgactggtcttccgtctctctggaactggatcagagggtgccactatccgtgtttatattgaacaatatgagaaggattcaagcaagactggaagagattctcaagatgcccttgctcctctggttgaagttgctcttaaactctctaagatgcaagagttcactggccgatctgcccctaccgttatcacataaatcataagcttcctgttgtcgcttctaactgtatgccttatataaaataaaaacagcaagatattactctcatagtattaattattagaagagttttgctaaaaacttttgtttgctttgttttcctgtaaccttatacaatgagcacaacgggatgagaggacagcatacggatgattctattttctgagttttgttgggaaaagttactagttttgttcttctaaataaaagtttatggtcaaatgccccgtaatttagggagtaaggcattaagcca

SEQ ID NO: 7070 - DNA, 1970 bp, Malus domestica
tctctcgttctctgtgatttgaatcgcggttcgttctcagcgagcagaatgtcgtcggggaaggttaagaaggtggagacgacgccgttcgatggccagaagcccggaacctctggcctccgcaagaaggtgaaagtctttacgcaacctcattacttgcaaaattttgttcagtcaacattcaatgcccttccatcggatcaagttaaaggtgccagaattattgtatctggtgatggtcgctatttctcaaaggatgccattcagatcataattaagatggcagcaggcaatggagtaagaagtgtttgggtcggtcagaatgggttgctttcaactcctgctgtatcagcagtcgtacgtgaaagagttggtgcagatggatcaaagtcatcaggtgcatttatattgaccgccagtcacaatccaggtggcccgaatgaggattttgggattaaatacaacatgggaaatggtggacctgcccctgagtcaatcactgacaagatatatgagaacacaacaaaaataaaggagtactttacagttgacctgcctgatgtggatatcactaaagtaggtgtgaccaccttttctgtggaaggaggaacttttgatgttgatgtttttgattcggcgagtgattatgtgaaattgatgaagtcaatctttgattttgagtctatccggaatctgctatcatctccaaaattctcattctgttatgatgcactacatggagttgctggagcttatgcaaaacgtatttttgtggaagagcttggcgcaaaagaaagctcattactgaattgtgtacccaaggaagactttggaggagggcatccagatcctaatctgacctatgcaaaggagttggttgcacgtatgggactgagcaaatcaaatactgcagatgagcccccagagtttggtgctgctgctgatggtgatgcagatcgtaacatggtcctcggtaaaaggttttttgttaccccttcggattctgtagccatcatcgctgcaaatgcagttgaagccataccttacttcaaaactggtctgaagggagttgccaggagcatgcctacctctgctgcccttgatgttgtagccaaacatctaaatttaaaattctttgaggtacccacgggctggaaattttttggtaatttaatggatgctggattatgttcagtttgtggggaagaaagttttggaacaagttccgatcatatccgtgagaaagatggtatctgggcagttttagcatggttatccatacttgcttacaaaaataaggaaaatcttggtggggagaagcttgtcagtgttgaggacatagttcgtaagcattgggctacctttggtcgccattattatactcgatacgactatgagaatgtggatgcaggtaaagcaaaggaactcatggcttctttggtgaaattgcaatctgacctttctgaagtcaataagattgtgaagggaatacgttctgatgtctgtaacgttgtcaccgctgatgaatttgagtacaaggatcctgttgacggttccatctcaaaacaccagggcatccggtacttgtttgaggacggatcacgattggttttccgcctctcaggaaccggctcagaaggtgccacaatccgactctacattgagcaatatgagaaggatccatcgaaaattggcagagaatcttcagaagcgcttggtcccctcgtggaggttgctcttaagctttcgaagatgcaagagttcaccggacgatctgcccctactgttatcacatagatccacatctctaaaatcacataaaaaaggaccggcttcttatcttcaaatatattagtaataagagaactctttttgtaattttgacgggtctgttggactctcatgtctacaatttttgtttgtccaaataatgcgaattttgaatggtactttgcaatctcttgtccaaa

SEQ ID NO: 7071 - DNA, 2222 bp, Oryza sativa
gatcctctcccgcaccagctataaaccgccacacgccctcgtcgctctcgcccccgcaccaccactccctcctcctccatctcctccgctcccgatctcacaaccaccgactcctcctcctcgcgcggcggcggcggcggcgtgagccagcagcagccatggtgctgttctcggtgacgaagaaggccaccacgcccttcgacggccagaagcccggcacctccggcctccgcaagaaggttactgtattccagcagcctcattacctccagaactttgtgcaatccacatttaatgcccttcctgccgacaaagtaaaaggtgcaaccattgttgtgtctggtgatggccgctatttctcgaaggatgctgttcagatcattacaaaaatggctgccgctaatggagtaagacgtgtttgggttggacaaaacagcctcatgtctactccagctgtatctgctgttatccgtgaaagagttggtgcagatggatcaaaggctactggtgccttcattttaacagctagtcacaaccctggtggtcctactgaggacttcggaatcaaatataacatggaaaatggtggacctgcccctgaatcggttactgataagatcttctctaatacaacgacaattactgaatatctcatcgcggaagaccttccagatgtcgatatttctgttgtaggtgtcactaccttcagtggacctgaaggcccttttgatgttgatgtttttgactctactatagattacataaagttaatgaagacaatctttgactttgagtcaattaaaaagcttctggcatctccgaagtttacattctgttatgatgctctccatggtgttgctgggacttacgcaacacgcatctttgtggaagagcttggtgctgctgaaagctcattgttgaactgtgttccgaaggaagactttggagggggccatccagatcctaacctcacctatgcaaaagaacttgttgaccggatgggccttggaaaatcctcaaatgctgaacccccagaatttggtgctgcagctgatggtgatgctgatcgcaacatgattctgggtaaaagattcttcgtaacaccttcagattcggttgccattattgcagccaatgctgttcagtcgattccttacttttcttctggccttaagggagttgccaggagcatgcccacatcagctgcccttgatgttgtcgctaagaatttgaatctcaagttctttgaggtgcctactgggtggaaattttttgggaacttgatggatgctggaatgtgctcaatttgtggtgaagaaagctttggcactggttctgatcacattcgtgagaaagatggtatttgggctgttctagcatggttatctattcttgctttcaagaacaaggacaaccttggaggcgataagcttgttactgttgaagatattgttcgccagcactggggtacttatggtcgccattattatacacgatatgactatgagaatgttgatgctggagctgctaaagaacttatggcaaaccttgtcagcatgcagtcgtccctttctgatgttaacaaattgatcaaggagattcggtcagatgtttctgatgtggttgccgcagatgagtttgagtataaggatcctgttgatggttctgtctccaagcatcagggtgtccggtacctcttcggagatggttcccggctggtgttccgcctctctggaactggctctgttggtgctactatccgtgtctacatcgagcagtatgagaaggattcttccaagaccggcagggattcgcaggatgcccttgctcctctggttgatgttgcactgaagctgtcaaagatgcaagagtacactggccgatctgctcccaccgtcatcacataaacttttcaagagccattctagaatgcttttgaggctacccatgaactttctttatggcctcctgtttgatagcctttttacatctctccccgaataaacgtgtatgtatcaactgttctcgttttcttgccaatactgcgtttctgctgcaggtccggtaaagtgtgcggcgataatgttgtcagttctgaaactgaagagggtactttatataagcgatatatcgatgttttttttgcttatctgtaatgccgtttctagttatgatctctcattctcatgggatgccattcttgaccatccatgattacaaac

SEQ ID NO: 7072 - DNA, 2351 bp, Panicum virgatum
gcgcgatacacccacagcaacagaagccacggcggacattttatgaaggagagaaggaaaaaaaagagcgacgaggaatgaagcatctgcatccttcttcggtgcgctccctgccctcccccgctataatatcgccacgccctcgtcgccatcgtcaccacaccgccactccctccctgccctctcgctcccgatctatccaccaccaccaccgccctctccgcgccaccactcccctcgcctcgcgcggcgaccggcggcgggacgtcggcgggccgatcatggggctcttcaccgtgacgaagaaggccaccacgcccttcgagggccagaagcccggcacctccggcctccggaagaaggttactgtattccagcaacctcattatctacagaactttgtccaatcaacattcaatgcccttcctgctgaggatgtaaaaggtgcgaccattgttgtctctggtgatggccgctatttctcaaaagatgctgttcagatcataacaaaaatggctgctgccaatggagcaagacgtgtttgggttgggctaaacagtctcatgtctactcctgcagtgtctgctgtcatccgtgaaagagttggtgcagatggatcaaaggctacgggtgccttcatcttaacagcgagccacaacccaggtggtccaactgaggacttcgggatcaaatacaatatgggaaatggtgggcctgcccctgagtctgttactgacaagattttctctaatacaacgacgatctctgaatacctcatcgccgaagaccttccagatgttgatatttctgttgctggtgtcactagcttcagtggacctgaaggcccctttgatgtggatgtctttgactccagtgtagattacataaagttaatgaagacgatttttgattttgaggcaataaagaagttgctgacctctccaaaatttacattctgttatgatgccctccatggtgttgctggagcttatgccaaacacatctttgtggaagagcttggtgctgatgaaagctctctgttgaattgcgtcccgaaggaggactttggcggtggccatccggatcctaacctcacctatgcaaaagagttggttgaacggatgggtcttggaaagtcatcttcaaacgtcgaacctcctgaatttggtgcggctgctgatggagatgcggaccgaaacatgattctgggtaaaagattctttgtgacgccatcggactctgttgccattatcgcggccaatgctgttcagtcaattccttactttgcttctggcctgaagggagttgccaggagcatgccaacatctgctgcccttgatgttgttgcgaagaatttaaatctcaagttctttgaggtgcctactgggtggaaattttttggcaacttgatggatgctggaatgtgctcaatctgtggcgaagagagctttggcaccggttctgatcacattcgtgagaaggatggtatttgggctgtgcttgcatggctgtctattcttgctttcaagaacaaggacaaccttgaaggagataataagcttgtctcagttgaagatattgttcgtcagcactgggccacctatggtcgtcactattacacacgttatgactacgagaatgttgatgctggtgctgctaaggagcttatggcaaacctagtcagcatgcaatcatcactttctgatgttaacaagttgatcaaggagatcagatctgatgtttccgaagtagttgcagctgacgagtttgagtataaggatcctgttgatggctctgtgtccaagcaccagggtatccgatacctctttggagatggttcacgactggtgttccgtctctctggaaccggttctgttggtgccaccatccgtgtctacattgagcagtacgagaaggattcctccaagaccggcagggattcacaggatgctcttgctccactggttgatgttgcactcaagctctccaagatgcaagagtacactggccgctctgcccccaccgtgatcacataaatttttgaagagcctgtgttttagaatgagcagcacttacacaaaccttctttctggcctcgtgtttgatagttttttccccgtgtccatctcaccagtgaataaagtgtatgtttattgcccatactgcagacttgccgctggcacagcatgcggtaataagtcttgtcacagtgctgtaactgggagcttgtttctcctctcgcaatatatcagatgtgtttttttgtttgtttgagcatatcaaaatctttacccacctgtatggcacttgtcagtgttgttttgttttctccaaaccatctgataatcgac

SEQ ID NO: 7073 - DNA, 2343 bp, Panicum virgatum
cgatacacacaccaacagaagccacggcggacatttaaaaaaaagtgaaggagagaggaaaaaaattagcgacgaggaatggttcatctccatccttcggtgcgctccctgccctcccccgctataatatcgccacgccctcgtcgccatcgccaccacaccaccactccctccctgccctctcactcccgatctctccaccaccaccgcccgctccgcgccaccacacccctcgcctcgcgcggcgaccggcggcgggacgtcggcggaccgaccatggggctcttcaccgtgacgaagaaggcaaccacgcccttcgagggccagaagcccggcacctccggcctccggaagaaggttactgtattccagcagcctcattatctacagaactttgtccaatcaacattcaatgcccttcctgctgaagaagtaaaaggtgcaaccattgttgtctctggtgatggtcgctatttctcaaaagatgctgttcagatcataacaaaaatggctgctgccaatggagcaagacgtgtttgggttggactaaacagtctcatgtctactcctgctgtgtctgctgtcatccgtgaaagagttggtgcagatggatcaaaggctacgggtgccttcatcttaacagcgagccacaacccaggtggtccgactgaggacttcgggatcaaatacaatatgggaaatggtgggcctgcccctgagtctgttactgacaagattttctctaatacaacaacaatctctgaatacctcatcgccgaagaccttccggatgttgatatttctgttgttggtgtcactagcttcagtggacctgaaggcccctttgatgtggatgtttttgactccagtatagattacataaagttaatgaagacaatttttgatttcgaggcaataaagaagttgctgacctctccaaaatttacattctgttatgatgccctccatggtgttgctggagcttatgccaaacacatctttgtggaagagcttggtgctgatgaaagctctctgttgaattgcgtcccgaaggaggactttggcggtggccatccggatcctaacctcacctatgcaaaagagttggttgaacggatgggtcttggaaagtcatcctcaaacgtcgaacctcctgaatttggtgcggctgctgatggagatgctgaccgaaatatgattctgggtaaacgattctttgtgacgccgtcggactctgttgccattattgcggccaatgctgttcagtcaattccttactttgcttctggcctgaagggagttgccaggagcatgccaacatctgctgcccttgatgttgttgcgaagaatttaaatctcaagttctttgaggtgcctactgggtggaaattttttggcaacttgatggatgctggaatgtgctcaatctgtggtgaagagagctttggcaccggttctgatcacattcgtgagaaggatggtatttgggctgtgcttgcatggctgtctattcttgcttttaagaacaaggacaaccttgaaggagataataagcttgtctccgttgaagatattgttcgtcagcactgggccacctatggtcgccactattacacacgctatgactacgagaacgttgatgcaggggctgctaaggagcttatggcaaacctagtcagcatgcaatcatcactttctgatgttaacaagttgatcaaggagatcagatctgatgtttccgaagtagttgcagctgatgagtttgagtacaaggatcctgttgatggctctgtgtccaagcaccagggtatccgatacctctttggagatggttcacgactggtgttccgtctctctggaaccggttctgttggtgccaccatccgtgtctacattgagcagtacgagaaggattcctccaagaccggcagggattcacaagatgcccttgctccactggtcgatgttgcacttaagctctccaagatgcaagagtacactggccgctctgcccccaccgtgatcacttaaatttttgaagagcctgtgttttagaatgagttgaggcacttacacaaaccttctttccggcctctcgtgtttgatagttttttttccctgttccatctcaccagtgaataaagtgtatgtttattgcccacactgcaaacttgccgctggcacagcatgcggtaataagtcttgtcacagtgctgtagttgggagcttgtttctcgtaatatatcaggcccttgtttagttgtataattcaaaattctaaaaaaaattccagcacttttgcatggagatttaaatctagacgaaataaaaaacacattgcac

SEQ ID NO: 7074 - DNA, 2069 bp, Pennisetum glaucum
ccctccccgccctctcactcccgatctctcctccaccaccgcttcctcctccgccccacccctctcctcgcctcgcgcggcgagcggcggcggatcgcctgcggcccagccatgttcagtgtgacgaagaaggccaccacgcccttcgagggccagaagcccggcacctccggcctgcgcaagaaggttactgtattccagcaaccccattatctgcagaactttgtccaatcaacattcaatgcccttcctgctgaagaagttaaaggtgcgactattgttgtctccggtgatggccgctatttctcaaaagatgctgttcagatcataacaaaaatggctgctgccaatggagtgagacgtgtttgggttggacaaaacagtctcatgtctactccagctgtatctgctgtcatccgtgaaagaactggtcaagatggatcaaaggctactggtgccttcatcttaacagcaagccacaacccaggtggtcccactgaggacttcgggatcaaatacaacatgggaaatggtgggcctgctcctgaatctgttaccgacaagattttcactaatacaacaacaatatctgaatacctcatctctgaggatcttccagatgttgatatttctgcaattggcgtctctagcttcagtggacctgaaggcccctttgatgtggaagtctttgactccagtgtagattacattaagttaatgaagacgatttttgactttgaggcaataaaaaagctgctgacctccccaaaatttacattctgttatgatggtctccatggtgttgctggagcttatgccaaacacatctttgttgaagagcttggtgctgatgaaagctcactgttgaattgtgtcccgaaggaggactttggaggtggtcatccggaccctaacctcacctatgcaaaagagttggttgaacggatgggtcttggaaagtcatcctccaatgtagagcctcctgaatttggtgctgcagctgatggagatgctgaccgaaacatgatccttggtaaaagattctttgtgacaccatcagactctgttgccattattgcggccaatgctgttcagtcaattccgtactttgcttccggcctgaagggagttgccaggagcatgccaacatctgcagctcttgatgttgttgcgaagaatttaaatctcaagttctttgaggtgcctactgggtggaaattttttgggaacttgatggatgctggaatgtgctcaatctgtggtgaagagagctttggcactgggtctgaccacattcgtgagaaggatggtatttgggctgtgcttgcgtggctgtctattcttgctttcaagaacaaggacaaccttggaggagataagcttgtctctgttgaagatattgttcgtcagcactgggccacctatggacgccattattacacacgctatgactatgagaatgttgatgctggggctgctaaggagcttatggcaaatctagtcagcatgcaatcatcactatctgatgttaacaagttgatcaaggagatcaggtctgatgtttccgaagtagtagcagctgacgagtttgagtacaaggatcctgttgatggctctgtgtccaagcaccagggtatccgatacctctttggagatggttcacgactggtgttccgtctctctggaacgggttctgttggtgccaccatccgtgtctacatcgagcagtacgagaaggattcggccaagattggcagggaatcttcggatgcccttgctccactggttgatgttgcactcaagctctccaagatgcaagagtacactggccgctctgcccccaccgttatcacataaatttttgaagaacctgcgttttagaatgagttgaggcacttacaaaccttcattccggcctcgtttgatagtttttccccctctgttgcatctcaccagtgaataaaatgtatgtttattacccatactgcagactcgccgctggcacagcatgcggtaataaatcttgttacagtgctgtaattgggagcgtgtttctcgtcgtaatatat

SEQ ID NO: 7075 - DNA, 1940 bp, Helianthus annuus
gaaaaaagctcaaaagcaatggcgaatttcaccgtcaatcgcgtcgaaacatcgccaattgaaggccagaagcctggtacatctggactcaggaagaaggttaaagtattcacccaaccacattacttgcataatttcgttcaatcgacattcgatgccctttctgcagagagcgttaaaggttctacacttgttgtttcgggtgatggacggtactactcaaaggttgcaatccagattataatcaaaatggcagctgcaaatggtgtaagacgcgtttgggtgggccaaaatggacttttatccacacctgctgtatcagcagttgtaagggaacgaattggggccgatggttccaaagcaaatggggcattcatattgacagctagtcacaaccctggtgggcccaatgaggattttggaattaaatacaatatgggaaatggtgggccagcacccgaaggaattactgataaaatctttgagaacacaaaaacaataaaggagtattttattgcagaaggcctacctgatgtggatatctcagtaactgggatttcaaacttttcgggtcctaacggtcaatttgatgttgatgtctttgactcagcaagtgactatgtgaaattgatgaagtcaatctttgacttccagtccatccaaaagttaattgcatctccacaatttagtttctgttttgatgcacttcatggagttggtggagcttatgctaaacgtatgtttgttgaagagcttggtgcaaaggagagctcgttattgaactgtgttcctaaggaagactttggtggtggacatcccgatcctaatctaacctatgcaaaagagttggtagcaagaatgggattgggtaataatgctgatagtaacccaccagagtttggtgctgctgctgacggtgatgctgataggaacatgatccttggtaaaaggttttttgttacaccttcggattctgttgccatcattgctgccaatgctgttcaagccattccctacttttcatctggattgaagggtgttgccaggagcatgccaacatctgctgctcttgatgttgtagctaatagtctgagccttaagtttttcgaggtaccaactggctggaaattctttggtaacttgatggatgctggtttatgttcaatttgtggtgaagaaagttttggaacagggtcggaccatattcgtgaaaaagacggaatctgggctgtgttggcttggttatccattctggctcataaaaacaaggacaatctcgatggcgggaaacttgtgaccgttgaagatattgtgaagcaacactgggcgacttttggccgtcactattatactcgctatgattatgagaacgtcgatgcgggtgctgcaaaggacgtaatggctcacttagtcaagctgcaatcctctatcagtgatattaacactaccttaaagggtatacgatcagatgtggcagatgtcgtcgctgccgatgaatttgaatacaaagatccggttgatggttcagtctctaaaaatcaaggaattcgttatttattcgaagacgggtcacgtttggttttccgtttatctgggaccgggtcagaaggtgccacaattcgtctttacattgagcagtacgaaaaagattcgtccaaaaccggaagagattctcaagaagcacttgctcctttggttgatgttgcactaaagctgtcaaagatgcaagaattcaccggccgttctgcacctactgtgatcacatagatatatatacacatgctgctgctatgagcctgtgatcaataccgtatgtattttttcgtgttttatagcaataaagttgactttcagtggtgcggttcttgcttgttactttcacaggcatcagtttgttgaatgctttgatgatttacaaagttttgttgtgttaatcattc

SEQ ID NO: 7076 - DNA, 2038 bp, Solanum tuberosum
cacacatccatcactcactcatctttccaaatcttcagattgaagaaaatggcgaatttcaaggtttctcgcgtcgaaactacgccatttgaaggacagaagcctggtacttccggtctccgtaagaaggtgaaggtgttcatacaacctcattacttgcaaaattttgttcaggcaacattcaatgcacttggagctgacagagttgaaggtgctacacttgtggtttctggtgatggccgatactattcgaaggatgctatccagatcattacaaaaatggcagcagcaaatggagtaagacgtgtttggattggccaaaatggacttttgtccactcctgctgtatcagctgttgttcgtgagagagtcggggctgatggttctaaagctactggggcatttatattgacagcaagtcacaacccaggtggccctcatgaggattttggaattaagtacaacatggaaaatggtggacctgctccggaaggtataacaaacaagatctatgagaacaccacaacaataaaggagtacttgattgctgagggcctgcctgatgtggacatatctacaacaggtgtctcaagctttgagggtccaaaggggaaatttgacgttgacgtttttgattcaactagtgattatctgaaattgttgaagtcaatatttgacttcccagctatccagaagttgctctcttctccaaaatttagtttctgctatgatgcacttcatggtgttgctggcgtacatgcaaagcgtatatttgtggaggagcttggggcaaatgaaagctctctagttaattgtgtacccaaggaggactttggtggagggcatcccgatcccaatctgacatatgcaaaggagttagttgcacgtatgggattgtctaaaacgcattctgaacccaatccaccagaatttggggcagctgctgatggagatggggaccgtaacatggtcctggggaaaagattctttgtgactccttccgactctgtagctataattgctgccaatgctgtacaagctattccttatttttctggaggtttgaaaggtgttgccaggagtatgcccacatctgctgctcttgatatagttgctaaacacctgaacttgaaattttttgaggtacccactggttggaaattttttggaaacttgatggatgctggaatgtgttcaatttgcggagaagaaagttttggaactggctcagaccacattcgagagaaagatggaatatgggctgttttggcttggttatctatccttgcctataagaataaggacaaccttggggaaggtaaccttgtgtctgttgaagatattgttcgccaacactgggcaatctatggacgtcactattacactcgatatgactatgagaatgtcaatgctgatggtgctaaggatcttatggctcatttggtgaagctgcaatcttccattgatgaagttaacaagttaataaagggaatccgttcagatgtttcaaatgtcgtgcatgctgatgaatttgagtacaaggacccagttgatggttcggtctcaaaacatcagggtataagatatctatttgaagatggatcacgattggtgttccgtctctctggaactgggtcagagggtgctacaatccgtctctacattgagcagtacgagaaggattcatccaagattgggagagattctcaggaagcacttgcacccctggtggaggttgctcttaaactatcgaaaatgcaggaatacactagtcgttctgccccaactgttattacataaacatattctgtatggtttactttctagaactaaacaattgaataagtgtactgtccttgctggcagagatgatgatatcaagttttcaattctgcagtcttttgtctggagttgaagtgtttttgttagaatatatgaatgttatgcgccaatttcttcttcgtttacctttcatcttgaatgacttgtgtagacataaatttcttgtccagaaattaaaatgttagcaacaatccta

SEQ ID NO: 7077 - DNA, 2424 bp, Zea mays
aaatcaccaaagaaatcactccagaattttgaaaaggtgacggaaatagtgaggagcggagaacaccggaatgatccatcctcttgtgctttccctgcccttccccgctataatatcgcgccctcgtcgccatcgtcaccacaccaccactccctcactgccctctcactcccgatccctgcaccactaccgcctcctccgcttcacccctctcgtcgcctcttgcggcgaccggcggcggatcgtccgcggcgcaagcgcaaccatggggctcttcaccgtgacgaagaaggccaccacccccttcgaaggccagaagcccggtacctccggcctccgcaagaaggttactgtattccagcagcctcattatctgcagaactttgtccagtcaacattcaatgcccttcctgcagaccaagtaaaaggtgcaaccattgttgtctctggtgatggccgctatttctcaaaagatgctgttcagatcataacaaaaatggctgctgccaatggagtaagacgtgtttgggttggacaaaacagtctcatgtctactcctgctgtatctgctgtcatccgtgaaagaattggtgcagatggatcaaaggctactggtgccttcatcttgacagcgagccataacccaggtggtcctacggaggactttggtatcaaatacaatatgggaaatggtggacctgcccctgaatccgttaccgacaagattttctctaatacaacgacaatctctgaatacctcatctctgaagaccttccagatgttgatatttctgttgtcggtgtcaccagcttcagtggacccgaaggcccctttgatgtggatgtctttgactctagtgtaaattacataaagttaatgaagacaatttttgacttcgaagcaataaaaaagctactgacctccccaaagtttacattctgttatgatgcgctccatggtgttgctggagcttatgccaaacacatctttgtggaagagcttggtgctgatgaaagctcactgttgaattgtgtcccaaaagaggactttggaggtggtcatccggatcctaacctcacctatgcaaaagagttggttgaacggatgggtcttggaaagtcatcctcaaatgttgaacctcctgaatttggtgctgcagctgatggagatgctgaccgcaacatgattctgggtaaaagattctttgtgacaccatcggactctgttgccattatagcggccaatgctgttcaatcaattccttactttgcttctggcctgaagggagttgccaggagcatgccaacatcagctgcccttgatgttgttgcaaagaatttgaatctcaagttctttgaggtgcctactgggtggaaattttttgggaatttgatggatgctggaatgtgctcaatctgtggtgaagaaagctttggcactgggtctgaccacattcgtgagaaagatggcatctgggctgtgcttgcatggctttctattattgctttcaagaataaggacaaccttggaggagataagcttgtcactgttgaagatattgtccgtcagcattgggccacatatggtcgccattattacacacgctatgactatgagaatgtcgatgctggggctgctaaggagctgatggcaaacctagtaagcatgcagtcatcactttctgatgttaacaagttgatcaaggagatccggtctgatgtttctgaagtagttgcagctgacgagtttgagtacaaggatccagttgatggctctgtgtccaagcaccagggcatccgatacctcttcggagatggttcacgactggtgttccgtctatccggaaccggttctgttggtgccaccatccgtgtctacatcgagcaatacgagaaggattcctccaagaccggcagggattcacaggaggcccttgctccactggttgatgttgcgctcaagctctccaagatgcaagagtacactggccgctctgcccccaccgttatcacataaatttttgaagagtgatttacaatgagttgaggcgcttacacaaattttcattcaagcctcttgttctatagttctacttcctgttgcatctcaccaatgaataaaatgtatgtatcagactcgccccgttttttttttgtccatgtactgcagtgcagcggactgagccgctggcacagcatgcggtaataatcttgtcacagtgacagtgctgtaatcgggagcgtgtttcttgtaatcttgttaggaagtgtttctggttttgtttgagcatttgcttatctttttttctgagtactaaaaataatttactcacatgtatgtataccatgtcactaatcttttgatggctgtttagggaacctgggttatgattcgtcgattactgattaaccgttccctgtgtg

SEQ ID NO: 7078 - DNA, 2178 bp, Solanum lycopersicum
gtcgcctataatagtgaatcgctctcttcgaagctccacacacatccatcactaactcatctttccaaatcttcagattgaagaaaatggcaaatttcaaggtttctcgcgtcgaaactacgccatttgaaggacagaagcctggtacttccggtctccgtaagaaggtgaaggtgttcatacaacctcattacttgcaaaattttgtccaggcaacattcaatgcacttggagctgacagagttgaaggtgctacacttgtggtttctggtgatggccgatactattcaaaggatgctatccagatcattacaaaaatggcagcagcaaatggagtaagacgtgtttggattggtcaaaatggacttttgtccactcctgctgtatcagctgttgttcgtgagagagtcggggctgatggttctaaagctactggggcatttatattgacagcaagtcacaacccaggtggccctcatgaggattttggaattaagtacaacatggaaaatggtggacctgctccggaaggtataacaaacaagatctatgagaataccacaacaataaaggagtacttgattgccgagggcctgccggatgtgattatatctacaacaggtgtctcgagcttcgagggtccaaaggggaaatttgacgttgacgtttttgattcaactagtgattatctgaaattgttgaagtcaatatttgacttcccagctatccagaagttgctctcttctccaaaatttagtttctgctatgatgcacttcacggagttgctggcgtacatgcaaagcgtatatttgtggaggagcttggggcaaatgaaacctctctagttaattgtgtacccaaggaggactttggtggagggcatcccgatcccaatctgacctatgcaaaggagttagttgcacgtatgggattgtctaaaacgcattctgaaccgaatccaccagaatttggagcagctgctgatggagatggggaccgtaacatggtcctggggaaaagattctttgtgactccttccgactctgtagctataattgctgccaatgctgtacaagctattccttatttttctggaggtttgaaaggtgttgccaggagtatgcccacatctgctgctcttgatatagttgctaaacacctgaacttgaaattttttgaggtacccactggttggaaattctttggtaacttgatggatgctggaatgtgttcaatttgcggagaagaaagttttggaactggctcagaccatattcgagagaaagatggaatatgggctgttttggcttggttatctatccttgcctataagaataaggacaaccttggggaaggtaaccttgtgtctgttgaagatattgttcgccaacactgggcaacctatggacgtcactattacactcgatatgactacgagaatgtcaatgctgatggtgctaaggatcttatggctcatttggtgaagctgcaatcttccattgatgaagttaacaagttaataaagggaatccgttcagatgtttcaaatgtggtgcatgctgatgaatttgagtacaaggacccagttgatggttctgtctcaaaacatcaaggtataagatatctatttgaagatggatcacgactggtgttccgtctctctggaacagggtcagagggtgcaactatccgtctgtacattgagcagtatgagaaggattcatccaagattggtagagattctcaggaagcacttgctcccctggtggaggttgctcttaaactatcgaaaatgcaggaatacactagtcgttctgccccaactgttattacataaacaaacaaacatattctctatgctttactttctcaattgaataagtctactactctccgagatgatgataactatcaagttttcgattctgcagtcactcttctgtctggagtttgaagtgttttttgttaggatatatatatatatatttcttcttcctttaccctttcatcttgaatgactagtgtaggcattaatttcttgtccacaaattaaaatttaccaacaatcctagtatttcatttcaatctttcaacagttaaaaggtcactcaaaaattctctttattataccatgtaatatgaagctcaaaaataaataaaactcattaacaagtcta

SEQ ID NO: 7079 - DNA, 2395 bp, Zea mays
agcagaaaccacagcagcctacctctgcggttgcattcttcgcgtccacagaccgcagggaccgcggtaaacaaatcagcaacgaaaccactgcaggatttcgaaaaggtgagataaaacgctaggagccgaggagaacaactgaatgatccaacaccgccctcttgtgctctccctgccctcccccgctataataccgccacgccctcgtcgccatcgtcaccacaccaccactccctccctgccctctcactcccgatccctcctccaccaccgcttcctccgcgtcacccctctcgtcgtcgcctcacgaggcgaccagcggcggaccctccgcggcgcaaccatggggctcttcactgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccgctatttctcaaaagatgctgttcagatcataacaaaaatggctgctgccaatggagtaagacgtgtttgggttggacaaaacagtctcatgtctactcctgctgtatctgctgtcatccgtgaaagagttggtgcagatggatcaaaggctactggtgccttcatcttgacagcgagccataacccaggtggtcctaaggaggacttcgggatcaaatacaacatgggaaatggtgggcctgctcctgaatctgttaccgacaagattttctctaatacaacgacaatctctgaatacctcatctctgaagacctaccagatgttgatatttctgttgtcggtgtcaccagcttcagtggacccgaaggcccctttgatgtggatgtttttgactctagtgtagattacataaagttaatgaagacaatttttgacttcgaagcaataaaaaagctgctgacctccccaaagtttacattctgttatgatgcactccatggtgttgcgggagcttatgccaaacacatctttgtggaagagcttggtgctgatgaaagctcactgttgaattgtgtcccgaaagaggactttggaggtggtcatccggatcctaaccttacctatgcaaaagagttggttgaacgcatgggtcttggaaagtcatcctcaaatgttgagcctcctgaatttggtgctgcagctgatggagatgctgaccgcaacatgattcttggtaaaagattctttgtgacaccgtcggactctgttgccattatcgcagccaatgctgttcaatcaattccttactttgcttctggcctgaagggagttgccaggagcatgccaacatctgctgcccttgatgttgttgcaaagaatttgaaccttaagttctttgaggtgcctactggatggaagttttttgggaatttgatggatgctggaatgtgctcaatctgtggtgaagaaagctttggcactgggtctgaccacattcgtgagaaggatggcatctgggctgtgcttgcatggctttcaattattgctttcaagaataaggacaaccttggaggagataagcttgtcactgttgaagatattgtccgtcagcactgggccacatatggtcgccattactacacacgctatgactatgagaatgttgatgcaggggctgctaaggagcttatggcaaacctagtaagcatgcagtcatcactttctgatgttaacaagttggtcaaggagatccggtctgatgtttctgaagtagttgcagctgacgagtttgagtacaaggatcctgttgatggctctgtgtccaagcaccagggcatccgatacctctttggagatggttcacgactggtgttccgcctctctggaaccggttctgttggtgccaccatccgtgtctacatcgagcagtacgagagggactcctctaagaccggcagggattcacaggacgcccttgctccgctggttgatgttgcgctcaagctctccaagatgcaagagtacactggacgctctgcccccaccgtcatcacataaattttgaagagtgttttagaatgagttgaggcgcttacacaaactttcattccggcctcttgttccatagtttttcttgcatgttacatctcaccgatgaataaaatgtatgtatcagacttgtctcgtttttttgcccatccaagcagcaaattagccgctggcacagcatgcggtaataatcttgtcacagtgctgtaattgggagcgtttttcttgttagaagtgtttctggtttgtttgagcatttgcggatcgatttttctttctgaagagtatataaacattttactcacc

SEQ ID NO: 7080 - DNA, 2225 bp, Sorghum bicolor
aaatcaccaaaggaaaccactggatccagaattttgaaaaagtgaggtaaaaagcgaggagccgaggagaacaacggaatgatccatcctcttgtgctctccctgccctcccccgctataatatcgccgcgccctcgtcgccatcgtcaccacaccaccactcctcctccctccctgccctctcactcccgatccctccaccaccaccgcttcctccgcgtcacccctctcgtcgcctcgcgcggcggccagcggcggatcgtccgcggcgcaaccatggggctcttcaccgtgacgaagaaggccaccacgcccttcgaaggccagaagcccggcacctccggcctccgcaagaaggttactgtattccagcagcctcattatctgcagaactttgtccaatcaacattcaatgcacttcctgcggaccaagtaaaaggtgcaaccattgttgtctccggtgatggccgctatttctcaaaagatgctgttcagatcataacaaaaatggctgctgccaatggagcaagacgtgtctgggttggactaaacagtctcatgtctactcctgctgtatctgctgtcatccgtgaaagagttggtgcagacggatcaaaggctactggcgcgttcatcttgacagcgagccataacccaggtggtcctacggaggacttcggtatcaaatacaatatgggaaatggtggacctgcccctgaatctgttaccgacaagattttctctaatacaacgacaatctctgaatacctcatctctgaagaccttccagatgttgatatttctgttgtcggtgtcaccagcttcagtggacccgaaggcccctttgatgtggatgtctttgactctagtgtagattacataaagttaatgaagacaatttttgactttgaagcaataaaaaagctgctgacttccccaaagtttacattctgttatgatgcgctccatggtgttgctggagcttatgccaaacacatctttgtggaagagcttggtgctgatgaaagttcgctgttgaattgtgtcccaaaagaggactttggaggtggtcatcctgatcctaacctcacctatgcaaaagagttggttgaacggatgggtcttggaaagtcatcctcaaatgttgagccccctgaatttggcgctgcagccgatggagatgctgatcgcaacatgattctgggtaaaagattctttgtgacaccatcggactctgttgccattatcgcagccaatgctgttcaatcaattccttactttgcttctggcctgaagggagttgccaggagcatgccaacatctgctgcccttgacgttgttgcaaagaatttgaatctcaagttcttcgaggtgcctactgggtggaagttttttgggaatttgatggatgctggaatgtgctcaatctgtggtgaagaaagctttggcactgggtctgaccatattcgtgagaaggatggcatctgggctgtgcttgcttggctttctattattgctttcaagaataaggacaaccttggaggagataagcttgtcagtgttgaagatattgtccgtcagcactgggctacatatggtcgccattattacacacgctatgactatgagaatgttgacgctggggctgctaaggagcttatggcaaacctagtaagcatgcagtcatcactttctgatgtcaacaagctgatcaaggagatccggtctgatgtttctgaagtagttgcagctgacgagtttgagtacaaggatcctgttgatggctctgtgtccaagcaccagggcatccggtacctcttcggagatggttcgcgactggtgttccgcctctctggaactggttctgttggtgccaccatccgtgtctatatcgagcagtacgagaaggattcctccaagatcggcagggattcacaggatgctcttgctccgctggttgatgttgcgctcaagctctccaagatgcaagagtacactggccgctctgcccccaccgttatcacataaatttttgaagagagattctttagaatgagctgaggcgcgtacacaaacttccattccggcctcttgttctatagtttttcttccttgttgcatctcaccgatgaataaaatgtatgtaccagactcgtctcgtttttttgcccatactgcagagtaagccgctggctcagcatgcggtaataatcttgtcagtgttg

SEQ ID NO: 7081 - DNA, 2651 bp, Sorghum bicolor
agaaaccacgtctccgcggtcgtattcttcgcgtccacagggatcggataaacaaatcaccaaaggaaaccactggatccagaattttgaaaaagtgaggtaaaaagcgaggagccgaggagaacaacggaatgatccatcctcttgtgctctccctgccctcccccgctataatatcgccgcgccctcgtcgccatcgtcaccacaccaccactcctcctccctccctgccctctcactcccgatccctccaccaccaccgcttcctccgcgtcacccctctcgtcgcctcgcgcggcggccagcggcggatcgtccgcggcgcaaccatggggctcttcaccgtgacgaagaaggccaccacgcccttcgaaggccagaagcccggcacctccggcctccgcaagaaggttactgtattccagcagcctcattatctgcagaactttgtccaatcaacattcaatgcacttcctgcggaccaagtaaaaggtgcaaccattgttgtctccggtgatggccgctatttctcaaaagatgctgttcagatcataacaaaaatggctgctgccaatggagcaagacgtgtctgggttggactaaacagtctcatgtctactcctgctgtatctgctgtcatccgtgaaagagttggtgcagacggatcaaaggctactggcgcgttcatcttgacagcgagccataacccaggtggtcctacggaggacttcggtatcaaatacaatatgggaaatggtggacctgcccctgaatctgttaccgacaagattttctctaatacaacgacaatctctgaatacctcatctctgaagaccttccagatgttgatatttctgttgtcggtgtcaccagcttcagtggacccgaaggcccctttgatgtggatgtctttgactctagtgtagattacataaagttaatgaagacaatttttgactttgaagcaataaaaaagctgctgacttccccaaagtttacattctgttatgatgcgctccatggtgttgctggagcttatgccaaacacatctttgtggaagagcttggtgctgatgaaagttcgctgttgaattgtgtcccaaaagaggactttggaggtggtcatcctgatcctaacctcacctatgcaaaagagttggttgaacggatgggtcttggaaagtcatcctcaaatgttgagccccctgaatttggcgctgcagccgatggagatgctgatcgcaacatgattctgggtaaaagattctttgtgacaccatcggactctgttgccattatcgcagccaatgctgttcaatcaattccttactttgcttctggcctgaagggagttgccaggagcatgccaacatctgctgcccttgacgttgttgcaaagaatttgaatctcaagttcttcgaggtgcctactgggtggaagttttttgggaatttgatggatgctggaatgtgctcaatctgtggtgaagaaagctttggcactgggtctgaccatattcgtgagaaggatggcatctgggctgtgcttgcttggctttctattattgctttcaagaataaggacaaccttggaggagataagcttgtcagtgttgaagatattgtccgtcagcactgggctacatatggtcgccattattacacacgctatgactatgagaatgttgacgctggggctgctaaggagcttatggcaaacctagtaagcatgcagtcatcactttctgatgtcaacaagctgatcaaggagatccggtctgatgtttctgaagtagttgcagctgacgagtttgagtacaaggatcctgttgatggctctgtgtccaagcaccagggcatccggtacctcttcggagatggttcgcgactggtgttccgcctctctggaactggttctgttggtgccaccatccgtgtctatatcgagcagtacgagaaggattcctccaagatcggcagggattcacaggatgctcttgctccgctggttgatgttgcgctcaagctctccaagatgcaagagtacactggccgctctgcccccaccgttatcacataaatttttgaagagagattctttagaatgagctgaggcgcgtacacaaacttccattccggcctcttgttctatagtttttcttccttgttgcatctcaccgatgaataaaatgtatgtaccagactcgtctcgtttttttgcccatactgcagagtaagccgctggctcagcatgcggtaataatcttgtcagtgttgtaattgggagcgcgtttcttctaatcttgttggaagtgtttctggtttgtttgagcatttgcgtatcgttttttctttctgaagagtataaaaaatatgtactcacctgtataacctgtcactaaagttttgatggctgttcggtgaggcttggttatgaaccgtccgagaattgataaccattcctgtgtgacctgattgtagaccctgtgttcttaagttcccagtaattgcaaatgacgagtggcattatggcagaggattgtgactaggcatctgtgttggttcagcaccatgatttacagtcaggagcgactgatggttctgaacttctgttacatgttctgttcttcttgtgataggtggccctctg

SEQ ID NO: 7082 - DNA, 2102 bp, Cephalotaxus harringtonia
atcgcgcatctgcgaaacccttgcattgcgtatactaattgtgtatattctcgtgctgttttgcactgctaggtgaagccagaaaatgacgatttttagtgtggttaggaaggagacctctcctttcgatggacaaaagccagggacatccggcctcaggaagaaggttaaagtcttcaagcaagagaattatttgcataatttcgttcaagcaactttcaatgcactgtcagctgataaaataaaaggttctacaattgttgtgtctggggatggacgatactattcaaaagaggctattcagataatagtaaaaatggcagctgcaaatggagtgaggcgcatctgggtgggccaaaatggactgctttcaacacctgcagtgtcaggagttatacgcgagagagttggggtaaatggagataaagcatccggagcttttatattgacagccagccataatccaggaggcccgcatgaggactttggaataaagtacaacatggaaaatgggggaccagcaccagaggggataactgacaagatttatgagaatacaaagacaataaaggagtattttattgcagaagatctcccagatgtagacatatcgactataggtataacacgttttagtggccccgaaggaccttttgatgtggatgtctttgattctgctgaagattatgttaaattgatgaagactatcttcgacttcgaagccatccaaaagctgcttacatgtcccaaattcacattctgctatgatgcacttcatggggtggctggagcatatgctaaaagaatttttgttgaggagctgtctgcagatgagagctcactaataaattgtattccaaaggaagattttggaggaggtcatccggacccaaatttaacatatgccaaggaactggttttgcgaatgggattgggtaaagaggctcctgcattggagccaccagagttcggtgctgctgctgacggtgatgcagatcgtaatatgattcttggaaagagattttttgtgactccatcagattctgttgcaatcattgcagcaaatgcggttgaagccattccatacttcagctctgggttgaaaggtgttgcaaggagcatgccaacatcggctgcacttgatgtggttgccaaaaatttgaatctcaagttttttgaggtgcccactggttggaagttttttggaaatttaatggacgcaggaatgtgctctgtttgtggtgaagagagctttggtactggttctgaccatattagagagaaggatggaatctgggctgttttagcatggctttcaattcttgctttaaaaaataaggacaatcttgatggtggggagcttgtctctgtggaggacatagtccatagccattgggcttcctatggtcggcactactatacacgctatgactatgaaaatgtcgatgcagctgctgcaaaggagctcatggctcatttggttaaattgcagtcttctcttcctgaagttaacaagataattaaggacgtgagaccggatgtttctgttgttgtacatgctgatgagtttgaatacaaagaccctgtagatggttctgtttccaaacaccagggtatacgctatctctttgaagatgggtctcgattggtgttccgactttccggcactgggtctgaaggtgcaactattcgattgtatattgagcaatatgaagcagatcccagcaagacaggaagaaagtcacaagatgctcttgccccactggtggaagtagctttacatctttcaaaaatggaagaatttacaggccgctcaagtcctactgtaatcacatgagttgtaggaaatgtgatagtggcgatttgtgtgttcaggtttatctggggaaaaagacacttggataaaattttccaataaaattttagagacatctgacagtgcagcaaaaatacttgatattgatatgagatatttttgcaatagaggtggtcttcctttttgtcaaggcgatggtttttataaaaaaattgaactaataaaggagtggtggttacctacgtgtaaattgttatggagcaaattcaaaggcctgaactccggg

SEQ ID NO: 7083 - DNA, 1981 bp, Nicotiana tabacum
  misc_feature (1256)..(1257): n is a, c, g, or t
  misc_feature (1265)..(1265): n is a, c, g, or t
  misc_feature (1278)..(1278): n is a, c, g, or t
  misc_feature (1280)..(1280): n is a, c, g, or t
  misc_feature (1286)..(1286): n is a, c, g, or t
  misc_feature (1293)..(1293): n is a, c, g, or t
cacacacgtccttctctcattcatcttcccctaccttcggattgacgaaaatggtgatgttcaagatcattcgcgtcgagactacgccgttcgaaggccagaagcctggtacttccggtctccgtaagaaggtgaaggtgttcatacaacctcattacttgcaaaattttgttcaggcaacattcaatgcccttggagctgacagagttaaaggtgctacgcttgtggtttctggtgatggccgctactattcaaaggatgccatccagatcattacaaaaatggcagcagcaaatggagttagacgtgtttggattggtcaaaatggacttttgtccacccctgccgtatcagctgttgttcgtgagagagtcggggctgatggttctaaagctactggggcatttatattgaccgcaagtcacaacccaggtggccctcatgaggattttggaattaagtacaacatggaaaatggtggacctgcaccagaaggtataacaaacaagatctatgagaacaccacaacattaaaggactacttgattgccgagggcctgcctgatgtggacatatctacaacaggtgtctcgagctttgagggtccagagggcaaatttgatgttgatgtttttgattcaactagcgactatctaaaattgttgaagtcaatatttgacttcccatctatccagaagttgctctcttctccaaattttagtttctgctatgatgcacttcatggtgttgctggagtacatgcaaaacgtatctttgtggcggagcttggtgcaaatgaaagctctctagtaaattgtgttcctaaggaggattttggtggagggcatcccgatcccaatctgacatacgcaaaggagttagttgcacgtatgggattgtctacaacgcattccgaacccaatccaccagaatttggggcagctgctgatggagatggggatcgtaacatgatcctggggaaaagattctttgtgactccttctgattctgttgctatcattgctgccaacgctgtacaagctattccttatttttctggaggattgaaaggagttgccaggagtatgcccacatctgctgctcttgatgttgttgctaaacatctgaacttgaaattttttgaggtacccactggttggaaattttttggtaacttgatggatgctggaatgtgttcaatttgtggagaagaaagttttggaactggctcagaccatattcgagagaaagatggnntatgggcngttttggcttggntntctatncttgccnataagaataaggataaccttgggggagaaaagcttgtgagtgttgaagacatagttcgccaacactgggcaacctatggacggcactattacactcgatatgattatgagaatgtcgatgcggctggagcaaaggagctaatggctcatttggtcaagctgcaatcgtccctcgatgaagtgaacaagataataaagggaatacattcagatgtttcaaatgtcgttcatggtgatgaattcgagtacaaggacccagttgatagttccatctcaaaacatcagggtatccggtatctgtttgaagatggctcacgattggttttccgtctctctggaactggctcagaaggcgctaccatccgtgtttatatcgagcagtacgagaaggatccatctaagatcgggagagattctcaggaagcacttgctccattggtggaggttgctattaagctgtcaaagatgcaggaattcactggccgttctgccccaactgtaataacataaatacatattgccgcatataatcctttctgtactttagaaatagtggtcctagtgtcctcattcaagggctgctggaaaatgcaccatattcaatagtcttaaaaaaaagatgcaatgtaccagttttttgtgttctgtagtgagttattttcagaatagacaagcagcgaatttatctt

SEQ ID NO: 7084 - DNA, 2178 bp, Solanum lycopersicum
gtcgcctataatagtgaatcgctctcttcgaagctccacacacatccatcactaactcatctttccaaatcttcagattgaagaaaatggcaaatttcaaggtttctcgcgtcgaaactacgccatttgaaggacagaagcctggtacttccggtctccgcaagaaggtgaaggtgttcatacaacctcattacttgcaaaattttgtccaggcaacattcaatgcacttggagctgacagagttgaaggtgctacacttgtggtttctggtgatggccgatactattcaaaggatgctatccagatcattacaaaaatggcagcagcaaatggagtaagacgtgtttggattggtcaaaatggacttttgtccactcctgctgtatcagctgttgttcgtgagagagtcggggctgatggttctaaagctactggggcatttatattgacagcaagtcacaacccaggtggccctcatgaggattttggaattaagtacaacatggaaaatggtggacctgctccggaaggtataacaaacaagatctatgagaataccacaataataaaggagtacttgattgccgagggcctgccggatgtgattatatctacaacaggtgtctcgagcttcgagggtccaaaggggaaatttgacgttgacgtttttgattcaactagtgattatctgaaattgttgaagtcaatatttgacttcccagctatccagaagttgctctcttctccaaaatttagtttctgctatgatgcacttcacggagttgctggcgtacatgcaaagcgtatatttgtggaggagcttggggcaaatgaaacctctctagttaattgtgtacccaaggaggactttggtggagggcatcccgatcccaatctgacctatgcaaaggagttagttgcacgtatgggattgtctaaaacgcattctgaaccgaatccaccagaatttggagcagctgctgatggagatggggaccgtaacatggtcctggggaaaagattctttgtgactccttccgactctgtagctataattgctgccaatgctgtacaagctattccttatttttctggaggtttgaaaggtgttgccaggagtatgcccacatctgctgctcttgatatagttgctaaacacctgaacttgaaattttttgaggtacccactggttggaaattctttggtaacttgatggatgctggaatgtgttcaatttgcggagaagaaagttttggaactggctcagaccatattcgagagaaagatggaatatgggctgttttggcttggttatctatccttgcctataagaataaggacaaccttggggaaggtaaccttgtgtctgttgaagatattgttcgccaacactgggcaacctatggacgtcactattacactcgatatgactacgagaatgtcaatgctgatggtgctaaggatcttatggctcatttggtgaagctgcaatcttccattgatgaagttaacaagttaataaagggaatccgttcagatgtttcaaatgtggtgcatgctgatgaatttgagtacaaggacccagttgatggttctgtctcaaaacatcaaggtataagatatctatttgaagatggatcacgactggtgttccgtctttctggaacagggtcagagggtgcaactatccgtctgtacattgagcagtatgagaaggattcatccaagattggtagagattctcaggaagcacttgctcccctggtggaggttgctcttaaactatcgaaaatgcaggaatacactagtcgttctgccccaactgttattacataaacaaacaaacatattctctatgctttactttctcaattgaataagtctactactctccgagatgatgataactatcaagttttcgattctgcagtcactcttctgtctggagtttgaagtgttttttgttaggatatatatatatatatttcttcttcctttaccctttcatcttgaatgactagtgtaggcattaatttcttgtccacaaattaaaatttaccaacaatcctagtatttcatttcaatctttcaacagttaaaaggtcactcaaaaattctctttattataccatgtaatatgaagctcaaaaataaataaaactcattaacaagtcta

SEQ ID NO: 7085 - DNA, 2098 bp, Festuca arundinacea
gcacgaggcactcccgatctctccaccgccagctcttcgtgccctcatcccctcctccttctcctctctctcgcgcgcagcgacggccgcgggccggcgcgcaggcagcagccatggtgttctcggtgacgaagaaggaaaccacgcccttcgacggccagaagcccggcacctccggcctccggaagaaggttacagtattccagcagcctcattacctcgcgaattttgtccagtcaacatttaatgcccttccagctgaggaagtgaaaggtgcgaccattgttgtctctggtgatggccgctatttctcaaaggatgctgttcagatcatcacaaaaatggcagctgctaatggtgtgaggcgtgtctgggttggacaagacactctcttgtctactccagctgtatctgctataatccgagaaagaattgctgctgatggatcaaaggctactggtgccttcattttaacagccagtcacaacccaggtggtccgaccgaggactttggtatcaaatataacatggggaatggcggacctgcccctgaatctgttactgataagattttctctaatacaaaaacaattaatgaatacctcattgctgaggaccttccagatgttgatgtttctgcgctaggtgttactaccttcactggacccgaaggtccttttgatgttgatgtctttgactctgctacagattacataaagctaatgaagtcaatctttgacttcgagtcaattaaaaagcttctggcatctccaaagttctctttctgttttgatggccttcacggtgttgctggagcttatgcaaagcgcatgtttgtggatgagcttggtgctagtgaaagctcactcttgaactgtgttccaaaggaggactttggtggtggtcatccggatcctaacctcacctatgcaaaagaattggttgaacggatgggtcttgggaagtcaagctcaaatgttgagccccctgaatttggtgctgcagctgatggagatgctgaccgtaacatggttctgggtaaaagattcttcgtgacgccatcagattctgttgccattattgcagccaatgctgttcaatcgattccttactttgcttctggcctgaagggagttgccaggagcatgccaacatcagctgcccttgatgtagttgcaaagaatttgaatctcaagttcttcgaggtgcctaccgggtggaaatttttcgggaacctgatggatgctggaatgtgctcagtttgtggtgaagaaagctttggcactggttctgaccacattcgcgaaaaggatggtatttgggctgttctagcatggctatctattctagcttacaagaacaaggacaaccttggaggagataagcttgttactgttgaagatattgttcttcagcactgggctacttatggtcgccattattacacacgatatgactatgagaatgttgattcagaagctgctaaggaacttatggcaaacctagtcaagctgcagtcgtccctgtctgatgttaacaagttgatcaaggaaatccagcctaatgtagcggatgtggtctccgctgacgagtttgagtataaggatcctgttgatggctctgtctccaagcatcagggtatcagatatctctttggagatggttcccgactggtgttccgcctttcgggaactggttcagttggtgctactattcgtatctacattgagcagtacgagaatgattcatccaaaactgggagggagtcttcggatgctctttccccactggttgatgtcgcgctgaagctttcgaagattcaggagtacactggccgatctgccccaactgtgatcacataaattttgacttagatacgtgccgaggccgcttatgcagttccgttctggcctcctgttcgatagctttttttacatctcacacatgaataaattgtatgtaccagaccgtccctgtttcgttgcctatactgcacacactgctgctggtacagtatgcggccgtaatgttgtcacagtgatgtaatcgagagtgaattcttcaagcgatatattgacgtgtgtttttttggtcgagt

SEQ ID NO: 7086 - DNA, 2305 bp, Saccharum officinarum
cgagggagaactacggaatcggaatgatccatcctcttgtgctatccctgcactcccccgctataatatcgccgcgccctcgtcgccatcgtcaccacaccaccactcctccctctctgccctctcactcccgatccctccaccaccaccgcttcctccgcgtcacccctctcgtcgcctcgcgcggcgaccagcggcggatcgtccgcggcgcaaccatggggctcttcactgtgacgaagaaggtcaccacgcccttcgaaggccagaagcccggcacctccggcctccgcaagaaggttactgtattccagcagcctcattatctgcagaactttgtccaatcaacattcaatgcccttcctgcggaccaagttaaaggtgcaaccattgttgtctctggtgatggccgctatttctcaaaagatgctgttcagatcataacaaaaatggctgctgccaatggagtaagacgtgtttgggttggactaaacagtctcatgtctactcctgctgtatctgctgtcatccgtgaaagaattggtgcagatggatcaaaggctactggtgccttcatcttgacagcgagccataacccaggtggtcctacagaggacttcggtatcaaatacaatatgggaaatggtggacctgcccctgaatccgttaccgacaagattttctctaatacaacgacaatatctgaatacctcatctctgaagaccttccagatgttgatatttctgttgtcggtgtcaccagcttcagtggacccgatggcccctttgatgtggatgtctttgactctagtgtagattacataaagttaatgaagacaatttttgactttgaagcaataaaaaagctgctgacttccccaaagtttacattctgttatgatgcgctccatggtgttgctggagcttatgccaaacacatctttgtggaagagcttggtgctgatgaaagctctctgttgaattgtgtcccgaaagaggactttggaggtggtcatccggatcctaacctcacctatgcaaaagagttggttgaacggatgggtcttggaaagtcatcctcaaatgttgagccccctgaatttggcgctgcagctgatggagatgctgatcgcaacatgattctgggtaaaagattctttgtgacaccatcggactctgttgccattatcgcggccaatgctgtacaatcaattccttactttgcttctggcctgaagggagttgccaggagcatgccaacatctgccgcccttgatgttgttgcaaagaatttgaatctcaagttctttgaggtgcctactgggtggaagttttttgggaatttgatggatgccggaatgtgctcaatctgtggtgaagaaagctttggcactgggtctgaccacattcgtgagaaggatggcatctgggctgtgcttgcatggctttctattattgctttcaagaataaggacaaccttggaggagataagcttgtcagtgttgaagatattgtccgtcagcactgggccacatatggtcgccattattacacacgctatgactatgagaatgttgacgcgggggctgctaaggagcttatggcaaacctagtaagcatgcagtcatcactttctgatgtcaacaagctgatcaaggagatccggtctgatgtttctgaagtagttgcagctgacgagtttgagtacaaggatcctgttgatggctctgtgtccaagcaccagggcatccgatacctcttcggagatggttcacgactggtgttccgcctctctggaaccggttctgttggtgccaccatccgtgtctacatcgagcagtacgagaaggattcctccaagaccggcagggattcacaggatgcccttgctccgctggttgatgttgcgctcaagctctccaagatgcaagagtacactggccgctctgccccgaccgttatcacataaaaattttgaagaatgttttagaatgagttgaggcggttacacaaactctcattccggcctcttgttccatagtttttctttcctgttgcatctcaccgatgaataaaatgtatgtatcagactcgcctcgtttttttgcccatactgcagagtaagccgctggcacagcatgcggtaataatcttgtcacagtgttgtaattgggagcgtgtttcttctaatcttgtttttctttgaaaagcttcgtctaatcttgttagaagtgtttctggtttgtttgagcatctgcgtatcatttttttcgttctgaagagaataaaaatatcttactcacc

SEQ ID NO: 7087 - DNA, 2286 bp, Hordeum vulgare
cgagcaaccgaaccgaatgattccgctgtgcgcaccctccacacccgctataatagcgccacgccctcgtcgccttcgtcaccgcaccaccactccctccccacctcactcccgatccccccaccaccgcggccacctccacctcgcgtcctcctcctcgtcggcgcaccgcccccgacccctcgcgcgcgcgcagcggccaggcgccgtcgtcactgcggcggacatggtgttctccgtgaccaagagggacaccacgccctacgagggccagaagcccggcacctccggcctccggaagaaggttacagtattccagcagcctcattaccttgcgaatttcgtccaatcaacattcaatgcccttccagctgaccaagtaaaaggtgccaccattgttgtctccggcgatgggcgctatttctcaaaggatgctgttcagatcatcgcaaaaatggctgctgctaatggagtaagacgtgtctgggttggacaagacagtctcctgtcaactccagctgtatctgctatcatccgtgaaagaatttctgcagatggcgcaaaggctactggtgccttcattttaacagcaagccataacccaggtggtccaaccgaggactttggaatcaaatacaacatggagaatggtggacctgcccctgagtctgttaccgataagatcttctctaacacaaagacaattactgaatacctcatcgcggaggaccttccagatgttgatatttctgtgacaggtgtcacttccttcactggacctgaaggcccttttgatgtggatgtcttcgactctgctacagattacatcaagctaatgaagacaatctttgacttcgagtctattaagaagcttctggcatctccaaagttctcgttctgttttgatggccttcacggtgttgctggagcttacgcaaagcgcatttttgtggatgagctcggtgccagtgaaagctcactgttgaactgtgttccaaaggaagactttggtggtggtcatccggaccctaacctcacctatgcaaaagaactggttgatcggatgggtcttgggaaaacctcaaatggtgaaccccctgaatttggtgctgcagctgatggagatgctgaccgtaacatggttctgggtaaaaggttcttcgtgacaccatcagattcggttgccattattgcggccaatgctgttcaatcaattccttactttgcttctggcctgaagggagttgccaggagcatgccgacatcagctgcacttgatgtagttgcaaagaatctaaatctcaagttctttgaggtgcctactgggtggaaattttttggaaacctcatggatgctggaatgtgctcagtttgtggtgaagaaagctttggcactggttctgaccacatccgtgaaaaggatggtatttgggctgttctagcatggctatctattctagcttacaagaacaaggacaaccttggaggagataagcttgttactgttgaagacattgttcttcagcactggggtacttatggtcgccattattatacacgatatgactatgagaatgtcgatgcagaagctgccaaggaactcatggctaacctagtcaagatgcaggcgtccctgcctgatgttaacaagtcgatcaaagagatccagcctgctgttgcagatgtggtctcggctgatgagtttgagtacaaggatcctgttgatggttctgtctccaagcatcagggtatccggtatctctttggagatggttcccgactggtgttccgtctttctggaactggttcagttggtgctactatccgtatttacattgagcagtatgagaaggattcttccaaaaccgggagggagtcaagtgacgctctttctccactggttgatgtggccctgaagctttccaagattcaggagtacaccggccgatccgcccccacagtgatcacataaattttgacctagatatgtgccgaggccgcgtatgaagttcggttcctggcctcccctgttcgatagcctttttttacatctcatctcccttacatctgaataaatgtatgtgccagaccgtccccgtttcgttgcctatactgcatactctgctgtgctgccggtacagtatacggccgtaatcttgtcacagtgattgtaatcaagagtgcgtttcttcatgcaatatattgacgtgttccttttttttgccgaggattcgtgtaccaatcttatcttgaacatccaaaaggaaaacatgaaaaacgtagcag

SEQ ID NO: 7088 - DNA, 2137 bp, Mesembryanthemum crystallinum
gtttataatccatcactctacctcacttcttcactcatcatcgttctcaccacctcgacatctctcacctgcaattgaggaagaaaaatggcgacgttcaaggtttctcgcgttgagactaagccttacgatggccagaaaccaggaacttctggtcttaggaagaaggtgaaagtgtttgcacaacctcattacttggaaaattttgtccagtctacttttgatgccctcacagctgacaaaatcaaaggtaaaacacttgttgtttctggtgatgggcgttattactcggaacaggctattcagacaattatcaagatgtctgctgcaaatggagtgaaaagtgtttgggttggtcaagatggattactttcaacacctgctgtgtctgctgttatacgtgaaagagttgggaaagatggatctaaggcatctggagcattcatattgactgcgagtcacaatccaggtggcccaaatgaggattttggaatcaaatataacatggaaaatggtggaccagctcaggagggagttacaaacaaaatttatgagaacaccactaccataaaggagtacttgattgccaaagagttgccgaatgttaatatttcaaaaacaggcgtgactagcttctcagggcctgatggacaatttgacgttgaagtatttgacgcaactgagacatatgtgaaattgatgaagtccatttttgatttccaagctattaagaagctgttgtcgattccgagtttcacattctgctatgatgccctccatggagttgccggtgtttatgccaagcgcatctttgttgatgagcttggtgccaatgaaagttccctgttgaattgtacacccaaggaagattttggtggagggcatcctgatcccaacttgacttatgctaaggagttagtggaacgtatgggattgggtaagtcaaacactcaaggtgaaccacctgaatttggtgctgctgctgatggtgatgctgatcgtaacatgatcctgggtaaaaggttctttgtgaccccttcagattctgttgctattattgctgctaacgctgttgaagcaataccatacttttctggtggtctaaagggagttgctaggagcatgcctacttcagccgctcttgatgttgtagcaaaacatcttaatttgaagttctttgaggtgcccactggctggaagttttttggtaatctaatggatgctggagtatgctcaatttgtggtgaagagagtttcggaactggctctgatcatgttcgtgaaaaggatggaatatgggctgttttggcttggttgtcaattcttgctcacaaaaacaaggataatctcaatggagagaagcttgtaactgttgaagatattgtttgccagcactgggctacatatggtcggcactattatacaagatatgattatgagaatgtggatgcgggtggagcaaaagaacttatggcatatttggtcaatctgcaatcagacctttctaaagtgaacaacattgtgaagggagtacattcaggtgtagccaatgtgatagctgccgatgagtttgaatacaaagatccagttgatggttcagtttcaaagcatcagggcattcgatacatgtttgaagatgggtcacgactgattttccgtctctctggaactggttcagaaggtgcaaccatccgtctgtacatcgagcaatatgaaaaggactcctcaaaaactggcagagattcccaggaagcacttaaacctcttgttgacgttgctctcaagctttccaagatgcaggagttttctgggaggtctgagccaactgttattacataagctggagcctttctggatgcaatgcccattaaaattttattttgtttgacgtgggtgtccttgttaaagggaatgtgacttttggactactcataagttgagcttagtgctttgatagagaatgatgtaaaataaaaagttgctatgggaaaaaaggttggggttgagggggatagttttcacctttgacatttcctgtgctggttatataaatggtaaagacaattactcgaacatttcgacgtgatggtatcaatgagttttgaagtcgttaaagaattatcattggttcatcgat

SEQ ID NO: 7089 - DNA, 1850 bp, Malus domestica
cacacttcgtcaccttccagttccgttataaatctctctttctttctctctctaaactccaatctccgatctctctttctctctctacctctctctgtgatttgaatcgcgttttgttctcagcgagcagaatgtcgtcggggcaggttaggaaggtggagacgacgccgttcgatggccagaagcccggaacctctggcctccgcaagaaggtgaaagtttttacgcaacctcattacttgcaaaattttgttcagtcaacattcaatgcccttccatcggatcaagttaaaggtgctagacttgttgtatctggtgatggtcggtatttctcaaaggatgccattcagatcattattaagatggcagcaggcaatggagtaagaagtgtttgggtcggtcagaatgggttgctttcaacccctgctgtgtcagctatcgtacgtgaaagagttggtgcagatggatcaaaggcatcaggagcatttatactgaccgccagtcacaatccaggtggcccaaatgaggattttgggattaaatacaacatgggaaatggtggacctgctccagagtcaatcaccgacaagatatatgagaacacaacaaaaataaaggagtattttacagtcgacctacccgatgtggatatcactgaagtaggtgtcaccaccttttcggtggacggtggaacttttgatgttgatgtttttgattcggcaagtgattatgtgaaattgatgatgtcaatctttgatttcgagtctatccggaagctgctatcatctccaaaattctcattctgttatgacgcgcttcatggagttgctggagcttatgcaaaacgtatttttgtggaagagcttggtgcaaaagaaagctcattactgaactgtgtacccaaggaagactttggaggagggcatccagatcctaatctgacctatgcaaaggagttggttgcacgtatgggactgggtaaatcaaatactgcagatgagcccccagagtttggtgctgctgctgatggtgatgctgatcgtaacatggtccttggtaaaaggttttttgttaccccatcggattctgtagccatcattgctgcaaatgcagttgacgccataccttacttcaaaactggtctgaaaggagttgccaggagcatgcctacctctgctgcccttgatgttgtagccaaacatttgaatttgaagttttttgaggtacctactggctggaaatttttcggtaacttaatggatgctggtttatgctcagtttgtggggaagaaagttttggaacaggttccgaccatatccgtgagaaagatggtatctgggcagttttagcttggttatccatacttgcttataaaaataaggaaaatcttggcggggagaagcttgtcagtgttgaggacatagttcgtaagcattgggctacctttggtcgccattattatacacgatacgactatgagaatgtggatgcaggtaaagcaaaggaactgatggcttctttggtgaaattgcaatctgatctttctgaagtcaacaagattgtgaagggcttacactctgatgtttccaatgttgtcaacgccgatgaatttgagtacaaggatcctgttgacggttccatctcaaaacaccaggggatccggtacttgtttgaggacggatcacgattggttttccgcctctcaggaaccggctcagaaggtgccacaatccgactctacattgagcagtatgagaaggatccatcgaaaatcagcagagaatcctcagaagcacttagtcctcttgtggaggttgcccttaagctttcgaagatgcaagagttcacc

SEQ ID NO: 7090 - DNA, 2241 bp, Triticum aestivum
aaaaataaggaaaaaaaggaggagcgaaggcgagcaaccgaatgattccgctgtgcgcatcctcctccccgtccacacccgctataatagcgccacgccctcgtcgccttcgtcaccgcaccaccactccctccctacctcactcccgatccccccaccgccacctcctcctcgcctcgccctcctcgcccgctccgaccccacgccccctcgcgcgcgcgcagcggctcgccgccgcggccacggcagcggagatggtgttctccgtgacgaagaaggagaccaagccctacgagggccagaagcccggcacctccggcctccgcaagaaggttacagtattccagcagcctcattacctcgcgaatttcgttcaagcaacatttaatgcccttccagctgaccaagtaaaaggtgccaccattgttgtctccggcgatgggcgctatttctcaaaggatgctgttcagatcattgcaaaaatggctgctgctaatggagtaagacgtgtctgggttggacaagacagtctcttgtcaactccagctgtatctgctatcatccgtgaaagaatttctgcagatggcgcaaaggctactggtgccttcattttaacagccagccacaacccaggtggtccaactgaggactttggaatcaaatacaacatggggaatggtggacccgcccctgagtctgttaccgataagatcttctctaatacaaagacaattactgaatacctcattgcggaggaccttccaaatgttgatatttctgtgacaggtgtcacttccttcactggacctgaaggaccttttgatgtcgatgtctttgactctgctacagattacatcaagctaatgaagacaatctttgactttgagtctattaaaaagcttctggcatctccaaagttctcgttctgttttgatggccttcacggtgttgctggagcttatgcaaagcgcatgtttgtggatgagctcggcgccagtgaaagctcactgttgaactgtgttccaaaggaagactttggaggtggtcatcctgaccctaacctcacctatgcaaaagaactggttgagcggatgggtcttgggaaaacctcaaacgctgacccccctgaatttggtgcggcagctgatggagatgctgaccgtaacatggttctgggtaaacgattctttgtgacaccatcagattcggttgccattatcgcagccaatgctgtccaatcaattccttacttcgcttctggcctgaagggagttgccaggagcatgccaacatcagctgcacttgatgtagttgcaaagaatctaaatctcaagttctttgaggtgcctactgggtggaaattttttggaaacctgatggatgctggaatgtgctcagtttgtggtgaagaaagctttggcacgggttctgaccacatccgtgaaaaggatggtatttgggctgttctagcttggctatctattctagcttacaagaacaaggacaaccttggaggagataagcttgttacggttgaagacattgttcttcagcactgggctacttatggtcgccattattatacacgatatgactatgagaatgttgatgcagaagctgccaaggaacttatggctaacctagtaaagatgcagtcgtccctgtctgacgttaacaagtcgatcaaggagatccagcctactgttgcagatgtggtttcggctgatgagtttgagtacaaggaccctgttgatggttctgtctccaagcatcagggtatccggtatctctttggagatggttcccgactggtgttccgcctttctggaactggttcagttggtgctactatccgtatttacattgagcagtatgagaaggattcttccaaaaccgggagggagtcgagcgatgctctttctccactggttgacgtggccctgaagctttcgaagatccaggagtacaccggccgatctgcccccacggtgatcacataaattttgacctagatatgcgccgaggccgcgtatgaagttcagttctggcctcctgttcgatagcttttttttttacatctcccttgcacctgaataaatgtatgtgccagaccgtccttgtttcgttgcctatactgcatactctgctgctggtacagacgtacagtgtatggcagtaatcttgtcgcagtgattgtaatcaagagtgtgtttcttcatgcaatatattgacgtgtttctt

SEQ ID NO: 7091 - DNA, 2288 bp, Triticum aestivum
cgagccaccgaatgattccgctgtgcgcatcctcctccccctccacgcccgctataatagcgccacgccctcgtcgccttcgtcaccgcaccaccactccctccctacctcactcccgatctccccaccgccacctcgtcctcgcctcgtcctcgcccgctccgaccccccggcccctcgcgcgcgcccaccggcccggcgccgtggccacggcagcggagatggtgttctccgtgacgaagaaggagaccaagccctacgagggccagaagcccggcacctccggcctccgcaagaaggttacagtattccagcagcctcattacctcgcgaatttcgttcaatcaacatttaatgcccttccagctgaccaagtaaaaggtgccaccattgttgtctccggcgatgggcgctatttctcaaaggatgctgttcagatcattgcaaaaatggctgctgctaatggagtaagacgtgtctgggttggacaagacagtctcttgtcaactccagctgtatctgctatcatccgtgaaagaatttctgcagatggcgcaaaggctactggtgccttcattttaacagccagccacaacccaggtggtccaaccgaggactttggaatcaaatacaacatggggaatggtggacccgcccctgagtctgttaccgataagatcttctctaatacaaagacaattactgaatacctcattgcggaggaccttccaaatgttgatatttctgtgataggtgtcacttccttcactggacctgaaggcccttttgatgtcgatgtctttgactctgctacagattacatcaagctaatgaagacaatctttgacttcgagtctattaaaaagcttctggcatctccaaagttctcgttctgttttgatggtcttcacggtgttgctggagcttatgcaaagcgcatgtttgtggatgagctcggcgccagtgaaagctcactgttgaactgtgttccaaaggaagactttggaggtggtcatccagaccctaacctcacctacgcaaaagaactggttgatcggatgggtcttgggaaaacctcaaatgttgaaccccctgaatttggtgccgcagctgatggggatgctgaccgcaacatggttcttggtaaaagattcttcgtgacaccatcagattcggttgccattattgcggccaatgctgttcagtcaattccttactttgcttctggcctgaagggagttgccaggagcatgcccacatcagctgcacttgatgtagttgcaaagaatctaaatctcaagttctttgaggtgcctactgggtggaagttttttggaaacctgatggatgctggaatgtgctcagtttgtggtgaagaaagctttggcacgggttctgaccacatccgtgaaaaggatggtatttgggctgttctagcttggctatctattctagcttacaagaacaaggacaaccttggaggagataagcttgttacggttgaggacattgttcttcagcactgggctacttatggtcgccattattatacacgatatgactatgagaatgttgatgcagaagctgccaaggaacttatggctaacctagtcaagatgcagtcgtccctgtctgacgttaacaagtcgatcaaggagatccagcctactgttgcagatgtggtctcggctgatgagtttgagtacaaggaccctgttgatggttctgtctccaagcatcagggtatccggtatctcttcggagatggttcccgactggtgttccgcctttctggaactggttcagttggtgctactatccgtatttacattgagcagtatgagaaggattcttccaaaaccgggagggcgtcgagtgatgctctttccccgctggttgatgtggccctgaagttttcaaagatcaaggagtacaccggccgatccgcccccaccgtgatcacataaattttgacctagatatgcgccgaggccgcgtatgaagttcatttctggcctcatgttcgatagccttttcttacatctcccttcacacctgaataaatgtatgtgccagaccgtctccgtttcgttgcctatacttactctgctgccggtacagtatatggccttgatcttgtcccagtgattgtaatcaagagtgcgtttcttcgtgcaatgcaatatattgacgtgtttcttttttcatcgaggactcgtaccaatcttatcttgaacattcaaaggaaaacaggaaaacataggaatttctgaaggaaaaaaaaaaaa

SEQ ID NO: 7092 - DNA, 1763 bp, Flaveria ramosissima
taatggcgaatttcaaggttactcgcgtcgaatcatcgccgattgaaggccaaaagcctggcacatctggactcaggaagaaggttaaagtattcacccacccacattacttgcataatttgttcaatcgacgttcaacgcctttctgtcgtgaaagttaaaggttctacgcttgttgtttctggtgatggacggtactactcaaaggaggcaatccagattataattaaaatggcagctgcaaatggtgtaaggcgcatttgggttggccagaatggacttttatccacacctgctgtatcagcagttgtacgtgaacgagttggcgctgatggttccaaagcaaatggggcattcatattgacagctagtcacaaccctggtggtcccaatgaggattttggaataaaatacaatatggagaatggtgggccagcacctgaaggaattactgataaaatctttgagaacactaaaacaataaaggagtattttatctcagaagacctacctgatgtggatatctcagcaatcggaatttcaaactttacaggtcctgatggtcagtttgatgttgatgtttttgactcagcaagcgactacgtgaagttgatgaagtcaatctttgacttccagtccatccaaaagttaattgcatctccacaatttagtttctgttatgatgcattgcatggagttgctggagcttatgctaaacgtatatttgttgaagagcttggtgcaaagtagagttcattattgaactgtgttcccaaggaggactttggtggaggacatcctgatcccaacctaacctatgcaaaagagttggtagcaagaatgggattgggtaaaaaccctgatagcaacccaccagaatttggtgctgctgctgatggtgatgctgataggaacatgatccttggtaaaaggttttttgtcacaccttcagattctgttgctatcattgctgccaatgcagtccaagccataccctacttttcatctggattaaagggtgttgccaggagcatgccaacatctgctgctcttgatgttgtagctaaaagtctgaaccttaagtttttgaggtgccaactggctggaaattctttggtaacttgatggatgctgggctatgttcagtttgcggtgaagaaagttttggaactgggtcggatcatatacgtgaaaaggatggaatttgggctgtgttagcttggttatccatccttgctcataaaaacaaggataacctcaatggtgggaacctagtgactgttgaagatatcgtgaagcaacactgggctacttttggacgccactattatactcgctatgattatgagaatgtcgatgcaggtgctgcaaaggaagttatggctcacttggtcaagctgcaatcctctatcagtgatgttaacaataccataaagggaatgcggtcagatgtggcagatgttgtcagtgctgatgaatttgaatacaaagatccggtagatggttcagtctctaaaaatcagggaattcgttatttatcgaagacgggtcacgcctggtttccgtttatctggtaccgggtcagaaggtgccacaattcgtctctacatcgagcaatacgaaaaggttcataccaaaactggaagagattctcaagaagcacttgctccttgtgatgtgcaactaaagctgtacaaagatagaaagaattacacgtggtccgttctacgccccgactgtgatcactaataaatatatatact

SEQ ID NO: 7093 - DNA, 2145 bp, Picea glauca
  misc_feature (397)..(397): n is a, c, g, or t
  misc_feature (2102)..(2102): n is a, c, g, or t
ccccccccccccgactcctcccttctcctccagaatcccataatcaaaccctcgcgcgttgtattttcgttgtgtatacttcgtactattacctaccaggcgaagctagaaaaatggtgatttttagcgtaaataagaaggaaacctcaccttacgatggacaaaaaccaggaacatctggcctcaggaagaaggtcacagtcttcaagcaacagaattacttgcacaattttgttcaagcaacttttgatgcactgtcagtggagaaaataaaaggttccacaattgttgtctctggtgatggccgctacttttcagaagaggctattcagataataataaaaatggcagctgcaaatggagtgaggcgtgtttgggtaggccaaaatggactgcnttcaacacctgcagtttcagcagttatacgcaatagaattggagcagatggagaaaaggcatcaggatcttttatattgacggctagccataatgcaggaggtccaaatgaggactttggaataaagtacaacatggaaaatgggggaccagctcctgaagggattactgacaagatatacgagaatactaagacaataaaggagtattttactgcagaagatctcccagacgtagacatttcaaccataggcataacaacatttggtggccccgagggaccttttgctgtggatgtctttgatcccactgaagattatgttaaattgatgaagactatatttgactttgaagctatccaaaagctgcttacatgccccaaattcacgttctgttatgatgcacttcatggagtggctgggatatatgccaaaaggatttttgtggaggagctgtctgccagtgagagctcattattaaattgcactccaaaggatgattttggaggaggtcatccagacccaaatttaacatatgccaaggaattggttgcacggatgggattgggtaaacaagctcctggttcagaaccaccagagtttggtgctgctgctgatggtgatgcagatcgtaatatgattcttggcaagaggttttttgtgactccatcagattctgttgccataattgcagcaaatgcagttgaagccattccatacttcagctctggattgaaaggtgttgcaaggagcatgccaacatcggctgcacttgatgtagttgcaaaaagtctgaatctcaggttttttgaggtgcccactggctggaagttttttggaaatttaatggatgctggaatgtgttctatttgtggtgaagagagttttggcactggttctgaccatatccgagagaaggatggagtctgggcagttttagcatggttttcgattctagcttacaaaaataaggataaccttgatggcgggaagcttgtcactgtagaggacatagtccgtaaccattgggcttcttatggtcgccactattatacacgttatgactatgaaaatgttgatgcaggtgatgccaaggagctcatggcacatttgattaagctgcagtcttctctcccagaagttaacaagttaattaaggaagtgagtccagatgtttccgatgttgtgcatgctgatgaatttgaatacaaggatccggttgatggttctgtttccaaacaccagggtgtacgctatcttttcgaagatggatctcgactggtgttccggctttctggcactgggtctgtaggtgcaaccattcggttgtatattgagcaatatgaagcagattccaccaagatcggcagagattcacaagaggctctgggtcccttggtggaagtagctctacaactttcaaagatggaagaatttactggccgctcgagccctactgtaataacatgagttataggaaatattatgaatacagtagagaagtttaggcttatcttttgaggaatagatcatgatcaagctttccaataacatgatcaagctttccaataaagttatcttacatctgattgataaacagaatatactatgtattattgtgacacatttttgcaatagagaaaattttgcgaaaattttataaaatccttgaagatggttctgagatggttctgctcctaactgcanaatagctttgtcaatctagactaaaataagcttttgtttacga

SEQ ID NO: 7094 - DNA, 2386 bp, Podocarpus macrophillus
gcgctcacattctatagtgtgctcattgtgtaaataaattcgcgtcgatctaatcaggtgaaggataggatggtgatcttcagcgtgactcggaagcaaaccactccctacgatggacaaaagccagggacatccggcctccggaagaaggttaaagtcttcaagcaagagaattacttgcataactttgttcaagctactttcggtgcactgtcacctgagaaagtgaaaggtgctacaattgttgtgtctggggatggacgctacttttcagaagaagctattcagataataataaaaatggcagctgcaaatggagtaaggaatgtttgggtaggccaaaatggactgctttcaacacctgcagtatcagcagttattcgtaacagaattggtgcagatggagaaaaagcatcaggagcttttatattaacagccagccacaacccaggaggtccacatgaggattttgggataaagtataacatggaaaatgggggaccagcaccggaagggattactgacaaaatataccagaatactacgacaattgaagagtactttatttcagaagatcttcctgatgttgacatatcgattataggaaaatcaagttttggtggccctgagggaccttttagtgtggatgtcttcgattctactgaagattatgttaaactgatgaagacaatctttgactttgaaaccattcgaaagctgcttacatgtcagaaattcacattctgctatgatgctcttcatggggtggctggaatatatgctacaagaatttttgttgaggagctgtctgcagacgagagttcattaataaattgcgttccaaaggaagattttggtggaggccatccagatccaaatttaacatatgccaaggaactagttcagcgaatgggattgggtaaagaaggtactgcttcagagccacctgagtttggtgctgctgctgatggtgatgcagatcgcaacatgattttgggaaaaaggttttttgtgaccccatcagattctgttgcaattattgctgcaaacgctgttgaatccattccgtacttcagctctgggttgaaaggtgttgcaaggagcatgccaacatcggctgcgctagatgtagtcgccaaaagtttgaatctcaagtttttcgaggtgcccactggttggaagttttttggaaacttaatggatgctggactgtgttctgtttgtggtgaagagagctttggcacaggatctgaccatattagagagaaggatgggatctgggctgttttagcatggctttcgattcttgcttataaaaataaggataacctggatggtggaaagcttgtcactgtggaggacatagtccgtaagcattgggcttcatatggtcgtcactattatactcgttatgattatgagaatgtagatgcagctgctgcaaaggaactcatggcttacttggtgaagctgcagtcttctctttctgaagttaacaagataattaaggaagtgagaccggaaatttctgatattgtacatgcggatgaatttgaatacaaagatcctgtagatgattctgtttccaaacaccagggtatacgctacctattccaagatggatctagattggttttccggctttccggcacggggtctgtgggtgcaactattcgcctgtacattgaacaatatgaagctgattcaaccaagataggaagagattcgcaggaggctcttgcacccctggtggaagttgctttatatctttcaaagatggaggaattcacaggccgatcaagtcctactgtaatcacatgattcgttggaaatgtgatgaaggtgataaatgtgttgaggcttttttggtgaacaaaggacatctggataaatttttgcagttaagttaccatcatgtgtgtgacactatgtgacacattctcacaataaaggaagatgcctttttgaaacaatcttaatgagagccatttcaatttaatcaacatgggtctgggatattttccggtcctgtgaatgcgcatattatgcacattattttattttatgttctaattcttgcactacaaacatttggagaaattaggttcaggaaagagtcgctttggttttgttttgttatcggctgtgtatctgaaggtgcagaagaaaaatgtctagaaaaagaatttacaggtttacttccatttgatgttttcttattttgaaagatgtatcttgagacagtatccttgtgttcaaaagttccccgattcctggaggactaccgactttatacgcagtattagctgttgaaacttataacttgagtgaacttgaagttgcgtaaaatactaatattaatggattctgcagatgattggcagac

SEQ ID NO: 7095 - DNA, 1979 bp, Zostera marina
ttcgttggctgcgttctcccggttctcccccttttccccttaatctgtcttctgttagatctcccagaaatggtgttccaggtctccaagaaagagacggtgcccatcgaaggccagaagccgggaacctccggccttagaaagaaggttgtagtattcaaggagccaaattatctacataatttcgttcaatcaacatttgacgcacttccagctgatcaagtaaaaggtgctactattgtggtttccggggatggtcgttatttctcggaagatgctattcagatcatagtaaaaatggctgctgcaaatggtgtaaggtctatttggattggggaaaatgggctgctatcaacacctgctgtatctgctattatacgtgaaagaattgctgcagatggatcaaaagcttcaggtgctttcattttgacagcaagtcacaatccaggtggaccacttgaggattttggaatcaagtataatatgggaaatggtggccctgctcccgaatccataacagacaaaatttatgccaatacaaagacaatcacagaatatcttattgcagaagatctacctgatgtgaatatatctgtatcaggtgtcacaagctttgacggtcctgatgggaagtttgatattgatgtttttgactcagctgatgaatatgtaaagttgatgaagaaaattttcgattttgcttccattcgaaatcttctgtcctcgccgaagttcacattctgttatgattctcttcatggagttgccggagcttatgccagcagaatatttgttgaagaacttggtgctaaagaaagttcattgattaattgcatcccaaaggaagactttggaggtggacatccagatcccaacttgacctatgcaaaggaactagttgcacgaatgggattgggaaagtcaccttcacaagatgagccaccagagtttggagctgcagctgatggtgatgctgatcgtaacatgatccttggtaaaagattttttgtgaccccatcagactctgttgccattattgctgcaaatgcagtccaagctatcccttatttcagctcggggctaaagggtgttgcgaggagtatgcctacatctgccgcactcgatgttgttgcaaagaatctaaatctgaaatttttcgaggtacctactggttggaaattttttggtaacttgatggatgctgggatgtgttcagtatgtggtgaagaaagctttggaactggttctgatcacatccgagaaaaggatggtatttgggctgttttagcttggctttctataatcgcttacaaaaacaaggacaatgatggggggaaacttgtcacggtagaagacatagttcttcaacattgggccacttatggtcgtcattactatactagatatgattatgaaaatgttgattcagatgcggcaaaaaatttgatggctcatttggtgaagctgcaatcttcccttcctgaagtcaacaagatgattaaagaaacaaggcctgaggttgctgatgttgtcgaagcagatgagtttgaatacaaggatcccgttgacggttctatctcaaagcaccagggaattcggtttctgtttgaggatggatctagattggtactccgtctctctggtactggttctcaaggtgctacaatccgtgtgtacatagaacagtatgaaaacgacccattgaagacagggagggattctcaagaggcccttgctcctcttgtggaagtggcactaaagctatctaatatgcaaggatttacaggaaggtccgaaccaaccgtgatcacatagatttttgaaatggaaaaattgtgttggtctgttctataatttcccggttaatcatcaatctatgtttagtagtcatgtggcaaagatatgagaaattgatgagagtcaaagctttatttaatcatgttacaatgttccttaaataaatcaaataaataaatgaa

SEQ ID NO: 7096 - DNA, 2179 bp, Brachypodium distachyon
accgcatcaccactccctccccacctcactcccgatctctcctccaccgccaccgcctcctcgcgtcctcatcccctgctcctcgactcgcccgcgctcgtcgtcggcggcggctcggcgcgcagccagcagacatggtgctcttcacggtgtcgaagaaggacaccaagcccttcgacggccagaagcccggcacatcaggcctccggaagaaggttacagtattccagcagcctcattacctcgcgaattttgtccagtcaacatttaatgcccttccagcagacagagtaaaaggtgcgaccattgttgtctccggtgatggccgctatttctcaaaggatgctgttcagatcatcacaaaaatggctgctgctaatggagtaagacgtgtctgggttggacaggacagtctgttgtctactccagctgtatctgctatcatccgtgaaagaattgctgcagatggatcaaaggctactggtgccttcattttaacagccagccacaacccaggtggtccgaccgaggactttggaatcaaatacaatatggagaacggtggacctgctccggaatctgtcactgataagattttttctaatacaaagacaattactgaatacctcatttctgatgaccttccagatgttgatatttctgtgataggtgtcactaccttcagtggacctgaaggcccttttgatgtcgatgtctttgactctgctacagattacataaagctaatgaagacaatttttgactttgagtcaattaaaaagcttctggcatccccaaagttctcgttctgttttgatggccttcatggtgttgctggggcttatgcaaagcgcatctttgtggatgagcttggtgctagtgaaagctccctgctgaactgtcttccaaaggaagactttggtggtggtcatccggatcctaaccttacctatgcaaaagaattggttgatcgtatgggtcttggaaagtcaacttcaaatgttgaaccccctgaatttggtgctgcagctgatggagatgctgaccgtaacatggttctgggtaaaagattcttcgtgacaccatcagattcggttgccattattgcagccaatgctgttcaatcaattccttactttgcttctggcctgaagggagttgctaggagcatgccgacatcagctgcccttgatgtagttgcgaagaatttaaatctcaagttctttgaggtgcctaccgggtggaaatttttcgggaacctgatggatgctggaatgtgctcagtttgtggcgaagaaagttttggcactggttctgaccacattcgtgaaaaggatggtatttgggctgttctagcgtggttatctatcctagcttacaagaacaaggacaaccttggaggagataagcttgttactgttgaagatattgttcttcagcactggggcacatatggtcgccattattatacacgatacgattatgagaatgttgacgcagaagctgctaaggaacttatggcaaacctagtcaagatgcagtcatctctgtctgatgttaacaagttgatcaaggagatccaaccacatgtttcagatgtggtctcggctgacgagtttgagtataaggatcctgttgatggctctgtctccaagcatcagggtatcagatatctctttggagatggttcccgactggtgttccgcctttctggaactggttcagttggtgctactatccgcatttacattgagcagtatgagaaggattcttcaaaaaccgggagggagtcgaaggacgcactttctccactggttgatgtggccctgaagctttcaaagattcaagagtacaccggcagatctgcccccaccgtgatcacataaattttgacctatagaatgtcccgaggccgcttgtgatacttccgtttctggcttcgtgtttgatagcttttttacatctcacacatgaataaatgtatgtaccagaccatccccgtttcgttaccaacactgcatactctgctgctggtacagtatgcggccgtaatcttgttactgtgatgtaatcgagagttagtttcatcaagcgatacattgatctgtttctttttggtcgagtaacccacttgtatcgttgttttggtagttgttatagttaacttatcgcatgaact

SEQ ID NO: 7097 - DNA, 1768 bp, Flaveria ramosissima
aactttgttcaatcaacatttaatgccctttctgctgagaaagttaaaggttctacacttgttgtttcgggtgatggacgttactattcaaaggatgcaatccagattataattaaaatggcagctgcaaatggtgtaagacgtgtttgggttggtcaaaatggacttctctccacacctgctgtatcagccgttgtacgtgaacgagttggcgctgatggttccaaagcaaatggggcatttattttgacagctagtcacaacccaggtggtcccaatgaggattttggaattaagtacaatatggaaaatggtgggccagcacctgaaggaattactgataaaatctatgagaacactaaaacaataaaggagtattttattgcagaaggccttcctgatgtggatatctcagcaattgggatttcaagcttttcaggtcctgatggtcaatttgacgttgatgtttttgactcatcaagtgactatgtgaaattgatgaaatcgatctttgatttccagtccatcaaaaagctaattgcatctccgcaatttagtttttgttatgatgctcttcatggagttgctggagcttatgctaaacgtatatttgtcgaagagcttggtgcaaaagagagctcattattgaattgtgttcccaaggaagacttcggtggcggacatcctgatcccaatcttacatatgcaaaagagttggtagcaagaatgggattgggtaaaaaccctgacagtaacccaccagaattcggtgctgctgctgatggtgatgctgacaggaacatgatccttggtaaaaggttttttgttacaccatcagattctgttgctatcattgctgccaatgcagtccaatccataccctacttttcatctgggttaaagggtgttgccaggagcatgccaacatctgctgctcttgacgtcgtagccaaaagtttgaacataaagttttttgaggtaccaaccggctggaaattctttggtaacttgatggatgctgggttatgttcagtttgtggtgaagaaagttttggaacgggatcggaccatatccgtgaaaaagatggaatctgggctgtcttggcttggttatccattcttgctcataaaaacaaggacaacctcaatggtgggaaacttgtgacggttgaagacatcgtgacactgcactgggctacctttggacgccactattatactcgttatgattatgagaatgtcgatgcaggtgctgcaaaagaactaatggctcacttggtcaagttgcagtcttctattagtgatgttaacaaaatcataaaggaaacacgatctgatgtggcaaatgttgcaagcgctgacgagtttgaatacaaagatcctgttgatggttcaatctctaagaatcagggaatccgttatttattcgaagatgggtcacgtttggttttccgtttatcagggactgggtcagaaggtgccacaattcgtctttacattgaacaatacgaaaaagatgcaacaaaaattggaagagattctcaagaagcacttgctcctctggtggaggttgcactgaagttgtcaaagatgcaagaattcacaggtcgttctgcccctaccgtgattacataaataaatatactcatgctgttggctgtctacaatctgggcttgtttgttagttacaaaagcatcgtcgtgtttgttaaatgtttgatgatttacaaattttttattgtcgttaataattcagttgtagcttgag

SEQ ID NO: 7098 - DNA, 2041 bp, Avena sativa
cgcgcagcggcggccgcgggtcggcgcgcagccagcagccatggtgttctcggtgacgaagaaggagaccacgccctttgaaggccagaagcccggcacctccggcctccggaagaaggttactgtattccagcagcctcattacctcgcgaattttgtccagtcaacatttaatgctcttcctgctgaccaagtaaaaggtgcgaccattgttgtctctggtgatggccgttatttctcgaaagatgctgttcagatcatcacaaaaatggctgctgctaatggagtgagacgcgtctgggttggacaagacactctcttgtcaactccagctgtatctgctataatccgtgaaagaattgctgctgatggatcaaaggctactggttccttcattttaacagccagccacaacccaggtggtccgactgaggactttggtatcaaatacaacatgggaaatggtggacctgccccggagtctgtcactgacaagattttctctaacacaaagacaattactgaataccttattgctgacgaccttccagatgttgatgtttctgcattaggtgtcactaccttcactggacctgaaggcccttttgatgtcgatgtcttcgactctgctacagattacataaagctaatgaagacaatctttgactttgagtcaattaaaaagcttctggcctctccaaagttctcgttctgttttgatggccttcatggtgttgctggagcttatgcaaagcgcatgtttgtggatgagcttggtgctagtgaaagctcactgttgaactgtgttccaaaggaggactttggaggtggtcaccccgatcctaacctcacctatgcaaaagaattggttgaacggatgggtcttgggaagtcaagctcaaatgtcgaaccccctgaatttggtgctgcagctgatggagatgctgaccggaacatggttctgggtaaaagattctttgtgacgccatcagattcggttgccattattgcagccaatgctgttcaatcgattccttactttgcttctggcctgaagggagttgccaggagcatgccgacatcagctgcccttgatgtagttgcaaagaatttgaatctcaagttcttcgaggtgcctaccgggtggaaattttttgggaacctgatggatgctggaatgtgctcagtttgtggtgaagaaagctttggaactggttctgaccacattcgtgaaaaggatggtatttgggctgttctagcatggctatctattctagcctacaagaacaaagataaccttggaggagataagcttgttagtgttgaagatattgttcttcagcactgggctacttatggtcgccattattatacacgatatgactatgagaatgttgatgcagaagctgctaaggcacttatggcaaacctagtcaagatgcagtcgtccctgacagatgttaacaagttgatcaaggaaatccagcctaacgtatcagatgtggtctcggccgatgagttcgagtataaggatccagtggacggctctgtctccaagcaccagggtatcagatatctctttggagatggttcccgactggtgttccgcctttccggaactggttcagttggtgctaccattcgtatctacatcgagcagtatgagaatgattcatccaagaccgggagggagtcttccgatgctctttccccactggttgacgtggccctgaagctttcaaagatccaggagtacaccggccgatctgcccccaccgtgatcacataaattttgaagtagatgtgtgctcaggccgcttatgcagtttcgtcctggccttccgttcgatagtttttttcttcttaaacctcctcacagctgaataaatgtatgtaccagaccgtccccgttttattgcctacactgcatactctgctgccggtacagtatgtggccgtaatcttgtcacagtggtgtaatcgagagttgagtttcttcaaagcgatatattgacttgtgttttttggtctaaaaaaaaaa

SEQ ID NO: 7099 - DNA, 2209 bp, Avena sativa
gagaaagaaacccaccaccgtagaaggaaaggaaaaaagaaagaacggaatgatccgattgtgctctgccgcacccgctataataccgccacgccctcgtcgccttcgtcaccgcagcaccactcccttcctacctcactcccgatctccccaccgcctcctccaccgccagcccctcgcgtcctcatcacctcctcctcccctctcgcacgcgcagcggcggccgcgggccggcgcgcagccagcagccatggtgttctcggtgacgaagaaggagaccacgcccttcgaaggccagaagcccggcacctccggcctccggaagaaggttacagtattccagcagcctcattacctcgcgaattttgtccagtcaacatttaatgctcttcctgctgaccaagtaaaaggtgcgaccattgttgtctctggtgatggccgttatttctcgaaagatgctgttcagatcatcacaaaaatggctgctgctaatggagtgagacgcgtctgggttggacaagacactctcttgtcaactccagctgtatctgctataatccgtgaaagaattgctgctgatggatcaaaggctactggttccttcattttaacagccagccacaacccaggtggtccgactgaggactttggtatcaaatacaacatgggaaatggtggacctgccccggagtctgtcactgacaagattttctctaacacaaagacaattactgaataccttattgctgacgaccttccagatgttgatgtttctgcattaggtgtcactaccttcactggacctgaaggcccttttgatgtcgatgtcttcgactctgctacagattacataaagctaatgaagacaatctttgactttgagtcaattaaaaagcttctggcctctccaaagttctcgttctgttttgatggccttcatggtgttgctggagcttatgcaaagcgcatgtttgtggatgagcttggtgctagtgaaagctcactgttgaactgtgttccaaaggaggactttggaggtggtcatcccgatcctaacctcacctatgcaaaagaattggttgaacggatgggtcttgggaagtcaagctcaaatgtcgaaccccctgaatttggtgctgcagctgatggagatgctgaccggaacatggttctgggtaaaagattctttgtgacgccatcagattcggttgccattattgcagccaatgctgttcaatcgattccttactttgcttctggcctgaagggagttgccaggagcatgccgacatcagctgcccttgatgtagttgcaaagaatttgaatctcaagttcttcgaggtgcctaccgggtggaaattttttgggaacctgatggatgctggaatgtgctcagtttgtggtgaagaaagctttggaactggttctgaccacattcgtgaaaaggatggtatttgggctgttctagcatggctatctattctagcctacaagaacaaagataaccttggaggagataagcttgttagtgttgaagatattgttcttcagcactgggctacttatggtcgccattattatacacgatatgactatgagaatgttgatgcagaagctgctaaggcacttatggcaaacctagtcaagatgcagtcgtccctgacagatgttaacaagttgatcaaggaaatccagcctaacgtatcagatgtggtctcggccgatgagttcgagtataaggatccagtggacggctctgtctccaagcaccagggtatcagatatctctttggagatggttcccgactggtgttccgcctttccggaactggttcagttggtgctaccattcgtatctacatcgagcagtatgagaatgattcatccaagaccgggagggagtcttccgatgctctttccccactggttgacgtggccctgaagctttcaaagatccaggagtacaccggccgatctgcccccaccgtgatcacataaattttgaagtagatgtgtgctcaggccgcttatgcagtttcgtcctggccttccgttcgatagtttttttcttcttaaacctcctcacagctgaataaatgtatgtaccagaccgtccccgttttattgcctacactgcatactctgctgccggtacagtatgtggccgtaatcttgtcacagtggtgtaatcgagagttgagtttcttc

SEQ ID NO: 7100 - DNA, 2177 bp, Avena sativa
gaaaaaagaaagaacggaatgatccgattgtgctctgccgcacccgctataataccgccacgccctcgtcgccttcgtcaccgcagcaccactcccttcctacctcactcccgatctccccaccgcctcctccaccgccagcccctcgcgtcctcatcacctcctcctcccctctcgcacgcgcagcggcggccgcgggccggcgcgcagccagcagccatggtgttctcggtgacgaagaaggagaccacgcccttcgaaggccagaagcccggcacctccggcctccggaagaaggttacagtattccagcagcctcattacctcgcgaattttgtccagtcaacatttaatgctcttcctgctgaccaagtaaaaggtgcgaccattgttgtctctggtgatggccgttatttctcgaaagatgctgttcagatcatcacaaaaatggctgctgctaatggagtgagacgcgtctgggttggacaagacactctcttgtcaactccagctgtatctgctataatccgtgaaagaattgctgctgatggatcaaaggctacgggttccttcattttaacagccagccacaacccaggtggtccgactgaggactttggtatcaaatacaacatgggaaatggtggacctgccccggagtctgtcactgataagattttctctaacacaaagacaattactgaataccttattgctgacgaccttccagatgttgatgtttctgcattaggtgtcactaccttcactggacctgaaggctcttttgatgtcgatgtcttcgactctgctacagattacataaagctaatgaagacaatctttgactttgagtcaattaaaaagcttctggcctctccaaagttctcattctgttttgatggccttcacggtgttgctggagcttatgcaaagcgcatgtttgtggatgagcttggtgctagtgaaagctcactgttgaactgtgttccaaaggaggactttggaggtggtcatcccgatcctaacctcacctatgcaaaagaattggttgaacggatgggtcttgggaagtcaagctcaaatgtcgagccccctgaatttggtgctgcagccgatggagatgctgaccggaacatggttctgggtaaaagattcttcgtgacaccatcagattcggttgccattattgcagccaatgctgttcaatcgattccttactttgcttctggcctgaagggagttgccaggagcatgccgacatcagctgcccttgatgtggttgcaaagaatttgaatctcaagttcttcgaggtgcctaccgggtggaaattttttgggaacctgatggatgctggaatgtgctcagtttgtggtgaagaaagctttggaactggttctgaccacattcgtgaaaaggatggtatttgggctgttctagcatggctatctattctagcctacaagaacaaagataaccttggaggagataagcttgttagtgttgaagatattgttcttcagcactgggctacttatggtcgccattattatacacgatatgactatgagaatgttgatgcagaagctgctaaggcacttatggcaaacctagtcaagatgcagtcgtccctgactgatgttaacaagttgatcaaggaaatccagcctaacgtatcagatgtggtctcagccgatgagttcgagtataaggatccagtggacggctctgtctccaagcaccagggtatcagatatctctttggagatggttcccgactggtattccgcctttccggaactggttcagttggtgctaccattcgcatctacatcgagcagtatgagaatgattcatccaagaccgggagggagtcctccgatgctctttccccactggttgacgtggccctgaagctttcaaagattcaggagtacaccggccgatctgcccccaccgtgatcacataaattttgaagtagatatgtgctcaggccgcttatgcagtttcgtcctggccttccgttcgatagtttttttcttaaacctcctcacagctgaataaatgtatgtaccagaccgtccccgttttattgcctacactgcatactctgctgccggtacagtatgcggccgtaatctcgtcacagtggtgtaatcgagagtgaatttcttcaag

SEQ ID NO: 7101 - DNA, 2047 bp, Pseudotsuga menziesii
tatactcatcgggcatacttcttacaattacttaccaggcgaatccagaaaaaaatggtgatttttagcgtcactaggaaggaaactactccttatgatggacaaaaaccaggaacatctggactcagaaagaaggtcacagtcttccagcaacagaattacttgcacaatttcgttcaagcaacattcgatgcactgtcagtggagaaaataaaaggttccacaattgttgtctctggtgatggccgctacttttcagaggaggctattcagataataataaaaatggcagctgcaaatggagtgaggagtgtttgggttggccaaaatggattgctttcaacacctgcggtttcagcagttatacgcaatagaattggagcagatggagaaaaggcatcaggatcatttatattgacggctagccataatgctggaggtccaaaggaggactttggaataaagtacaacatggaaaatgggggaccagctcctgaagggatcactgacaagatatacgagaatactaagacaataaaggagtattttactgcagaagatctcccagatgtagacatatcaaccataggcataacaacttttggtggccccgatggacctttcgatgtggatgtctttgattctactgaagattatgttaaattgatgaagactatattcgactttgaagctatccaaaagctacttacatgccccaaattcacgttctgctatgatgcacttcatggagtggctgggatatatgccaaaaggatttttgtggaggagctgtctgccagtgagagctcattaataaattgcactccaaaggctgattttggaggaggtcatccagacccaaatttaacatatgccaaggaattggttacacggatgggattgggtaaagaaacgcctggttcagaagtgccagagtttggtgctgctgctgatggtgatgcagatcgtaatatgattcttggcaagaggttttttgtgactccatcagattctgttgccatcattgcagcaaacgcagttgaagccattccatacttcagctctggattgaaaggtgttgcaaggagcatgccaacatcagctgcacttgatgtagttgcaaaaaatcttaatcttaggttttttgaggtgcccactggctggaaattttttggaaatttaatggatgctggaatgtgttctgtttgtggtgaagagagttttggcactggttctgaccatatccgtgagaaggatggagtctgggcagttttagcatggttttcaattctggcttacaaaaataaggataaccttgatggcgggaagcttgtcactgtagaggacatagtccgtagccattgggcttcctatggtcgccactattatacacgttatgactatgaaaatgttgatgcaggtgctgcaaaggagctcatggcacatttgattaagttgcagtcttctctcccagaagttaacaagttaattaaagaagtgagaccagatgtttctgttgtcgtgcatgcggatgaatttgaatacaaagatcctgttgatggttctgtttccaaacatcagggtgtacgctacctttttgaagatggatctcgattggtgttccggctttctggaactgggtctgtaggtgcaaccattcggttgtatattgagcaatatgaagcggattctgccaagattggaagagattcacaagaggctcttgctcccctggtggaagtagctctacgactttcaaagatggaagaatttactggccgatcgagtcctactgtaatcacatgagttataggaaatattttgaatgcaatgcaaaagtttaggtttatcttttgaggaatggaccatgatcaagttttccaataaagttttcttacatctgattaataaacagaatataatgtattattgtggcatttttgcaatagagaagtatttgccaaaatttcataaattccttgaagatggttctgctcgtaactgcacgatagctttgtcaatctagagactaaattaaactttcgtg

SEQ ID NO: 7102 - DNA, 2211 bp, Pinus pinaster
cacgacaccacacagcttgtccacgtcatatatctggattgggagcttatttctacgctacatcgtacgttctccaagctccattttataaccctccctctctctcagaatcccgtcacgaaaccctcgcgtggtgcataaccattgtgtatactgcgtactattacctaccgggcgaagctagaaaaatggtgctttttagcgtaaataagaaggaaacctctccttacgatggacaaaaaccaggaacctctggcctcaggaagaaggtcacagtcttcaagcaacagaattacttgcacaattttgttcaagcaactttcgatgcactgtcagtggagaaaataaaaggttccagaattgttgtctctggcgatggccgctacttttcggaagaggctattcagataataataaaaatggcagctgcaaatggagtgaggagtgtttgggtaggccaaaatggactgctttcaacacctgcagtttcagcagttatacgcaatagaattggagcagatggagaaaaagcatcaggagcttttattttgacggccagccataatccaggaggtccaaatgaggactttggaataaagtacaacatggaaaatggggggccagctcctgaagggattactgacaagatatacgagaatactaaaacaataaaggagtattttaccgcagaagatctcccagatgtagacatatcaaccataggcataacaacttttggtggtcccgagggaccttttgatgtggatgtctttgatcccactgaagattatgttaaactgatgaagactatatttgacttcggagctattcaaaagctgcttacataccccaaattcacgttctgctatgatgcacttcatggagtggctgggatatatgccaaaaggatttttgtggaggagctgtctgctagtgagagctcattaataaattgcactccaaaggatgattttggaggaagtcatccagacccaaatttaacatatgccaaggagttggttacccggatgggattgggtaaacaagctcctgattcagaaccaccagaatttggtgctgctgctgatggtgatgcagatcgtaatatggttcttggcaagaggttttttgtgactccatcagattctgttgccatcattgcagcaaatgcagttgaagccattccatacttcagctctggattgaaaggtgttgcaagaagcatgccgacatcagctgcacttgatgtagttgcgaaaagtcttaatcttaggttttttgaggtgcccactggctggaagttttttggaaatttaatggatgctggaatgtgttctgtttgtggtgaagagagtttcggcactggttctgaccatatccgagagaaggatggagtctgggcagttttagcatggctttcaattctagcttacaaaaataaggataaccttgatggcgggaagcttgtcactgtagaggacatagtccgtaaccattgggcttcttatggtcgccactattatacacgctatgactatgaaaatgttgatgcaggtgctgccaaggagctcatgtcacatttaattaagctgcagtcttctctccccgaagttaacaaattaattaaggaagtgaggccagatgtttctggtgtcgtggatgccgatgaatttgaatacaaagatccggttgatggttctgtttccaaacaccagggtgtacgctatctttttgaagatggatctcgactggtgttccggctttctggtactggatctgtaggtgcaaccattcggttgtatattgagcaatatgaagcggattccaccaagatcggacgtgattcacaagtggctcttggtcctttggtggaagtagctttacggctttcaaagatggaagaatttactggtcgctcgagccccactgtaatcacatgagttataggaaatattatgaatgcaatcgaggagttcaggcttcttttgggaggaatagatcatgaccaagctgtgtgttaaaagttttcttacatctgattaataaacagattatactgtgtattattgtggaatgtttttgcaatagagaaaatcttgcgaaaatttaattaaacagaatatactatgtaatattgtggcacatttttgcgatagagaaaattttgcgaaaatttaataaatccttgaagatggtttgccccgactaccg

SEQ ID NO: 7103 - DNA, 2168 bp, Pinus taeda
ctctcagaatcccgtcacgaaaccctcgcgtggtgcataaccattgtgtatactgcgtactattacctaccgggcgaagctagaaaaatggtgcttttcagcgtaaataagaaggaaacctctccttacgatggacaaaaaccaggaacctctggcctcaggaagaaggtcacagtcttcaagcaacagaattacttgcacaattttgttcaagcaactttcgatgcactgtcagtggagaaaataaaaggttccagaattgttgtctctggtgatggccgctacttttcggaagaggctattcagataataataaaaatggcagctgcaaatggagtgaggagtgtttgggtaggccaaaatggactgctttcaacacctgccgtttcagcagttatacgcaatagaattggagcagatggagaaaaggcatcaggagcttttattttgacggccagccataatccaggaggtccaaatgaggactttggaataaagtacaacatggaaaatggggggccagctcctgaagggattactgacaagatatacgagaatactaaaacaataaaggagtattttaccgcagaaaatctcccagatgtagacatatcaaccataggcataacaacttttggtggtcccgagggaccttttgatgtggatgtctttgatcccactgaagattatgttaaactgatgaagactatatttgacttcggagctattcaaaagctgcttacataccccaaattcacgttctgctatgatgcacttcatggagtggctgggatatatgccaaaaggatttttgtggaggagctgtctgctagtgagagctcattaataaattgcactccaaaggatgattttggaggaagtcatccagacccaaatttaacatatgccaaggagttggttacccggatgggattgggtaaacaagctcctgattcagaaccaccagaatttggtgctgctgctgatggtgatgcagatcgtaatatggttcttggcaagaggttttttgtgactccatcagattctgttgccatcattgcagcaaatgcagttgaagccattccatacttcagctctggattgaaaggtgttgcaagaagcatgccgacatcagctgcacttgatgtagttgcaaaaagtcttaatcttaggttttttgaggtgcccactggctggaagttttttggaaatttaatggatgctggaatgtgttctgtttgtggtgaagagagtttcggcactggttccgaccatatccgagagaaggatggaatctgggcagttttagcatggctttcaattctagcttacaaaaataaggataaccttgatggcgggaagcttgtcactgtagaggacatagtccgtaaccattgggcttcttatggtcgccactattatacacgctatgactatgaaaatgttgatgcaggtgctgccaaggagctcatgtcacatttaattaagctgcagtcttctctccccgaagttaacaaattaattaaggaagtgaggccagatgtttctggtgtcgtggatgccgatgaatttgaatacaaagatccggttgatggttctgtttccaaacaccagggtgtacgctatctttttgaagatggatctcgactggtgttccggctttctggtactggatctgtaggtgcaaccattcggttgtatattgagcaatatgaagcggattccaccaagatcggacgtgattcacaagtggctcttgctcccttggtggaagtagctctacggctttcaaagatggaagaatttactggccgctcgagccccactgtaatcacatgagttataggaaatattatgaatgcaatcgaggagttcaggcttctctttgggaggaatagatcatgaccaagcttaaaagttttctttgatctgattaataaacagattatactgtgtattattgtggcacgttatttgcaatagagaaaatcttgcgaaatttaattaaacagaatatactatgtattattgtggcacatttttgcaatagagaaaattttgcgaaaatttaataaatcccttgaagatggttttgctgctaactgcacgatagctttgtttttgtaaatctagactaaaataaaattttgcttgcaaattcctttgct

SEQ ID NO: 7104 - DNA, 1798 bp, Coffea canephora
cggccgggggattccgttcctttctctttgcgtacatattactgctctccctccttttccttttccctctggaatctctctcacacccgtcactccctcatctcttctagctcagttttgaacctaattcagcaacaacaaacaaaccaggacgacaacaatggtggttttccaggtagctcgcgttgaaactacgccgttcgacggccagaagcctggcacctccggcctccgcaagaaggtgaaggtttttactcagcctcattacttgcacaactttgtgcagtcaacattctatgcccttggagctgataaagtcagaggtgctacactggttgtttctggtgatggtcgatactattcaaaggatgcaatccagatcattattaaaatggcagctgcaaatggagtaagacgaatttgggttggtcagaatggattgttgtctactcctgctgtatcggctgttatacgtgacagagttggccatgatggatctaaggcaaatggaggatttattttgactgcaagtcacaaccctggtggaccccatgaggattttggaattaaatacaacatggaaaatggtggacctgctccagagtcagttactgataagatctatgagaatacaaaaacaataaaggagtatttgattgcagaaggattgccagatgtggacatcagtacagtaggtgtttcaagctttactggtccagaggggcaatttgacgttgatgtttttgattcaaccactgattatgtgaaactgatgaagtccatatttgattttgagtctattcggaagcttctatcatctccaaactttactttctgttatgatgcacttcatggggttgctggagtttatgcaaagcgtatatttgttgaagagcttggtgcagaagaaagctctcttttgaattgcgtaccaaaggaggactttggcggagggcacccagatcctaatcttacctatgcaaaagagttagttgctcgcatgggattgggtaagactaacaatgaaagtgagccaccagaatttggtgctgctgctgatggggatgctgaccgtaacatgatccttgggaaaaggttttttgtcactccatctgattcggttgctattattgctgcaaatgctgttgaagccatcccttacttttccagtggtctaaaaggagttgccaggagtatgccaacatctgctgctcttgatgttgtggctaaacatctcaacctgaaattctttgaggtgcctactggctggaaattctttggtaacttaatggatgctggaatgtgttcagtttgtggtgaagaaagttttggaactggctcggatcatatacgcgagaaagatggaatctgggctgttttggcttggctatccatactggcctacaaaaacaaagataacttaggtggagggaagcttgtgactgttgaagacattgttcgtcagcattggtctgtctatggacgccactattacactcgatatgattacgagaatgttgatgcaggtggtgcaaaggacttgatggcacatttggtcaagctgcaatcatccctcggtgaagtgaatgaaataataaaagggatacgttcagacgtttcaaatgttgatcgtgctgatgagtttgagtataaagatccagtggatggttccatctctaagcatcagggtatccgatatctgtttgaagatggttcgcgattggttttccgtctttctggaactggatcagagggtgctactattcgtgtttatatcgagcaatatgagaatgattct

SEQ ID NO: 7105 - DNA, 1825 bp, Euphorbia peplus
aaagttagaggtggtacacttgttgtctctggtgatgggcgctattactcgaaggatgctgttcagatcattattaagatgtctgctgctaatggagtaaggcgtgtttgggttggtcagaattcattactttcaactcctgctgtctcagctgtaattcgagaaagagttggggtagatggatctaaagcaacaggagcatttatattgacggcaagtcataatccagggggtccgaatgaggactttggtataaaatataacatggaaaatggtggaccagctcctgaggggattaccgacaagatttatgagaacaccaaaaccataaaggagtacttaacagctgatcttcctgatgtggatatttctgcaattggtgtaactaattttagtgggcccgagggacaatttgatgttgaggtgtttgattcagcgaatgattatgtcaaattaatgaagtctatatttgatttcgaatctatgaagaagctgatttcatcgccaaaattcagtttctgctttgatgcactacatggagttggtggagcttatgcaaaacgtatgtttgtggaggaacttggtgctccagagagcgcattgttgaactgcgtacctaaggaagattttggagggggccatccagatcccaatcttacctatgcaaaagagttggttgctcgcatgggattgggcaaatcaaactcagaagttgaaccgccagaatttggtgctgctgctgatggtgatgcagaccgtaatatggtccttggtaaaaggttcttcgttactccatcagattctgttgcaattattgctgccaatgcagttgaatccataccttatttctcttctggtctaaagggtgttgccaggagcatgccaacgtcagctgcccttgatgttgtggccaaacatttgaacctgaaattttttgaggttcccactggctggaagttttttggaaatttgatggatgcaggaatgtgttcagtttgtggggaagaaagtttcgggactggctcggaccatattcgtgagaaagacggaatttgggcagttcttgcttggttatctattctggcttataaaaataagggaaatctcgatggaggaaagcttgtaactgttgaagatatagttcgcaatcattgggctaaatatggccgccactattatactcgctacgattatgagaatgttgatgcaactgcagcaaaggagctaatggcacatttggtcaagctgcaatcttccttgggtgaagttaacgagattgtgaaggggataagatcagatgtatctaaggttgttggtggtgacgagtttgaatacaaagatcctgttgatggttcaatctcaaagcaccagggtatacgatatttctttgaggatggctctcgactggttttccgcctctcaggaactggctcagaaggtgcaaccatccgtctctacattgagcaatatgagaaagatccatcaaaaattggaagagaatcttcagaagcactcgctcctcttgtggatgttgctctaaaactttctaagatgcaggaattcactggccgatctgctccaactgttattacatagatgctgcttttacatgggaaagctttatagattgaatgcatgccgccttgaataatgccatgatgagttcataatgtggtattaagaaccttttgagtggttctatgttgatctttgtattctatatatactgtgtttcgtcacagggcatacaagaacacatacctatctaaatttttgatgtgcaaaataataggaatacatatctgagtacttgaaatatgcttat

SEQ ID NO: 7106 - DNA, 1869 bp, Abies balsamea
cagattctgcacgtcagcgatctggattagggaaattgttctcgacgcttcattttctacccctcttctcctccagatttcaatcaccaaaccctctacgttgtatactcattgtgtatacttcatactgttaccgaccaggcaaaactagaaaaatggtgatttttagcgtaaataagaaatcaaccgctccttacgatggacaaaaaccaggaacatctggcctcagaaagaaggtcacagtcttcaagcaacagaattacttgcacaatttcgttcaagcaacatttgatgcactgtcagcggagaaagtaaaaggttccacaattgttgtgtctggtgatggccgctacttttcagaagaggctattcagataataataaaaatggcagctgccaatggagtgaggcgtgtttgggtaggccaaaatggattgctttcaacacctgcagtttcagcagttatacgcattagaattggagcagatggagaaaaggcatcaggagcttttatattgacggctagccataatgcaggaggtccaaatgaggactttggaataaagtacaatatggaaaatggtggaccagctcctgaagggattactgacaaaatatacgagaatactaagacaataaaggagtattttactgctgaaaatctcccagatgtagacatatcgaccataggcataacaagttttggtggccccaagggacctttcgatgtggatgtctttgattccactgaagattatgttaaattgatgaagactatatttgactttgaagctatccaaaagctgcttacatgccccaaattcactttctgctatgacgcacttcatggagtggctgggatatatgccaaaaggatttttgtggacgaactatctgccagtgagagctcattaataaattgcattccaaaggatgattttggaggaggtcatccagacccaaatttaacatatgccaaggaattggttacacggatgggattgggtaaagaagctcctggttcagaagtgccagagtttggtgctgctgctgatggtgatgcagatcgtaatatgattcttggcaagaggttttttgtgactccatcagactctgttgccatcattgcggcaaatgcagttgaagccattccatacttcagatctggattgaaaggtgttgcaaggagcatgccaacatcggctgcacttgatgtagttgcaaaaagtctggatcttaggttttttgaggtgcccactggctggaagttttttggaaatttaatggatgctggaatgtgttctatttgcggtgaagagagttttggcactggttctgaccatatccgagagaaggatggagtctgggcagttttagcatggttttcaattctagcttacaaaaacaaggataacctcgatggtgggaagcttgtcactgtggaggacatagtccgtaaccattgggcttcttatggtcgccactattatacacgttatgactatgaaaatgttgatgcaggtgctgcaaaggagctcatggcacatttgattaagctgcagtcttctctcccagaagttaacaagttagttaaggaagtgagaccagatgtttccgatgttgtgcatgccgatgaatttgaatacaaagatcctgttgatggttctgtttccaaacaccaaggtgtacgctatctttttgaagatggatctcgattggtgttccggctttctggcactgggtctgtaggtgcaaccattcggttgtatatcgagcaatatgaagtggattccaccaagattggaagagattcacaagaggctcttgctcccctggtggaagtagctctacgactttcaaagatggaag

SEQ ID NO: 7107 - DNA, 1580 bp, Brassica napus
gacacttctaataacgtgagggagaagaagagagcaaaaatgagctttaataggaatttgttgaatatcataataatcctttgtgtatgtctcaactgggactgtagcgagggagctcaagaaaaacagaggagggcgattgattctcatactatccaactcagttctctcttcccttcatcatcatcaccttgtgttctttctacaagagcttccagtacaaagtcctcactgcacgtgacgcacagacacggcacgtgctcgcgtataaccagtgccaaagccaagagtccagaccatgccgagatcctcagactcgaccaagcgcgcgtaaactcgattcactcgaaactgtcgaaaaaactcacagatcgagtcaggcaaagcaagtcaacggatctaccagctaaagacggaagcacctacggttcaggaaacttcgtcgtaaccctcggaatcggaacaccgaaacacgatctgtctctgatcttcgacacaggaagcgacctgacgtggattcaatgcgagccatgcgttcgaacttgctattcccaaaaggaaccaatctttaacccgtcctcctcttcctcataccacaacgtctcttgctcatcggctgagtgtagctcactctcttccgctacaggtaattccggaacatgctcggcttcgaactgcgtctacggtattcaatacggcgatcaatcgttctccgttggttttctcgccaaggagaagtttacactaacggcgtctaatgtgtttgacggcgttaacttcggctgcggcgaaaacaaccaaggacttttcaccggcgtcgccggacttctcggcctcggccgtgacaagctctctttcccgtcgcagacggcggcgacctacaacaagatcttctcctactgcctcccttcctccgctagctacaccggacacctcaccttcggatccgccggagtctccagatccgttaagttcactccgatctccacgatcaccgacggcacatccttctacggtctcgacatcgtcggaatctccgtcggcggtcagaaactcgcgattcctccgacggtgttctccactccgggagctctgatcgattccggaaccgtcatctctcgcctcccgccgaaggcctacgcggcgctgcgaggcgcgttcaaggcgaagatgtcgcagtacaagaatacgtcgggagtctcgatcttggacacgtgttttgatctcaccgggttaaaaacggtgacgatcccgacggtgtcgttttacttcaatggtggtgccgtggtgcagcttggctcgaaaggggttttgtacgcgtttaagatgtcgcaggtttgtttggcgtttgcggggaacagcgatgataataacgctgccatctttgggaacgttcagcagcaaacgctggaagttgtgtacgatggtgcggccgggcgggtcgggtttgctccgaatgggtgcagttaatgaaaacatatgggtacaattttatttgtggatttggcgccaaaatagctttatccttaatcaagtgtataatttgtatgaggacgtgatggtctatggtacacgtttat

SEQ ID NO: 7108 - DNA, 1666 bp, Brassica napus
gcaaagaagagtggctataaaggaccggccattatcatgatattgagtgacacttctaataacgtgagggagaagaagagagcaaaaatgagctttaataggatgaatatcataataatcctttgtgtatgtctcaactgggactgtagcgagggagctcaagaaaaacagaggagggcgattgattctcatactatccaactcagctctctcttcccttcatcgtcatcaccttgtgttctttctacaagagcttccagtacaaagtcctcactgcacgtgacgcacagacacggcacgtgctcgcgtataaccaatgcaaaagccaagaatccagaccatgccgagattcttagactggaccaagcgcgcgtcaactcgatacattcgaaactatcgaagaagctcacagatcgagtcaggcaaagcaagtcaacggatctacctgctaaagacggaagcacctacggttcaggaaacttcgtcgtaaccctcggaatcggaacaccgaaacacgatctgtctctgatcttcgacacaggaagcgacctgacgtggattcaatgcgagccatgtgttcgaacttgctattcccaaaaggaaccaatctttaacccgtcttcctcttcctcataccacaacgtgtcttgctcatcggctgagtgtagctcactctcttccgctacaggtaattccggaacatgctcggcttcgaactgcgtctacggtattcaatacggcgatcaatcattctccgttggctttctcgctaaagaaaagtttactctaacggcttctaacgtattcgacggcgttaacttcggctgcggtgagaacaaccaaggactcttcaccggagtcgccggacttctcggccttggccgtgacaagctctctttcccgtcgcagacggcggcgacctacaacaagatcttctcctactgcctcccttcttccgctagctacaccggtcatctcaccttcggatccgccggagtctccagatccgttaaattcactccgatctccacgatcaccgacggcacatccttctacggtctcgacatcgtcggaatctccgtcggcggtcagaaactggcgattcctccgacggtgttctccactccgggagctctgatcgattccggtaccgtcatctctcgcctcccgccgaaggcctacgcggcgctgcgaggcgcgttcaaggcgaagatgtcgcagtacaagaatgcgtcgggagtctcgatcttggacacgtgttttgatctcaccgggtttaaaacggtgacgatcccgacggtgtcgttttacttcaatggtggggccgtggtggagcttggctcgaaaggggttttgtacgcgtttaagatgtcgaaggtttgtttggcgtttgcagggaatagcgatgataataacgctgctatctttgggaacgttcagcagcaaacgctggaagttgtgtacgatggtgcggccgggcgggtcgggtttgctccgaatgggtgtagttaatgaaaacattatgggtaaattttatttatggatttggcgccaaattagctttatccttaatcaagtgtgtaatttgtgcgagcacgtgatgggtctatgaaaagtgtaaaatggtacacatttattgtaaaaaggccaaaactgttaatttaca

SEQ ID NO: 7109 - DNA, 1621 bp, Brassica napus
ggacactttttaattattgtaagagacaaagaagagagagataaaatgaactctactaggaatgtattgaatatcatattaatcctttgtgtatgtctcagttggggttgtactgatggagctcaaaaacgagagaatggagagattttaactcatactatagaactaagctctctcttcccttcgtcatcatcaccttgtgttctttccaccagagcgtctaatacaaagtcctcactgcacgtgacgcacaggcacggcacgtgctcgtctttaaccagcgacaaggccaccacgagtccagaccatgctgagatcctcagactcgaccaagcccgcgtaaactcgatccagtcgaaactgtcgaagaagctcacagacagagtaagacaaagcaagtcaacggctctaccagctaaagacgggagcatcttcggatcaggaaactacgtcgtttcggtcggaatcggaacaccgaaacgcgatcagtctctcatcttcgacacaggaagcgatctgacgtggattcaatgcgagccatgcgttcaaacttgctattctcaaaaggcaccaatctttaacccgtcctcgtcttcctcgtactacaacgtctcgtgctcttcggctgcgtgtagctctctctcttcagctacaggtaactctggaagctgctcagcttcgacgtgcgtctacggaattcaatacggcgatcaatccttctccgttgggtttctcgccaaggagaagtttacactaacggcgtctaacgtattcgacggcgttaacttcggctgcggcgagaacaaccaaggactcttcaccggagtcgccggacttctcggcctcggccgtgacaagctctctttcccgtcgcagacggcggcgacctacaacaagatcttctcctactgcctcccttcctccgctagctacaccggacacctcaccttcggatccgccggagtctccagatccgttaagttcactccgatctccacgatcaccgacggcacttccttctacggtctcgacatcgtcggaatctccgtcggcggtcagaaactggcgattcctccgacggtgttctccactccgggagctctgatcgattccggaaccgtcatctctcgcctcccgccgaaggcctacgcggcgctgcgaggcgcgttcaaggcgaagatgtcgcagtataagaatacgtcggccgtttcgatcttggacacgtgttatgatctcaccgggttaaaaacggtgacgatcccgacggtgtcgttttacttcaatggtggtgccgtggtgcagcttggctcgaaaggggttttgtacgcgtttaagatgtcgcaggtttgtttggcgtttgcggggaacagcgatgataataacgctgccatctttgggaacgttcagcagcaaacgctggaagttgtgtacgacggtgcagccgggcgggtcgggtttgctccgaatgggtgtagttaatgaaaacatatgggtaaattttatttgtggatttggcgccaagtgtataatttgtatgaggacgtgatggtctatggtacacgtttattgtaaaagctcaaactgttaatttacatatttttactccaatagaaacctctag

SEQ ID NO: 7110 - DNA, 1544 bp, Brassica napus
ctctgctaggaatgtattgaatatcataataatcatttgtgtatgtttcaactggggtagtgctaatggagctcaaaaacgagagagtggagagattttaactcatactatagaactaagctctctcttcccttcatcatcatcaccttgtgttctttccaccagagcgtctaatacaaagtcctcactgcacgtgacgcacaggcacggcacgtgctcgtctttaaccagtgacaaggccacgacgagtccagaccatgcagagatcctcagactcgaccaagcgcgcgtaaactcaatccactcgaaactctcgaagaagctcacagaccgagttagacaaagcaagtcaacggctctaccggctaaagacgggagcatcttcggatcaggaaactacgtcgtttcggtcggaatcggaacaccgaaacgcgatcagtctctcatcttcgacacaggaagcgatctgacgtggatccaatgcgagccgtgcgttcaaacatgctattctcaaaaggaaccaatctttaacccgtcctcgtcttcctcatactacaacgtctcgtgctcttcggccgcgtgtacttctctctcttcagctacaggtaactctggaagctgctcagcttcgacgtgcgtctacggtattcaatacggcgatcaatccttctccgtcgggtttctcgcgaaggagaagttcacgctaacgagctccaacgtattcgacggcgtatacttcggctgcggcgagaacaaccaaggactcttcaccggcgtcgccggacttctcggactcggccgtgacaagctctccttcccgtcgcagactgcaacaacctacaacaagatcttctcctactgcctcccttcctccgccagctacaccggccacctcaccttcggaaccgccggaatctccagatccgtcaagttcactccgatctccaccatcaccgaaggcacgtccttctacggcctcgacatcgtcgggatcaccgtcggaggtcagaagctagccatcgctcccgccgttttctcaactccgggggctttgatcgactccggaaccgtcatcactcgtctcccgccgaaggcttacgcggcgctgaaagacgcgttcaaggcgaagatgagtcagtatccgagcgcgtcgggggtctcgatcttggacacgtgtttcgatctcagcgggcttaagacggttacgattccgaaagtggcgttttctttcagcggcggcgcggttgtggagcttggatcgacgggggttctatacgcgtttaagatggcgcaggtttgtttggcgtttgcggggaatagcgatgacactaacgctgccatctttgggaacgttcagcagcaaacgctggaggttgtgtacgatggtgcgggtgggcgggtcgggttttctcctaatgggtgtagttaaagctaaaaaagagggtggatttggcattaattagctttatccgttattcaagtgtgtaattgggctgaaatcgttatgggcctgtgaagaaaagtgtacagaaataaatttgtgt

SEQ ID NO: 7111 - DNA, 1598 bp, Brassica napus
ggacactttttaattattgtaagagacaaagaagagagagataaaatgagctctgctaggaatgtattgaatatcatcataatcatttgtgtatgtctcagttggggttgtactgatggagctcaaaaacgagagagtggagagactgattctcatactgtagaactaagctctctcttcccttcgtcatcatcaccttgtgttctttccaccagagcgtctaatacaaagtcctcactgcacgtgacgcacaggcacggcacgtgctcgtctttaaccagcgacaaggccaccacgagtccagaccatgctgagatcctcagactcgaccaagcccgcgtaaactcgatccactcaaaactatcgaagaagctcgcagacagagtaagacaaagcaagtcgacggctctaccggctaaagacgggagcatcttcggatcaggaaactacgtcgtttcggtcggaatcggaacaccgaaacgcgatcagtctctcatcttcgacacaggaagcgatctgacgtggattcaatgcgagccatgcgttcaaacttgctattctcaaaaggaaccaatctttaacccgtcctcgtcttcctcgtactacaacgtctcgtgctcttcggctgcgtgcagctctctctcttccgctacaggtaattctggaagctgctcagcttcgacgtgcgtctacggaatccaatacggcgatcaatccttctccgtcgggtttctcgccaaggagaagttcacgctaacgagctccaacgtattcgacggcgtttacttcggctgcggcgagaacaaccaaggactcttcaccggcgtcgccggacttctcggactcggccgtgacaagctctccttcccctcgcagacggcgaaggcttacaacaatatcttctcctactgcctcccttcctcatctagctacaccggacacctcaccttcggaaccgccggaatctccagatccgtcaaattcactccgatctccacgatcaccgaaggcacgtccttctacggcctcgacatcgtcgcaatcaccgtcggaggtcagaagctagcgatcgctcccgccgttttctcaactccgggggctttgatcgactccggaaccgtcatcactcgtctcccgccgaaagcctacgcggcgctgaaagacgcgttcaaggcgaagatgagtcagtatccgagcgcgtcgggggtctcgatcttggacacgtgtttcgatctcagcgggttaaagacgtttacgatcccgaaagtggcgttttctttcagcggcggcgcggtcgtggagcttggatcgacgggggttctatacgcgtttaagatgtcgcaggtttgtttggcgtttgcggggaatagcgatgacactaacgctgccatctttgggaacgttcagcagcaaacgctggaggttgtgtacgatggtgcgggcgggcgggtcgggtttgctcctaatgggtgtagttaaagcgaaaaaaggggtggatttaattgtatggatttggcattaattagctttatccttcttattcaagtgtgtaattgggctgagatcgttatgggcctgtaaagtaaagtgtacagaaa

SEQ ID NO: 7112 - DNA, 2249 bp, Brassica napus
ctctcccatggtggttcctctatttcaatcatgccctctcacaccaacttcctcttcaggtggattggactgttttctcagaaactccgccgggaaacaactgaaatctcggaaaacaacggtggagaatcgagcagcagtagcgacgacacgccggtgctgagctccggcgagtgttacgcatgcactcaagtaggcgtaccggccttccactccacaagctgcgatcaagccaacgcgccggagtggcgtgcctccgccgggtcctccctagtcccgatccaggaaggatccgcacccagcccggttcgagcccggatcagacgtctcaagggcccgttcggcgaagttctcgatcccaggagcaagcgcgtgcagaggtggaaccgcgcgttgcttctagctcgcgggatggccttggcggtggatccgctcttcttctacgcgctctccatcggaagaactactggacccgcgtgcctctacatggacggcgcgttcgcggctgttgtaacggtcgttcgcacgtgcctggatgctcttcatctgtggcacgtgtggcttcagtttaggctggcttacgtctcgagagagtcgctcgtggttgggtgtgggaaactcgtttgggatccacgcgccatcgcgtctcactatgcacgctcgcttactggcttctggtttgatgttatagtcatcctcccggttccgcaggctgtgttttggttagtggtgccaaaactgataagagaagagaaggttaagctgataatgacgatccttctgctgatcttcttgttccagttcctccccaagatttatcactgcatctgcttgatgagaaggatgcagaaggtcactggttacatttttgggactatttggtggggttttgctcttaacctcatcgcgtatttcatcgcttctcatgtagctgggggatgctggtatgttcttgcaatacagcgtgtggcttcttgtatcagacagcagtgcatgaggactgcgaactgtaatctgagtctgtcttgccaagaagaggtctgttaccaattcgtgtcacccagtagcacaattgggtttccatgcgtatctggaaacctcaccagtgtggttaagaagcctatgtgcttagactctgacggaccattccgatatggtatctacggttgggcgcttccggtcatctctagcaactctcttgccgttaagatactttaccctatcttctgggggttaatgactctcagcacattcgggaacgatcttgagcccacaagcaactggcttgaggttgttttcagcatagttatggtccttagcgggttactactcttcactctcttgatcggaaacattcaggtgtttttgcacgcggtgatggcaaagaagaggaaaatgcagatacggtgtagggatatggaatggtggatgaaacgtaggcagttgccttctcggttaagacagagagttaggagatttgagcggcagagatggactgccttgggtggagaagacgagctggaacttatacaagatctgcctccgggtcttcgaagagatattaagagatatctttgcgttgatctcattaacaatgtgccattgttcaggggcatggacgatttgatcctagacaacatttgcgatcgtgctaagcctcgtgtctactctaaagacgaaaagatcatccgggaaggagatcctgtacagagaatgatattcatcatgcgcgggagagtgaaacgtaaccagagcctaagcaaaggcgttgtagccactagtactctcgaaccaggcggttacttaggggacgagctactctcatggtgcctacggcgtccatttatcgaccgtcttcctccttcctccgcaacctttgtctgtctcgacaacatcgaggcgttctccctcggatccgaagatcttcggtacataaccgatcatttccgctataaattcgcaaacgagcgccttaagaggactgcaagatactactcctcaaactggaggacgtgggctgcggtgaatatacaaatgtcgtggcgccggtacaggaagagaacatgtggtggtgtaggcggttcgatgagtcctgtgtcggaacatagcgttgaaggtaacagtgaacgccgtttgcttcagtatgcagcaatgttcatgtccatccgaccgcatgatcatctcgagtaaaaccaaaaaaagttgctaaatttatcggtcgaaataattgtttgtatccattgttcgtc

SEQ ID NO: 7113 - DNA, 2340 bp, Brassica napus
tcttctgtctctcccatggtggttcctctgtttcaatcatgccctctcacaccaacttcctcttcaggtggattggactgttttctcagaaactccgccgggaaacaactggaatctcggaaaacaacggtggagaatcgagcagcagcagcagcagcgacgacacgccggtgctgagctccggcgagtgttacgcatgcactcaagtaggcgtaccggccttccactccacaagctgcgatcaagccaacacgccggagtggcgcgcctcagccgggtcctccctagtcccgatccaggaaggatccgcacccgacccggttcgagcccggctcagacgtctcaagggcccgttcggggaagttctcgatcccaggagcaagcgcgtgcagagatggaaccgcgcgttgcttctagctcgcgggatggccttggcggtggatccgctcttcttctacgcgctctccatcgggagaactactggacccgcgtgtctttacatggacggcgcgttcgctgctgttgtaacggtcgttcgcacgtgcctcgacgctcttcacctctggcacgtgtggcttcagtttaggctggcttacgtctcgagagagtcactcgtcgttgggtgtgggaaactcgtttgggatccacgcgccatcgcgtcacactacgcacgctccctcactggcttctggtttgatgttatagtcatcctcccggttccgcaggctgtgttttggttagtggtgccaaaactgataagagaagagaaggttaagctgataatgacgatccttctgctgatcttcttgttccagttcctccccaagatttatcactgcatctgcttgatgagaaggatgcagaaggtcactggttacattttcggaactatttggtggggttttgctcttaacctcatcgcatatttcatcgcttctcatgtagctgggggatgctggtatgttcttgcaatacagcgtgttgcttcttgtatcagacagcaatgcatgaggaccgcgaactgtaacctgagtctgtcttgccaagaagaggtctgttaccaattcgtgtcacccactagcacaattggatttccttgcttatccggaaacctcactagtgtggttaagaagcctatgtgcttagactctaacggaccattccgatatggtatctacggttgggcacttccggtcatctccagcaactctcttgcggttaagatactttaccctatcttctggggtctcatgactctcagcacatttgggaacgatcttgagcccacaagcaactggcttgaggttgttttcagcatagttatggtccttagcgggttattactcttcactctcttgatcggaaacattcaggtgtttttacacgcggtgatggcaaagaagaggaaaatgcagatacggtgtagggatatggaatggtggatgaaacgtaggcagttgccttctcggttaagacagagagttaggagatttgagaggcagagatggactgccttgggtggagaagacgagctggaacttatacatgatctgcctcctggtcttcgaagagatattaagagatatctttgcgttgatctcattaacaaggtaccattgttcaggggcatggacgatttgatcctagacaacatttgcgatcgtgctaagcctcgtgtctactctaaagacgaaaagatcatccgggaaggagatcctgtacagagaatgatattcatcatgcgtggaagagtcaaacgtaaccagagcctaagcaaaggcgtggtagccactagtacgctcgaaccaggcggttacttaggcgacgagctactctcatggtgcctccgacgtccatttatcgaccgtcttcctccttcctccgcaacatttgtctgtctagacaacatcgaggcgttctccctgggatcagaagatctaaggtacataaccgatcatttccgttataaattcgcaaacgagcgtcttaagaggactgcaagatactactcctcaaactggaggacgtgggcagcggtgaatattcaaatgtcgtggcgccggtacaggaagagaacatgtggtggtgtaggcggttcgatgagtcctgtgtcggaacatagcgttgaaggtaacagtgaacgccgtttgcttcagtatgcagcaatgttcatgtccatccgaccgcatgatcatctcgagtaaaaccaaaaaaaaagttgctaaatttatcggtcgaaataattgtttgtatccattgttcgtcctcaattgtttttgttctctttgtgtaaaataaaacctctctttcgattatgtgtatttgagtttaaaactagca

SEQ ID NO: 7114 - DNA, 2530 bp, Eutrema parvulum
caaacccggttcggtttccgaattaggtgaaattataggtttatcattgtgtaccggagtctccctaacaataaaccgaatcctattagaaacatacgtatcacactctgccttatgcctacacacacaatctctctctctctctctctctcccatggtggttcctctagttcaatcatgccctctcaccccaacttcctcctcaggtggattggactgttctccgagaaactccgtcgggaaacgagtggaatcgaggaaatcagcatcatccagaacaacggtggagaatccagcagcggcggcgatgatacgcctgtgctgagctccgtcgagtgttacgcgtgtacacaggtaggcgtaccagctttccactccaccagctgcgatcaagctcacgccccggagtggcgtgcctccgccggctcttccctagttccgatccaggaaggatccgtacccaacccggttcgaccccgattcagacgtcctaagggaccgttcggcgaggttctcgatcccaggagcaagcgcgtgcagagatggaaccgcgcgttgcttctagctcgcgggatggctctagcagtggatccgctcttcttctacgcgctatccatcggccgaaccaccggacccgcgtgtctctacatggacggcgcgttcgcggccgtcgtcacggtcgtccgcacgtgcctcgacgctcttcacctatggcacgtgtggcttcaatttagattggcttacgtctcgagagagtccctcgtcgttggttgcgggaaactcgtttgggatccacgcgccatcgcttcacactacgcacgctcgctcactggcttctggttcgatgttatcgtcatcctccctgtccctcaggctgtgttttggttagtcgtgccgagactgataagagaagagaaggttaagctgataatgacgatccttctgctaatcttcttgttccaattcctccccaagatttatcactgcatctgcttgatgagaaggatgcagaaggtcactggttacatttttgggactatatggtggggttttgctcttaacctcatcgcatatttcatcgcttctcatgtagctgggggatgctggtatgttcttgcaatacagcgtgttgcttcttgtattagacatcaatgcatgaggaccgggaactgtaatctgagtctgtcttgccaagaagaagtctgttaccagttcgcgtcaccgactagcacaattggatatccatgcttatctggaaaccttaccagtgtggtcaagaagcctatgtgcttagaccctaacggaccattccgatatggtatctacggttgggcacttcccgtcatctccagcaactctcttgcggttaagatcctctaccctatcttctggggtctaatgactctcagcacattcgggaacgatctccagcccacaagcaactggcttgaggttatttttagcatagttatggtccttagcgggttattactcttcacactgttgataggaaacattcaggtgtttttgcatgcggtaatggcaaagaagaggaaaatgcagatacgttgtagggacatggaatggtggatgaaacgtaggcagttgccttctcggttaagacagagagttaggagatttgagcggcagagatggactgccttaggtggagaagacgagctagaacttatacacgatttgcctccgggtcttcgaagagatattaaacgatatctttgctttgatctcattaacaaggtaccattgttcaggggcatggacgatttgatcctggacaacatttgcgatcgtgctatgccttgcgtcttctctaaagacgaaaagatcatccgggaaggagatcctgtacagagaatgatattcatcatgcgtgggagagtcaaacgtaaccagagcctaagcaaaggcgtggtagccactagtacgctcgaaccaggcggttacttaggcgatgagctactctcatggtgtctacgtcgaccattcattgaccgtcttcctccttcctccgcaacatttgtctgtctcgacaacatcgaggcgttctctcttggatccgaagatcttaggtacataaccgatcatttccgatataaattcgcaaacgagcggcttaagcggacagcaagatactactcctcaaactggaggacgtgggctgctgtgaatcttcagatggcgtggcgccggtataggaagagaacccgtggcggtgagaacatcggtggtgtaggcggttcgatgagtcctgtgtcggataatagcgttgaaggtaacagtgaacgccgcttacttcagtatgccgcgatgttcatgtctatccgaccgcatgatcatcttgagtaaaacaaaaaagatatccaaaatttatcggtctgagataattgtttgtatccattgttcctcctcaattgttttttttcttttctccccgttcttttgtaaattctgtcgttggatgatggttatgtgcccttacttgagtttaaaactatcattcgagctttct

SEQ ID NO: 7115 - DNA, 2512 bp, Eutrema halophilum
atcccggttcggtgtccgaattaggtacaatttcggtttaaatgtttgtaccggagtctccctaacaataaaccgaatcctattagagacatacgtatcacactctgcctttgcctatacaatctctctctcacacacgctctctctccctgcaaatcttctctctctcccatggtggttcctctatttcaatcatgccctctcagcccaacttcatcttcaggtggattggactgttttccgataaattccgtcggaaaacgcctggaatcgaggaaatcagcatcgtccaaaacaacagtggggaatcgagcagcggcgatgatacgccggtgttgagctccgtcgagtgttacgcttgtacacaagtaggcgtaccagccttccactcaaccagctgcgatcaagctcacgcgccggagtggcgtgcttctgccggctcttccctagtcccgatccaggaaggatccgccccgaacccgacccgaacccgattcagacgtctcaagggtccgttcggcgaagttctcgacccaaggagcaagcgcgtgcagagatggaaccgcgcgttgcttatagctcgcgggatggctttagcggtggatccgctcttcttctacgcgctctccatcggccgaaccaccggaccggcgtgtctctacatggacggcgcgttcgcggcggtggtcacggcggttcgcacgtgtctcgacgctgttcacctgtggcacgtgtggcttcaattcagactggcttacgtctcgagggagtctctcgtcgtcggttgcgggaagctcgtttgggatccacgcgccatcgcgtcacactacgctcgctcgctcactggcttctggttcgatgttatagtcatcctccctgttccacaggctgtgttttggttagtcgtgccgaagctgataagagaagagaaggttaagctgataatgacgatccttctgctaatcttcttgttccagttcctccccaagatttatcactgcatctgcttgatgagaaggatgcagaaggtcactggttacatttttgggactatttggtggggttttgctcttaatctcatcgcatatttcatcgcttctcacgtcgctgggggatgctggtatgttcttgcaatacagcgtgttgcttcttgcataagacaacaatgcatgagggccgggaactgcaatcttagtctgtcttgcaaagaagaggtctgttaccaatttgtgtcaccgattggatatccatgcttatctggaaaccttaccagtgtggtcaacaagcctatgtgcttagattctaacggaccattccgatatggtatctacggttgggcacttccggtcatctccagcaactctcttgcggttaagatcctttaccctatcttctggggtctaatgactctcagcactttcgggaacgatcttgagcccacaagcaattggcttgaggttatgttcagcatagttatggtccttagtgggttattactcttcacgctgttgatcggaaacattcaggtgtttttgcacgcggtgatggcaaagaagagaaaaatgcagattcggtgtagggatatggaatggtggatgaaacgtaggcagttgccttctcggttaagacagagagtaaggagatttgagcgacagagatggactgccctcggtggagaagacgagctggaacttatacaagatttgcctccgggccttcgaagagatatcaaacgatatctttgctttgatctcattaacaaggtaccattgttcaggggcatggacgatttgatcctagacaacatttgtgatcgggctaagcatcgcgtcttctctaaagacgagaagatcatccgcgaaggagatcctgtacaaagaatgatattcatcatgcgtgggagagtcaaacgtaaccagagcctaagcaaaggtgtggtagccactagtacgctcgaacaaggcggttacttaggcgacgagctactctcatggtgcttaaggcgtccattcatcgaccgtcttcctccttcctctgcaacatttgtctgcctagacaacatagaggcgttctcactcggatccgaagatcttaggtacatcaccgatcatttccgttataaattcgcaaacgagcggcttaagcggaccgcaagatactattcctcaaactggaggacttgggctgccgtaaatattcaaatggcgtggcggcggtacaggaagagaacccgtggtggtgaaaacaacggcggttcgatgagtcctgtgtcggagaacagcgtcgaaggtaacagtgaacgccgtttacttcagtatgccgccatgttcatgtccattcgaccacatgatcatctcgagtaaaacaaacagaaagtgccaaaatcattggtctcaataattgtttgtttccattgttcgtcctcaattgttattattattattattttgaaaagatctttatgtgaatgtttatgtaccttattaaaaaaaactagcatttgagttttctt

SEQ ID NO: 7116 - DNA, 2482 bp, Arabidopsis thaliana
aatcctactaagagacgtacgtatcacacacaaatcttgcggctttgcctctctatacaaatcactcttctctctcccaatcactccctgcaaattttcttctctccctctcccatggtggttcctctatttcaatcatgccctctcaccccaacttcatcttcaggtggattggactgttttccgataagttccgtcgacaaacgactgggatcgatgaaaacagtaacctccaaatcaacggtggagattcgagcagcagcggcagcgatgagacgccggtgctaagctccgtcgagtgttacgcttgcacacaagtaggcgtcccagctttccattcaactagctgcgatcaagctcacgcgccggagtggcgtgcctccgccggctcttctctagttccgatccaggaaggatctgtccctaacccagcccgaaccagattccgacgtctcaaaggtccgtttggtgaagttctcgatcctaggagcaagcgcgtgcagagatggaaccgcgcgttgcttttagctcgtgggatggctttagcggtggatccgctcttcttctacgcgctttccatcggccgaactaccggaccggcgtgtctttacatggatggtgcgttcgccgcggtggtcacggtgctccgcacgtgtctcgatgctgttcatctttggcacgtgtggcttcaattcagactggcctacgtctcgagagagtcgcttgtcgttggttgtgggaagctcgtttgggatccacgcgccatcgcgtctcactacgcacgctctctcactggcttctggtttgatgttatcgtcatcctccctgtccctcaggcagtgttttggttagttgtgccgaaactgataagagaagagaaggttaagctgataatgacgattctgctgctaatattcttgttccagttcctccccaagatttatcactgcatctgtttgatgagaaggatgcagaaggtcactggttacatttttggaactatttggtggggttttgctcttaatctcatcgcatatttcatcgcttctcatgttgctgggggatgttggtatgttctcgcaatacagcgtgttgcttcttgcataagacaacaatgtatgagaaccgggaactgcaatctgagtctggcttgcaaagaagaggtctgttaccaatttgtgtcaccgacaagcacagttggatatccatgcttatctggaaaccttaccagtgtggtcaataagcctatgtgcttagactctaacggaccattccgatatggtatctaccgttgggcacttccagtcatctccagcaactctcttgcggttaagatcctttaccccatcttctggggcctaatgactctcagcacatttgcgaatgatcttgagcccacaagcaactggctcgaggttattttcagtatagttatggttctaagtggcttgttacttttcacgctgttgataggaaacattcaggtgtttttgcatgcggtaatggcgaaaaaaaggaaaatgcagatacggtgtagggatatggaatggtggatgaaacgtaggcagttaccttcccggttaagacagagggttaggcgatttgagcggcagagatggaatgccttgggtggtgaagacgagctagaacttatacatgatttgcctccgggtcttcgaagagatatcaaacgatatctttgctttgatctcattaacaaggtgccattgttcaggggcatggacgacttgatcctcgacaacatttgcgatcgggctaagcctcgagtcttctctaaagacgaaaagatcatccgtgaaggagatcctgtacagagaatgatattcatcatgcgtggacgagtcaaacgtatacagagcctaagcaaaggcgtcctagccactagtacactagaaccaggcggttacttgggcgacgagctactctcatggtgcctacgtcgcccgtttctggaccgtcttcccccttcctcagcaacatttgtctgcctagaaaacatcgaggcattctccctcggatccgaagatcttaggtacattaccgatcatttccgttataaattcgcgaacgagcggcttaagcggaccgcaagatactattcctcaaactggaggacgtgggcagcggtaaatattcagatggcgtggcgccggcgtaggaaaagaacccgtggtgaaaacatcggcggttcgatgagtcctgtgtcggagaatagcattgaaggtaacagtgaacgccggttacttcagtatgcagctatgttcatgtccattcgaccgcatgatcatctcgaataataataaaaagttccaattttatatcggtccaaataattgtgtgttcattgttcctcctcaattgtttacctttacttctttaaaaaatctttcttggaatgatacttcaacctcttacggttaagttcaaagtagattttttgagcaacaaaatcttggaggag

SEQ ID NO: 7117 - DNA, 2391 bp, Arabidopsis lyrata
gagaggtacgtatcacacacaactcttgcgcctttgccttctccaatcactccctgcaaaatcttctctccctctcccatggtggttcctctgtttcaatcatgccctctcaccccaacttcatcttcaggtggattggaatgttttccgagaaattccgtcgacaaacgactggaatcgatgaaaacagtatcctccacatcaacggtggagattctagcagcagcggcagcgatgagacgccggtgctaagctccgtcgaatgttacgcctgcacacaagtaggcgtcccagctttccattcaactagctgcgatcaagctcacgcgccggagtggcgtgcctccgccggctcttccttagttccgatccaggaagcatccgtccctaaccctgcccgaacccgattccgacgtctcaaaggccctttcggtgaagttctcgatcccaggagcaagcgcgtgcagagatggaaccgcgcgttgcttctagctcgagggatggctttagctgtagatccgctcttcttctacgcgctttctatcggccgaaccaccggaccggcgtgtctttacatggacggtgctttcgccgcggtggtaacggtgctccgcacgtgtctcgacgctgttcatctttggcacgtgtggcttcaattcagactggcttacatctcgagagagtcgcttgtcgttggttgtggcaagctcgtttgggatccacgcgccatcgcgtctcactacgcacgctctctcactggcttctggtttgatgtcatcgtcatcctccccgtccctcaggctgtgttttggttagttgtgccgaaactgataagagaagagaaggttaagctgataatgacgattcttctgctaatattcttgttccagttcctccccaagatttatcactgcatctgcttgatgagaaggatgcaaaaggtcactggttacatttttgggactatttggtggggttttgctcttaatctcattgcatatttcatcgcttctcatgtcgctggaggatgttggtatgttctcgcaatacagcgtgttgcttcttgcataagacagcaatgcatgagagccgggggctgcaatttgagtctggcttgcaaagaagaggtctgttaccaatttgtgtcaccgacaagcacagttggatatccatgcttatctggaaaccttaccagtgtggtcaataagcctatgtgcttagactctaatggaccattccgatatggtatctaccgttgggcacttccagtcatctccagcaactctcttgcggttaagatcctttaccccatcttctggggcctaatgactctcagcacattcgcaaatgatcttgagcccacaagcaactggctcgaggttattttcagtatagttatggtcctaagcgggttattactcttcacgctattgatcggaaacattcaggtgtttttgcatgcggtaatggcgaaaaaaaggaaaatgcagatacgatgtagggatatggagtggtggatgaaacgtaggcagttaccttcccggttaagacagagggttaggcgatttgagcgtcagagatggaatgccttgggtggagaagatgagctagaacttgtacaagatttgcctccgggtcttcgaagagatatcaaacgatatctttgctttgatctcattaacaaggtgccattgtttaggggcatggacgatttgatcctcgacaacatttgcgatcgggctaagcctcgtgtcttctctaaagacgaaaagatcattcgtgaaggagatcctgtacagagaatgatattcatcatgcgtgggcgagtcaaacgtatccagagcctaagcaaaggcgtgatagccactagtacactcgaaccagggggttacttgggcgacgagctactctcgtggtgcctacgtcgcccgtttctggaccgtcttcccccttcctcagcaacatttgtctgcctagacaacatcgaggcattctccctcggatgcgaagatcttaggtacattaccgaccatttccgttataaattcgcaaacgagcggctcaagcggaccgcaagatactattcctcaaactggaggacgtgggcagccgtgaatattcagatggcgtggcgccgatgtaggaaaagaacccgtggtgaaaacatcggcggttcaatgagtcctgtgtcggagaatagcattgaaggtaacagtgaacgccggttacttcagtacgcggcgatgttcatgtccattcgaccgcatgatcatctcgaataataaaaaagaagttccaatatttatcggtccaaattgtttgttcccattgttcctcctcaattgtttacctttactctttttttttggaaaaatctttcttggaatgata

SEQ ID NO: 7118 - DNA, 1310 bp, Brassica napus
tcggattgaaattttagggttggagaatgacgatgaactcgcttccaaggaggttcgggagagatcaaggatacctagaccgagaccaccgtagagggaggagatccggttcagactccgacgaagagctgaaaggattgagtcacgaggagtaccggaggcttaaacgcctcaagatgaggaaatctggtaagcactgcatttggaggaacacgccgagtccgcctagagatcccaacgaggtggagtccgatgagaacgccgccgacgaggaggttccggagaaggacgaggaagatccgaaatctgagtctggtaagtcggaatctgagtctgatagatctaagaggaagagtaagagctctaggagtaagcggagtagacgatatagtgatagcgagagtgatgatgattcggatgaggaagataggaggagaaggaggaggaagaagaagcagaagagtagtaggaagaggagaggacataggaggaagaggagatatagtgattctgatgatgaatctgagattagcgcttcttcgtcttctggggaagaacgtagcaaatcaaagagcaagaaggacactgattcgaaggggaagttggaagaagcggggaaggagcctgagcttgacgaagaggagatgaagatgattattgaatcgaagaagaaagctttaccagaagatgaagaagaagaaggtgaggtgggtccaatgccgttacctaaagccgaaggacacatcagctacggtggtgctttacgacccggtgaaggagacgctatagctcagtatgttcagcaagggaaacgtatcccacgtagaggagaagtgggtctcaacgctgatgagattcagaggtttgaggatcttgggtacgtgatgagtgggagtaggcatcagaggatgaatgctattcgtatcaggaaggagaaccaggtttacagtgctgaagataaacgggcgttggcgatgtttaactatgaggagaaggctaagcgcgaggctaaggtgatgtctgatttgtcgaggcttgtgcaacgccatatgggagaagagttgggtccgaatcatgacccttttggtgctgggaagactgatggtgctgatgattgatttgcttagcttcccttctactgcttgtgtgggtacttatcttatgcttttactacttgctcgttactgagttttacagttctaatatgctatgcgtgtcacattatcgtctttgtgtgtttaaaaatggaagattctgactttaaggatctgctattgttcctacgcaatttgtttgagcttcagagatta

SEQ ID NO: 7119 - DNA, 1121 bp, Brassica napus
ggattgaaattttagggttggagaatgacgatgaactcgcttccaaggaggttcgggagagatcaaggatacctagaccgagaccaccgtagagggaggagatccggttcagactccgacgaagagctgaaaggattgagtcacgaggagtaccggaggcttaaacgcctcaagatgaggaaatctggtaagcactgcatttggaggaacacgccgagtccgcctagagatccgaacgaggtggagtccgatgagaacgccgccgacgaggaggttctggagaaggacgaggaagatccgaaatctgagtctggtaagtcggaatctgagtctgatagatctaagaggaagagtaagagctctaggagtaagcggagtagacgatatagtgatagcgagagtgatgatgattcggatgaggaagataggaggagaaggaggaggaagaagaagcagaagagtagtaggaagaggagaggacataggaggaagaggagatatagtgattctgatgatgaatctgagattagcgcttcttcgtcttctggggaagaacgtagcaaatcaaagagcaagaaggacactgattcgaaggggaaactagaagaaacggtgaaggagcctgagcttgacgaagaggagatgaagatgattattgaatcgaagaagaaagcttcagctcccgaagaggaagaagaagctgaggtgggaccaatgccgttacctaaagctgaaggacacatcagttacggtggtgctttacgacctggtgaaggagacgctatagcacagtacgttcagcaagggaaacgtatcccacgtagaggagaagtgggtcttaacgctgatgagattcagaggtttgaggatcttgggtatgtcatgagtgggagtaggcatcaaaggatgaatgctatccgtatcaggaaggagaaccaggtttacagtgctgaagataaacgggcgttggcgatgtttaactatgaggagaaggcttaagcgcgaaggctaaggtgatgtctgatttgtccaggcttgtgcagcgccatatgggagaagagttgggtccgaatcatgatccttttggtgctgggaagactgatggagctgatgattgattt

SEQ ID NO: 7120 - DNA, 1730 bp, Eutrema halophilum
agacttactacaaggacggcaaatggtaaaaacgtgaaccaccaccaccaccaccaccagatacacagacacgagaccgatcggcgatcagtagactcaaccaattgaacactcggaatcgagcgataaggaagcaatgatgatctcccagttcttcgtcttatctcaacgaggagataacatcgtcttccgtgactaccgagctgaggtaccgaaaggcagtacagagacattcttccgtaaagtcaagttctggaaggaagatggaaatgcagaggcaccacctatctttaatgtcgatggcgtgaactacttccatgtcaaggttgttggtctatattttgttgcgacaagtagagttaacgtgtcaccgtctcttgttttggagcttctgcaaaggatcgctcgtgtaattaaggactatctcggtgttctgaatgaagattcattcaggaaaaactttgtgctcgtgtatgagttgctcgatgaagtaattgattttggttacgtgcaaactacatctaccgaggttttaaaatcgtatgtgttcaacgagccaattgtgattgctcctgcacgccttcaacctattgatcctgctgccatcttcacacaaggagccaaaagaatgcctggaacagcagttacaaaatcggttgtagctaatgagcctgggggtcgaagaagggaggaaatttttgttgacatcatcgagaaaatcagtgttacttttagttcaagcggatatatactgacctctgagattgatggcaccattcaaatgaagagctatctttctggtaatccagaaattcgtttagcccttaatgaagacctaaacataggaagaggaggaagatcagtatatgattataggagttcttcaggttcaggggtgatactggatgattgcaactttcatgagtctgttcgtcttgatagctttgattcagatagaactttgtccctggtcccaccagatggtgaatttcctgtaatgaattaccgtatgacccaggaattcaagcctccttttcatgttaataccttgattgaagaggccggacgccttaaggctgaagtgattattaaaatacgtgctgaatttccctcagacataattgcaaacacgattactgttcagatgccattgccaaattatacttccagggctagttttgagttagaacctggtgcagctggacagaagacagatttcaaggaaaccagcaaaatgcttgcatggagtttaaaaaagattgttggcggggctgaacatacactgcgtgcaaaactgacattttcacaggaatttcatggtaacatcacaaaggaagcagggccggttagcatgaccttcacgataccgatgtacaatgtatctaaactacaggtcaaatacttgcaaatagcaaagaaatcaagtagttacaatccatatcgttgggtgagatatgtgacccaggccaattcatatgtggctcggatataaccttctgtcagataatatttgtcacttgtatgtccaagtacttttatcttttcttctcgataatgtttgttcattttcgaatcatacttgctttaagttcaaagaggatacttcgccagtacgcgttgaaggttgtcttttctatttggaatttctttatagaatttcttggtttggtcttattatatgctttattttgtttctcccctgcaaacaacatatgatctcttttcatgga

SEQ ID NO: 7121 - DNA, 1728 bp, Eutrema parvulum
aaccttccttctcgggaagaggctttacgatcacgacggaggcaattggtaaaaaaaaacgtgaaccaccaccaccaccagatacacagacacgagaccgatcggcgatcagtagacacaacggtgaacagttagaatcaaccgctgaggaagatatgatgatctcccagttcttcgtcttatctcagcgaggagacaacatcgtcttccgtgactaccgcgctgaggtacccaaaggaagtacagagacattctttcgtaaagtcaagttctggaaggaagatggaaatgcagaggcaccacctatctttaatgtcgatggcgtgaactacttccatgtcaaggttgttggtctttattttgttgccactacgagggttaacgtctcaccgtctcttgttttggagcttctacaaaggatcgctcgtgttattaaggattatctcggtgttttgaatgaagattcattcaggaaaaatttcgttctcgtgtatgagttgcttgatgaagtaattgattttggttacgtgcaaactacatcaaccgaggttttgaaatcctatgtattcaatgagccaattgtggttgctcctgcacgccttcaacccatcgatcctgctgccatcttcacacaaggagccaaaagaatgcctggaacagcagttacaaaatcggttgtagctaatgatcctggaggtcggagaagggaggaaatttttgtggacatcatcgagaaaatcagtgttacttttagttcaagcggttatatactgacttctgagattgatggcaccattcaaatgaagagctatctttctggtaatccagaaattcgcctagcccttaatgaagatctaaacatcggaagaggaggaagatcagtatatgattataggagttcctcaggttcaggggtgatacttgacgattgtaactttcatgagtctgttcgtcttgatagcttcgattcggatagaactttgtccctggttccaccagatggcgaatttccagtaatgaattaccgtatgacccaggagtttaagcctccttttcatgttaataccttgattgaagaggctggacgccttaaggctgaagtgattatcaaaatacgtgctgaattcccgtcagacataattgcaaacacgattactgttcagatgccattgccaaattatacttccagggctagttttgagttagaacctggtgcagctggacagaagacagatttcaaggagaccagcaaaatgcttgaatggagtttaaaaaagattgttggcggggctgatcatacactgcgtgcaaagctgacattttctcaggaatttcatggtaatatcacaaaggaagcagggccggttagcatgaccttcaccataccaatgtacaatgtttctaaactccaggtcaaatacttgcagatagcaaagaaatcaagtagttacaatccatatcgttgggtgagatatgtgacacaggccaattcatatgttgctcggttatgacctgctttcagataatgtttttcacttgtttgtccaaatactttctcttttcttctcgatagtgtttgttcatcttcggattgtacttaagttctatgaggatggttcagtacgtacatgttgaattgaatgtttttttctcttcaatctggattttctttatatattatctttgtctggtctcaatctcattatatgctttatcttgttctccgga

SEQ ID NO: 7122 - DNA, 1708 bp, Raphanus sativus
  misc_feature (275)..(275): n is a, c, g, or t
  misc_feature (383)..(383): n is a, c, g, or t
  misc_feature (1689)..(1689): n is a, c, g, or t
ggaacgacggcaattggttaataaaaaaaacgtgaaccaccagaccagacacagacagaaacaagaccgatcggcgatcagctgtccgaaaccatatccaccggcgagcaatcggaaatcatccgctaagtaaaaagatgatgatctctcagttcttcgtcttatctcagcgtggagataacatcgtcttccgcgactatcgagctgaggtaccaaaaggaagtacagagacattcttccgtaaagtcaagttctggaaggaggatggtaatgcngaggcaccacctatctttaatgtagatggtgtgaactacttccatgtcaaggttgttggtctatattttgttgcgacaacgagggttaatgtttcaccgtctcttgtnctggagcttctacaaaggatcgctcgtgttatcaaggattacctcggtgttttgaacgaagattcattcaggaaaaattttgtgctcgtgtatgagttgcttgatgaagtcattgattttggctatgtgcaaactacatcaacggaggttttgaaatcctatgtattcaacgagccaattttgattgctcctgcacgccttcaacctatcgatcctgctgccatcttcaatcaaggagccaaaaggatgcctggaacagcagttacaaagtcggttgtagctaatgatcctagtggtcggagaagagaggaaatttttgtggacatcattgagaaaatcagtgttacttttagttcaagcggctatatactgacttctgagattgatggcaccattcaaatgaagagttatctttctggtaatccagaaattcgtatagctcttaatgaagacctaaacataggaagaggagggagatcagtatatgactataggagttcttcaggttcaggggtgatacttgatgattgtaactttcatgagtctgttcgtcttgatagcttcgattcggatagaactttgtccctggttccaccagatggtgaatttccagttatgaattaccgtatgacccaggagttcaagcctccttttcatgttaataccttgattgaagaggccggacgccttaaggctgaagtgattattaaaatacgcgctgagttcccttcagacataattgcaaacacgattacggtccagatgcctttgccaaattacacttccagggctagttttgagttagaacccggtgcagctggacagaagacagatttcaaggaaaccagcaaaatgcttgaatggaatttgaaaaagattgttggtggagctgaacatacactgcgtgcaaagctgacattttcacaggagtttcatggtaatctcacaaaggaagcagggccggttagcatgaccttcaccataccgatgtacaatgtttctaaactccaggtcaagtacttgcagatagcaaagaaatcaagtagttacaatccatatcgttgggtgagatatgtgacacaggccaattcgtacgtggctcggatatgaccctactttcagataatgtttgttcattttcagatcatacttgttcttaaattctaagaggatccttcacagtacgtgctgaatgtttgttgtctctgctatttggattttcttggtttgttctctacgctggaaacatgagtctgaatgaaacatattccaatttatggaaattgcaacgaaataaaagcatacnccttaataataatttaata

SEQ ID NO: 7123 - DNA, 1619 bp, Brassica napus
gtatatgttttcctagcctcttgaccagaccagacacacatcacgagaccgatcggcgataagctgtctgaaaacatattagccggcgatcaatcggaatcatccgctaagtaaaaagatgatgatctctcagttcttcgtcttatctcaacgaggagataacatcgtcttccgtgactatcgagctgaggtacccaaaggaagtacagagacattcttccgtaaagtcaagttctggaaggaggatggtaatgctgaggcaccacctatctttaatgtagatggtgtgaactacttccatgtcaaggttgttggtctatactttgttgcgactacgagggttaatgtttcaccgtctcttgttttggagcttctacaaaggatcgctcgtgttatcaaggactacctcggtgtcttgaacgaagattcattcaggaaaaattttgtgctcgtctatgagctgcttgatgaagttattgattttggttacgtgcaaactacttcaaccgaggttttgaagtcctatgtattcaacgagccaattgtgattgctcctgcacgccttcaacctattgatcctgctgccatcttcactcaaggagccaaaagaatgcctggaacagctgttacaaagtcggttgtagctaatgatcctagtggtcggaggagagaggaaatttttgtggacatcattgagaaaatcagtgttacttttagttcaagcggttatatactgacttctgagattgatggaaccattcaaatgaagagttatctttctggtaatccggaaattcgtatagctcttaatgaagatctaaacataggaagaggtggaagatcagtatatgattacaggagttcttcaggttcaggggtgatacttgatgattgtaactttcatgagtccgttcgtcttgatagctttgattcggatagaactttgtccctggttccaccagatggtgaatttccagttatgaattaccgtatgacccaagagttcaagcctccttttcatgttaataccttaattgaagaggccggacgccttaaggctgaagtgattatcaaaatacgcgctgagttcccttcagacataattgcaaacacgattactgtccagatgccattgccaaattttacttcgagggctagttttgagttagaacctggtgcggctggacagaagacagatttcaaggaaagcaacaaaatgcttgaatggagtttgaaaaagattgttggtggggctgaacatacactgcgtgcaaagctgacattttcacaggagtttcatggtaatatcacaaaggaagcagggccagttagcatgaccttcaccataccgatgtacaatgtttctaaactccaggtcaagtacttgcagatagcaaagaaatcaagtagttacaatccatatcgttgggtgagatatgtgacacaggccaattcgtacgtggctcggatatgatctactttcagataatgtttgtcacttgtatgtcctactaccttctcttttcttctcgataatatttgttccttttcggatcatacttgttcaagttctaagacgatccttcacagtacgtatgctgaatgtgctatttggattt

SEQ ID NO: 7124 - DNA, 1501 bp, Brassica napus
ggaatcacagacagacacgagactgatcgaaccaaatcagcggtgaacagtcgggagggaagggaagggaagggatgatgatctctcaattcttcgtcctatctcagcgaggagataacatcgtcttccgtgactatcgagccgaggtaccaaaaggaagtacagagacattcttccgtaaagtcaagttctggaggaggatggtaatgcagaggcaccacctatctttaatgtcgacggtgtgaactacttccatgtcaaggttgttggtctctattcgttgccactacgagggttaacgtctcgccttctctggttttggagcttctacaaaggatcgctcgtgttattaaggactacctcggtgttttgaatgaagattctttcaggaaaaactttgtgcttgtctatgagttgcttgatgaagtcattgattttggctacgtgcaaactacatcaaccgaggttttgaaatcctatgtattcaacgagccaattttgattgctcctgcacgccttcaacctatcgatcctgctgccatcttcacccaaggatccaaaagaatgcctggaacagctgtcacaaagtcggttgtagctaatgatcctagtggtcggaggagagaggaaatttttgtggacatcattgagaaaatcagtgttactttagttcaagcggttatatactgacttctgagattgatggaaccattcaaatgaagagttatctttctggtaatccggaaattcgtatagctcttaatgaagatctaaacataggaagaggtggaagatcagtatatgattacaggagttcttcaggttcaggggtgatacttgatgattgtaactttcatgagtccgttcgtcttgatagctttgattcggatagaactttgtccctggttccaccagatggtgaatttccagttatgaattaccgtatgacccaagagttcaagcctccttttcatgttaataccttaattgaagaggccggacgccttaaggctgaagtgattatcaaaatacgcgctgagttcccttcagacataattgcaaacacgattactgtccagatgccattgccaaattttacttccagggctagttttgagttagaacctggtgcggctggacagaagtcagatttcaaggaaaccaacaaaatgcttgaatggagtttgaaaaagatcgttggtggggctgaacatacactgcgtgcaaagctgacattttcacaggagtttcatggtaatatcacaaaggaagcagggccagttagcatgaccttcaccataccgatgtacaatgtttctaaacttcaggtcaagtacttgcagatagcaaagaaatcaagtagttacaatccatatcgttgggtgagatatgtgacacaggccaattcgtatgtggctcggatatgagataatgtttgtctatgtcctagtaccctctcctcgacaatgtttgttcatttttggatcatacttctacttaa

SEQ ID NO: 7125 - DNA, 1636 bp, Arabidopsis lyrata
agcttgacgataacgacggcaattggtaaaacgtgaaccacctcaccacacacaaatacgagaccgatcggcgatcagtagactcaaccaaactcgcggtgaaacagtcggattccaccgctaaggaacgatgatgatctcccaattctttgttttatctcagcgaggagataacatcgtcttccgtgactaccgggctgaggtaccgaaaggcagtacagagactttcttccgtaaagtcaagttctggaaggaggatggcaatgcagaggcgccacctatctttaatgtcgatggcgtgaactacttccatgtcaaggttgttggtctatattttgttgcgactacgagagttaacgtgtcaccgtctcttgttttggagcttctacaaaggattgctcgtgttattaaggattatcttggtgttttgaatgaagattcattcaggaaaaattttgtgctcgtgtatgagttgcttgacgaagttattgattttggttacgtgcaaactacatctaccgaagttttgaaatcctatatattcaatgagccaattgtggttgctcctgcccgccttcagcccatcgatcctgctgccattttcacacaaggaaacaaaagaatgcctggaactgcagttacaaaatcggttgtagctaatgatcctgggggtcggagaagagaggaaatttttgtggacattatcgagaaaatcagtgttacttttagttcaagcggctatatactgacttctgagattgatggaaccattcaaatgaagagctatctttctggtaatccagaaatccgtttagctcttaatgaagacctaaacataggaagaggagggagatcagtatatgattataggagctcttcaggttcaggggtgatacttgatgattgtaactttcatgagtctgttcgtctggatagttttgattcagatagaactttgtccctggttccaccggatggtgaatttccagtaatgaattaccgtatgacccaggagttcaagcctccttttcatgttaataccttgattgaagaggccgggcgccttaaggctgaagtgattattaaaatacgagctgagttcccttcagacataatcgcaaacacaattactgttcagatgccattgccaaattatacttccagggctagttttgagttagaacccggtgcggctggacagaagacagatttcaaggaatccagcaaaatgcttgaatggaatttaaagaaggcaagtattgttggcgggggtgagcatacactgcgtgcaaagctgacattttcacaggaatttcatggtaatatcacaaaggaagcagggccagtcagcatgacgttcacgatacctatgtacaatgtttctaaacttcaggtcaaatacttgcagatagcaaagaaatcaagtagttataatccatatcgttgggtgagatacgttacacaggccaattcatatgtggctaggatatgacctgctttcagataatggttgtccctcacttgtatgtctaagtactttctctttacatgttcggagcacacttgctacacagtactgtgttgaatgttgtctcttctatttggatactttcttgttttggtatcaacatatatg

SEQ ID NO: 7126 - DNA, 1699 bp, Arabidopsis thaliana
agcttcacgataacgacggcaaatggtaaaacgtgaaccacctcaccaccagacacacaaaaagacgagaccgatcggcgatcagtagacttaaccaaactcgcggtgaaacagtcggaatccaccgctataaggaacgatgatgatctcccaattcttcgtcttatctcagcgaggagataacatcgtcttccgtgactaccgggctgaggtacccaaaggaagtacagagacattcttccgtaaagtcaagttctggaaggaggatggcaatgcagaggcgccacctatctttaatgtcgatggcgtgaactacttccatgtcaaggttgttggtctatattttgttgcgacaacgagagttaacgtgtcaccctctcttgttttggagcttctacaaaggattgctcgtgttattaaggattatcttggtgttctgaatgaagattcattcaggaaaaactttgtgctcgtgtatgagttgcttgatgaagttattgattttggttacgtgcaaactacatctaccgaagttttgaaatcttatatattcaatgagccgattgtggtttctcctgcccgccttcagcctattgatcctgctgccattttcacacaaggagccaaaagaatgcctggaactgcagttacaaaatcggttgtggctaatgatcctgggggtcggagaagagaggaaatttttgtggacatcatcgagaaaatcagtgttacttttagttcaagcggatatatactgacttctgagattgatggcaccattcaaatgaagagctatctttctggtaatccagaaatccgtttagctcttaatgaagacctaaacataggaagaggagggagatcagtatatgattataggagttcttcaggttcaggggtgatacttgatgattgtaactttcatgagtctgttcgtctggatagcttcgattcagatagaactttgtccctggttccaccagatggtgaatttccagtaatgaattaccgtatgactcaggagttcaagcctccttttcatgttaataccttgattgaagaggctggacgtcttaaggctgaagtgattattaaaatacgcgctgagttcccttcagacataattgcaaacacaatcactgttcagatgccattgccaaattatacttccagggctagttttgagttagaacccggtgctgctggacagaggacagatttcaaggaatccaacaaaatgcttgaatggaatttaaaaaaggcaaattgttggcgggggtgagcatacactgcgtgcaaagcttacattttcacaggaatttcatggtaatatcacaaaggaagcagggccagtcagcatgacgttcacgatacctatgtacaatgtttctaaacttcaggtcaaatacttgcagatagcaaagaaatcaagtagttataatccatatcgttgggtgagatatgtgacacaggcgaattcttatgtggctaggatatgacctgttttcagataatgtttatccttcacttgtatgtctaagtactttctcttttcattttcggatcacacttgcttcacagtactgtgttgaatgttgtctcttctatttggatactttcttgtttcggtatcaacatatatggctatatgcttttattttgtttgcccctgaaaacatcatatgatctcttttcttgg

SEQ ID NO: 7127 - DNA, 1423 bp, Brassica napus
ttcttcgtcttatctcaacgaggagataacatcgtcttccgcgactatcgagctgaggtacccaaaggaagtacagagacattcttccgtaaagtcaagttctggaaggaggatgctaatgctgaggcaccacctatctttaatgtggatggcgtgaactacttccatgtcaaggttgttggtctatactttgttgcgactacgagggttaacgtttcaccgtctcttgtcttagagcttctacaaaggatcgctcgtgttatcaaggactacctcggtgttttgaacgaagattctttcaggaaaaattttgtgctcgtctatgagttgcttgatgaagttattgattttggttacgtgcaaactacttcaaccgaggttttgaagtcctatgtattcaacgagccgattgtgattgctcctgcacgccttcaacctattgatcctgctgccatcttcactcaaggagccaaaagaatgcctggaacagcagtcacaaagtcggttgtagctaatgatcccagtggtcggagaagagaggaaatttttgtggacatcattgagaaaatcagtgttacttttagttcaagcggttatatactgacttctgagatcgatggcaccattcaaatgaagagttatctttctggtaatccggaaattcgtatagctcttaatgaagatctaaacattggaagaggtggaagatcagtatatgattataggagttcttcaggatcaggggtgatacttgatgattgtaactttcatgagtctgttcgtcttgatagcttcgactcggatagaactttgtccctggttccaccagatggtgaatttccagttatgaattaccgtatgacccaagagttcaaacctccttttcatgttaataccttgattgaagaggccggacgccttaaggctgaagtgattatcaaaatacgcgctgagttcccttcagacataattgcaaacacgattactgtccagatgccattgccaaattttacttccagggctagttttgagttagaacctggtgcggctggacagaagtcagatttcaaggaaaccaacaaaatgcttgaatggagtttgaaaaagatcgttggtggggctgaacatacactgcgtgcaaagctgacattttcacaggagtttcatggtaatatcacaaaggaagcagggccagttagcatgaccttcaccataccgatgtacaatgtttctaaacttcaggtcaagtacttgcagatagcaaagaaatcaagtagttacaatccatatcgttgggtgagatatgtgacacaggccaattcgtatgtggctcggatatgagataatgtttgtctatgtcctacgtaccctctcctcgacatgtttgttcttattttggtatctatacttctactaagtaggt

SEQ ID NO: 7128 - DNA, 1776 bp, Brassica napus
gacatgtttatacaagagaaggtgaaacaagagaagctgcaactggagatgcagaagaagatgaagtatggagggctgccgaagagctcgagcgtagggatggccgatcctgatcgagaaaataaggggcctgaaccttccaactcgtgaactgaagaagctttacgacaacgacagcaatcggtggaaacgtggtccacccgacacactctatagacacgagactgatcggcgatcagtagacttaaatcaaaatgagccggtgaacatttcggaactaaccgctaaggaaaaggatgatgatctctcagttcttcgtcttatctcagcgtggagataacatcgtcttccgcgactaccgagctgaggtaccaaaaggaagtacagagacattcttccgtaaagtcaagttctggaaggaggatggtaatgcagaggcgccacctatctttaatgtggatggtgtgaactacttccatgtcaaggtcgttggtctttatttcgttgcgactacgaaggttaacgtgtcaccgtctcttgtcttggagcttctacaaagaatcgcccgtgttattaaagattaccttggtgttttaaatgaagattcgttccggaaaaatttcgtgctcgtgtatgagttactcgatgaagtcattgattttggttacgtgcaaactacatcaaccgaggttttgaaggcctatgtattcaacgagccaattttgattgctcctgcacgccttcaacctattgatcctgctgccatcttcacacaaggagccaaaagaatgcctggagcagcagttacaaaacccgttctagctaatgatcctgggggtcggagaagagaggagatttttgtggacatcatcgagaaaatcagtgttactttcagttcaagcggttatatactgacatctgagattgatggcaccattcaaatgaagagttatctttctggtaatccggaaattcgtttagctcttaatgaagaccttaacataggaagaggaggaggaggagtatctgtatatgattataggagttcttcaggttcaggggtgatacttgatgactgtaactttcatgagtctgttcgccttaatagcttcgattcagatagaactctgtcccttgttccaccagatggtgagtttccagtgatgaattaccgtatgacacaggagttcaggcctccttttcatgttaataccttgattgaagaggccggacgccttaaggctgaagtgataattaaaatacgagccgagttcccttcagacataattgcaaacacgattgctgttcagatgccattgccaaattatacttgcagggctagttttgagttagaacatgatgcggttggacagaagacagatttcaaggaaaccagcaaaatgcttgaatggagtttgaaaaagattgttggcggggctgaacatacactgcgtgccaagctgacattttctcaggaatttcatggtaatatcacaaaggaagctggacctgtcagcatgacgttcacgatacccatgtacaatgtttcaaaacttcaggtcaaatacttgcagatagcaaagaaatcaagtagttacaatccatatcgttgggtgaggtatgtgacgcaggccaattcgtacgtggctcggatatgaccaactttgagataatgtttgtcactttgtatgtctcctaagtactttctattttcttctcgagagtgtgttcatttttcaagtcaatacttgttctgagttctacggtgggtgcccc

SEQ ID NO: 7129 - DNA, 2197 bp, Gossypium hirsutum
ctccgaggtcaagaaaggaataatttaaattctaaggtatggacataaaatttcgagatctttaaggggtcaaaacataaatgtaaaatcgaagtaaaaaacagccgagtggaaagaagcagaagaaacaaagcctaaaagatcgaagctgcagtgcataaaaacaaagcaaaatcaaaatcgcaggcaaattcatagagggaaggaaatcggaggagacgatttgaacggcgaaaatcatgatctctcagtttttcgtgctctctcagcgaggcgataacatagtttttcgcgattatcggggtgaagtagcgaaaggaagtgcagagattttcttccggaaagttaagttctggaaagaggatggacaagaggaggcaccccctgtctttaatgtggatggtgtgaactacttccatgtgaaggttgttgggctgttgtttgttgcaaccacaagggttaatgtatcgccatctcttgtcctggaacttctgcaaaggattgctcgtgtcattaaagattatttaggggttctaagtgaagattcattgcggaaaaactttgttcttgtatatgaactgcttgatgaagtcattgactttggttatgtgcaaacaacatctactgaagttttgaagtcctacgtttttaatgagccaattgtggttgatgctgcacgtttgcaacctcttggccctgctgccatctttatgcaaggaaccaaaagaatgcctggcacagcagttacgaagtctgttgtagcaaatgagcctggaggccggaagagagaggaaatttttgtggatataattgagaaaatcagtgtcacatttagctctagtgggtatatactgacttccgagattgatggcactattcaaatgaaaagttatttgtcaggaaatccagaaattcgactagctcttaatgaagatctgagcataggaagaggagggggaacagtctatgactataggagttcatctggttcaggcgctgtgatactcgatgattgtaattttcatgaatcagtgcgtcttgatagttttgacatggacaggactctatctctggtaccaccagatggtgaatttcctgtcatgaactaccgaatgacgcaggaatttaagcctcctttccgtattaattgtttaattgaagaagcaggacagcttaaagctgaagttattattaaagtacgtgcggagttcccttcaaacattactgcaaacacaattgctgtacaaatgccacttcctaaatatactactagagctagttttgagttggaacctggagctgttggacaaagaactgatttcaaagaagctaacaagaaacttgaatggggattgaagaagatcgtgggtggatctgaacatacacttcgtgcaaagctgacattttcacaggaatcacatgcaaacctcacaaaggaagctggtccagttagcatgactttcacaataccaatgtataatgtttcaaggcttcaggtgaaatacttgcagatagcaaagaaatccagctcctataatccatatcgatgggtgagatatgtcactcaggccaattcgtatgttgctcgaatatgatacagtcaaacctctctttttctttaatatgttctgtatttgttgactcccagatggcacttttttccttttttttcccttttcattaactgctttaaacatttttatcatgtagccattacctgatttctatgttagtggtctttgtattgacaatctagtacaatttttggatgttgcgtttgtgccgaattcaatgtttgcgggatgttatttgttgattcgcaagcatggagccgttctacttgcatttaactaccctacattagtaaaccctgctatacttgactggcacaggcaccggcaccggccccggccatcacgtgcatgatcattcttgtgttagaaaagatgaaacaaacattccatgctttccttctgttaccttgcatacagactattcatggtttccaggccgtgaaatatcaaccctttgtatttccttccgtcaactttgcttatattagtaggtttgcccggtccaaggtttaaaagaaagggcttctcttttcaaagcctgattactattatatgtattcagaatttttaatagtttttgaaaaataagtatatttatattcatatttatgtttgaatatatc

SEQ ID NO: 7130 - DNA, 1643 bp, Ricinus communis
agctctgttagcacacaaaagaacaaatcgcccaaccatagttaacagagacacggattcaaagtacagagaagaagaaactgaagcaagaacaataacaagtacaagaacaagaagcttcaagaagagaaaatcatgatctctcaattcttcgttctctctcaaagaggcgataatattgtctttcgcgactatcgcggtgaagtacccaaaggaagtgctgagatattttttcggaaagtgaagttttggaaggaagatggacaagaagaggcgccacctgtctttaatgtcgatggggtgaactactttcatgttaaggttgttggattattatttgttgcaacaacaagagttaatgtgtcaccttctctggtgttggaactcttacaaaggattgcacgtgtcatcaaagattaccttggaattctcaatgaagattctttgcgcaaaaactttgtgcttgtctatgaattgcttgatgaagtgatagattttggttatgtacagacaacttccactgaagtgttaaagtcctatgtatttaatgagccaattgtagttgatgttggacgtttgcaacctatgaaccctgctgccatttttatgcaagggaccaaaaggatgccaggtacagctgtaacaaaatctgttgtagcaaatgagcctggaggtagaaagagggaggaaatatttgtggatataatcgagaaaatcagtgtcacatttagctctagtggctatatactgacatctgaaattgatggcaccatccaaatgaagagctatctttctggaaatccagaaattcgattagcccttaacgaggacctggggattggaagaggtagtgggagatcggtatatgattataggagttcatctggatcaggagcagtgatacttgatgattgtaatttccatgaatctgtacgtcttgataattttgatctggatagaactttgactctggtacctccagatggtgaatttcctgtcatgaattatcgtatgacccaggaattcaaacctccttttcgcattaataccttgattgaggaagcaggagcccttaaggctgaagtgattcttaaaatatcagctgagtttccctcgagcattactgcaaacacaattaacattcagatgtcattgcctaaatatactactagggctacttttgagttggaacctggagtatttgggcaaacagcagatttcaaggaagcaaataagaagcttgagtggggattaaagaagattgttggtggatctgaacatacattacgtgcaaagctgactttttcacaggaattgcatggcaatatcacaaaggaggctggacctgtcagcatgacattcacaataccaatgtacaatgcttctaggcttcaggtgaagtacttgcagattgcgaagaagtcgaacacctataatccgtatcgatgggtgagatatgttactcaggccaattcttatgttgctcggatatgagtcagtagtctcctgtgtgcttcttgttcatcctgattttgtaatgttactatttttaattttcttcaatgtgcaatacattcttcccctagaggtaaatctgtcaatttgaggcgttgtattaaaaaggaacaactatgtgttgcgga

SEQ ID NO: 7131 - DNA, 3790 bp, Ricinus communis
ttcaaaatatgcttcttatattacaggatcaagaacttatccgattcttacgacaactgtagctgctctcagacacagatacagctcagagaagattgccaaagttaatggtactcgaaaaggattgctctcttcggacaaagaaaacccagttgtgagattggatgcttcaatcagttcccttggacttgttcaagaactcacaagtagcaatacacagaatgtatccaaaactgatggatttctgcttgccttgagtattctcagcgacatgcttttgaacagaaaagaagcagagaatttcaaaaatcttgctgaattgcaatcaccgaagtttatggtgattgcttgtgtagactctagagtttgcccatctaacgtccttggatttcaacctggagaagcttttatggttcgaaatgttgcaaatatagtccccgcacttgagaatagaccaacagaaacaactgctgcccttgagtttgctgtaaatactcttgaagttgaaaatatatttgttattggccatagtaactgtgcaggaattcaagctctaatgagtatgaaagacgacaataaatccagctttgttgagaagtgggttgctactgccaaaattgccaagttaagaacaaaaactgatgccggtggccttagctttgatcaacaatgcaaacattgtgagaaggaatctatcaactggtcgttgctgaacttactaacatatccatggattgaagaacgggtgaagaaagaaacactctctattcatggagggtactatgatttcttaaattgcacattcgagaaatggactcttgatttcaatggaagcagtgttggccatggcggcagattctcaaccaaagccacagaattgtggagttgactgttgaagtgttgggtttacttgtatttgcatcttccttcatccccaatagttggattccacctttggtccattgcaaaagaccgtactctgaattattttaacctgtaaatatgccgttacagggcagtaaatacatatacaaacactactttatcttttatttaaatataaatatacatgcaactaaaatacaaataattattatttttttttgttttctggcaaattcttcaacttttagaccagatcaaatgaatatgaacagagctcaaatctaatttgtgtctgtttttctatattgtataaggaaaagtagtttaacttccagttttcttttacatgcggaagaatcgcaaataattgctttaatgaagaaaatgtgaaatctaaaatatcataatttataattactttaacaaaaaaaatgtgaattctatattatgacaacttataattttaaaatatgttaatttacagtgactcttaatattttatatttttatataatgaaatttataaaatatgaattaaaattatagaaatatttaaaatgtaatttttataaagtatatattaaaatattcttatataaatattttaagattatttttatataaatttatttaaattttataattaataaacatataaaaatactgaaaatactataaattgtgatattttaaaatttatcaaaaaaatataattaatacaaataaaaaaataattttttatttataagaggaaatctcagtggtgtgaaaattgggctaatttcttttttagagaattgtggtttatttttggagattaacgggcaatgataacttttatatttttagataaattagcatatttgttataaaattatagtgcatataattattaataataccattttggtaatattagcaattcttgtgaagttggaataattctttttaaaaaaaatgaaattcgacaattttttattcctttttcttttttaataaagtaattataaccatgtttttgtttagctctgttagcacacaaaagaacaaatcgcccaaccatagttaacagagacacggattcaaagtacagagaagaagaaactgaagcaagaacaataacaagtacaagaacaagaagcttcaagaagagaaaatcatgatctctcaattcttcgttctctctcaaagaggcgataatattgtctttcgcgactatcgcggtgaagtacccaaaggaagtgctgagatattttttcggaaagtgaagttttggaaggaagatggacaagaagaggcgccacctgtctttaatgtcgatggggtgaactactttcatgttaaggttgttggattattatttgttgcaacaacaagagttaatgtgtcaccttctctggtgttggaactcttacaaaggattgcacgtgtcatcaaagattaccttggaattctcaatgaagattctttgcgcaaaaactttgtgcttgtctatgaattgcttgatgaagtgatagattttggttatgtacagacaacttccactgaagtgttaaagtcctatgtatttaatgagccaattgtagttgatgttggacgtttgcaacctatgaaccctgctgccatttttatgcaagggaccaaaaggatgccaggtacagctgtaacaaaatctgttgtagcaaatgagcctggaggtagaaagagggaggaaatatttgtggatataatcgagaaaatcagtgtcacatttagctctagtggctatatactgacatctgaaattgatggcaccatccaaatgaagagctatctttctggaaatccagaaattcgattagcccttaacgaggacctggggattggaagaggtagtgggagatcggtatatgattataggagttcatctggatcaggagcagtgatacttgatgattgtaatttccatgaatctgtacgtcttgataattttgatctggatagaactttgactctggtacctccagatggtgaatttcctgtcatgaattatcgtatgacccaggaattcaaacctccttttcgcattaataccttgattgaggaagcaggagcccttaaggctgaagtgattcttaaaatatcagctgagtttccctcgagcattactgcaaacacaattaacattcagatgtcattgcctaaatatactactagggctacttttgagttggaacctggagtatttgggcaaacagcagatttcaaggaagcaaataagaagcttgagtggggattaaagaagattgttggtggatctgaacatacattacgtgcaaagctgactttttcacaggaattgcatggcaatatcacaaaggaggctggacctgtcagcatgacattcacaataccaatgtacaatgcttctaggcttcaggtgaagtacttgcagattgcgaagaagtcgaacacctataatccgtatcgatgggtgagatatgttactcaggccaattcttatgttgctcggatatgagtcagtagtctcctgtgtgcttcttgttcatcctgattttgtaatgttactatttttaattttcttcaatgtgcaatacattcttcccctagaggtaaatctgtcaatttgaggcgttgtattaaaaaggaacaactatgtgttgcggaccacttgggaatggttttgatgttgccatatgtaggatgtcgtttgttaaaatttatcatccaaagaacccttttaggacatgcacatgaataaagcatgggttcaagatggaaagtgaatcccatgcctgactttttgggcctttaaataggcactacttaattgcttgtgccgttggcgatgcacactgaaaaagcaaaaaaaaaaaaagaaaaaagaaaaagaaaagagaagtgt

SEQ ID NO: 7132 - DNA, 1679 bp, Populus trichocarpa
aattggtgcctcaacttgaactagcttgcaagactgcagaaacaaatcgatcgagctaaaaaaaagaaagaaatcatgatctctcaattcttcgtgctctcgcagcgaggcgacaatattgtctttcgcgattatcgcggtgaagttccaaaaggaagtgcagaaatatttttccgcaaagtcaagttttggaaggaagacggagaagaagaggccccccctgtctttaatgtggatggtgtaaactactttcatgtgaaagtagttggattattatttgttgcaaccacgagagcaaatgtgtcaccttctctagtcttggaacttttacaaaggattgctcgtgttatcaaagattatcttggggttctcaatgaagattctcttcggaaaaactttgtgctcgtgtatgagttgcttgatgaagtcattgattttggttatgtacaaaccacgtccactgaactgttgaagtcctatgtattcaatgagccacttgtggtcgatgctgcacgtttgcaacctctgagtcctgctgccattttcatgcaagggacaaaaaggatgccaggtacagctgtcacaaagtctgttgttgcaaatgagccagggggtaggaagagggaggaaatctttgtggatataattgagaaaatcagtgtgacattcagctctagtggatatatattgacttctgaaattgatggcaccattcaaatgaagagctatctttctggaaatccagaaatccgattagcccttaacgaggacttgagcataggaagaggtgattatagaagttcatttgggtcaggctcagtgatacttgatgattgtaatttccatgagtctgtacgtctagataattttgatctggatagaactttgactctggtaccgccagatggtgaatttcctgtcatgaattatcggatgactcaggaatttaaacctccttttcgcattaatactttgatagaagaagcaggtgcacttaaggctgaagtgattcttaaagtatctgctgaatttccctcaagcattaccgcaaacacaatcattgtacagatgccactgccaaaatataccaccagagttaattttgagttggaacctggagcacttgggcaaacaacagatttcaaggaagcaaataggaggcttgaatggggattaaagaagattgttgggggatcagagcataccttacgtgcaaagctgacattttcacaggagttgcatgggaatatcacaaaggaagctggaccagttagcatgacattcacaattccgatgtataatgcttcacgtcttcaggtgaaatacttgcagatagcaaagaaatcaagtacatataatccatatcgatgggtgagatacgttacacaggccaattcctatgttgcccgtatatgatgctctaatctcccctttgttccttgcacattttgttaatgttatcatctgtatttttgtgtaactttttttgcccattgatccttgtattgttgtaactcttttagatgatgatctttgcacttgcgagttttattgaccatctagatcgattctcaacggacgtagtcctgtgtttaatttgccctcctgtagatgaactccattcaaggacaaacacccacctgtctgatgtttgtgaaaagtgatagatgaaacagtta

SEQ ID NO: 7133 - DNA, 1670 bp, Manihot esculenta
agtccaagtcgaagtctcgaagccaagggaaaatcgcccgagcttggtttacagacagacaaattagagaacgaaaagaaaaaggaagaagaaacagctgagcaataatgatctctcagttctttgtgctatcccagcgaggcgataatattgtcttccgcgactatcgcggtgaagtaccaaaaggaagtgcagaaatattttttcggaaagtgaagttttggaaggaggatggacaagaagaggcgccgcctgtctttaatgtggatggggtgaactactttcatgtaaaggttgttggattattatttgttgcaaccacaagggttaatgtgtcaccatcactggtcttggaactcttacaaaggattgctcgcgttatcaaagattatcttgggattctcaatgaagattctttgcggaaaaactttgtgctcgtgtatgaattgcttgatgaagtgatagattttggttatgtacagacaacatctactgaattgttgaagtcctatgtttttaatgagccaattgtggttgatgctggccgtttgcagcctctgaaccctgctgccatttttatgcaagggacaaaaaggatgccgggtacagcagtaactaaatctgttgtggcaaatgagcctggaggtaggaagagggaggaaatattcgtggatataatcgagaaaatcagtgtcacatttagctctagtggttatatactgacatctgaaattgatggcaccattcaaatgaagagttatcttactggaaatccagaaattcggttagcccttaatgaggacctgagcataggaagaggaaatggaagatcagcctatgattataggagttcatttgggtccggagctgtgatacttgatgattgtaatttccatgaatctgtacgtcttgataattttgatcttgatagaacattgacactggtgcccccagatggagaatttcctgtcatgaactatcgtttaacccaggaattcaaacctcctttccgcattaatgctttgattgaggtagcaggagctctcaaggctgaggtgatccttaaaatatcggctgagttcccctcaagcattacagcaaacacaatttctgtacagatgccgttgccaaaatatactgccagagctacttatgagctggagcctggagcaattggacaaacaacagattttaaagaagcaaataagagacttgaatggggattgaagaagattgttggtggatccgaacatacattacgtgcaaaactgacgttttcacaggagttgcatgggaatattacaaaggaggctggaccagtcagcatgacattcacaattccaatgtacaatgcttctaggcttcaggtgaaatacttgcagatagcaaagaagtctaatacctacaacccttatcgatgggtgagatacgtcacacaggccaattcttatgttgctcgtatatgactatggtagtcttccacctacctttttgttcatcctgatttcgcacttttattgttattgttttcttcaatttttccttttactcaacgtaatatacttcaatttgacccttgtattagcagcagcttactttgccaattattcaccccttttatgttcaatgctacattgtcattttaaagttaatacttgaaagataaaagc

SEQ ID NO: 7134 - DNA, 1679 bp, Tragopogon dubius
tatacgatggtcgccgcgagatgtatcgtcgatcgggaagtcttggaggggctgtgcacaacattgcgactgcttgtggtctccgagtattagagatttgaatcggggaagagagctgtttggttgccatgatctcgcagttcttcgtattatcgcagagaggcgataacattgtttttcgtgattaccgtggcgatgtgcaaaaaggaagtgcagagatatttttccgtaaagtgaagttctggaaagaagatggcgaaaccgaggctccacctgtctttaatgtggatggagtcaactactttcatgtaaaagtagtcggattgttgtttgtcgcaaccacaagagcaaacgtatcaccttctctagtcttagagcttctacaaagaatagcgcgtgtcactaaagactaccttggcatcctcaatgaagattccatacgaaaaaactttgtccttgtctatgaactactcgatgaagtcattgatttcggttatgtccaaacaacatcaactgaagttcttaagtcgtctgtgttcaatgagccaataatgcttgatgcttcacatatgccacctcttgggcctgctgccctctttatgcaagggagtaaaagaatgccggggacagctgtcacgaaatcagtggtagctaatgagcccggtggcaggaagagagaggaaattttcgtggatataattgagaaaataagtgtcacatttagctcaagtggatatatattaacttctgagatagatggaaccattcaaatgaaaagttatctttctgggaacccagaaattcgattagctttaaatgaggatcttaatataggaagaggtggcagatcagtatacgactatggaggttctagtgggtctggatcggttatactagatgattgcaatttccatgaatcggttcatcttgatagctttgatgtggacagaactttgactcttgtgcctcctgatggtgaatttcctgtcatgaactatcgtatgactcaggagtttaagccaccttttcgtattaacaccttgattgaagaagcaggatcacttaaggctgaggtgattctgaaaatacgggcagagtttcctcaaaatataactgcaaatacagttgtgattcagatgccagtgccaacctacacatccagagtaagttttgagttggaacccggagcagttggacaaatgactgatttcaaggagtcaaataagaaacttgagtgggggttaaaaaagattgttggtggaaccgaacatacactgcgtgccaaattaacattttcacatgaatcacacggtaatataacgaaagaagcgggccctgtcagcatgaccttcaccataccaatgtacaactgctcaagacttcaggtgaaatatttgcaaattgcgaagaagtcgaaaacatataatccatataggtgggtgagatatgttacgcaagcgaattcttatgttgctcgtatatgatttagttggagtttctaaactttggttgcaacatcttttgattttccctttttttttttctatgtgatgtgtttgatagatttgtttttcgtgtaacattgatctttttgtttaatgttgaattatgatatatttcaatgttcatctatgaattacttgataagttcaaaaataatatatcactttcttacaatc

SEQ ID NO: 7135 - DNA, 1849 bp, Tropaeolum majus
agaaactctcaatccccgtgaccggaaggatcatcacctagttgctcttcttcttacactcgtgtcacacaagactttcttctccctcgatccgatttcacatacctatctcctcctcatcgatccggggtcaccgcgagcccctcggcatcttaacgaacgccggacttcttcaccaaccacctcttgctgtcttatctgaaaaactgagttttttttttgcttccatatccctgtgtggtaaagctttgctttggattaatagcacctccagtttagctaagcaatattcaagcttgaatcgaggaactgttctacaaccatgatctcacaattttttgtgctgtcacagagaggcgataacattgtgtttcgtgactatcgtggtgaagtacctaaaggaagtgctgagatttttttccgtaaagttaagttctggaaagaagatggagaaggggatgcaccacccgtctttaatgtggatggcgttaattactttcacgtgaaagttgctgggttgttgtttgttgcaacaacaagggttaacgtgtcaccttccctcgttttggaactcctacaaaggattgcacgtgtcattaaagattaccttggcgttctcaatgaagattcattcaggaaaaactttattcttgtgtatgagcttttggatgaagtaattgattttggatatgtgcagacaacttcaactgagatgctaaagtcgtatgtgttcaatgaaccaattgtaattgaagctgcacgactgccaaaccttggtcctgcttcactctttatgcaagggacaaaaagaatgccaggcacggctgttacaaaatctgttgtagcgaatgaacctggagggaagaagagagaagaaatttttgtggatataattgagaaaataagtgtcacatttagcgcaagtggatacatacttacttctgagattgatggaaccattcagatgaagagttatctttcaggaaatccagaaattcgacttgctcttaatgatgatttgagtataggaaggggaggaagatcgatctatgattataatagctcatcaggaggtgctgtaattctagatgattgtaatttccatgaatcagtacatcttgataactttgaaaatgatagaactctatcactggtaccgccagatggggaattccctgtgatgaactaccgaatgactcaggagttcaagcctccctttcgtattaatgcattaattgaggtggcaggacccctaaaggcagaagttattcttaaagtgcgagctgagttcccgtctagcattactgcaaacactattcagatacagatgccactgcccacctatacaacaagggttagctttgagttggagcctggcacagttggcaacacaactgatttcaaggaatcgagtaagaaactcgaatggggcttaaaaaagattgttggtggatcggagcatactttacgcgcaaaactgacattttcacaggagtcccatggaaatatcacgaaagaagctggtccagttagcatgaccttcacgatcccaatgtacaacacctcgaaacttcaggtgaagtatttacagatcgcaaaaaagtcgagttcttacaacccataccgatgggtgagatacgtcactcaagcaaactcatatgtagcccgtttgtaatttacaactttttttcttcccctagtttcctgtactcctgtttctatgtttatctttgtgtgcgctttggttgtttatcatacaccaagtatccctaaatttccgatcagtgtatccgtgaattaaatagttttatgtacttccattataatggacgaaagataatatttattt

SEQ ID NO: 7136 - DNA, 1691 bp, Ambrosia trifida
tagtaatttatacggtagtgcaccacgtgatgtaccgtcgatgtaaaagtctctacagagccttacgacttgttgtggtctccctcaatattaaatagttgaatcaggaaggagactgcaatgatctcgcagttctttgttttgtcacagagaggcgataacatcgtctttcgtgattaccgtggtgatgtgcaaaaaggaagtgcagagatattttttcgtaaagtaaagttctggagcgaggacggggaagcggaggctccacctgtctttaatgtggatggtgtcaactacttccatgtaaaggtggtcggattattgtttgttgcaaccactagaacaaatgtatcaccatctcttgtattggagcttctacaaagaatagcacgtgttactaaagattaccttggcatccttaatgaagattctataagaaaaaactttgtgcttgtgtatgaattacttgatgaagttattgattttggttatgtgcaaacaacatcgactgaagttctaaagtcatgtgtatttaatgagccaatcatgattgacgcagcacatatgccacctcttggtccggctgccctctttatgcaagggaacaaaagaatgccagggacagctgtcacaaaatcagttgtagctaatgaacctgggggtaggagaagggaggaaattttcgtggatataattgaaaaaataagtcttacatttagctctagtggatatatactaacctctgagatagatggcaccattcaaatgaagagttatctttctgggaatccagaaattcgattagctctcaatgaggacttgaatataggaagaggtggcagatcagtatatgattatggtggttctagtggatcaggagctgttatactagatgattgcaattttcatgaatcggtgcatcttgatagttttgatgttgatagaactttgactcttgttccccctgatggtgaatttccagttatgaattatcgcatgactcaggaatttaagccaccttttcgtattaacaccttgattgaagaggcagggtcacttaaggctgaagtgattctgaaaatacgtgctgaattccctcaaaatataactgcaaatacagttgtagttcagatgccagtgccaaaatacacatccagagtcagttttgaattggaatccggagccattggacaagtgactgatttcaaggaaccgaataagaaaatcgagtgggggttaaaaaagattgttggtggatcggaacatacattgcgtgccaaattaacatttgcacatgaatcacatggcaatataacaaaagaagctggacctgtcagcatgactttcactataccaatgtacaactgctcaagactccaggtgaaatacttgcagatcgctaagaagtcgaaaacttataacccgtatcgttgggttagatacgtcacccaagcaaattcctacgttgcgcgtatatgagtaatttgaacgtttgaactttggttgtaatttcacattttctttataattttggttttcatctctaagacgtgtttagaagcttgatcatacttcgcgtgacagtagatattttcaatgttgaaccatggattttgtgacgagttgcccatgaccgcgtggtaataattaaaacacgaggagtggtgttgtattattaatcttcagtttataca

SEQ ID NO: 7137 - DNA, 1733 bp, Centaurea maculosa
  misc_feature (73)..(73): n is a, c, g, or t
  misc_feature (79)..(79): n is a, c, g, or t
  misc_feature (88)..(88): n is a, c, g, or t
  misc_feature (93)..(93): n is a, c, g, or t
  misc_feature (114)..(114): n is a, c, g, or t
  misc_feature (134)..(134): n is a, c, g, or t
  misc_feature (695)..(695): n is a, c, g, or t
  misc_feature (1320)..(1320): n is a, c, g, or t
  misc_feature (1580)..(1580): n is a, c, g, or t
  misc_feature (1595)..(1595): n is a, c, g, or t
  misc_feature (1609)..(1609): n is a, c, g, or t
  misc_feature (1618)..(1618): n is a, c, g, or t
  misc_feature (1656)..(1656): n is a, c, g, or t
attctttttaattctctactacattcataaacgtattcattatatagtgagagcgtccccatcgtcacactgnctttcngagcattantctcngatctcattattatcgcttcntctgctctacaatcatcctntgatttctccagagatagttgaaaatcaattggaagaaaaagctgcttgattggttgccatgatttcacagttctttgtattatcgcagagaggcgataatatcgtttttcgtgattatcgcagtgatgtgcaaaaaggaagtgcagagatattttttcgtaaagtgaagttctggaaagaggatggggaaactgaggctccacctgtctttaaatgtggatggtgtcaactactttcacgtaaaggtggttggattgctatttgttgcaaccactagagcaaatgtgtcaccttctcttgtcttggagcttctgcaaagaatagcacgtgttactaaagattaccttggcatcctcaatgaagattctatacggaaaaactttgtgcttatgtatgaattacttgatgaagttattgattttggatatgtgcaaacaacatcgactgaagttctaaagtcatctgtatttaatgaaccaatcatgattgaggcgacacatatgccacctcttggtccggccgccctctttatgcaagggagcaaaagaatgccagggacngctgtcacgaaatcagttgtagctaatgaacctgggggtaggaagagggaggagatttttgtggatataattgaaaaaattagcgttacattcagctctagtggatatatactaacatctgagatagatggcaccattcaaatgaagagttatctttccgggaatccagaaatcagattagctctcaatgaggacctaaatataggaagaggtggcagatcaatatatgactatggtggctctagtggatcgggagccgttatactagatgattgcaatttccatgaatcagtgcatcttgatagttttgatgtggatagaactctgactcttgtgccccctgatggtgaattcccggtcatgaattatcgaatgactcaggaatttaagccacctttccgtattaacaccctgatcgaagaagcgggatcgctgaaggctgaggtgattctgaaaatacgtgccgagttccctcaaaatatcaccgcaaatacagtggttgttcagatgcctctgccaacatacacatccagagttagttttgagttggaaccgggagcagttggacaagtgactgatttcaaggagacaaataagaaactcgaatgggggttaaagaagatcnttggtggatctgaccatacactgcgcgccaagttaacattttcacatgaatcacatggtaatataacaaaagaggctggccctgtcagcatgaccttcaccataccaatgtataactgctcaagactccaggtgaaatacttgcaaattgcaaagaagtcgaaaacttataatccatatcggtgggtgagatacgtgacccaagccaactcctatgttgctcgtatatgatcagtttgagcttctaaaactccctgtagnatatcgactttcttnaaattttcctcttncatatgtancatgtgctttatttaataaattcccgttcatgtaaccnctagatttttgctttgttgaagcactggtaggagttgtcgaatagaccggtgttgtatgaagctccaagttatattc

SEQ ID NO: 7138 - DNA, 1638 bp, Ambrosia trifida
tacagagccttacgacttgttgtggcctctctcaatattaaatagttgaatcaggaaggagactgcaatgatctcgcagttctttgttttgtcgcagagaggcgataacatcgtctttcgtgattaccgtggtgatgtgcaaaaaggaagcgcagagatattttttcgtaaagtaaagttctggagcgaggacggggaagcggaggctccacctgtctttaatgtggatggtgtcaactacttccatgtaaaggtggtcggattactgtttgttgcaaccactagagcaaatgtatcaccatctcttgtattggagcttctacaaagaatagcacgtgttactaaagattaccttggcattctcaatgaagattctatagaaaaaactttgtgcttgtgtatgaattacttgatgaagttgttgattttggttatgtgcaaacaacatcgactgaagttctaaagtcatgtgtatttaatgagccaatcatgattgacgctgcacatatgccacctcttggtccggctgccctctttatgcaagggaacaaaagaatgccagggacagctgtcacaaaatcagttgtagctaatgaacctgggggtaggagaagggaggaaatttttgtggatataattgaaaaaataagtcttacatttagctctagtggatatatactaacctctgagatagatggcaccattcaaatgaagagttatctttctgggaatccagaaattcgattagctctcaacgaggacttgaatataggaagaggtggcagatcagtatatgattatggtggttctagtggatcaggagctgttatactagatgattgcaattttcatgaatcagtgcatcttgatagttttgatgtggatagaactttgactcttgttcccccggatggtgaatttcctgttatgaattatcgcatgactcaggaatttaagccaccttttcgtattaacaccttgattgaagaggcaggatcacttaaggctgaggtgattctgaaaatacgtgctgaattccctcaaaatataactgcaaatacagttgtagttcagatgccagtgccaaaatacacatccagagtcagttttgaattggaatccggggcagttggacaagtgactgatttcaaggaaccgaataagaaaatcgagtggggttaaaaaagattgttggtggatcagagcatacactgcgagccaaattaacatttgcacatgaatcacatggcaatataacaaaagaagctggacctgtcagcatgactttcactataccaatgtacaactgctcaagactccaggtgaaatacttgcagatcgctaagaagtccaaaacttataacccgtatcgttgggttagatacgtcactcaagcaaattcctatgttgcgcgcatatgagtaatttgagtgtctgaactttggttgtaatttcccatttctttataatttggtttttcatctctaagacgtgtttagaagcttgatcatacttcgcttgacagtagacattttcaatgttgaaccatggattttgtgatgagttgcccatgaccgcgtggtaataattaaaacacgaggagtggtgttgtattattaatcttcagtttatacacaa

SEQ ID NO: 7139 - DNA, 1974 bp, Gossypium hirsutum
actttcaagtgccaaagtttcatcggctattgaatcaacaacttaaacgtgttggtatttaaacacacgtaggatagtaaaaagaaaataattggtgaaaatatcagaagaagacaagcgaaaactttaaatgaagacaaaataaaatagaagtcggagctgaatttgcagagagaataaaacagaggagacgattcaaaaagaagcttcaatcatgatctcacagttcttcgtgctttctcagcgaggcgataacatagtgtttcgcgattatcgcggtgaagtagcaaagggtagtgcagagatattctttcgtaaagttaagttttggaaagaggatggtcaagaggaggcgccccctgtctttaacgtggatggtgtgagctacttccatgtgaaggttgttgggctgctgtttgttgcaaccacaagagttaatgtgtccccgtctcttgtcctggaacttctgcaaaggattgctcgtgttattaaggattatttaggggttttaagtgaagattcacttcggaaaaactttgtacttgtatatgagttgcttgatgaagtcattgacttcggttatatgcaaacaacctctactgaagttttgaagtcctacatatttaatgagccaattgtggttgatgctgcgcgtttgcaacctcttggccctgctgccatctttatgcaaggaactaaaaggatgcctggcacagcaattacaaaatctgttgtagctaatgagcccggaggtcggaagagagaggaaatttttgtggatataattgagaaaatcagtgttacatttagctctagtggatatatactgacttctgagattgatggcactattcaaatgaaaagttatctgacaggaaatccagaaatccgattagcacttaatgaagacttgagtattggaagaggaggggaatcggccaatgattataggagttcatatggttcgggggctgtgatccttgatgattgtaatttcatgaatcagtgcgccttgatagtttcgatatggataggactctggctctggtaccaccggatggtgaatttcctgtcatgaactaccgaatgacacaggaattcaagcctccttttcatattaattgcttaattgaagaagcaggacaccttaaggctgaagtgattcttaaagtacgagcagagttcccctcaaacattactgcaaacacagttgttttagagatgccacttcctaaatatactaccagagctagttttgagttggaacctggagttactgggcaaagaacagatttcaaaggagcaaacaagaaacttgaatgggatttagaaaagtttgttggtggagttgaacatacactgcgtgcgaagctgactttttctcaggaattgcatgcaaacatcataaaggaagctggaccagttagcatgactttcacaataccgatgtataatgtttcaaggcttcaggtgaaatacttgcagatagcaaagaaatctagttcctataatccatatcgatgggtgagatatgttactcaggccaattcatatgttgctcgaatataataaggtgaaatccccttcccccctaaaaaaaggttcatatttgttatctcctggattatacactatttttcttcaccagattatacatttgttgaactatcccatatattcaagttgcttcgtctgttgaatttctctattttgtatattacgggtgtttggattgacaatttggtacagtttaatatttgtcagaattagatatcacctcctacgatttagagctgttcttttggaaatcgtatgtatcctgtaagattagagctgttgtggcctaaacgatctttttattccgatgtacaagctatgcagtccatatgagatatatgtagatgaaagtatgtaggagatccctatatccctgtatcaaattggttaaattggttcctctattattaaatggat

SEQ ID NO: 7140 - DNA, 1743 bp, Carica papaya
aaatatacagtgaaaaagctatgagtgcaaatttctgatcatccaagttcttaaacgaaataggaagacacaattgagatacatagaatagactcgaagatatcaagcgcagccgagctcagatacagaaatcatgatctcgcagttcttcgtcttgtctcagcgaggcgataatatcgtttttcgcgattatcgtggtgaggtaccaaaaggaagtacggagatctttttccgcaaagtcaagttctggaaggaggatggacaagaggaggcaccacctgtctttaatgtggatggcgttaactacttccacgtgaaggttgttggactgttgtttgttgcaaccacaagagttaatgcatcaccttctcttctattggagcttctacaaaggattgctcgtgttattaaggattatcttggtgttctcaatgaagattcacttaggaaaaactttgttcttgtctatgagttgcttgacgaagtcattgactttggttatgtgcaaacaacatccactgaagtgttgaaatcctatgtgtttaatgagcccattgtgatcagtgctgcacgtctacaaactcttgatcctgctgccatctttaggcaagggattaagagaatgcctggaacagctgtgacaaaatctgttgtggcaaatgaacctgggggccggaagagagaagaaatttttgtagatataatagaaaagatcagtgtcacattcagctctagtggatatatattgacctctgagattgacggcaccattcaaatgaagagttacctgtctggcaatccagaaatccgattagctcttaatgatgaattgagcataggacgaggggggacatcaacatatgattataggacttcatatgggtcaggaagtgtgatacttgatgattgcaattttcatgagtctgttcatcttgatagttttgacatagacagaactttgactctggttccaccagatggtgaattccctgttatgaattaccgaatgaccaaggaattcaagcctcctttccgtatcaatgcactgattgaagaggcaggatctcttaaggctgaagtgattctcaaagtaagtgctgagtttgccacaaatatttcagcaaacacagttgtgatagagatgccactgccaaaatatactaccagggttagtttcgagttagaatctggggctatcgggcagaggacagatttcaaagaagcaaacaagaggcttgaatggtgtttgaagaagatttttggagggggtgaacatactctacgtgcgaagctgacattttcgcaggaagttcatggaaatatcacaaaagaagctggaccagttagcatgacattcaccatacctatgtataacgcttctgggcttcaggttaaatacctacagattgcaaagaaatcagccaactacaatccatatcgatgggtgagatatgttactcagtcgaattcctatgttgctaggttatgaaatgatgccaataaagtcttcttacgaagttgggcgatgttgttgtttggaacaaagtgtatatcataatttagttatacatctaaacagtagagtctctttcctccctgctgcatttgttggttatataatctttgtactgtcatgttttttggtcaaatttctatcctcttagcaatgtgcttagactttatacagtgattctctcatgacttttttgctgtccatgaacagttttctttcaagctaaatga

SEQ ID NO: 7141 - DNA, 1484 bp, Cichorium intybus
cggggatcgtcgattgggagtctttggagaggctgtgcataacactgcaaccggttgtcgtctccgaatactagagatttgaatcggggaagaaagttgttcggttgccatgatctcgcagttcttcgtcttatctcagagaggcgataacatcgtttttcgtgactatcgtggcgatattcaaaaaggaagtgcagagatattctttcgtaaagtaaaattctggaaagaggatggtgaaaccgaggcgccacctgtctttaacgtagatggtgtcaactactttcatgtaaaagtagttggattactctttgttgcaaccactcgagcaaatgtatcaccttctcttgtcttggaacttctacaaagaatcgcacgtgtcaccaaagattatttaggcatcctcaatgaagattctatacgcaaaaactttgttcttgtgtatgaattactcgatgaagttattgattttggttatgtgcaaacaacatcaacagaagttctaaagtcatctgtgtttaatgagccaatcatggttgattcagcacatatgccacctcttggtcctgctgccctctttatgcaagggaacaaaagaatgccagggacagctgtcacgaaatcagtagtggctaatgaaccagggggtagaaaaagggaagaaatattcgtggatataattgaaaaaataagtgttacattcagctctagtggatatattttaacttctgaaatagatggaaccattcaaatgaaaagttatctttctggaaatcctgaaatccgattggctcttaatgaggatctgaatataggaagaggtggcagatcagtatacgattatggtggttctagtggatcaggagcggttatattagatgattgtaattttcatgaatcggtgcatcttgatagttttgatgtggatagaactttgactcttgtacctcctgatggtgaatttcctgttatgaattatcgtatgactcaagaatttaagccacctttccgtattaataccctgattgaagaagcggggtcgcttaaggctgaggtgattttgaaaatacgtgctgagtttcctcaaaatattactgcaaatacagatgtcattcagatgccagtgccaacatatacatccagagttagttttgagttggaacctggagcagttggacaagtgaccgatttcaaggagtccaataagaaacttgaatgggggttaaagaagattgttggtggatctgaacatacactacgtgccaaattaacattctcacatgaatcacatggtaatataacgaaagaagctggcccagtcagcatgaccttcaccataccaatgtacaactgttcaagactccaggtgaaatacttgcaaattgcaaagaagtccaaaacttataatccatatcggtgggtgagatatgttacccaagcccaattctacgttgcgcgtatatgatttactttcatctttcaaa

SEQ ID NO: 7142 - DNA, 1561 bp, Actinidia deliciosa
atctcgcagttctttgtgctctcgcagagaggcgacaacatcgtcttccgcgactaccgtggtgatgtaccaaaaggaagtgcagagatattctttcgcaaagtaaaattttggaaagaggatggcgaagaggaagcaccacctgtctttaatgttgatggcgtgaactacttccatgtgaaagttgttggattgctgtttgttgcaaccacaagaaccaatgtgtcaccttctcttgtcttggaacttttacagaggattgcacgtgtcatcaaagattaccttggggttctcaatgaagattcattccggaaaaattttgtgcttgtgtacgagttacttgacgaagttgttgattttggttatgtgcaaacgacatccactgaagtattgaagtcctatgtgtttaatgagccaattttggttgacgctgcacgcttacagacccttggccctgctaacctctttatgcaagggagcaaaagaatgccggggacagctatcacgaaatccgttgtagcaaatgaacctgggggtcggaagagggaggaaatttttgtggatataatcgagaaaataagcgttacattcagctctagtggatatatactgacttctgaaattgatggcactatccaaatgaagagctatcttactggcaatccagaaatccgattagccctcaatgaggagctgagcataggaagaggcggaagatcaatctatgattatagtggttcctctgggtctggagcagtgattctagatgactgcaatttccatgaatctgtgcatcttgacagctttgacatggacaggactctaactttggttccgtcagatggtgaatttcctgtcatgaattaccgcttgactcaagaattcaaacctccttttcgtattaacgctttgattgaagaatctgggccgcttaaggctgaagtgattctgaagatacgtgctgaattcgcctcatccatcactgcaaacacgattcttgtgcagatgccactaccaacatatacctccagagttagttttgagttggaacctggtgcagttggacaaatgactgatttcaaggagtcaaataagaaacttgaatggaatctaaagaagattgttggtggatctgaacttacaatgcgtgcgaagctgacattttcacaagaatcacatggaaacatcacaaaagaagctggacctgtgagcatgacctttacaataccaatgtataatgcctcaaggcttcaggtgaagtacctacaaatagcgaagaaatccaaaacctacaatccatatcgatgggtgagatatgttacccaggccaattcttatgttgctcgtatatgatagagggaatcctttttggtgctcttctttttttatttttcctcaacgtgttcccaatgaatcgtataacaacttccaccctaaagaaactgcgtatccacatgcgagttcctttatcctttgtcttttcctggataagttatgatatatcttgaacattttcgaatgaatttcactttattcttacactgttgttttaaaaaaaaaa

SEQ ID NO: 7143 - DNA, 1374 bp, Ambrosia trifida
gaaggagagtgcaatgatctcgcagttctttgttttgtcgcagagaggcgataacatcgtctttcgtgattaccgtggtgatgtgcaaaaaggaagcgcagagatattttttcgtaaagtaaagttctggagcgaggacggggaagcggaggctccacctgtctttaatgtggatggtgtcaactacttccatgtaaaggtggtcggattactgtttgttgcaaccactagagcaaatgtatcaccatctcttgtattggagcttctacaaagaatagcacgtgttactaaagattaccttggcatcctcaatgaagattctatagaaaaaactttgtgcttgtgtatgaattacttgatgaagttgttgattttggttatgtgcaaacaacatcgactgaagttctaaagtcatgtgtatttaatgagccaatcatgattgacgctgcacatatgccacctcttggtccggctgccctctttatgcaagggaacaaaagaatgccagggacagctgtcacaaaatcagttgtagctaatgaacctgggggtaggagaagggaggaaattttcgtggatataattgaaaaaataagtcttacatttagctctagtggatatatactaacctctgagatagatggcaccattcaaatgaagagttatctttctgggaatccagaaattcgattagctctcaatgaggacttgaatataggaagaggtggcagatcagtatatgattatggtggttctagtggatcaggagctgttatactagatgattgcaattttcatgaatcggtgcatcttgatagttttgatgttgatagaactttgactcttgttccccctgatggtgaatttcctgttatgaattatcgcatgactcaggaatttaagccaccttttcgtattaacaccttgattgaagaggcaggatcacttaaggctgaggtgattctgaaaatacgtgctgaattccctcaaaatataactgcaaatacagttgtagttcagatgccagtgccaaaatacacatccagagtcagttttgaattggaatccggagccattggacaagtgactgatttcaaggaaccgaataagaaaatcgagtgggggttaaaaaagattgttggtggatcggaacatacattgcgtgccaaattaacatttgcacatgaatcacatggcaatataacaaaagaagctggacctgtcagcatgactttcactataccaatgtacaactgctcaagactccaaggtaaatacttgcagatcgctaagaagtcaaaaacttataacccgtatcgttgggttagatacgtcacacaagcaaattcctacgttgcgcgtatatgagtaatt

SEQ ID NO: 7144 - DNA, 1592 bp, Flaveria ramosissima
tgtgaaagtctctgcatccccttgcgacttgttgtggtctcccaatattaaagagttgaatcgggaaggagagttggttggttgccatgatctcgcagttcttcgtattgtcgcagagaggcgataacatcgtatttcgtgattaccgtggtgatgtgcaaaaaggaagtgcagagatattttttcgtaaagtaaagttctggaaagaggatggggaaaccgaggctccacctgtctttaacgtggatggtgtcaactactttcatgtaaaagtggttggattactgtttgttgcaaccactagagcaaatgtatcaccatctcttgtcttggagcttctacaaagaatagcacgtgttactaaagattaccttgggatcctcaatgaagattctatacggaaaaatttcgtgcttgtgtatgaattacttgatgaagttattgattttggttatgtgcaaacaacatcaactgaagttctaaagtcatgtgtatttaatgagccaatcatgattgatgcagcacatatgccgcctcttggtccggctgccctcttcatgcaagggaacaaaagaatgccagggacggctgtcacaaaatcagttgtagctaatgaacctgggggtaggaggagggaggaaatttttgtggatataattgaaaaaataagtcttacattcagctctagtggatacatactaacttctgagatagatggcaccattcaaatgaagagttatcttactgggaatccagaaattcggttagctctcaacgaggacctgaatataggaagaggtggcagatcagtatatgactatggtggttctagtggatcaggagccgttatactagatgattgcaattttcatgaatcggttcatcttgatagttttgatgtggatagaactttaactcttgttccccctgatggtgaattccccgttatgaattatcgcatgactcaggaatttaagccacctttccgtattaacaccctgattgaagaagcagggtcacttaaggctgaggtgattctgaaagtacgtgctgaatttcctcaaaatataactgcaaatacagttgtagttcagatgccagtgccaaaatacacttccagagtaagttttgaattggaatctggagcagttggacaagtgactgatttcaaggagccgaataagaaaatcgagtgggggctaaaaaagattgttggtggatctgaacatacgctgcgtgcaaaactaacatttgcacatgaatcgcatggcaatataacgaaagaagctggtcctgtcagcatgactttcactataccgatgtacaactgctcaagactccaggtgaaatacttgcagattgctaagaagtcgaaaacttataatccatatcggtgggttagatatgtcacccaagccaattcctatgttgctcgtatatgattaatttgagcctctacacttcggttgtaatatctcgattttctttattatttttattaacttgatcatctttcgtgtaatggtaaatcttttcaatcttggaccgtggattgtgataggatttgcacatgacctatgagattgagtggt

SEQ ID NO: 7145 - DNA, 1610 bp, Flaveria ramosissima
atgtgaaagtctctgcatccccttgcgacttgttgtggtctcccaatattgtataaagagttgaatcgggaaggagagttggttggttgccatgatctcgcagttcttcgtattgtcgcagagaggcgataacatcgtatttcgtgattaccgtggtgatgtgcaaaaaggaagtgcagagatattttttcgtaaagtaaagttctggaaagaggatggggaaaccgaggctccacctgtctttaacgtggatggtgtcaactactttcatgtaaaagtggttggattactgtttgttgcaaccactagagcaaatgtatcaccatctcttgtcttggagcttctacaaagaatagcacgtgttactaaagattaccttgggatcctcaatgaagattctatacggaaaaatttcgtgcttgtgtatgaattacttgatgaagttattgattttggttatgtgcaaacaacatcaactgaagttctaaagtcatgtgtatttaatgagccaatcatgattgatgcagcacatatgccgcctcttggtccggctgccctcttcatgcaagggaacaaaagaatgccagggacggctgtcacaaaatcagttgtagctaatgaacctgggggtaggaggagggaggaaatttttgtggatataattgaaaaaataagtcttacattcagctctagtggatacatactaacttctgagatagatggcaccattcaaatgaagagttatcttactgggaatccagaaattcggttagctctcaatgaggacctgaatataggaagaggtggcagatcagtatatgactatggtggttctagtggatcaggagccgttatactagatgattgcaattttcatgaatcggttcatcttgatagttttgatttggatagaactttgactcttgttccccctgatggtgaattccccgttatgaattatcgcatgactcaggaatttaagccacctttccgtattaacaccttgattgaggaagcagggtcacttaaggctgaggtgattctgaaagtacgtgctgaatttcctcaaaatataactgcaaatacagttgtagttcagatgccagtgccaaaatacacttccagagtaagttttgaattggaatctggagcagttggacaagtgactgatttcaaggagccgaataagaaaatcgagtgggggctaaaaaagattgttggtggatctgaacatacactgcgtgcaaaactaacgtttgcacacgaatcgcatggtaatataacgaaagaagctggtcctgtcagcatgactttcactataccaatgtacaactgctcaagactccaggtgaaatacttgcagattgctaagaagtcgaaaacttataatccatatcggtgggttagatacgtcacccaagccaattcctatgttgcccgtatatgattaatttgagcctctaaacttcggctgtaatatcctgatcttcatattttcccttttaataacttgatcatgtttcgcgtaatggtaaatcttttcaatgttggaccatagattttgtgagtaggggttgcccatgacctatgagaattaattgatgttataa

SEQ ID NO: 7146 - DNA, 1531 bp, Tabernaemontana elegans
agattgatccgccgcgaataaccgaaagaattgagctcgcacggcggagctcgaatcggaggggtttttcagtgtcactgaagcagcggtaattttcttcatcatgatttctcagttctttgtgctctctcagagaggcgacaacatcgtctttcgcgactaccggggtgatgtacagaaaggaagtgcagagatatttttccgcaaagtgaagttttggaaagaagatggtgaagaggaggctccacctgtctttaatgtggatggtgtaaactacttccatgtgaaggtggctggtttgctttttgttgcaaccacaagaacaaacatctcgccttctcttgttttggagcttttacagaggattgcacgtgtcatcaaagattaccttggtgtccttaatgaagattcattgcggaaaaattttgtgcttgtttatgagcttcttgatgaagtaattgactttggctatgttcaaacaacatcaactgaagtcttgaagtcttatgttttcaatgagcccattgttgttgatgctggccgtttaccaccccttggtcctgcttccatgtttatgcaaggaagcaagagaatgccggggacagccatcacaaaatctgttgtggcaaacgaaccaggtggcagaaagagggaggagatatttgtggacattattgagaaaatcagtgtcacatttagctctagtgggtatatattaacttctgaaattgatggcaccattcaaatgaagagttatctaactggtaatccagaaatcagattagctcttaatgacgagctaaacattggaagaggcgggaggtcaatatatgactatggtggttcctcaggttcaggagcagtgatactggatgactgcaatttccatgagtctgtgcatctggatagttttgatgtggataggaccctgagtcttgtcccacctgatggtgaatttccagtcatgaattaccgcataacccaggaatttaagcctccttttcgcattaacacattgattgaagaagccgggcagctaaaggctgaagtgattctgaaaatccgtgctgagtttctttctagcatcactgcaaacacaattgtagtccaaatgcccttgccaaaatacacaacaagagttagttttgagttggaacctggagcagttggacaaacgactgatttcaaggaatcaaatcgaagattggagtggaatttgaagaagattgttggtggatctgaacatacgctgcgtgccaagcttacattttcacaggaaacacacggaaatattaccaaggaagcaggtcctgtgagcatgacgttcaccatacctatgtacaatccttcaaggcttcaggtgaaatacttgcagatagcaaagaaatccaaaacttacaatccttatagatgggtgaggtatgtcactcaggcgaattcttatgttgctcgcttatgatactagaagagccccctgtcagagctgtgattttccattttcctttgtttgctttggcatcccatccccttg

SEQ ID NO: 7147 - DNA, 1567 bp, Helianthus annuus
gtctatgtgaaagtctctgcagaaccttgcgacttgttgtggtctctctctcaatattaaattgttgaatcgagacggagagtttgttggctgacatgatctcgcagttctttgttttgtcgcagagaggcgataacatcgtgtttcgtgattaccgtggtgatgtgcaaaaaggaagtgcagagatattttttcgtaaagtaaagttctggaaagaggatggggaaaccgaggctccacctgtctttaatgtggatggtgtcaactactttcacgtaaaggtggtcggattactgtttgttgcaaccacaagagcaaacatatcaccatctcttgtattggagcttctacaaagaatagcacgtgtcactaaagattaccttggcatcctcaatgaagattctataagaaaaaactttgtgcttatgtatgaattactcgatgaagttatcgattttggttatgtgcaaacaacatcgactgaagttttaaagtcatgtgtatttaacgagccaatcatgattgaagcagcacatatgccacctctcggtccggctgccctatttatgcaagggaacaaaagaatgccggggacagctgtcacaaaatcagttgtagctaatgaacccgggggtagaaggagggaggaaattttcgtcgatataattgaaaaaataagtcttacgttcagctctagtggatatatactaacctccgagatagatggcactattcaaatgaagagttatctttcggggaatccggaaatccgattagcgctcaacgaggacctgaatataggaagaggtggtagatcagtatacgactatggtggttctagtggatcgggagctgttatactagacgattgcaattttcatgaatcggtgcatcttgatagttttgatgtggatagaactttgactctcgttccacctgatggtgaatttcctgttatgaattaccgcatgactcaagaatttaagccaccgttccgtattaacaccctgattgaagaagcaggatcacttaaggctgaggtgattctgaaaatacgtgctgagttcccgcaaaatataactgcaaatacagttgtagttcagatgccggtgccaaaatacacatccagagttagtttcgagttggaatctggagcagttggacaagtgactgatttcaaagagccgactaagaaaatcgagtgggggttaaaaaagattgttggtggatccgaacatacactgcgtgccaaattaacgtttgcacatgaatcacatggcaatataacaaaagaagctggacccgtcagcatgactttcactataccgatgtacaactgctcaagactccaggtgaaatacttgcagatcgctaagaagtcaaaaacttataacccgtatcgttgggttagatacgtcacccaagcaaattcctatgttgcgcgtatatgattaatttgagcgtctgagcttttgttgtaatttctcgattttcttcatagttatgtgtttcatctctctaagacgtttttaaaacttaatcatatatcgcgtgacagcagatcttt

SEQ ID NO: 7148 - DNA, 1603 bp, Artemisia annua
atcattttcatcacgaattcatatctaaatcacaaatcggttattataaacccacattactactaatcacttgctgcaatgatctcgcaattcttcgtcttatcgcagcgaggcgataatatcgtctttcgtgattatcgtggtgatgtgcaaaaaggaagtgcagagatattttttcgtaaagtgaagttctggaaagaagatggggaaaccgaggctccacctgtctttaacgtggatggggtcaactactttcatgtaaaggtggttggattgctgtttgttgcaaccactagagcaaatgtttcaccttcgcttgtctttgagcttctacaaagaatagcacgtgttactaaagattaccttggtatcctcaatgaagattctattaggaaaaacttcgttcttatgtatgaattgcttgatgaagttattgattttggttatgtgcaaacgacatcgactgaagtgttaaagtcatgcgtattcaatgagccaatcatgattgatgcgacacatatgccacctcttggtcctgctgccctctttatgcaagggaacaaaagaatgcctgggacagctgtcacaaaatcagttgtagctaacgaacctgggggtaggaagagggaggaaattttcgtggatataattgaaaaaataagtattacattcagctctagtggatatatactaacgtctgagatagacggcaccattcaaatgaagagttatctttctgggaatccagaaatccgattagctctcaatgaggacctgaatataggaagaggtggaagatcagtatatgactacggtggttctagtggatcaggctcagttatattagatgattgcaatttccacgagtcagtgcatcttgacagctttgatgtggatagaactctgactcttgtgccccctgatggcgaatttcctgtaatgaattaccgcatgacccaagaattcaagccaccattccgtattaacaccttaattgaagaagcaggatcacttaaggctgaagtgattctgaaaatacgtgccgagtttcctcaaaatatcagtgcaaatacagtttctattcagatgccggtgccaaaatacacatccagggttagttttgagttggaacccggagcagttggacaagtgactgatttcaaggaacagaataagaaagtcgagtggggattaaagaagattgttggtggatctgagcacacactgcgtgccaaattaacattttcacatgagtcacatggaaacttaaccaaagaagctggccctgtaagcatgaccttcaccataccaatgtacaactgctccagattacaggtgaaatacttgcaaattgctaagaagtcgaaaacttataatccataccggtgggtgagatatgtgacccaagctaattcatacgttgctcgtatatgagtagttcgaacttataaactttggttgtaatatctcgattttcttcatgttttcctcttttgtctctaaagatgtgttaaataactatcatgtttatgtaaaagtagatctttttaatgtcgaatcgtgaattacttgataagggttttccctgaggattggagttata

SEQ ID NO: 7149 - DNA, 1662 bp, Aquilegia formosa
gaaaaccagacaagaagaagaagaaagaaactcacatctgagctttggtgatcgttttcagaaacttcaatcgaagaagaagaaataacaacaacactgacgatgatctcgcagttcttcgttctttctcaaagaggcgacaacattgttttccgtgattatcgtagtgatgtgccaaaaggaagtgcagaaatatttttccggaaagtgaagttttggaaggaagatgaagaagaggaagcacctcctgtctttaacttggatggagtaaactacttccatgtgaaggttgctggattgttgtttgtggcaacgacaagagtcaacatgtcaccttctctggttttggagttgttacacagaattgcacgtgtaattaaagattaccttggagttctcaatgaagattcatttcggaagaattttgttcttgtatatgaactgcttgatgaagtcattgattttggttatgcacagacaacatctactgaattgttgaaatcttatgtcttcaatgagccaattgtagtggatgctgcacgtttgccaccccttggtccagctgccatgttcatgcaaggcactaaacggatgccagggacagctgttacaaaatctgtcgttgccaatgagcctggtggtcggaaaagggaggaaatatttgtggacattatagagaaaataagtgttactttcagctctagtggttacatacttacgtctgagattgatggcaccatccaaatgaagagctatcttactggaaacccagaaattcgtctagctctaaatgaggacctgaacatagggaggggtgggagatctgtatatgattatggtagttctgctggagcaggttcagtgatattagatgattgtaacttccatgaatcagtacatcttgacagttttgatgtggatcgaactttatctttggtacccccggatggagaatttcctgtgatgaactaccgcatgacacaggagttcaagcctccttttcgtattaatgcattgattgaagaagcaggagccttcaaggctgaagtgatacttaaagtgcgcgctgagtttccctcgaccatcactgcaaacacaattgtagtacagatgccactcccaaaacataccaccagggttagtttcgagttggaatctggagcagttgggcacacaacggatttcaaggaagcaaataagaaactggaatggggattgaagaagattgttggtggaagtgaacatactctacgtgcaaaactcacattttcacaggaatcacatggaaatatcatgaaggaagcgggacctgtaagcatgactttcacaatacctatgtataatgcttcaaagcttcaggtgcggtacttgcagatagcaaaaaaatcgaagacctacaatccatatcgatgggtcagatacgttacacaagcaaattcctatgtagctcgtttatgatactcaaattttgtggtacccgtttctttgtattttctttgctgatgtttcatttgacaattgagctagttagacggttacatgtaatataactcctgataaaattcagttatccttctaaaaagatgtatgtcacagtattcatgtatttttcttattttgagtggaaacatagagtacctatttgaaagcactctattattc

SEQ ID NO: 7150 - DNA, 1628 bp, Sarracenia psittacina
aagaccaggggctgtcttgaaggaggtgatggtgatatagaaatcaaacaaatccaaccggaacattaaatctcggagactcgagcttagacgcaaagcgaaggatcatgatctctcaattctttgtgctgtcacaaaggggagataacatcgtcttccgcgactaccgtggtgacatacaaaaaggaagtgcagagatatttttcgtaaagtgaagttttggaaagaagatggtgaggaggaggcaccacctgtctttaatgtggacggtgtgaactacttccatgtgaaggtggttggattgctgtttgttgctaccacgagagccaatgtgtcaccttctcttgtcttagagtcttttacagaggattgcacgtgtcatcaaggattacctaggtgttctcaatgaagactcattacgaaaaatttcgttcttgtctatgagttgctagacgaagttgttgattttggttatgtgcaaacaacatccactgaactcttgaagtcatatgtatttaatgagccaattgtggttgatgctgcacgcctaccgactcttggccctgctggcatctttatgcaagggtccaaaagaatgccagggacagctgtcacaaaatctgttgtagcaaatgaacctggtggtagaaagagagaagagattttcgtggatataattgagaaaataagcgttacattcagctctagtggatatatactgacttctgagattgatggcactattcaaatgaagagttatctcaccgggaatccagaaatccggttagccctcaatgaggatctgagcataggaagaggcgggagatcgatctatgactctagtggttcctctgggtctggagcagtgattttagatgattgcaatttccatgaatctgtacatcttgatagttttgaaatggacagaactctgactttggtgccgccagatggtgaatttcctgtcatgaattatcgtatgacccaggaattcaagcctccttttcatattaatgcgttgattgaagaagctggatcactgaaggctgaagtgattcttaaaatacgtgctgaatttgcctcaagcatcactgcaaacactattttagtgcagatgccactaccgacatataccaccagagttagttttgagttggaaccgggtgcagttggacaaatgactgatttcaaggagccaaataagaaacttgaatggagtctgaaaaagattgttggtggatctgaacataccctacgtgcaaagctgacatttttacaggaatcacatggaaacatcacaaaagaagctggacctgtcagtatgacctttacaataccaatgtataatgcctcaaggcttcaggtgaagtatttgcagatagccaagaaatccaaaacatataatccttatcgatgggtgagatacgttactcagtccaattcttatgttgctcgtatatgaaaaaaagggggggggggggttcactctttggtctctcttcttttttccagtttcttccttttgtcacgattttgttcttgattatgccatcattgagcttaatcttttggtaccatttgattatatacaattttgtatccttgattatctattgataggtatggaa

SEQ ID NO: 7151 - DNA, 1857 bp, Cucumis melo
cccatccggttgagttccttcacgctccgttgtctctgtgaatcggagacttactggtttttatattctcaacagccgttgcagagttatcggccatgatttcccagttcttcgtgctctcgcagagaggcgacaatatcgtattccgagattatcgtggcgaagttccgaaaggaagtgctgagatctttttccggaaagtgaaattctggaaggaagatggagaaggagatgcgccacctgtctttaatttggatggtgtaaactactttcacgtgaaggttgtaggactgttatttgttgctacaacaagaattaatgcatcaccttctcttgttcttgaacttcttcaaagaattgcacgtgtcatcaaagattaccttggggttctcaatgaagattccctcaggagaaattttgttcttgtgtacgagttgctagatgaagttattgattttggttatgtacaaacaacttcaactgaggttttgaagtcatatgtatttaatgagccaattgtggttgatgctgcacgcttgcctccccttggtcctgcttccatttttgtgcaagggagcaaacggatgccaggtacagctgttactaagtctgtggttgcaaatgagcctggaggtagaaaaagagaggaaatttttgttgacataatcgagaagattagtgtcacattcagctcaagtgggtatatacttacttcagagattgatggtaccattcaaatgaagagctatctaacgggtaacccagaaattcggcttgctcttaatgaggacttgagcattggaagaggtggaaggtcaatctatgattatagcagttcatctggtggagggacagtgatccttgatgattgtaattttcacgaatctgtgcatcttgataattttgacactgacagaactttggtcttggtaccaccagaaggtgaatttcctgtcatgaattatcgaatgactcaagaattcaagcctccctttcgtattaatgccttaattgaagaagcagggtcccttaaggctgaagtaattctcaaagttcgtgctgaatttgcctccagcatcacagcaaacacaattatgattcagatgccccttccaactttcacaacaagggtcagttttgaattggaacctggagcagttggaaatacaactgattttaaagaggcgaacaagagactagaatggggtttgaagaagattgttggtggatctgaacatactttacgtgcgaggctcacattttcacaagaatcacatggaaacatcgtgaaagaagctggacctgttagtatgacattcactattccaatgtacaacgcttcaaggctccaggttaagtacttgcagattgcaaagaagtctaaaacctataatccatataggtgggtaagatatgtgacacaagcaaattcatatgttgctcggttgtgaatgtagccttcctcgatctagtttctctcttttattattttgagctgctctatcagtaagcaaaataaacacttgtgggttgtggtttatctgaggctgtgtttggtgcatgatatggagttatttttatcttgtggagtttcgagtgttgcttattcatccttcaagtgcacctctcataatagctgtggtctacagtgttcatagtgtggaatgctttaaagttatcaaaattgtcaaaaacggcattgtaaactagtaattaggaaactacggcatatgggctaatagacatattcagtcagagtggtggtctacattctagtaggtcaggtcggtgctttgaaatttaatttcatgtatttaatttgaacctttgaacttaatgatgattaggtattaggat

SEQ ID NO: 7152 - DNA, 1950 bp, Citrullus lanatus
tgacgtctgcggacgtggcaaacagcaagcaggtccgagtctgctttctttccgagggagtgcttcggaagtctcccatccggttgagttccttcgcgccccgttgtatctgcggatcggagacggactgatttttgataacctcaacactgttgctgagtaattgaccatgatttcccagttcttcgtgctctcgcagagaggcgacaacatcgtattccgagattatcgtggtgaagtaccgaaaggaagtgctgagatctttttccgaaaagtgaaattctggaaggatgacggagaaggagatgcgccacctgtctttaatttggatggtgtaaactattttcacgtgaaggttgtaggactgttatttgttgctacaacaaggactaatgcatcgccttctcttgttcttgaacttcttcaaagaattgcacgtgtcatcaaagattaccttggggttctcaatgaagattccctcaggaaaaattttgttcttgtgtatgagttgctggatgaagttattgattttggttatgtacaaacaacttcaactgaggttctgaagtcatacgtatttaatgagccaattgtggttgatgctgcacgcttgcctccccttggtccggcttccatttttgtgcaagggagcaaacggatgccaggtacagctgtcactaagtctgtggttgcaaatgagcctggaggtagaaaaagagaggaaatttttgttgacataatcgagaagattagtgtcacattcagctcaagtggttatatacttacttcagaaattgatggtaccattcaaatgaagagctatcttacgggtaacccagaaattcgccttgctcttaatgaggacttgagcattggaagaggtggaaggtcaatctatgattatagcagttcatctggtggagggacagttatccttgatgattgcaattttcatgaatctgtgcatcttgataatttcgacactgacagaactttggtcttggtaccaccagaaggtgaatttcctgtcatgaattatcgaatgactcaggaattcaagcctccattccgaattaatgccttgattgaagaagcagggtcacttaaggctgaagtaattctgaaagttcgggctgaatttgcctccagcatcacagcgaacacaattatgattcagatgccattgccaactttcacaacaagagtcagttttgagttggaacccggagcagttggaaatacaactgattttaaggaagctaacaagagacttgaatggggtttgaaaaagattgttggtggatctgaacatactttgcgtgcaaggctcacattttcacaagaatcacatggaaacatcgtgaaagaagctgggcccgttagtatgacgttcacaattccaatgtacaacgcttcaaggctccaggttaagtacttgcagattgcaaagaagtctaacacctataatccgtataggtgggtaagatatgtgacgcaagcaaattcatacgtcgctcggttgtgattgtaaccttcctcgatctcaattatctcttagtattttgagctgcactgtcagtaagcaaaataaacaatttttgtgggctgctatctgaggctgtgtttggtgccatatgcggacttaatttttattcttctgtggagtattgagtctattgttcatccttcaagtgcatctctcaggatagctgtggtctacaatgttcatagtgtggaatgcttgacgttatcaatatgtcaaaaactgcattgtaaagtaataattagaaaactacggctcattggttatagatacattcaggcagagtggcccatattctagtaggacaggtcggtgctttgaaatgtgctttgatgtatttggtttgaacttttgaacttaatgatgattaggtattagaatataaagttgagttccatcgttttata

SEQ ID NO: 7153 - DNA, 1812 bp, Fragaria vesca
aagagagaaaaaatttgagggtgagagggaagaaacgacgaccacatttgggagagaagagaaaagaagagagagagcgccatgatctcgcagttcttcgtgctttcccagcgtggcgataatatcgtcttccgcgactatcgcggcgaagttccgaaaggaagtgctgagatattcttcaggaaagtcaagttctggaaagaagacggccaagaggaagcaccacctgtctttaatgtggatggtgtcaactactttcatgtgaaggtcgttggactcttgtttgttgcaactacaagagctaatgtatcgccatcaattgtcttggaacttctacaaagaattgcccgtgtcatcaaagattacgttggagttctcaatgaggattctatcaggaagaattttgtgcttgtctatgagttgcttgatgaagtcatagattttggctttgtgcaaacaacatcaactgaactgttgaagtcttatatattcaatgagccaatcgtcgttgatgctgcacgtttatcatctcttggatctcctggcctgtttatgcaagggacaaagagaatgcctggaacagcagtcacaaaatctgttgttgctaatgagcctgggggtaggaagagggaggaaatttttgtggacataatcgagaagatcagtgttactttcagctctagcgggtatatattgacttctgagattgatggtaccattcaaatgaagagctatctcactggtaatccagaaatcagattagctcttaatgaggacctcggcattggaagaggtggaacatcggcgtatgactataggagttcatttggctcgggggcagtaatacttgatgactgcaattttcatgaatctgtgcgtcttgataattttgatgtagacaaaactcttactctggtacccccggatggcgaatttcctgtcatgaactaccgtatgactcaggagtttaagcctccttttcgtataaatgctctgattgaagaagcaggatcacttaaggctgaagtgattctgaagctatatgctgagttcccatccaacattaccgcaaacactatttctgtacaaatgccactacctaaatatactacgagagccagttttgagttggaaccaggagcagttggacaatcaacagatttcaaggaagcaaataagaggcttgaatggggtttaaagaagattgttggtggttccgaacataccctacgtgccagactgacgttttcacaggaatttcatggaaatatcacaaaagaagctggtccagttagcatgacgttcacaatacctatgtataactcttcaaaacttcaggtaaagtacttgcagatagctaagaagtctggaacttataatccatatcggtgggtaagatatgttactcttgccaattcatatgttgctcgtatatgatgcaatgaagctacatttgttgtgccatttcgtgattgaagaacggaatctttgaaaacactggatctagttgtgagatatctaatgaaacctttgcactctgttctcttttggtgggttcggatatttctctattctgcttcagtgatataattccttgactacattagattatgggttgcattttgttagtcgtactattgtattattgaatcgttctttgtgtagtggttgtgtatttgatgataactcaaattgcagcggatagcttcccttttttttttttgtccgagttgaatgtcatctgaagaaagcctcatcaaaaatgtatggttttatcgacttgaatgaagattgtatggttttattgacttg

SEQ ID NO: 7154 - DNA, 2014 bp, Vitis vinifera
caagaggatggctccagccagatacggtccaactgaggactcagccccgagaggagaggctaggcatgactcgagccaaccaagccagcggtcatcaggacgctcggaagaaccaatagtaaaccgccacgtcatcaaaacaaatttccctcgcgcgtcgacacctgttcttctcaacgtggcgctcagcgacaggctggacatccgtgtgagatacgatagcttcacacagaatccgaaccctcttgattccggttcatcaaagtagaaaaccgaaaacctcaaaaccacagaacatcagagcgaacacaagatcggatcgagaaactttagcaaccatgatctcccagttcttcgtgctctcgcagagaggcgataacatcgtcttccgtgactatcgtggggaagtacctaaaggaagtgcagagatatttttccggaaggttaagttttggaaggaggatggagaaggggatgcaccacctgtctttaatgtggatggtgtgaactactttcacgtgaaggttgctggattgttatttgttgcaaccacaagagttaatgtgtcaccttctcttgttctggaacttctacaaaggattgcacgtgtcatcaaagattaccttggcattctaaatgaagattcattgcggaaaaattttgttcttgtgtatgagttgctggatgaagttattgattttggttatgtgcaaacaacatctactgaggtgttgaaatcatatgtatttaatgagcccatagttgttgatgctgcacgattaccaacccttggtcctgcttccatttttatgcaaggaaccaaaagaatgccagggacagctgttacaaaatctgttgtagcaaatgagcctggtggtagaaagagggaagaaatttttgtggacataattgagaaaataagtgtcacatttagttctagtggatatatacttacttctgagattgatggcaccattcaaatgaagagttaccttacaggcaatccagaaattcggcttgctctcaatgaagagctgagcatagggaggggtggaaggtcaatttatgactataatagttcaactggatccgggacagttatactagatgactgtaatttccatgaatctgtgcatcttgatagttttgacattgacagaacgcttaccctggtcccaccagatggtgaatttccagtaatgaactaccgtatgactcaggaattcaagcctccctttcgtattaatgctttgattgaagaagcaggagctctccgggctgaagtaattcttaaggtgcgtgctgaattcccctcaagcattactgcaaacacaattcaagtacaaatgccactgcccccatatacaactagagttagttttgagttggagcctggggctgttggaaacacaaccgattttaaggaagcaaataagagactagaatggggtctaaagaagattgtaggtggatctgagcatactctacgtgcaaagctgacattttcacaggaattgcatggaaatatcacaagggaagctggacctgttagcatgaccttcacaataccaatgtacaatgcttcaagacttcaggtaaagtatttgcagatatcgaagaagtccaaggcctacaatccatatcgatgggtgagatacgtcacacaatcaaattcctatgttgcccggttatgataagaagcttttttccccatttttctcgctcctttccctgtcctactgttgtgtttaagatcaaatgaatccaaaaattactgctaaaagtaaggcatgactgtgtatcatttgctatttaatcttcattcgcctggttacccaagttttgcacctttctttttcttagtgcagttctacagtaagtgaaccttccccaagatttcttgtatttcagataaatgaaatgggatgaacctcacatgtggatcattacttttaagttttaactgacttgtggttggaacttgtaaacaagctaatttgttccttttttttag

SEQ ID NO: 7155 - DNA, 1726 bp, Vitis vinifera
aagtagaaaaccgaaaacctcaaaaccacagaacatcagagcgaacacaagatcggatcgagaaactttagcaaccatgatctcccagttcttcgtgctctcgcagagaggcgataacatcgtcttccgtgactatcgcggggaagtacctaaaggaagtgcagagatatttttccggaaggttaagttttggaaggaggatggagaaggggatgcaccacctgtctttaatgtggatggtgtgaactactttcacgtgaaggttgctggattgttatttgttgcaaccacaagagttaatgtgtcaccttctcttgttctggaacttctacaaaggattgcacgtgtcatcaaagattaccttggcattctaaatgaagattcattgcggaaaaattttgttcttgtgtatgagttgctggatgaagttattgattttggttatgtgcaaacaacatctactgaggtgttgaaatcatatgtatttaatgagcccatagttgttgatgctgcacgattaccaacccttggtcctgcttccatttttatgcaaggaaccaaaagaatgccagggacagctgttacaaaatctgttgtagcaaatgagcctggtggtagaaagagggaagaaatttttgtggacataattgagaaaataagtgtcacatttagttctagtggatatatacttacttctgagattgatggcaccattcaaatgaagagttaccttacaggcaatccagaaattcggcttgctctcaatgaagagctgagcatagggaggggtggaaggtcaatttatgactataatagttcaactggatccgggacagttatactagatgactgtaatttccatgaatctgtgcatcttgatagttttgacattgacagaacgcttaccctggtcccaccagatggtgaatttccagtaatgaactaccgtatgactcaggaattcaagcctccctttcgtattaatgctttgattgaagaagcaggagctctccgggctgaagtaattcttaaggtgcgtgctgaattcccctcaagcattaccgcaaacacaattcaagtacaaatgccactgcccccatatacaactagagttagttttgagttggagcctggggctgttggaaacacaaccgattttaaggaagcaaataagagactagaatggggtctaaagaagattgtaggtggatctgagcatactctacgtgcaaagctgacattttcacaggaattgcatggaaatatcacaagggaagctggacctgttagcatgaccttcacaataccaatgtacaatgcttcaagacttcaggtaaagtatttgcagatatcgaagaagtccaaggcctacaatccatatcgatgggtgagatacgtcacacaatcaaattcctatgttgcccggttatgataagaagcttttttccccatttttctcgctcctttccctgtcctactgttgtgtttaagatcaaatgaatccaaaaattactgctaaaagtaaggcatgactgtgtatcatttgctatttaatcttcattcgcctggttacccaagttttgcacctttctttttcttagtgcagttctacagtaagtgaaccttccccaagatttcttgtatttcagataaatgaaatgggatgaacctcacatgtggatcattacttttaagttttaactgacttgtggttggaacttgtaaa

SEQ ID NO: 7156 - DNA, 1557 bp, Ambrosia trifida
tcatatagatctcatcattttctcttacaattcgcctctaatttacacacaatcacaaatcagatttatgtgaattacattatatgttcacaccacacttgatgatttagttataaccaatttctgttactaatttgtttcagaaatagttgaatcaggaaggagacttcaatgatctcgcagttctttgttttatcgcagagaggcgataacatcgtctttcgtgattaccgtggtgatgtgcaaaaggaagtagcagagatatttttcgttaagtaaagttctggagcgaggacggggaagcggaggctccacctgtctttaatgtggatggtgtcaactacttccatgtaaaggtggtcggattactgtttgttgcaaccactagagcaaatgtatcaccatctcttgtattggagcttctacaaagaatagcacgtgttactaaagattaccttggcatcctcaatgaagattctataagaaaaaactttgtgcttgtgtatgaattacttgatgaggttattgattttggttatgtgcaaacaacatcgaccgaagttctaaagtcatgtgtatttaatgagccaatcatgattgacgcagcacatatgccacctcttggtccggctgctctctttatgcaagggaacaaaagaatgccagggacagctgtcacaaaatcagttgtagctaatgaacctgggggtaggagaagggaggaaattttcgtggatataattgaaaaaataagtcttacatttagctctagtggatatatactaacctctgagatagatggcaccattcaaatgaagagttatctttctgggaatccagaaattcgattagctctcaatgaggacttgaatataggaagaggtggcagatcagtttatggttatggtggttctagtggatcaggagctgttatactagatgattgcaattttcatgaatcggtgcatcttgatagttttgatgttgatagaactttgactcttgttccccctgatggtgaatttcctgttatgaattatcgcatgactcaggaatttaagccaccttttcgtattaacaccttgattgaagaggcaggatcacttaaggctgaggtgattctgaaaatacgtgctgaattccctcaaaatataactgcgaatacagttgtagttcagatgccagtgccaaaatacacatccagagtcagttttgaattggaatccggggcagttggacaagtgactgatttcaaggaaccgaataagaaaatcgagtgggggttaaaaaagattgttggtggatcggagcatacactgcgagccaaattaacatttgcacatgaatcacatggcaatataacaaaagaagctggacctgtcagcatgactttcactataccaatgtacaactgctcaagactccaggtgaaatacttgcagatcgctaagaagtcgaaaacttataacccgtatcgttgggttagatacgtcacccaagcaaattcctacgttgcgcgtatatgagtaatttgaacgtttgaactttggttgttaa

SEQ ID NO: 7157 - DNA, 1639 bp, Arnica chamissonis
gatgtatcgtcgatgtgaaagtctctgcagaagctttgcgacttgttgtggtctcccaatattaaagagttgaatcgggaaggacagttggtcggctgccatgatctcgcagttctttgtattgtcgcagagaggcgataacatcgtgttcgtgattaccgtggtgatgtgcaaaaaggaagtgcagagatatttttccgtaaagtaaagttctggaaagaggatggggaaaccgaggctccacccatctttaatgtggatggtgtcaactactttcatgtaaaggtggttggattactgtttgttgcaaccactagagcaaatgtatcaccatctcttgtcttggagcttctacaaagaatagcacgtgttactaaagattaccttggcatcctcaatgaagattctataagaaaaaactttgtgcttgtgtatgaattacttgatgaagttgttgattttggttatgttcaaacaacatcgactgaagttttaaagtcatgtgtatttaatgagccaatcatgcttgatgcaacacatatgccacctcttggtccggctgccctctttatgcaagggaacaaaagaatgccagggacagctgtcacaaaatcagtcgtggctaatgaacctgggggtaggagaagggaggaaattttcgtggatataattgaaaaaataagtcttacattcagctctagtggatatatactaacttctgagatagatggcaccattcaaatgaagagttatctttctgggaatccagaaatccgagtagctctcaatgaggacctgaatataggaagaggtggcagatcagtatatgactatggtggttctagtggatcaggagccgttatactagatgactgcaattttcatgaatcggtgcatcttgatagttttgatgtggatagaactttgactcttgttccccctgatggtgaattccctgttatgaactatcgcatgactcaggaatttaagccacctttccgtattaacaccctgattgaagaagcaggatcacttaaggctgaggtgattctgaaaatacgtgctgaattccctcaaaatataactgcaaatacagttgtggttcagatgccagtgccaaagtacacgtccagagttagttttgagttggaatccggagcggttggacaagtgactgatttcaaggaaccaaataagaaactcgagtggggtttaaaaaagattgttggcggatctgaacatacactgcgtgctaaattaacctttgcacatgaatcgcatggcaatataacaaaggaagccggccctgtcagcatgactttcactataccaatgtacaactgctcaagactccaggtgaaatacttgcagattgctaagaagacaaaaaattataatccatatcggtgggttagatacgtcacccaagccaattcctatgttgctcgtatatgatcataccgagcgtctaaacttcggttgtaatatctcgattttcttcataattttgtctttaatcgcttaaatgtgtttaacaacatgataatgtttggtgtaacgatagatcttttcgatgttgaaccatggattttgtgataggagttgctcatgacccacgaggattgattggtgttaatta

SEQ ID NO: 7158 - DNA, 1664 bp, Euphorbia peplus
tcccagcgcggcgataatatcgtcttccgcgattatcgcggtgaggtgcctaaaggaagtgctgaaatcttttttcgtaaagttaagttttggaacgacgatggagaacaagacgccccccctgtctttaatgttgatggggttaactactttcacgtcaaagttgttggattattatttgttgcaaccacacgagttaatatgtcaccttctctcgtcttggaactcttacaaaggatcgctcgtgttatcaaagattaccttggcattctcaatgaagattctctacgcaaaaactttgtgcttgtgtatgagttgcttgatgaagtcatagattttggttatgtacaaacaacatccactgagttgttgaagtcttatgtatttaatgagccaattgttgttgatgctggccgtttgcaaccgctgaatcctgctgccatgtttatgcaaggtaccaaaagaatgccaggtacagctgtgacaaaatctgttgttgcaaatgagcctggaggtaggaaaagggaggaaatatttgttgatataattgagaaaatcagtgtcacgttcagctctagtggttacatactgacatcggaaattgatggcaccattcaaatgaagagctatctttctggaaatccagaaattcggttagccctaaatgaggacctgagcataggaagaggtggtgggcgatctgtctatgattacaggagttcaggtggttcaggatcagtgatacttgatgattgtaatttccatgaatctgtacgtcttgatagtcttgaggtggacagaacgttgtctctggtgcctccagatggtgaatttcctgtcatgaactatcgcatgacccaggaattcaaacctccatttcgcattaatactttgattgaggaagcaggagctcttaaggcggaagtgattcttaagatatcagcagagtttccttctagcattacagctaacacaattattgtccagatgccactgccaaaatatacaaccagagctacatttgaaacagaacctggagcaattgggcaaacaacagatttcaaggaagcaaacaagaagcttgaatggggattaaaaaagattgttggtggatctgaacatacattacgtgcaaagctgacattttcgcaggagtttcatgggaatcttacaaaggaggctggaccagttagtatgacattcacaataccaatgtacaatgcatctcgccttcaggtgaaatacttacaaatagcaaagaagtcgaatacgtataacccataccggtgggtgagatatgtgacacaggcaaattcatatgtcgctcggatatgatatgatgatgggatatggaaacggatatgggggagacttatggattttgtaatatgattattattatgttggaattgatgttatagccagctcatcctcagctggtttttgaggtcgaatgattttaaaggagtgtctttgttggatatgaatggaaagcataagcatgggcaagggatttttatcccttgtacaagctgtgagctgagctgaactgctctgttccgttctctttttttcctacctaagcttgttgcttaaacggtacacttgtcgcttggttcgatttcactttgttggatatatactctttacgttctattgcaaac

SEQ ID NO: 7159 - DNA, 1694 bp, Solanum lycopersicum
agggcaaagagaaagaatgaaaaaaatcagagataaaacgtgagaataaattaagacaagtatcaggagaagcgaaaaactccatctcagcgaaatagcaaccatgatttctcagttctttgtgctttctcagagaggcgacagcatcgtcttccgcgactatcggggtgatgtaccaaaaggaagtgcagagatcttcttccggaaagtgaagttttggaaagaagatggcggagaggaagcacctcctgtatttaatgtggatggtgtgaactacttccatgtgaaggtagttggtctgctttttgttgcgacatctaggacaaatttgtcgccttctctagtattggagcttctccagaggattgcacgtgtaatcaaagattaccttggtgttctaaatgaagactcattgcggaaaaattttgtgctggtgtatgagcttcttgatgaagttgttgattttggttatgtgcaaacaacgtcgacagaaatcttaaagtcttacatatttaatgagccaattatgattgacgctggccgcttgccaccccttggtcctgcagccatgttcatgcaaggatccaaaagaatgccagggacagcaattactaaatctgttgtggcaaatgaacctggggggagaaagagggaggaaattttcgtggatataattgaaaaaatcagcattactttcagctcaagtggatatatattgacttctgaaattgatgggaccattcaaatgaagagttatcttactggtaatccagaaatcagattagctctcaatgaggatctgggcattggaagggccggtgggagatcagcttacgattatggaggttcggctgggtctggagcagtagtactggatgattgcaatttccatgaatcggtgcaacttgatagttttgatgtggacaggaccttgactctggttcctccggatggtgaatttcctgtcatgaattaccggataacccaggaattcaagcctccctttcgtattaatactttgattgaagaagctggatcacttaaggctgaagttatcttgaaaatccgtgctgaatttccttcggacattactgcaaatacaatcttggtacaaatgccgctgcctacatatacaagcagagtaagctttgagttggaacctggaacagttggccaaacaactgattttaaggaatccaataagaggcttgagtggaatttgaagaaggttgtcggtggatcagaccatacattacgtgccaagctaacattttcacaagagtcacatggaaatatcaccaaggaagctggaccagtgagcatgaccttcacaatcccaatgtacaatccttcaaggcttcaggtgaaatatctgcaaattgcaaagaagtcaaagacatataatccttatcggtgggtgagatatgtgactcaggccaattcatatgttgctcgtatatgatggctgttgagaccttttccagcattaccctcctcggtttcttcttctctttttcacttcttcccagacatcttttgcccactccctgttgaggtgtcttgagttctaaattgtcttttctaactctggttttgggctttcaatgtttgtactatattgtctagataatgatggagggctctttggtgattctcattttaaaaaattgtgcaactaatggaaaattttgcta

SEQ ID NO: 7160 - DNA, 1694 bp, Solanum lycopersicum
agggcaaagagaaagaatgaaaaaaatcagagataaaacgtgagaataaattaagacaagtatcaggagaagcgaaaaactccatctcagcgaaatagcaaccatgatttctcagttctttgtgctttctcagagaggcgacagcatcgtcttccgcgactatcggggtgatgtaccaaaaggaagtgcagagatcttcttccggaaagtgaagttttggaaagaagatggcggagaggaagcacctcctgtatttaatgtggatggtgtgaactacttccatgtgaaggtagttggtctgctttttgttgcgacatctaggacaaatttgtcgccttctctagtgttggagcttctccagaggattgcacgtgtaatcaaagattaccttggtgttctaaatgaagactcattgcggaaaaattttgtgctggtgtatgagcttcttgatgaagttgttgattttggttatgtgcaaacaacgtcgacagaaatcttaaagtcttacatatttaatgagccaattatgattgacgctggccgcttgccaccccttggtcctgcagccatgttcatgcaaggatccaaaagaatgccagggacagcaattactaaatctgttgtggcaaatgaacctggggggagaaagagggaggaaattttcgtggatataattgaaaaaatcagcattactttcagctcaagtggatatatattgacttctgaaattgatgggaccattcaaatgaagagttatcttactggtaatccagaaatcagattagctctcaatgaggatctgggcattggaagggccggtgggagatcagcttacgattatggaggttcggctgggtctggagcagtagtactggatgattgcaatttccatgaatcggtgcaacttgatagttttgatgtggacaggaccttgactctggttcctccggatggtgaatttcctgtcatgaattaccggataacccaggaattcaagcctccctttcgtattaatactttgattgaagaagctggatcacttaaggctgaagttatcttgaaaatccgtgctgaatttccttcggacattactgcaaatacaatcttggtacaaatgccgctgcctacatatacaagcagagtaagctttgagttggaacctggaacagttggccaaacaactgattttaaggaatccaataagaggcttgagtggaatttgaagaaggttgtcggtggatcagaccatacattacgtgccaagctaacattttcacaagagtcacatggaaatatcaccaaggaagctggaccagtgagcatgaccttcacaatcccaatgtacaatccttcaaggcttcaggtgaaatatctgcaaattgcaaagaagtcaaagacatataatccttatcggtgggtgagatatgtgactcaggccaattcatatgttgctcgtatatgatggctgttgagaccttttccagcattaccctcctcggtttcttcttctctttttcacttcttcccagacatcttttgcccactccctgttgaggtgtcttgagttctaaattgtcttttctaactctggttttgggctttcaatgtttgtactatattgtctagataatgatggagggctctttggtgattctcattttaaaaaattgtgcaactaatggaaaattttgcta

SEQ ID NO: 7161 - DNA, 1468 bp, Quercus alba
aagcgaaagcgaaagccaaagcaatctgagctttgaacagagtgcgcacagcgagaccgagagagagatcgttcatccatcatgatctcgcaattcttcgttctatcgcagcgcggcgataacattgtcttccgtgattatcgtggtgaaatacaaaagggaagcacagaaatattcttccgtaaagtgaagttttggaaagaggatgggcaagaggaggcaccacctgtctttaatctggatggtgtaaactacttccatgtgaaggttgttggattgttttttgttgcaaccacaagagttaacgtatcaccctctctcgtcttggagcttttacaaaggattgcccgtgtcattaaagattaccttgggattctgaatgaagaatcattgcggaaaaattttgtgcttgtgtacgagttgcttgatgaagttatagattttggttatgtacaaacaacatccaccgaaatgttgaagtcttatgtttttaatgagccaatagtggttgaagatgcacgtttgcaatattctgccctttttatgcaagggacgaaaagaatgccaggaacagctgtcacaaaatctgttgtagcaaatgaccctacgggtaggaggagggaggagatttttgtcgatctaattgagaaaatcagcatcacctttagctcaagtggatatatactgacttctgagatagatggtaccattcaaatgaagagctatctcactggcaatccagaaatacgattagctcttaatgatgacctgactataggaagaggagggagatcagtatttgattacaggagttcatctgggactggagcagtgatattggatgattgtaattttcatgaatctgtacatctagatagtttcgaaatggacaaaactttgagcttggtaccaccagatggtgaatttacagtcatgaactatcgattgactcaggagttcaaacctccttttcgtgtaaacactttgattgaagaaacaggagcccttaaggctgaagtaattattaaagtacgtgcggagttttcctcaagcattactgcaaacacaattatggttcagatgccactaccaaaatatactacgagagctagttttgagttggaacctggagcaattggacagacaacaaatttcaaggaagcaaataggagacttgaatggggtctaaagaagattgttggtggatctgaacatactctgcgtgcaaagctaacattttctccggaatcacatggaaatattacaaaagaatctgggccagttagcatgactttcacaataccaatgtataatgcttccaggcttcaggtgaaatacttgcagatagcaaagaaatccggaacttataatccatataggtgggtgagatatgttactcaggccaattcgtatgttgctcgtatatgatgcggttaaaacttcctgttgccaccatttttttataacc

SEQ ID NO: 7162 - DNA, 1703 bp, Solanum phureja
gggcaaagagaaaatcagaggaagaaaaaaatcataggtaaaacgtgagagtaaaccaagacaagtatcaggagaagccaaaaactccatctcagcgaaatagcaaccatgatttctcagttctttgtgctttctcagagaggcgatagcatcgtcttccgcgactatcggggtgatgtactgaaaggaagtgcagagatcttcttccggaaagtaaagttttggaaagaagatggcggagaggaagcacctcctgtatttaatgtggatggtgtgaactactttcatgtgaaggtagttggtctgctttttgtagcaacatctaggacaaatttgtcgccttctctagtgttggagcttctccagaggattgcacgtgtaatcaaagattacctcggtgttctaaatgaagactcattgcggaaaaattttgtgctcgtgtatgagcttcttgatgaagttgttgattttggttatgtgcaaacgacgtcgacagaaatcttaaagtcttacatatttaatgagccaattatgattgatgctggccgcttgccaccccttggtcctgcagccatgttcatgcaaggatccaaaagaatgccagggacagcaattactaaatctgttgtggcaaatgaacctggggggagaaagagggaggagattttcgtggatataattgaaaaaataagcattactttcagctcaagtggatatatattgacttctgaaattgatgggaccattcaaatgaagagctatcttactggtaatccagaaatcaaattagctctgaatgaggatctgggaattggaagggccggtgggagatcaggttatgattatggaggttcggctgggtctggagcagtagtactggatgattgcaatttccatgaatctgtgcaacttgatagttttgatgtggacaggaccttgactctggttccaccggatggtgaatttcctgtcatgaattaccggataacccaggaattcaagcctccctttcgtattaatactttgattgaagaagctggatcacttaaggcagaagttatcttgaagatccgtgctgaatttccttcggacattactgcaaatacaatcttggtacaaatgccgctgcctacatatacaagcagagtaagctttgagttggaacctggaacagttggtcaaacaactgattttaaggaatccaataagaggcttgagtggagtttgaagaaggttgtcggtggatcagaccatacattacgtgccaagctaacattttcgcaagagtcacatggaaatatcaccaaggaagctggaccagtgagcatgaccttcacaatcccaatgtataatccttcaaggctgcaggtgaaatatctacaaatcgcaaagaagtcaaagacatataatccttatcggtgggtgagatatgtgactcaggccaattcgtatgttgctcgtatatgatggctatcgagaccttttccagcattattcccctcggtttctttcttttctctttctcacttcttcccaaacatattttgcccactccctgttgaggtgtcttgagttctaaattgtcttttctaactctgcttttgggctttcaaatgtttgtacctatattgtctagataatggagggctatctggttattctcaatttgaaaattgtgcaacaaatggaaaaatttgctaata

SEQ ID NO: 7163 - DNA, 1830 bp, Cannabis sativa
aaaaaaaaaaaaaaactaattttaaagagattttagagttatgcctacttccccttcatatagatagatagatggatatattgatttttgagaagaaaagacaatttcttataagtgtggaaactggaaaagagttcgacagttccagcaaaagaccagatccgaagtagccgtagccatgatctcgcagttcttcgtgctatctcagcgcggcgataacatcgtctttcgcgactatcgaggtgaagtacagaaagaaaccgcggagatattcttccggaaagtgaagttttggaaagaagatggccaagaggaagctccccctgtctttaatgtggatggtgtcaactactttcatgtaaaggttgtgggattattgtttgttgcaacaacaagaatcaatttgtccccttcttttgtcttcgagcttttacagagaattgcccgtgttatcaaagattaccttggagttctcaatgaagattctctaaggagaaattttgtactcgtgtatgagttgcttgatgaagtcattgattttggctatgttcaaacaacatcaaccgaagtgttgaagtcctatgtattcaatgagccaattgttgttgattctgcacatttgtcacctcttggtcctgcttccctattcatgcaagggaccaaaagaatgccagggactgctgtcacaaaatctgttgttgcaaatgatcctagtggtagaaagagggaggaaatttttgttgatataattgagaagatcagcatgacttttagttctagtggatacatactgacctctgaaattgatggcacaattcaaatgaaaagttatcttactggaaacccagaaattcggttagcacttaatgatgacctgagcataggaagaggtgggagatcagtctatgactatagaagctccgtcggctcaggagtagtgattcttgatgactgtaattttcatgaatccgtacgtcttgatagttttgaggcagaaaaaactttgtccctggttcctccggatggtgagtttcctgtcatgaattatcgtatgacccaggaattcaagcctcctttccgtattaatgctttgattgaagaagcgggagcccttaaggctgaggtgattctgaaagtacatgcagagtttccctctagcattacggcaaacactatttctatacagatgccactgcctaagtatactatgagagcaagttttgagttggaaactggagctgttggacaaactacagatttcaaggaagctaataagaagcttgaatggaatttaaagaagattgtaggtggatcggaacatacactgcgagcaaggctaacattttcacaagaatcgcatggtaatataacaaaagaatccggtcctgttagcatgacatttaccataccaatgtataatgcttcaaagcttcaggtgaagtacttgcagatagcaaagaagtcggggacatacaatccatacagatgggtgagatatgttactctgtccaattcctacgttgctcgtctgtaaaatggtaaagcatcggctgcaccaatctcctttgtgttttttatttttatctattgcgatcctgtaaactgctgttgtctagaaccattttgattggtttaacgttgcagactcttgaattgttaagttttcattttccttttttttattcatggaacgaaagttcaagttcagttattatttgtttcaacttttttgggtatgatatatgaagatacaatactccttcagaaaataaaaagtaataataatgaatctttcaagccaaaggaaataatattttttgttgactttga

SEQ ID NO: 7164 - DNA, 1696 bp, Prunus persica
caacagctgagcttgaggaccacccaccgcatttcggacacagggaggagaaagaagtaagcaaagccatgatctcgcagttcttcgtgctctcgcagcgtggcgataacatcgtcttccgcgactatcgcggtgaagtaccaaaaggaagtgcggagatatttttccggaaggtgaagttttggaaagaagatgggcaagaggaagcaccacctgtctttaatgtggatggtgtcaactactttcatgtgaaggttgttggactattatttgttgcaaccacaagagctaatgtatcgccatctcttgtcttggaacttcttcaaagaattgcccgtgtcatcaaagattatgttggagttctcaatgaagattctataaggaagaattttgtgcttgtgtacgagttgcttgatgaagtcatagattttggctttgtgcaaacaacatcaactgaactgttgaagtcttatatctttaatgagccaattattcttgattctgcacgtttatcatctattggccctactggcctttttatgcaagggacaaagagaatgcctggaacagctgtcacaaaatcagttgttgcaagtgaacctggcggtaggaagagggaggaaatttttgtggatataatcgagaagatcagtgttacttttagctctagtgggtacatactgacttctgagattgatggcaccattcaaatgaagagctatctcactggcaatccagaaatccgattagctcttaatgaggacctcagcataggaagaggtggaggatcggcatatgactataggagttcctttggctcaggagcagtgatacttgatgattgtaattttcatgaatctgtgcgtcttgataattttgaagtggacaaaactctgaccctggtaccccctgatggtgaatttcctgtcatgaactaccgtatgactcaggagttcaagcctccttttcgtattaatgctttgattgaagaagcaggagcgcttaaggccgaagtgattctgaaaatatttgctgagttcccatcaaacattacttcaaacacaattgctgtacaaatgccactacctaaatatacaatcagagccagttttgagttggaaccaggagcagttgggcaaacaacagatttcaaggaagcaaataagagacttgaatggggtttaaagaagattgttggtggatctgaacatacactgcgtgccagactgaccttttcaccggaagcacatggaaatataacaaaagaatctggtccagttagcatgacatttacaatacctatgtataattcttcaagacttcaggtaaagtacttgcagatagcgaagaaatctggaacttataatccatatcggtgggtaagatatgtcacgctcgccaattcatatgttgctcgtatatgatccaataaagcttcatatgttatggtatttcgcggtggaggaattggaaagaaggtttctagttccaagatgtcttatgaaaccctcactctattccttctttggtgggtctggatatttctctattctttttcagtggtttcatttcttgaccaacattaggctgtatcgttggatttttttggtggacaattgaattattgaattgctccttctgtagtgcctgttcaataactatataaatacactcaaattgcaatgggattttttat

SEQ ID NO: 7165 - DNA, 1733 bp, Citrus clementina
acaagcatcaactcaacacagcaaaagcatcagatcttaagttcaattttgcagcaggaaaaatgatatcgcaattcttcgtactctctcaacgaggcgataacatcgtcttccgcgactatcgaggcgaagttcagaaaggaagcgcggagatatttttccgtaaagtgaagttctggaaagacgatggagaggaagaggcgccacctgtatttaatgtggatggtgtgaactactttcatgtcaaagttgttggattattgtttgttgcaactacgagggttaatgtgtcaccatctctggtgttggagcttctacaaaggatagctcgtgtcatcaaagattaccttggggttctcaatgaagattcacttcgaaagaactttgtgcttgtctatgaattgcttgatgaagtcatcgattttggttatgtgcaaacaacgtctactgaagtgttgaagtcctatgtatttaatgagccaattgtggttgatgctgtacgcctgcaaccgctaagccctgctgctatttttatgcaagggaccaaacgaatgccaggaacagctgtaactaaatctgttgtggcgaatgagcctggaggtaggaagagagaagaaatttttgtggatattattgagaaaattagcgtgacattcagctcaagtggatatattctgacttctgagattgatggcaccattcaaatgaagagctacctcactggaaacccggaaatacgtttggctcttaatgatgacctgctcattgggaaaggcggaagatcaatctatgattacagaagttcaactgggtcaggagctgtggtacttgatgattgtaactttcatgaatctgtacgtcttgatagttttgatgtggacaggactttgtccctggttccaccagacggtgaatttcctgttatgaactaccgaatgacccaggaatttaagcctccttttcgtattaatacattggttgaagaagcaggagcccttaaggctgaagtgatcattaaaataagtgctgaattctccgcaagcattactgccaacacaattgttgtagaaatgccgctgccaaaatacactaccagagtgagttttgggttggaacctggagcagttgggcaaagaacagatttcaaggaagctaataggagacttgaatggggtctaaagaaggcaataatttcttagcaattttcttattaattgttgggggatctgaacataccctacgtgcaaagttgacattttcacaggaatcacacggaaatatcacgaaagaagttggacctgttaacatgactttcacgatcccaatgtacaatgcatcaaagcttcaggtgaaatacttgcagatagcaaagaaatccagtacttataatccatatcgatgggtaagatatgtaactcaggccaattcatatgttgcccggatatgagggtagaatttccgtcccattcctacccaatctgttgatgtaccctgtttatgtggtgtcattttttaactacttgttacgggtcaagtgaaacgaaacttcaaagtttgtagtcgtggctaagtggaactaatccttgtacgattgtatcaatgtctgttatatttactaatcttgcaatctcttcatacacttgtcttattgtggatttgtgagttgttaaagtgacgggtaatgttttagtgtaagataaaatatcaattaggtaaacaaatgctgactttac

SEQ ID NO: 7166 - DNA, 1733 bp, Citrus sinensis
acaagcatcaactcaacacagcaaaagcatcagatcttaagttcaattttgcagcaggaaaaatgatatcgcaattcttcgtactctctcaacgaggcgataacatcgtcttccgcgactatcgaggcgaagttcagaaaggaagcgcggagatatttttccgtaaagtgaagttctggaaagacgatggagaggaagaggcgccacctgtatttaatgtggatggtgtgaactactttcatgtcaaagttgttggattattgtttgttgcaactacgagggttaatgtgtcaccatctctggtgttggagcttctacaaaggatagctcgtgtcatcaaagattaccttggggttctcaatgaagattcacttcgaaagaactttgtgcttgtctatgaattgcttgatgaagtcatcgattttggttatgtgcaaacaacgtctactgaagtgttgaagtcctatgtatttaatgagccaattgtggttgatgctgtacgcctgcaaccgctaagccctgctgctatttttatgcaagggaccaaacgaatgccaggaacagctgtaactaaatctgttgtggcgaatgagcctggaggtaggaagagagaagaaatttttgtggatattattgagaaaattagcgtgacattcagctcaagtggatatattctgacttctgagattgatggcaccattcaaatgaagagctacctcactggaaacccggaaatacgtttggctcttaatgatgacctgctcattgggaaaggcggaagatcaatctatgattacagaagttcaactgggtcaggagctgtggtacttgatgattgtaactttcatgaatctgtacgtcttgatagttttgatgtggacaggactttgtccctggttccaccagacggtgaatttcctgttatgaactaccgaatgacccaggaattcaagcctccttttcgtattaatacattggttgaagaagcaggagcccttaaggctgaagtgatcattaaaataagtgctgaattctccgcaagcattactgccaacacaattgttgtagaaatgccgctgccaaaatacactaccagagtgagttttgggttggaacctggagcagttgggcaaagaacagatttcaaggaagctaataggagacttgaatggggtctaaagaaggcaataatttcttagcaattttcttattaattgttgggggatctgaacataccctacgtgcaaagttgacattttcacaggaatcacacggaaatatcacgaaagaagttggacctgttaacatgactttcacgatcccaatgtacaatgcatcaaagcttcaggtgaaatacttgcagatagcaaagaaatccagtacttataatccatatcgatgggtaagatatgtaactcaggccaattcatatgttgcccggatatgagggtagaatttccgtcccattcctacccaatctgttgatgtaccctgtttatgtggtgtcattttttaactacttgttacgggtcaagtgaaacgaaacttcaaagtttgtagtcgtggctaagtggaactaatccttgtacgattgtatcaatgtctgttatatttactaatcttgcaatctcttcatacacttgtcttattgtggatttgtgagttgttaaagtgacgggtaatgttttagtgtaagataaaatatcaattaggtaaacaaatgctgactttac

SEQ ID NO: 7167 - DNA, 1600 bp, Cirsium arvense
aactgtccttggtatttgcagatgttcatcggatctcatttacactgttgcacacaacctcctcaccccaatcgtcgtccgatttcgagatacataatctctatccgagctagttgaattgaggaaggaagcaggttcacggcaatgatttcacagttctttgtattgtcgcagagaggcgataacattgtgtttcgtgattatcgtggtgatgtgcaaaaaggaagtgcagagattttctttcgtaaagtgaagttctggacggaggatggagaagccgaggctccacctgtctttaacgtggatggtgtcaactactttcatgccaaagtagttgggttgctgtttgttgcaacaactagagcaaatgtttcaccttctcttgtcttggagcttctactaagaatagcacgagttaccaaagattaccttggcatcctcaatgaagattcaatacggaaaaactttgtgcttatgtacgaattacttgacgaagtaattgattttggttatgtgcaaacgacatcaactgaagttctaaagtcatgtgtatttaatgagccaatcatggttgatgctgcacgtatgccacctcttggtccagctgctctctttatgcaagggaacaaaagaatgccagggacggctgtcacgaagtcagttgtagctaatgaacctgggggtaggaagagggaggaaattttcgtggatataattgaaaaaataagtgttactttcagctctagtggatacatactaacttctgaaatagatggcaccattcaaatgaagagttatctttctgggaatccagaaattcgactagctcttaatgaggagctgaatataggaagcagtggcagatcattatatgattacactggctctactggatcaggagcagttatattagatgattgcaatttccatgaatctgtgcatctagatagttttgatgtcgacagaactctgactcttgtgcctcatgatggtgaatttcctgtcatgaattatcgcatgactcaggaatttaagccacctttccgtattaacaccctgattgaagaagctggatcactcaaggctgaagtgattctgaaagtacgtgccgaatttcctcaaaatattaccgcaaatacggttgtggttcagatgcctgtgccgtcatacacatccagaattagcttcgaaatggaatctggagcagttggacaagtgactgattttaaggaatcaaacaagaaactcgagtgggggttaaagaagattgttggtggatctgaacatacactgcgtgcaaagctaacattctcacaggaatcgcatgggaatataacgaaggaagctggacctgtcagcatgaccttcaccataccaatgtacaactgctctagactacaggtgaaatacttgcaaattgcaaagaagtcgaaaacgtacaatccataccggtgggtgagatatgttacccaagccaattcatatgttgctcgtatatgaatatgagcctctctctctgtatggatttttatttttttggtttggttttgataatagctcgttgtttatgtaccgagagaattgtgtacaattgacttta

SEQ ID NO: 7168 - DNA, 1697 bp, Quercus alba
caagggaaactcagaacctgaaattgaaccgaaagaaaaggaatagaaaaagccaaagccccgttgtgtaaactgaaaactctctctctctctctctcaggagccatgatttctcagttcttcgttctgtcgcagagaggcgacaacatcgtcttccgtgactatcggggtgaagtaccaaaggggagtgccgagatatttttccgaaaagtgaagttttggaaggaggatggagaaggggatgcaccacctgtctttaatgtggatggtgttaactattttcatgtcaaggttgctggattgttgtttgttgctacaacaagagttaatgtgtcaccttctcttgttttggaacttttgcaaaggattgcacgtgtcatcaaagattaccttggaatactcaatgaagattcattgcggaaaaactttgtgcttgtgtatgagttgcttgatgaagtcattgattttggttatgtgaaaacgacatcaaccgaggttttgaagtcttacattttcaatgaaccaattgtgatcgatgcagctcgtgtgccatcccttggagctgcaggcatatttatgcaagggtcaaaaagaagaatgccagggacagctgttacaaaatctgttgtagcgaatgagcctgggggtagaaagagggaagaaatttttgtggacataattgagaaaataagtgttacattcagctctagtggatatatactaacttctgagattgatggcaccattcaaatgaagagttatctgtcaggaaatccagaaattcggcttgctcttaatgatgacctgagtataggaagaggcagaagttcaatctatgattatggtaattcatccggttccgggtccgtgattctagatgattgtaatttccatgaatctgtacatcttgacaatttcgacattgacaggactctggccctggtaccaccagatggtgaatttccagtcatgaactaccgcatgactcaggaattcaggactccttttcgtattaatgcattgatagaagaagcgggccctcttaaggctgaagtaattctgaaagtgcgtgctgagttcgcctctagcatcactgcaaacacaattctagtacagatgccactgccaacatatacaactagagttacttttgagttggagcctggtgcagtgggaaacacaactgattttaaggaagcaaataaaagacttgaatggggtttgaagaagattgttggtggatctgaacatactctacgtgcaaagctgacattttcacaggaatcacatggaaatattgtgaaggaatctggacctgttagcatgacctttacaataccaatgtacaattgttcaagacttcaggtaaaatacttgcagatagctaagaagtccaagacggataatccatatagatgggtgagatatgtcacacaggcgaattcctatgttgctcggttatgatcatagtctattctccccataattcttcttgttcctctgtttacttgctccattttcctctcactagttcattccaataagaactgcagttgaaagaattttttttgttttcatggtccgtgaagtttgatcctttctatgctatttttattaagcatttacttatatggatctctgttactgcaatttggtaaaatagaacgaagatatctagatgaagcaaaaaaaaaaaa

SEQ ID NO: 7169 - DNA, 1685 bp, Malus domestica
caacagctgagctttgaggaactcccgcatttcggatacagcgaagacggaaagcaaagccatgatctcgcagttcttcctgctctcgcagcgtggcgacaatatcgtcttccgcgactatcgcggagaagttccaaaaggaagcgcggagatatttttcaggaaagtgaagttttggaaagaagatgggcaagaggaagcgccccctgtctttaacgtggatggtgtcaactactttcatgtgaaggttgttggactattgtttgtcgcaaccacaagagctaatgtatcaccatctcttgtcttggaacttctacaaagaattgcccgtgtcatcaaagattatgttggggttctcaatgaagattctataaggaagaattttgtgcttgtgtatgagttgcttgatgaagtcatagattttggctttgtgcaaacaacatcaactgaattgttgaagtcttatatatttaatgagccaattgttctcgaatctgcgcgtttatcatctattggccctactggcctttttatgcaagggacgaagagaatgcctggaacagctgtcacaaaatcagttgttgcaaatgagcctggtggcaggaagagggaggaaatttttgtggatataatcgagaagatcagtgttactttcagctctagtgggtacatattgacttctgaaattgatggaaccattcaaatgaagagctatctctcaggaaatccagaaatccgattagctctcaatgaggatctgggcataggaagaggtggagggtcaggctatgaccataggagttcatttggatcaggagcggtggtacttgatgattgcaattttcatgaatctgtacgtcttgataattttgaagtagacaaaactctgaccctggtgccccctgacggtgaatttcctgtcatgaactaccgtatgactcaagagttcaagcccccttttcgtattaatgcgttgattgaagaaaaaggagctcataaggctgaagtgattctgaaaatatatgccgagttcccctcgaacattacttccaacacaattgctatacaaatgccgctacctaaatatactatcagagccagttttgagttggaaccaggagcagtcggacaaacaacagatttcaaggatgccaataagagacttgaatggggtttaaagaagattgttggtggatctgaacatacgctacgtgccagacttacattttcaccggatgcacatggaaatattacaaaagaatctggaccagttagcatgacatttacaatacctatgtataattcttcaagactacaggtaaagtacttgcagatagcaaagaattctggaacttataatccataccggtgggtaagatatgttactctcgccaattcatacgttgctcggatatgatctaataaagccttatctgttatgctatttcgcggtggagagttggattgggaagaaggtttctagttgtaagatgtctaatgaaaccctcgcgctgtattccttttccatgggttcggatttcagtgatttcatttcttgactaacgtttaggttgtatcgctgaatgtttttgggttggactattgattcattgaattgctacttgtgtattggatgttcattaactatataaatgcactcaaattggaaccaatagagtttgtta

SEQ ID NO: 7170 - DNA, 1774 bp, Fagopyrum esculentum
aaaagcaagtagaagaacacaacaaccagttatctcgagaagctcgggagttgaaggtgagacgaagtcgacaatgatatcgcagttcttcgttctctcgcaaagaggcgataacatcgtcttccgcgactatcgaagtgacgtaccgaagggcagcacagagatattttttcggaaagtgaagttctggaaagaagaggatggggagggggatgcaccacctgtctttaatatagatggtgttaactacttccatgtgaagattgttggcttattatttgttgcaacaaccagaatcaatacatcgccttcccttgtattggagcttctgcaaagaattgcccgtgttatcaaggattacctagggattctcagtgaagactctttaaggaaaaattttgtccttgtctatgagttacttgatgaagtaatagatttcggttatgtacaaacaacgtccactgaagtgttgaagtcttacatattcaatgagccaattgtggtcgatgctgcacgtgtgccagcacttggccctgcttcaattttcatgcaaggaaacaaaagaatgccaggaactgctgtcacaaaatcagttgtggcaaatgagcctgggggtagaaagagagaggaaatctttgttgatatcattgagaagatcagcgttacattcagttccagcgggtacatactcacatctgagattgacggcacaattcaaatgaagagttatctgactggtaatccagaaatcaagttagcactgaatgaggatgtttgcgttggaagaggtgaagtgcatatggttatggaagctcagctgggtctgggtcagtgatacttgatgactgtaactttcatgaatctgttcaccttgatagctttgacattgacaggactctgagtttggtaccacctgatggtgaatttccagtgatgaattatcgtatgactcaggagttcaggcctccatttcgaattaacaccttgattgaagaagctggatcactaagagctgaagttatcatcaaagttcgtgcagaattcccctcaaacatcactgcaaatacaattttgatacacatgcctgtaccaacacatactacaagagtgagttatgaggtggagcctggtgcagttggacagacaactgacttcaaggaagccaacaagagactagaatggaatttgaagaagattgttgggggagctgagcatacactacgtgcaaagctaacattctcacaggaaactcatggaaacattacaaaggaagctggacctgtttcaatgaccttcacaataccaatgtacaatgcttctaggcttcaggtaaaatacttgcagatagcaaagagatcgaatacctacaatccatatcgatgggtcagatatgtcacacaagctaattcatatgttgctcgcatatgatggacaaaacctgctttgcacaggtataaaattctgccaaggttaatcatacactcgtaccaaagtctatgtatttcttttctttcaagtcgagctttagactcgcagactttcgtcttggtttagcttgtgaagattttcggttcggctgatgttacctctttgagagatacgtaagatggatgcgtcaaattagtctttgttcaagtttgaagttcgtattctatctgggtgattagagatagaatcagtgattcagtgggcacgttgcttttcatattgctgttcagactgttactcgtggtgtctgtattctagttttcaatttctatatgctcctactttc

SEQ ID NO: 7171 - DNA, 1472 bp, Medicago truncatula
cacaaagagtattgaattatcgtcttcattgctcgctcgcaaaacagccatcacagaaggaacagctgaagaaagtgcagtgcagcatcgaccggaaccatgatctcacagttcttcgtcctttcacagcgtggcgataacatcgttttccgtgactatcgtggtgaggtcccaaggggaagtgcagagatatttttccgcaaagtaaagttttgggaagatggcgaattgcaggaggcaccacctgtctttaatgtagatggtgtaaattactttcatgtgaaagttgttggcttactgtttgttgcaactacaagggttaatatatcaccttccttcgtcttcgagcttttacaaagaattgcccgtgtaattaaagattaccttgggattctcaatgaagactcattacgaaaaaactttgtcctggtgtacgagttactcgatgaagttattgatttcggttatgtgcaaacaacatctacagaattgttgaagtcctatattttcaatgagccacttgtaattgatgcagcacgtctgtcacctcttggacctgctgcaatcttttctcaggggacaaaaagaatgccgggaatagctgttacaaagtctgttgttgcaacagagcctgggggtagaaggagggaggaaatctttgtggatataattgagaaaatcagcatcacttttagctctagtggatatatattgacttctgagattgatggcaccatacaaatgaagagctatcttactggcaatcctgaaattcgcttagctcttaatgacgacctttccattggaagaagcgagggaccaatctccggttataggagttcctctggctcaggagcagtggtattagatgactgcaatttccatgaatctgttcgtctggatagttttgaaacaaacagaactctatccctgatacctccagacggtgaatttccagtcatgaattaccgtatgacccagccatttaagcctccttttcgcatcaatgctttgattgaagaggcagggtcccttaaggcagaagtatttcttaaattaagtgctgagtttgcctcaagtataacagcaaacactattaaagtgcagatgccactaccgaaatataccaccagagttagttttgaactggagcctggtgctactggacagacaactgattttagggaggcaaataagaagctagaatggagtttaaagaagattaatgggggatctgagcatactttacgtgcaaagctaaccttttctcaggaatcacatggtaatataacgaaagaatccgggcctgttagcatgacatttactataccaatgcacaatgtatcacagcttcaggtaaaatatttgcaaataggaaagaaatctgggtcgcatgagccatatcggtgggttagatatgttacacaggcaaattcctacgtagctcggatatgatgcaattaggaaacccc

SEQ ID NO: 7172 - DNA, 1763 bp, Arachis hypogaea
aggggggatagaaaacatagaacaacaccagtattgttgagctcgtgatacactaagtcaatagcaaaaccaaaggcagcaatagccatctgcaggaagaggaacacatcgaaagaggagtgaagacagagccatgatctcgcagttcttcgtcctctctcagcgtggcgataacatcgtctttcgagactaccgtggtgaagtgccgaaaggtagtgcagagatattttttcggaaagtgaagttttgggaagatggagggctcgaggaggcaccacctgtctttaatgtggatggtgtaaattactttcacgtgaaagttgttgggttattgtttgttgcaactacaagagttaatacgtcaccttcctatgtcttggagcttttacaaagaattgctcgtgttatcaaagattaccttggcattctcaatgaggactcattacggaagaactttgtgcttgtgtacgagttacttgatgaagttattgattttggttatgtgcaaacaacatctaccgaattgttgaagtcctatgttttcaatgagccactagtggttgatgccacacgtatgccacctcttggacctgctacactttttgcgcaagggacaaaaagaatgcctgggatagctgtcacaaaatcagtggttgcaacagagcctggaggtagaaagagggaggaaatatttgtagacataattgagaaaatcagcatcacttttagctctagtggctatatactaacttctgagattgatggcaccatacaaatgaagagctatctttctggcaatcctgaaattcgattagctcttaatgatgaccttgccattggaagaggccaaggacctgtttatggttataggagttcaacaggctcaggagtagtggtattagatgactgtaatttccatgaatctgttcgtcttgatagttttgaagtagacagaactctatccctggtaccaccagatggtgaatttcctgtcatgaattaccgtatgacccaggaattcaagcctcctttccgtatcaatgctttgattgaagaagcaggggcccataaggcagaagtcattcttaaagtacgtgccgagtttgcgtcaagtataactgcaaatacgatcaaagtgcagatgccactaccaaaatacaccaatagagtgagttttgagctggaacctggagcttctggacaaacaactgatttcaaggaggcaaataagaggctagagtggaatttaaaaaaggttgttggaggatgtgaacatactctacgtgcaaagcttagcttttctcaggaattacatggtaacataacaaaagaatctggacctgttagcatgacgtttaccattccaatgtataatgcatctcggcttcaggtaaaatacttgcagatagcaaagaaatatggaactcatgaaccatatagatgggtgagatatgtgacgcaggccaactcctacgttgctcgcatatgatgcaattaagaagagtgccccacagctcttcttagtgctctttattatcccatggtttccctttatttactttattctttatttgtaaattacactttaagtcagacagaccataatagtcgctctttcattcattgatcataaaaccagcttggtttacaacgtgggatgaattcagtcactttatttatatactttttcatcgtattagtggatcactcggtcttattgtagagtgttaatgagaaattgaaaatgtcgattgcagggattg

SEQ ID NO: 7173 - DNA, 1641 bp, Phalaenopsis aphrodite
gttggcaatggcaccgactgacccaccgtctgattttcagctgcgaatcacttgatcagagaaatatcagatctgcgagaggcatccaacgagagaatcctccggagattggattctcagatcgctctctgatctcagtcatgatctcgcagttcttcgttctctctcaacgaggcgacaacatcgttttccgggattatcgaggtgtagttccaaaaggcagtgcagagatattcttccggaaggtgaagttttggaaagaggatgaagcagaggaagcacccccagtctttaatgtggatggagttaattacattcacgccaaggtagcaggattgatgtttgtcgccactacgagagcaaatatttcaccatctcttgttttggagcttctacaaaggatagcacgcataattaaagattaccttggggttcttaatgaagattcgttacgcaaaaactttgttcttgtatatgaattacttgatgaaatcatcgactttggctatccacaaactacatctacagaggttctaaagtcttatgtatttaatgaaccaattgtggttgattcttctcgaatgccacctcttggcccggcagcaatgtttatgcaaagctctaaacggatgccgggcacagctgtcacgaaatctgttgtctccaatgagcctggtggtcggcagagggatgaaatatttgttgatgttatcgaaaaaattagtgtcactttcagctctagtggatatatacttacttctgagattgatggaactattcaaatgaaaagctacctcagtggaaatccagatatacgattggctcttaatgaggacctaagcattggcagaaatgttggaaactctatgtatgattatagaacttcttcgggaggagggacggtgatcctcgatgattgtaacttccatgaatctgtacatcttgataattttgatttggatagaaccttaagtttggtaccacctgatggagaattttctgtcatgaactacagaatgactcaagaattcaagcctcctttccgtatcaatgcattgattgaagaagctgggcccctcaaggctgaagtcattattaaaatccgtgccgattttttatcaagtataaatgcaaatacaattacagtgcaaatgccagtgccaaaatatacaacaagggttagctttgacttggaatctggggcgattggacaaacaactgattttaaggaaatgaataggaagctagaatggagtctaaataagattgttggaggctccgaacacacattacgggcaaaacttacattttctcaggaatcacatggaaatctgacaaaggaagcaggacctgttagtatgaatttcaccataccgatgtacaatgcatctaagcttcaggtgagatatttgcagatagcaaagaaatcgaagacctacaatccttatcgttgggttagatatgttactcagtctaattcctatgtggcccgtttataaccatttatttgataatcataagactttgtgtttagctttaattcctaaataatctttttgaataatctcatttactcacagaagcatctttaattattcttaattattattagttttgatagattatctatttcatttaaaa

SEQ ID NO: 7174 - DNA, 1760 bp, Amorphophallus konjac
atgccccaccggtgggaactaacaaggaccccgcctccctgtccgtccgagtagcagcagcgtcgtcgcagcggccggagacctaccacacccagctgaagccatgatctcgcagttcttcgtcctgtcgcagaggggcgacaacattgtcttccgcgactatcgtggtgagatacaaaaaggaagtgcagagatcttcttccgcaaagtaaagttttggaagggggatgaatttgaggaggcaccacctgtctttaatgtggatggagttaattacattcatgtgaaggtagcaggattgttatttgttgcaacaacaagagttaatgtatcgccatctctggtattggaactgttgcaaaggattgctcgtgtcactaaagactatcttggggttctaaacgaggattccttacggaaaaattttgtccttgtgtatgaattgctggatgaagtaattgactttggttatcctcaaacaacatcaacagaagtattgaaatcttatgtatttaatgaaccaattgtggttgaagctgctcgtttgccgccccttggacctgcagccatgtttatgcaagggacaaaacgaatgccaggtactgcagttactaaatctgttgttgccaatgagcctggtgggagaaaaagggaggagatatttgttgatgtaatcgagaaaataagtgtcacattcagctccagtggctacatacttacctcagagattgatggtactatccaaatgaaaagttatctcactggcaatccagaaatacgacttgctcttaatgaggagctgagcatcggaaggaatggaagttccatatatggctacagtagctctgctggaggtggaccagtaatcctcgacgattgtaactttcatgaatctgtacatcttgacagttttgatgtagatcgaacattgatgttgattccaccggatggagaattttctgttatgaattaccgtatgacccaggagtttaaacctccattccgtgtaaatgcattaattgaagaagcaggagcatttaaggctgaagttattctgaaagtcagagcagacttcccctcgagtatcactgcaaatacaattttagtgcaaatgcccttgcccgcttacacaacaagggttagctttgagttagaggcaggagcagttggaaacacaaccgacttcaaggaaggaacgaagcgactggagtggggtttgagaaagattgttggtggttctgaacatactcttcgtgcaaaactcacatttactcaggaatcacatgggaatattatgagggaagctgggcctgtgaacatgaccttcacaataccaatgtataatgcttcgaggcttcaggtgaggtacttgcaaatagcaaagaagtctaaaacctacaacccataccggtgggtgagatatgttactcaagcaaattcctatgttgcccggttgtgatggtattaaaacttgtatataccgtgtttgctgtataatacaagtgaaacggagcatttgggcacttgagtaaattatgccttactgagttgccaagtttgttctcaactctttgctcttttactgttcctggcatacctctgagaatgttttatatgcattcaattaaaattgcagactgatgtacctaaaaatagcctcctattactctgggacgtctgcacatatgacattcttacatgtgaaattgcaagatttccattaatttgtctaattcaactgcacaagaatgtgtaaagat

SEQ ID NO: 7175 - DNA, 1490 bp, Cirsium arvense
ggggtgcaaaacattgcaactggtcgtggtctcccaatattgcatttctttcagatctcatcattctcgcctcctcttctatacaatcatcgtttgatctctcgagagatagttgaatcgttggttgccatgatatcgcagttctttgtattatcgcagagaggcgataacatcgtttttcgtgattatcgtggtgatgtgcaaaaaggaagtgcagagatattttttcgtaaagtgaagttctggaaagaggacggagaaaccgaagctccacctgtctttaatgtggatggtgtcaactactttcatgtaaaagtggttggattgctgtttgttgcaaccactagagcaaatgtgtcaccttcccttgtcttggagcttcttcaaagaatagcacgggttactaaagattaccttggcatcctcaatgaagattctatacggaaaaactttgtgcttgtgtatgaattacttgatgaagttatcgattttggttatgtgcaaacaacatcgactgaagttctaaagtcatctgtatttaatgaaccaatcatgattgatgcaacacagatgccgcctcttggtccggctgccctctttatgcaagggagcaaaagaatgccagggacagctgttacaaaatcagttgtagctaatgaacctgggggtcggaaaagggaggagattttcgtggatataattgaaaaaataagtgttacattcagctctagtggatatatactaacttctgagatagatggcaccattcaaatgaagagttatctttccgggaacccagaaatccgattagctctcaatgatgacctaaatataggaagaggtggcagatcagtatatgactatggcggttctagtggatcaggagcagttatactagatgattgcaatttccatgaatcggtgcatcttgatagttttgatgtggatagaactctgactcttgtgccccctgatggtgaattccctgtcatgaattatcgcatgactcaggaatttaagccacctttccgaattaacaccctgatcgaagaagcgggatcactgaaggctgaggtgattctgaaaatacgtgccgagttccctcaaaatatcaatgcaaatacagttgtagttcagatgccgttgccaccatacacatccagagttagtttcgagttggaacccggagcagttggacaagtgactgatttcaaggagtcaaataagaaactcgagtgggggttaaagaagattattggtggatctgaccatacactgcgcgccaagttaacattttcacatgaatcacatggtaatataacaaaagaagctggccctgtcagcatgaccttcaccataccaatgtataactgctcaaaactccaggtgaaatacttgcaaattgcaaagaagtcgaaaacttataaatccatatcggtgggtgagatacgttacacaagccaattctaatgttgctcgtatatgatttt

SEQ ID NO: 7176 - DNA, 1349 bp, Platanus occidentalis
gtcgcagaggggcgacaacatcgtcttccgtgactatcgtggtgaagtacaaaaggaagtgcagagatattttttcgcaaagtaaagttttggaaggaggatgaagaagaggaggcaccacctgtatttaacttggatggggtgaactactttcatgtgaaggttgctggactgttatttgttgcaaccacaagagttaatgtgtcaccttccctgttttggagctcttacaaaggattgcacgagtcattaaagattaccttggggttctaaatgaagattctttacgaaagaactttgtgcttgtctatgagttgcttgacgaagtcattgactttggctatgtacaaacaacatcaactgaagtgttgaaatcctatgtattcaatgagccaattgtgattgatgttacacgtttgcccccccttggccctgcttcgatgttcatgcaagggaccaaaagaatgccagggacagctgttactaaatctgttgtagcaaatgagcctgggggtaggaaagagggaggaaatatttgttgacataattgagaaaataagtgtcacattcagctctagcggttacattcttacttctgaaattgatggcaccattcaaatgaagagttatcttacaggcaatccagaaatccgcctagcccttaacgaggacctgagcatagggagagatgggaggtctatatatgactatagtagttctgctggagctggatcagtgatactagatgattgtaattttcatgaatctgtacgtcttgatagttttgacattgacaggactttgactctggtacccccggatggtgaatttccagtgatgaactaccgtatgacccaggaattcaagcctccttttcgtattaatgctttgattgaagaagcaggggcccttagggctgaagtgattcttaaaatacgtgcggatttcccctcaagtattactgcaaacacaattgtagtacagatgccagtgccaacatacactactagggttagttttgagttggaacctggagcagtaggaaacacgactgacttcagggaatcaaataagagaattgaatggggcttaaaaaagattgttggtggttctgaacatactctacgtgcaaagactcacattttcacaagaatcacatgcaaatatcacaaaagaagctggaccagtaggcatgacttttactaataccaatgtataatgcttccaggcttcaggtgagatacttgcagatagcgaagaaattcaagacctataatccctatcgatgggtaagatatgtcacgcaggcaaattcctatgttgctcgcatatgattgaccactctacac

SEQ ID NO: 7177 - DNA, 1739 bp, Trigonella foenum-graecum
cgtgaatcacaaagactattcaattatcgtcttcgttgctagcaaaataaccatcacaaaagaaccagctgtgtagaaagtgcagtgcagtgcagtgcagcatcaagcggagccatgatctcacaattcttcgtcctttcacagcgtggcgataacatcgttttccgtgactatcgtggtgaggtcccaaggggaagtgcagagatatttttccgcaaagtaaagttttgggaagatggcgaactgcaggaagcaccacctgtctttaatgtagatggtgtaaattactttcatgtgaaagttgttggcttactgtttgttgcaactacaagggttaatatatcaccttcctttgtcttcgagcttttacaaagaattgctcgtgttattaaagattaccttgggattctcaatgaagactcaatcgaaaaaactttgtcctggtgtacgagttactcgatgaagttatcgatttcggttatgtgcaaacaacatctacggaattgttgaagtcctatattttcaatgagccacttgtaattgatgcagcacgtctgtcacctcttggacctgctgcgatcttttctcaggggacaaaaagaatgccgggaatagctgttacaaagtctgttgttgcaacagagcctgggggtagaaggagggaggaaatctttgtggatataattgagaaaatcagcatcacttttagctctagtggatatatattgacttctgagattgacggcaccatacaaatgaagagctatcttactggcaatcctgaaattcgcttagctcttaatgacgatctttctattggaagaagcgagggaccagtctctggttataggagttcctctggctcaggagcagtgatattagatgactgtaatttccatgaatctgttcgtctcgatagttttgagacaaacagaactctatccctgatacctccagacggtgaatttccagtcatgaattaccgtatgacccagccttttaagcctccttttcgcatcaatgctttgattgaagaggcagggtcccttaaggcagaagtatttcttaaagtaagtgctgagtttgcctcaagtataacagcaaacactattaaagtgcagatgccactaccaaaatataccaccagagttagttttgaactggaacctggtgctactggacagacaactgattttagggaggcaaataagaggctagaatggagtttaaagaagattaatgggggatctgaacatattttacgtgcaaagctaaccttctctcaggaattacatggtaatataacgaaagaatctgggcctgttagcatgacatttactataccaatgcacaatgtatcacagcttcaggtgaagtatttgcaaatagggaagaaatctgggacgcatgagccatatcggtgggttagatatgttacacaggcaaattcctatgttgctcggatatgacgcaataggccacccctcacccttttatctcctcctcttgctatttatatcattgcttttgttgtatttacttattctttatttatatactacattcaagttaagtgtagatgacattgttgtttgtttatcatttattacatatacaccagctggtcttacaacataggatgaattaagtcactattctctttttggcatttcctgtaaacggataactcagtcctgttataaatctttttattttatgagaatatttggtaatgtctg

SEQ ID NO: 7178 - DNA, 1556 bp, Lotus japonicus
ggtggaagtgaagagggaagaagacgatgagttgagttgagttgaagcagaagcagaaccaaacatgatgatttctcagttcttcgtgctttctcagagaggcgacaacatcgtcttccgcgactatcgcggtgaagtgcaaaaaggaagtgctgagacattcttccgaaaagtcaagttctggaaagaggatgctgaaggagatgctcctcctgtttttaatgtagatggtgtgaactacttccatgtgaaggctgctgggttgttatttgttgctacaactagagtcaatgtctccccttctcttgttttggggcttttgcaacgaatcgcgcgtgttatcaaggattaccttggtgttcttaatgaggattcttttaggaagaactttgtgcttgtgtatgaattgctggatgaaatgatcgattttggttatgtgcaaacaacatctactgaacttttgaagtcatatgttttcaatgagccaattatgattgatgctgcgcggcttcctcccatgggtcctgcttccatttttatgcaagggaccaaacgaatgccaggtacagctattacaaaatctgtttttgctaatgaatctggtggtaagaagagggaagagatctttgttgatgtaattgagaaaataagtgctacattcaactctagtggatttatacttactagtgagatagatggcaccattcaaatgaagagttatcttactggtaacccagagattcgacttgctctcaatgaggacctgagtataggaacaagtgattatagaggttcaggtgccgtgattttagatgattgcaacttccatgagtctgtacaccttgatagttttgatgttgaccgaactttatcattggtaccaccagatggggaatttcctgtcatgaattatcgtatgactcaaccatttaagccaccctttcgtattaatgtattgattgaagaaacaggacccctcaaggctgaagtgaccattaaaatacgtgctgaattcaactcaagcatcaatgctaatacagttcttgtacagatgccactaccaacatctacggctcgtgttaattttgagttagaacctggagcagttggtcacacaactgattttaaggaaacaaataaaagactggaatggggcataaaaaaggttgttggtggttctgaacatactttacgagcaaaactgacactttcacatgagtttcatggaaacatcatgaaagaagcagggcctcttagcatgactttcactatacctatgtacaatgcttcaaggcttcaggtgaagtacttgcaaatagcaaagaagtcaaaagcacataatccataccgatgggttagatatgtaacccaagcaaactcgtatgttgctcggttgtaatttcaacatctgcaagtgcagattctgaagttacttgttttcctactcattaattttcatgtatgctgaattattccaggataactacatgtagtgtttttagtcagttaaaattgactgtttaacttgcaacttgtaattaaatttggtttttggt

SEQ ID NO: 7179 - DNA, 1770 bp, Pinus taeda
ctaaaattaaatttcagagggagtgtagcgctaagctcgaaggtacataaagacctttaaagaagcagggatcggcagatcttgtatatatatagctcactgtgaattcggtggaacggacatcgtgcttatcgccgaagggctttcaacgacaaacttcagcatgatatcgcaatttttcgtgctctcacagaggggagacaacattgtcttccgagattatcgtggggaggtaccaaagggaagtgctgaaatatttttccgcaaagtcaaattttggaagaatgatgacggagaggaggcaccaccagtcttcaatgttgatggggtgaactatttacatgtgaaagttgctggcctgttattcgttgcaaccacaagagtaaatgtgtctcctgcacttgtgttggagcttctgcagcggatagcacgtgtgataaaagattatcttggaattctcaatgaggattcactacggaaaaattttgtccttgtatatgaattactcgacgaagtgattgactttgggtatccacagaatacttcaactgaagtgttgaagtcatttatattcaatgaaccaattgtagtagatgcaggacgggggccatcacttagccctgctgcaatgttcatgcaaggatcaaagcgaatgccaggaacggctgttacaaagtcagttgtagccaatgagcctggaggcaggaagcgggaggaagtttttgttgatgtcattgaaaaaataagtgtaacatttagcgctagtggctatattctgacatctgagattgatgggaccattcaaatgaaaagctatctgacaggcaaccctgaaattcgactggccctaaatgaggacttgagtattgggcgaagtggccattctagctatgattatagcagctcatctggggcaggcatggtaattttggatgactgtaattttcacgaatctgtccgcctcgacaactttgatttggatcgaacactgactctggtgcccccagatggagaatttccagtcatgaattaccgcatgactcaagagtttaagcctccatttcatgtcaatactttgattgaagaagctggttcattaaaggcagaagttatgctgaaagttcgtgctgacttttcctctacaattactgctaacacggttgcgttgcatatgcctctgccaaaatacacgacaagggttagctttgatttggagtcaggagcagtaggacaaacaacagatttcaaggaagggaataagatgctagaatgggggctgagaaagattgtcggtggttctgagcatacattacgggcaaagctttcattttcccaagagacaaatatgaatatcacaaaggagtcgggtcctgtcagcatgactttcactataccaatgtacagtgcttcgaggctacaggtacgatatttacaaattgttaaaaagtccagaacctacaatccttaccggtgggtgagatatgtgactcaagcaaactcttatgtcatcagaatatgaagaatcgaaagtatagaactgtattgtattgcacaattttgtcatatgactctagattgttaaaaatattttcatttgaaataattttgctttgtttatcaagattgggaattagagaataaaacctttaattcagtacacttaaggtggttcatattaattttttgtttattgcatggtgaacaatcaagagggaggggcacccttcatatctgttgtttttttaattctttcccatattttcctagtaa

SEQ ID NO: 7180 - DNA, 1799 bp, Glycine max
gcaaaacggcaatgcgtttgttgcgaagagtgggcaaagtaaaaaggaaggaggaagatgacttgagttgagctgttaagacagaaagctaaaacagaagaagcaaagatgatattgcagttcttcgtgctttcacagagaggcgataacatcgtctaccgcgactatcgtggtgaagctcaaaaaggaagcgctgagacatttttccgaaaagtaaagttctggaaagaagatgctgagggagatgctccacctgtttttaatatagacggtgtgaactacttccacgtaaaggttgctggattgctatttgttgctactactagagtcaatgtctccccttctcttgttttggaacttttacaaagaattgcacgtgtcatcaaagattaccttggtgttctcaatgaagattcctttagaaagaacttcgtgctcgtttatgaattactggatgaagtcattgattttggttatgtgcaaacaacatccactgaggatttgaagtcatatgttttcaatgagccaatagtgattgatgctgcacggatgcctccacttggccctgcttccatttttatgcaagggaccaaacgaatgccaggtacagctattacaaagtctgtggttgctaatgaacccggtggaaggaagagggatgagatctttgttgatgtaattgagaaaataagtgttacattcaactctagtggatttatacttactagtgagatagatggaaccattcaaatgaagagttatcttactggtaacccagagattcgacttgctctcaacgaggacctgagtataggaacaagtgattatagaggttcaggtgctgtcattttagatgattgtaacttccatgagtctgtacaccttgatagttttgatgttgatagaactttgtcattggtaccaccagaaggtgaatttccagtcatgaattatcgtatgactcaaccatttaagccaccctttcgtattaatgcattaattgaagaaacaggatccctaaaggctgaagtgaccattaaagtgcgagctgaattcaactcaagtatcaatgctaatactgttcttgtgcagatgcctctgccatcatttacatctcgtgttacttttgagttagaacctggagcagttggacacaccactgattttaaggaagcaaataaaagactggaatggggtctgaaaaaggttgttggtggatctgaacatactttacgagcaaagctgacattttcacaggagttacatggaaatatcatgaaagaagcagggcctgtcagcatgactttcaccgtacctatgtacaatgcttcaaggcttcaggtgaagtatttgcaaatagcaaagaaatcaaaagcacataatccttatcgctgggttagatatgtaacccaagcaaactcatacgtagcacggttataattggaatctctgcaagtccaaattccgagttaaatttggggggatggcagcatatcaggtgaaaaaatggcgggctctctgcctctacaagtgaagataattttctctagataatgaatggctaaatggaactagagttcttaaaatttttcattttaaatgaaaatgaagatgtacacgacaaatcttaaaattgtgtaatgtggagggcagacatctaaatcttaaaattattaaagacttgatgtaatatcaaatatcaatagtcttatgatgtgtttagcctcctcagtaatgtgttggactagagatattcgtttgaatgtatatgccattgaacctgagctggctttgacgag

SEQ ID NO: 7181 - DNA, 1867 bp, Sorghum bicolor
gtcatcgtccccacctcgtctatcacccccgtcatcgtccccacctcgtcttcttcctcacttgctgttcttctgcgtcgcgtcgcgttacagcgggcagccagggcgcgcggccccgagagaagacggaagtggcagcggaagcggcggcgtggagggatgatctcgcagttcttcgtgctgtcgcagcgcggcgaccacatcgtcttccgcgactatcgcggcgaggtgcccaagggcagcgcggagatcttcttccggaaggtgaagttctggaacgacgacgaggcagaggaggcgcccccagtcttcaatgtcgatggggttaactatattcatgtcaaggtcgctggactattttttgtggtaaccacaatggttaatgtttccccatcccttctcttggaacttcttcaaaggattgcacgtgttacaaaggattatctcggcgttcttaatgaagattcactgcggaagaattttattttggtgtatgaattgcttgatgaagtcattgactttggatacccacaaacaacctctactgaggttctgaagtcgtacatattcaatgaaccgattatggttgatgctggaaggctgccaccgcttggtcctgctgctatgttcatgcaaggcacaaagcgtatgcctggtacagctgttaccaaatctgtggttgctactgagccaggggggaagaagagggaggaaatttttgttgatatcattgagaggataagtgtgacattcagctcgagtggctatatacttacatctgagattgacggaacgattcaaatgaaaagttacctcactggtaatccagaaatccgtcttgctctcaatgaggatttgagcattggaagaactggatcttcatatgattacagaagttcttctggaggtggaacagtcattcttgatgattgcaacttccatgagtcagtacatctggatagttttgacattgacagaactttgactctgataccacctgacggagaatttcctgtaatgaactaccggatgacccaagaatttaagccgccgttccgtgtaaccgctctaattgaagaagctggaccatcgagggctgaagttctactgaaaataagagcagacttctccgcaaatgccactgctaacacaatcacagtacaaatgccagtgccatcatacacaatgagagcaagttttgagttggaagctggagcagttggacagacaaccgatttcaaggaaggatccaggagactcgagtggaatctcaagaagattgttggtggttctgagcacacccttcgtgcaaagctgacattttctcaggagtcacatggaaatatcacaaaggaagctggcccagtgaatatgaatttcactataccgatgtacaatgcatcaaagttgcaggtgaggtatcttcagatagcaaagaaatcaaaggcatacaacccttacagatgggtacgatatgtaacacaagctaactcctacgtagctcgtctatgagaaacccgcatctgtacatttgtttccagtccaattttttttgtgtaatatttgagctttatcatggacaagagtggcatgtatttgtaactttatagtggaattcacaataccgctcagctcctgcagtttttttttctcaaatacacaagttttgcgcatcattatattaattaagagtttaaacaaacatacaacacacttctattgagcgctgaagaaggtcgacctaacacaccttagctggctcagctcccgtagttgaacacatttgtagtatcatttttttcctcatgcaatgtgtagaagaatgtttatgttttattgctgtgaaatgtatgaagttcttgttcat

SEQ ID NO: 7182 - DNA, 1774 bp, Mimulus guttatus
gatctagaattcaacagagctctcttaatacaggcgaggttttggtggtagctgttgatcatcgtcttcatcgtatcaatgatctctcaattcttcgtgctatcacagagaggcgacaacatcgttttccgagactatcgtagtgatgtacagaaaggaagtgcagagatatttttccgcaaagtgaagttctggaaggaagatggcaaagaggaagctcctcctgtctttaatctagatggtgtaaactactttcatgtgaaggtggttggcctgctttttgttgcaaccacaaggatcaacttgtccccttccttagctctggaacttctgcagaggattgcacgcgtcatcaaagattatcttggtgttcttaacgaagaatccttacgaaaaaattttgtacttgtgtatgagctgcttgatgaagtcatagattttggctatgttcaaacgacatcgactgaagttttgaagtcttatatattcaatgaaccaattgtggttgatgctgcacgtttgcctccccttggtccggcatccttgttcatgcaaggaaccaaacgaatgcctgggaccgcagttacaaaatctgttgtggcaaatgaaccaggggggagaaagagggaggaaatctttgttgatataattgagaaaataagtgtcacctttagctctagtggatatgtattgacttccgaaattgatggaaccattcaaatgaagagttatctaactggaaacccagagatcaaattagctctcaatgatgatctatacgtcgggagaggcggggtaccaaattatggcggctacagtggttcttcagggtcaggagcagttattttggacgattgcaattttcatgaatctgtacatatggacaattttgaggttgataaaacattgagtctggtaccaccagacggcgaatttcctgtcatgaattatcgtattacccaggaattcaagcccccctttactgttaacaccttaattgaagaagcgggatccctcaaggctgaagtgattttgaaaatccgtgccgagtttccttcaaacatcactgccaatacagttttagtagaaatgccattgccagcatgtacaaccagagtcaattttgacttggaacgtggagtagttgggcagaatgctgatttcaaagaatcacagaagagactcgagtggagtgtgaagaagatggtggggggatcagaacacactctacgtgcaaagttaaatttttcacaggagttgcatggaaatatcactaaagaagctggacccgtcagtatgaccttcacaatacctatgtataatccttcaaggctggaggtgaagtatttacagattgcgaagaagtccaaaacttccaacccgtatcgttgggtgagatacgtcactcaggctaattcttatgttgctcgcatgtgacagctgtcatggtttttccccgttgtttatattcatttcctttttatgcttcgatttctattgccgtttagtgtaatgtttcttgagttatatctcgttagattaatgcttgcaatacgtctttctttttcgatcgggactttctcaatgacggaagctggatctcttatagcatgtacaatttgcattactcggacttgctcaatttgcatgtactatctgcattattcagactttctcaatttgcatgcacaatttacaataaccttcagaacatgatattgaggtcacattagtttattcaagagttttgagtgcctaagagagaatctttgtt

SEQ ID NO: 7183 - DNA, 1725 bp, Cephalotaxus harringtonia
tggacacttaatttactcaacaggcaagggtgtttaatttctcttagctccacagcatccgacatttggcaaaaagtgtattcagctcccttcaaatccttcttttcagtttcaattaggtggaaagcgaaggcaacatgatctcacagtttttcgtgctctcacagagaggagacaacattgtcttccgagactatcgcggggaggtaccgaagggaagtgctgaaattttttttcgcaaagtgaagttttggaaaggtgatgatgaagaggaggcaccaccaatttttaatgtagatggtgtgaactatttacacgtaaaagttgctggactgttatttgttgcaacgacaagagttaatgtgtcgcctgcacttgtgttggagcttctgcagcggatagcacgtgtcataaaagactatcttggaattctcaatgaagattcacttcggaaaaattttgtccttgtttatgaattacttgatgaagtgattgattttggctatccacagactacttcaactgaagtattgaagtcctttatcttcaatgagccaattgtggtagatgctggacgattgccatcacttggtcctgcttctatgttcatgcaaggatcaaaacgaatgccaggaacagctgttacaaaatcggttgtggctaatgagcctggaggccgaaaacgagaggaagtttttgttgacatcattgaaaaaataagtgttacttttagctctagtgggtatatcctgacatctgagattgatgggaccattcaaatgaaaagttatttgacaggcaaccctgaaattcgactagccttaaatgaggaccttagcattgggagaagtggccattccagctatgattatagcagctcaactggggcaggaatggtaatcttagacgattgcaatttccatgaatctgttcggctagacaactttgatttggatcggacactaaccttggtgcccccagacggagaatttccagttatgaactatcgtatgactcaagagtttaagcctccatttcgtgtgaattctttgattgaagaagctggtgcgttcaaggcagaggttatgctgaaagtacgtgctgacttttccaatacgattactgccaacactgctgcattgcatatgcctcttccgaagtacacaacaagggttagctttgagttggagccaggagcagtaggacaatctacagatttcaaggaaggaagtaagatgctagaatgggggttgagaaagattgttggtggtgccgaccatacattacgggcaaagcttacattttcacaggatacaaacatcaatataacaaaggagtcaggtcctgttagcatgactttcactataccgatgtacagtgcctcaaggctacaggtgcgatacttgcaaatagttaaaaaatccagaacctacaacccttaccgttgggtgagatatgtgactcatgctaattcgtacgtcatcagaatatgaacaactaaaagttcaaggatatttttatattgctcaatttcatgtaatgggattttctgacagcttgtaaggtttcgcatgcattttaaacgactgcatctgttgagagtaggaaatttagaataaaacatcacaattaatatcactcttatagtgttgtatcatttattttatatttgttatgtggtgaatcatttggggaggtgcccttcaagattttcttagggaaaag

SEQ ID NO: 7184 - DNA, 4596 bp, Zea mays
cgcaccgccagtccgccatcggccaccgcaacagtgcagaaacagagctaaccctgatcctcccctcgcagcctgcctgccaccatcagcggcgctacacctcgccgctgccgccgctggggataaacaaacggaacgaacgcaggttcacctcggatctgcggctcgccggactccgaacgaacgtcacgtcactgaacggacgccacagatttggcctgctccgccccacgggacgcctagccggatttgacagctccacgcgcgcgcgcgcgcgcacccaacccgcgtcttctccggcctgccagtgccgcggccggggctccatccccatccatgcattcgccgaggtcgcgcattcgcgtccgcgacccacacccaaacccgcaccggccctcgggtggcggacgaggaggaggaggaggatgcctccgccgccggtcaccgcctgctccgccctccccgcgttaccggcgacgcccgcagaggcacaccccgccgccgcggcgcggcagcgatcctcaccccgacatctccgccatcgcccgccaccgcatcctgctcgaggccggccgcttcgccgcgcattacctggtcgcccagggcgtcctccccgaccacgtgctcagggacagggaagacccgcccgccagccgcgggaggaatctagacggcggcggcgatcctagatcgagctggaacgatggggactgggcccgcgcctgggaggatgacgacaggcaggcacggaagtcgacgagatgggacaggagaagccagagctttgacgacaggggtaaaaagtaccacgacgccggccgtgatgtagaccggggtgcccgccggactcgagattacgatgagcccaggagacctccgatgtcgagatcctactcgcataacgaccgccgcccttccggctccgctgatggcggcagagtggatccaaggagcaggagcaggagtagaagcagggccaggatccgcagagatttggatcacaccaaggtgacagactctggcattattcctgctgatgctgctgatgatggagactgtgatgtgcactacggtcatgttgatgaaatgccaaggcagcagcggagggtgcctagttcagtggtggttgcagacagtgccgatcaggcaatggctaccgaagacggggaggcggagttcgatatccatggactgaatcgcactcgagacgtttctgaagacgaggacggtgagtttgcagctgctcgcttgaatggtgaagatgatgttcatccgttgaaatctgttaaggaaccggccttgcatagggggtcccagctcagcaatgccgtagaggacagggaagctgccaatgcacccaccatggtcatggatgcttgtacgagggaaacatcaggtgaggacaatgcctactctgaagcaacaaatgaaatggtggctccacatccacatagtgaaggtaaaccagagctgccagcttcgtgcagaccttttgacctcaacgtcgtcgaaactccagatgcctgtgaaatggctggtgatcctcaagcagaccatgtttctgatttagttggctggatacaccagcaaactaactgccatgcttcagaatttcaaggtcaagatgagcgtcacatgctgaagaatgggcacgacttgattaggtatgatctgaacagcgaggctgttgaagacgcacaggatattcacctgctggaggatgagaaattacctgtaggtcttggcattgatgcgcatgatacgactagaatccaatgttggcgcggttcgcatttacgtctgaatcaaaatgctggtgagctggaacatgaaaacgactgtgtgattggtgagcagctgctgctaagtgatggcatggatggacatcttgtccgcgattaccaaatggcgtcagaacccaagatgggtgtctatgatttgcacagctacaatctggaaagcgagaaaatgctcctagatgatggtgcagagaaacacgcacatgataattgccatctacacgacgggcaagtgcttttcaatcagtctgcgaatctacaggctcacaatagggccaatgagcgaacaattcctgtgatcaatctcgaagatgatgattatgaagagcagtctgatatcagggagtttctcgaatccaaaagttatcaatgcctgggacatgcccttctctgagcttgggaagtgggcaagtggccatgttgtttgccaagacggctgcgagattctgcgtcagtcagtgcaatatgtcgtcatcctggagcattggaaacaagatttgcaatgttttaaaggtggatgcatcatgctccatccatacataataattgattgaagaaaggaagtcgttcaggtgctgtactaggagaggatacctgactcaccgacctggcctcagcactcagcagtcagcagcagcttgtaggcgtcttcaaaacttcagcttcaccttcttgtagttgtgttcctttcctttccagtttccatgctggtgcgtacgtgtgcgtgcaagcaatattcagtgtgatgcatggccacaatattcaacttcaccttcttgtagttgtgatttgctgtcgaggtgatgcatggccacaatattcagtgtgtctatgtatgtatctcaggcccggagcagtgagctgcgtctgcgcatgaacgcaaagtaaagctgtgactgtgactgtgactgtcaggaacaggaagtactactacactactggtggcctgtgtgcgctgtcccctgtggagggaaaccaacaaggccaaacacacacgcacgttgggccgagaaaaaagaaatagaaatacgggcccatctcatctatgttctagttaatggaaaatccggcctgtgtcactgatggtagatcaggcccaatgaacacgatcacagccacaccaacgcaccacgctcggctgcgagcttgcgaccccaccgacacacacagcagggaagcgaggggaaggagaggcaaggcggcgcggccagcggcccaggatatctgcgcgtgcgatcccgaggaggcgtcggcgaggtgggatgatatcgcagttcttcgttctgtcgcagcgcggcgaccacatcgtcttccgcgactatcgcggcgaggtgcccaagggaagcgcggagatcttcttccggaaggtcaagttctggaacgacgacgaggcagaggaggcgcccccggtcttcaatgtcgatggggttaactatattcatgtcaaagtcgctggactattttttgtggtaaccacaatggttaatgtctccccatcccttctcttggagcttcttcaaaggattgcacgtgttacaaaagattatctcggcgttcttaatgaagattcattgcggaagaactttattttggtgtatgaattgcttgatgaagtcattgactttggatacccacagacaacctctactgaagttctcaagtcgtacatattcaatgaacccattatggttgatgctggaaggctgccaccgcttggtcctgctgctatgttcatgcaaggcacgaagcgtatgcctggtacagctgttacaaaatctgttgttgctactgagcctggggggaagaagagggaggaaatttttgttgatatcattgagagaattagtgtaacattcagctcgagtggctatatacttacatctgagattgatggaacaattcaaatgaaaagttacctcactggcaatccggaaatccgtcttgctctcaatgaggatttgagcatcggaagaactggatcttcttcatacgattacagaagttcttctggaggaggaacagtcattcttgatgattgcaatttccatgagtcagtacatctggacagttttgatattgacagaactttgactttaataccgcccgatggagaatttcctgtaatgaactaccgtatgacccaagaatttaagccaccattccgtgtaaccgcactaattgaagaagctggaccagcgagggctgaagttctactgaaaataagagctgacttctccgcgagtgccactgctaacacaatcgtagtacaaatgccagtgcctgcatacacaatgagagcgagttttgagttggaagctggagcagttggacagacaaccgattttaaggaaggatccaggagacttgagtggaatctaaagaagattgttggtggttctgagcacaccctccgtgcaaagctgacattttctcaggagtcacatgggaatatcacaaaggaagctggcccagtgaacatgaatttcactataccgatgtacaatgcatcaaagttgcaggtcaggtatcttcagatcgcaaagaaatcgaaggcatacaacccttatagatgggtgcgatacgttacacaagccaactcctacgtagctcgtctatgaggaatcagcatctgtactcttgtttccagtccattttttttgggtgtaatatttgagcgttatcatggacatagtggcgtgtattgtgtaactgtatattgaggttcgcataccgctcagctcctgtagtaacaattgtttttcgtcgtgcaatgtgcagatgaataattcatgttcta

SEQ ID NO: 7185 - DNA, 1837 bp, Pinus pinaster
agcagtgggggcagatcttgtatatatatagctcactgtgaattcggtggaacggacatcttgcttatcgccgaagggctttcaacgacaaacttcagcatgatatcgcaatttttcgtgctctcacagagaggagacaacattgtcttccgagattatcgtggggaggtaccaaagggaagtgctgaaatatttttccgcaaagtcaaattttggaagaatgatgacggagaggaggcaccaccagtcttcaatgttgatggggtgaactatttacatgtaaaagttgctggcctgttatttgttgcaaccacaagagtaaatgtgtctcctgcacttgtgttggagcttctgcagcggatagcacgtgtgataaaagattatcttggaattctcaatgaggattcactacggaaaaattttgtccttgtatatgaattactcgacgaagtgattgactttgggtatccacagaatacttcaactgaagtgttgaagtcatttatattcaatgaaccaattgtagtagatgcaggacgggggccatcacttagccctgctgcaatgttcatgcaaggatcaaagcgaatgccaggaacggctgttacaaagtcagttgtagccaatgagcctggaggcaggaagcgggaggaagtttttgttgatgtcattgaaaaaataagtgtaacatttagcgctagtggctatattctgacatctgagattgatgggaccattcaaatgaaaagctatctgacaggcaaccctgaaattcgactggccctaaatgaggacttgagtattgggcgaagtggccattctagctatgattatagcagctcatctggggcaggcatggtaattttggatgactgtaattttcacgaatctgtccgcctcgagaactttgatttggatcgaacactgactctggtgcccccggatggagaatttccagtcatgaattaccgcatgactcaagagtttaagcctccatttcatgtcaatactttgattgaagaagctggttctttaaaggcagaagttatgctgaaagttcgtgctgacttttcctctacaattactgctaacacggttgcgttgcatatgcctctgccaaaatacacgacaagggttagctttgatttggagtcaggagcagtaggacaaacaacagatttcaaggaagggaataagacgctagaatgggggctgagaaagattgttggtggttctgagcatacattacgggcaaagctttcattttcccaagagacaaatatgaatatcacaaaggagtcgggtcctgtcagcatgactttcactataccaatgtacagtgcttcaaggctacaggtacgatatttacaaattgttaaaaaatccagaacctacaatccttaccggtgggtgagatatgtgactcaagcaaactcttatgtcatcagaatatgaagaatcgaaagtatagaattgtactgtattgcacaattttgttatacgactctagattgttaaaaatattttcatttgaaataattttgctttgtttatcaagattgggaattagaggataaaacctttaattcagtacacttaaggtggttcatattaattttttgtttattgcatggtgaacaatcaagagggaggggcgcccttcatatctgttgtttttttaattctttcccatattttcctagtaagaggaaattggctacataaaatatgacagtggtagttggactttattatggttttttaagtttctgcaattttcctgatgttcacttgtgttcatatttaggcacaagagaaattatgagagaaatggtat

SEQ ID NO: 7186 - DNA, 1623 bp, Orobanche aegyptiaca
gctcaaaacaggtggtggtagctgctgatcaatcatcatgatctctcagttcttcgtgctctcacagagaggcgataatatcgtcttccgagattatcgtagtgatgtgcagaaaggaagtgcggagatattcttccgcaaagtgaagttctggaaagaagatggcaaagaggaagcaccacctgtatttaatctggatggtgtaaactactttcatgtgaaggtggttggcctgctttttgttgcaaccacaaggggcaacttgtccccgtctttagcgttggagcttctacagagaatcgcacgtgtcatcaaagattaccttggtgttctgagtgaagaatcattgcgaaaaaattttgtgcttgtgtatgagctacttgatgaagttgtagattttggatacgttcaaacaacatctactgaagtcttgaagtcgtatatatttaatgaaccgattgtagttgatgctgcacgtataccgtctcttggtcctgcagccttatttatgcaaggaaacaagcgaatgcctgggacagctgttacaaaatctgttgtggcaaatgaacctgggggtaggaaaagagaggaaatctttgttgatataattgagaaaattagtgttacctttagctcgagtgggtatgtattgacttctgagattgatggaaccattcaaatgaagagttatctaactggaaacccagagatcaaattagctctcaatgatgatctatatattggaaaaagtggggcatcaaattatggctacagttcttcagggacagggccagttattttggatgattgcaatttccacgaatctgtacatatggataattttgatgttgacagaactctgagtctggtaccatcagatggggaatttcctgtcatgaattatcgcattacccaggaattcaagccccccttctctatcaataccttaattgaagaagcaggaacactcaaggctgaagtcattctgaaaatccgtgccgaatttccttcaagcatcactgctaacacagttttagtagagatgccattgccagcgtgtacaaccagagttagttttgatttggaacgtggaatagctggccaaaatgctgatttcaaagaatcccagaggaaacttgaatggagtgtgaagaagatggttgggggttcagaacacactttacgtgcaaagttaaatttctcacaggagttacatggaaatatcactaaagaagctggacctgtgagcatgaccttcacaatacctatgtataatccttcaaggctgcaggtgaagtatttacaaatagcaaagaaggccaaaacatccaatccgtatcggtgggttagatatgtcacgcaggctaattcttatgttgcccgcatatgatcagtcatggttttccggtgtttctgttcgtcttattactgttcagattttttttttcttgcggtgtaattgtatgtttattgagtcgaaactcatatgacttttgcaacccttgcctattgcctctttattttgattgcgttttcttttataaaactctaaagaaatctagaaaatatagagaaattgattctcttagaattgattttcattatgaaatgaagttcctattc

SEQ ID NO: 7187 - DNA, 1761 bp, Triphysaria pusilla
caaattcaatcagagctcaaactctagccgctgacaaattcaaccggagctcaatcaggcggagtttggtcgctagccgctgatcggttatcatgatctctcagttcttcgtgctttcgcagaggggagataacattgtattccgagattatcgtggtgatgtgcaaaaaggaagtgcagagatattcttccgcaaagtgaagttctggaaagaagatggcaaagaggaagcaccacctgtatttaatctggatggtgtaaattattttcacgtgaagatggttggcctgctttttgttgcaactgcaagggttaacttggccccttctttagcattggagcttctgcagaggattggacgtgtcatcaaagattacctaggtgttcttagtgaggaatcattgcgaaagaattttgtgcttgtgtatgagctgcttgatgaagttatagattttggatacgttcaaacaacatctactgaggtcttgaagtcttatatattcaatgaaccaatagtggttgattctgcacgaatgccgccccttggtcctgcagccttatttatgcaaggaaacaaacgaatgcctgggacagctgttacaaaatctgttgtcgcgaatgaacctggcggtaggaaaagggaggaaatatttgttgatataattgagaaaattagtgtcaccttcagctctagtggatatgtattgacttctgaaattgatggcaccattcaaatgaagagttatctaactggaaacccagagatcaaattagctctcaatgatgatctatacattggaaaaagcgggatatcaaattacggctatagttcttcaggggtaggaccggttattttggacgattgcaattttcacgaatctgtacatatggataattttgatgttgatagaacactgagtctggtaccaccagaaggggaatttcctgtcatgaattatcgcattacccaggaatttaagcccccattttctatcaataccttaattgaagaagcaggaacacttaaggccgaggtgattctgaaaatccgtgccgagtttccttcaagcatcactgctaacacaattttcgtagagatgccattgccagcatatacaaccagagtcaattttgatttggaacgtggaatagtgggacagagcgccgattttaaagaatcacagaagaaacttgaatggagtatgaagaagattgttgggggctctgaacacactctacgcgcaaagttaaatttttcacaggagttgcatggaaatatcactaaagaagctgggcctgttagcatgaccttcactatacccatgtataatccttcgaggctgcaggtgaagtatttacaaatcgcaaagatggccaaaacttccaacccatatcggtgggttagatatgtcacacaagctaattcttatgttgctcgcatgtgatggcttttggtgtttatatttgttttcatacattgttcaaaaaaattcacgcggagtaatgtatgtgttgttgagttggtcgtattagatgacacttgaaacccttgaaatacctctttcttcgactgttttatcggttcctgaatgtagatgtattgtaccgtgattgaatttctttttattttgacaccaccatagaataatgaaaaaagagaatgctctattttcaagagtcttaagatgaaaatgtaatgattcaagtttgtgtgatgttgaaatagtagaaattatttactgacaaaaaaaaaaaaaaaaa

SEQ ID NO: 7188 - DNA, 1658 bp, Saccharum officinarum
tcgggatccccccgttctcctgcgtcgcgtcgcgttacagcgggcatccagggctcgcggccccgagagaagacgtggcagcggaagcgccggcgtggagggatgatctcgcagttcttcgtgctgtcgcagcgcggcgaccacatcgtcttccgcgactatcgtggcgaggtgcccaagggcagcgcggagatcttcttccggaaggtgaagttctggaacgacgacgaggcagaggaggcgcccccagtcttcaatgtcgatggtgttaattatattcatgtcaaggtcgccggactattttttgtggtaaccacaatggttaatgtttccccatcccttctcttggaacttcttcaaaggattgcacgtgttacaaaagattatcttggcgttcttaatgaagaatcactgcggaagaattttattttggtgtatgaattgcttgatgaagtcattgactttggttacccacaaacaacctctactgaggttctgaagtcatacatattcaatgaacccattatggttgatgctggaaggctgccaccgcttggtcctgctgctatgttcatgcaaggcacaaagcgtatgcctggtacagctgttacaaaatctgtggttgctactgagcctggggggaagaagagggaggaaatttttgttgatatcattgagagaataagtgtgacattcagctcgagtggctatatacttacatctgagattgatggaacaattcaaatgaaaagttacctcaccggtaatccagaaatccgtcttgctctcaatgaggatttgagcattggaagaactggatcttcatacgattacagaagttcttctggaggaggaacagtcattcttgatgattgcaacttccatgagtcagtacatctggacagctttgacattgacagaactttgactctaataccacctgatggagaatttgctgtaatgaactaccggatgacccaagaatttaagccgccgttccgtgtaaccgctctaattgaagaagctggaccatcgagggctgaagttctactgaaaataagagcagacttctctgcaaatgccactgctaacacaatcacagtacaaatgccagtgccatcatacacaatgagagcgagttttgagttggaagctggagcagttggacagacaaccgatttcaaggaaggatccaggagacttgagtggaatctcaagaagattgttggtggttgtgagcacacccttcgtgcaaagctaacattttcccaggagtcacatggaaatatcacaaaggaagctggcccggtgaatatgaatttcactataccgatgtacaatgcatcaaagttgcaggtcaggtatcttcagatagcaaagaagtcaaaggcatacaacccttacagatgggtgcgatatgtaacacaagctaactcctacgtagctcgtctatgaggaacccgcatctgtacacttgtttccagtccaaattttttgtgtgatatttgagctttatcatggacaagagaggcatgtatttgtaactttatagtggaattcaccataccgctcggctcccgcagttgaacgcatttgtagtatcatttttttttctcatgcaatgtgcagaagaatgatccgtgttttattgatgcgaa

SEQ ID NO: 7189 - DNA, 2346 bp, Brassica napus
atggctctatctgcatttgcttttccttcttacataacaaccaaaggaggtttaacagattcttgttgtaaatcaacttctctgtcttcttctcgatctttgtctgcagatcttccatcaccatgtctgaggccaaacaccagtcattcaaacagaaaggcaaaagtgaatgcttcacttgcagagaagggtgaatactattcaaacagaccaccaactccattacttgacacaatcaattacccaatccacatgaaaaatctttccatcaaggagctgaaacaactctctgatgagctgagatcagatgtgatcttcaacgtctcaaaaaccggtggacatttggggtcaagcctcggtgttgtggagctcactgtggctcttcactacattttcaacactccacaggacaagattctttgggatgttggtcatcagtcttatcctcacaagattctcaccgggagaagaggcaagatgccgacaatgaggcaaaccaatggtctctccggtttcactaagcgaggagagagcgaacatgattgctttggtacaggacatagctcaaccacaatatctgctggcttaggaatggcagtaggaagggatttgaaagggaagaacaacaatgtggttgctgtgatcggtgacggtgctatgactgcagggcaagcttatgaagccatgaacaacgctggttatctagactcggatatgattgtcattcttaacgacaacaagcaagtctcgttacctactgccactttggacggaccgagtccacccgttggagcgttgagcagcgctcttagccggttacagtcaaacccagctctcagagagttgagagaagtcgcaaagggtgtgacaaagcaaataggcgggccaatgcaccaattggctgctaaggtagatgagtatgctagaggaatgataagcggaactggatcaacgctgtttgaagaactcggtctctactatattggtccagttgatggacacaacatagatgatttggtagccattcttaaagaagttaagagcgcaagaaccacaggaccggtacttatccatgtcataacagagaagggtcgtggctatccttacgcagagagagctgatgacaagtaccatggtgttgtgaaatttgatccagcaactggtaaacagttcaaaagtagtaacaagactcagtcttacacaacttactttgcggaggctttggttgcggaagcagaggtagacaaagacgtggttgcgattcatgcagccatgggaggtgggacagggttaaacctcttccaacgtcgcttcccgacaagatgtttcgatgtggggatagcggaacagcatgcagttacttttgctgctggtttagcatgtgaaggtcttaagcccttctgtgcaatctattcttctttcatgcagcgtgcttatgaccaggttgtacatgatgttgatttgcagaaactaccggtgagatttgcaatggatagagctggacttgtgggagctgatggtccaacacattgtggagcttttgatgtgacgttcatggcttgtcttcctaacatgatagtgatggctccatcagatgaagctgagctttttaacatcgttgcaaccgctgctgctattgatgaccgtccttcttgtttccgttaccctagaggtaacggtattggcgttgcgttgcctccaggaaacaaaggtgttcctcttgaggttgggaaaggtaggatcttaaaagaaggagagagggttgcgttgttggggtatggctcagcggttcagagctgtttaggagcggcagtaatgctccaagaacgtggactaaacgtcaccgtggcagatgcgcggttctgcaagccgttggaccgtgctctcattcgcagcttagctaagtcgcacgaggtgctgatcacggttgaagaaggttccattggagggtttggatcgcatgtggttcagtttcttgctttggatggtcttctcgatgggaagctcaagtggagaccaatggtattgcctgataggtacatcgaccacggttcaccagctgatcaaatggctgaagctggacttatgccgtctcatatagcagcaactgcacttaacttaatcggagcaccaagggaagctctgtactgagtgtagaatctgtggaaaacgtatacaagaagcaagtcatttggatgagatgttaaagacaatgtgtctgcaaagattagttgtaatgtaaactttgttaaggggtgtgtgtgattgagatcgagctgtacaaccatatctaacatctttgtaaaaatcaaatattccctctgtttttaatagataacgttttag

SEQ ID NO: 7190 - DNA, 2475 bp, Brassica rapa
aatcggccatcacgaccactgtcacaccaccaccttctaaagtattgatttttcactgttcttgataacctcagtttctctttgtttctgacaaatcttttgtcaagtcttcttctttcctccctttaatggctctatctgcatttgcttttccttcttacataacaaccaaaggaggtttaacagattcttgttgtaaatcaaattctctgtcttcttctcgatctttgtctgcagatcttccatcaccatgtctgaggccaaacaccagtcattcaaacagaaaggcaaaagtgaatgcttcacttgcagagaagggtgaatactattcaaacagaccaccaactccattacttgacacaatcaattacccaattcacatgaaaaatctttccaccaaggagctgaaacaactctctgatgagctgagatcagatgtgatcttcaacgtctccaaaacaggtggacatttggggtcaagcctcggtgttgtggagctcacagtggctcttcactacattttcaacactccacaggacaagattctttgggatgttggccatcagtcttatcctcacaagattctcaccgggagaagaggcaagatgccgacaatgaggcaaaccaatggtctctccggtttcactaagcgaggagagagcgagcatgattgctttggtacaggacatagctcaaccacaatatctgctggcttaagaatggcggtaggaagggatttgaaagggaagaacaacaatgtggttgctgtgattggtgacggtgccatgacggcagggcaggcttatgaagccatgaacaacgctggttatctagactctgatatgattgtcattcttaacgacaacaagcaagtctcattacctactgccactttggatggtccgagtccgcccgttggcgcattgagcagcgctcttagtcggttacagtcaaacccagctctcagagagctgagagaagtcgcaaagggtgtgacaaagcaaataggcgggccaatgcaccaattggctgctaaggttgatgactatgctagaggaatgataagtgggactggatcaacactgtttgaagaacttggtctgtactatattggtccagttgatgggcacaacatagatgatatggtagccattcttaaagaagttaagagtgccagaaccacaggtcctgtacttattcatgtcgtaacagagaagggtcgtggttatccttacgcagagagagctgatgacaagtaccacggtgttgtgaaattcgatccagctacgggtaaacagttcaaaagtagtaacaagactcagtcttacacaacttactttgcggaggctttggtcgcggaagcagaggtagacaaggacgtggttgcgattcatgcagctatgggaggtgggactggcttaaacctcttccaacgtcgcttcccgacaagatgtttcgatgtgggaatagcggaacaacatgcagttacttttgctgctggtttagcatgtgaaggccttaagcctttctgtgcaatctattcttctttcatgcagcgagcttatgaccaggttgtacatgatgtagatttgcagaaactaccggtgagatttgcaatggatagagctggacttgtgggagctgatggtccaacacattgtggagcttttgatgttacgtttatggcttgtcttcccaacatgatagtaatggctccatcagatgaagctgagctctttaacatggttgcaaccgcttctgctattgatgaccgtccttcttgtttccgttaccctagaggtaacggtattggggtcgcattacctccaggaaacaaaggtgttcctgttgaggttgggaaaggtaggatcttaaaagaaggagagagggttgcgttgttggggtatggctcagcggttcagagctgtttaggagcggctgtaatgctccaagaacgtggactaaacgtcaccgtggcagatgcgcggttctgcaagccgttggaccgtgctctcattcgcagcttagctaagtctcacgaggtgctgatcacggttgaagaagggtccattggagggtttggatcgcatgtggttcagtttcttgcactggatggtcttctcgatgggaagctcaagtggagaccaatggtattgcctgataggtacattgaccatggttcaccagctgatcaaatggctgaagctggactcatgccatctcatatagcagcaactgcacttaacttaatcggagcaccaagggaagctctgtattgagtgtagaatctgtggaaaacatatacaagaaggaagtcatttggctgagatggtaaagacaatgtgtgtgcaaagattagttgtaatgtaaactttgttaaggggtgtgtgtgattgagatcgagctgtacaaccatatctaacatctttgtaaaaatcaaatattccctccgtttttaatagataacgttttaga

SEQ ID NO: 7191 - DNA, 2495 bp, Brassica napus
ggtcgttttatttcatcacccattacaaaaagtgtccatcttttcttcttcaaccttccaccactgtcaccaccaccttctaaagtattgatttttcactgttcttgataacctttgtttctctttgtttctgacaaatcttttgtcaagtcttcttctttcctccctttaatggctctatctgcatttgcttttccttcttacataacaaccaaaggaggtttaacagattcttgttgtaaatcatcttctctgtcttcttctcgatctttttctgcagatcttccatcaccatgtctgaggccaaacaccagtcattccaacagaaaggcaaaagtgaatgcttcacttgcagagaagggtgaatactattcaaacagaccaccaactccattacttgacacaatcaattacccaatccacatgaaaaatctttccatcaaggagctgaaacaactctctgatgagctgagatcagatgtgatcttcaacgtctcaaaaactggtggacatttggggtcaagcctcggtgttgtggagctcactgtggctcttcactacattttcaacactccacaggacaagattctttgggatgttggtcatcagtcttatcctcacaagattctcaccgggagaagagacaagatgcctacaatgaggcaaaccaatggcctctccggttttactaagcgtggagagagcgaacatgattgctttgggacaggacatagctcaaccacaatatctgctggcttaggaatggcagtaggaagggatttgaaagggaagaacaacaatgtggttgctgtgatcggtgacggtgctatgactgcagggcaagcttatgaagccatgaacaacgctggttatctagactcggatatgattgtcattcttaacgacaacaagcaagtctcgttacctactgccactttggacggaccgagtccacccgttggagcgttgagcagcgctcttagccggttacagtcaaacccagctctcagagagttgagagaagtcgcaaagggtgtgacaaagcaaataggtgggccaatgcatcagttagctgctaaggtagatgaatacgctagagggatgataagcggaactggatcaacgctgtttgaagaactcggtctctactatattggtccagttgatggacacaacatagatgatttggtagccattcttaaagaagtcaagagcgcaagaaccacaggaccggttcttatccatgtcataactgagaaaggtcgtggttatccttacgctgagagagctgatgacaaataccatggtgttgtgaaatttgatcctgcaactggtaaacagttcaaaagtactaacaagactcagtcttacacaacgtactttgcggaggcgttagtggcggaagcagagggagacaaagacgtggttgcgattcatgcagccatgggaggtgggacagggttgaatctcttccaacgtcgctttcctacaagatgtttcgatgtcgggatagcggaacagcacgcagttacttttgctgctggtttagcgtgtgaaggccttaagcctttctgtgcaatctattcttctttcatgcagcgtgcttatgaccaggttgtacatgatgtggatttgcagaagttaccggtgagatttgcgatggatagagctggactagtgggagctgatggtccaacacattgtggagcatttgatgtgacgttcatggcgtgtcttcctaacatgatagtgatggccccatctgatgaagctgagctttttaacatcgttgcaaccgctgctgctattgatgaccgtccttcttgtttccgttatcctagaggtaacggtattggcgttgcgttgcctcctggaaacaaaggtgttccttttgaggttgggaaaggtaggatcttaaaagaaggagagagggttgcgttgttggggtatggctcagcggttcagagctgtttaggagcggcagtaatgctccaagaacgtggattaaacgccaccgtggcagatgcgcggttctgtaagccgttggaccgtgctctcattcgcaacttagctaagtctcacgaggtgctgatcacggttgaagaaggttctattggagggtttggatcgcatgtggttcagtttcttgctttggatggtcttctcgatgggaagcttaagtggagaccaatggtattgcctgataggtacatcgaccacggttcatcagctgatcaaatagctgaagctggacttatgccgtctcatatagcagcaactgcacttaacttaatcggagcaccaagggaagctctgtattgagtgtagaatctgtggaaaacgtatacaagaagcaagtcatttggatgagatgttaaagacaatgtgtctgcaaagattagttgtaatgtaaactttgttaaggggtgtgtgtgattgagatcgagctgtacaaccatatctaacatctttgtaaaaatcaaatattccctccg

SEQ ID NO: 7192 - DNA, 2643 bp, Eutrema parvulum
ccaaaatctcaatttctctgcggatcacgaaccatctccatatcttctgagtttttttcttactgtctcaatatcaaacaacgttacatataaaaaaattagtaatccatgaagttggctcttttgtcgttttatttcatcacccataaaacaaaagtctccatcttttcttcttcaactctccaccactgtcaccacctccaccacattttatcacttctcatttttcttattggattctaaagtacaattattgatttttcactgttcttgataacctcagttttcctaattagattcttataaatcttttgatttaacttacattttttctttcccgaagttttcaagttttcttcttgttccctttaatggctctatctgcatttgcctttccttcttacataataaccaaaggagttttaacagattcttgtaagtcaacttctctgtcttcttctcgatctttggctacagatcttccatcgccatgtccaagaccaaacaattgccattcaaacagaaaggcaaaagtgaatgcttcactttcagagaagggtgaatattattcaaacagaccaccaactccattacttgacacaatcaattacccaatccatatgaaaaatctttccatcaaggaactgaaacaactttccgatgagctgagatcagatgtgatcttcaacgtctcgaaaaccggtggacatttggggtcaagtcttggtgttgtagagctcactgtggctcttcattacattttcaacactccacaggacaagattctttgggatgttggtcatcagtcttatcctcacaagattcttaccgggagaagaggaaagatgccgacaatgaggcaaaccaatggtctctccggtttcaccaaacgaggagagagcgaacatgattgctttggtacgggacatagttcaaccacaatatctgctggcttaggaatggcggtaggaagggatttgaaagggaagaacaacaatgtggtttctgtgattggtgatggtgcgatgacggcagggcaggcttatgaagccatgaacaacgccggatatctagactcggatatgattgtgattcttaacgacaacaagcaagtctcattacctactgctactttggatggaccgagtgcacccgttggagcattgagcagtgctcttagtcggttgcagtcaaacccagctctcagagagttgagagaagtcgcaaagggcgtgacaaagcaaataggcgggccaatgcaccaattggctgctaaagtggacgaatacgctcgaggaatgataagcgggactggttcgacactttttgaagaactcggtctctattatattggtccagttgatgggcacaacatagatgatttggtagccattcttaaagaagttaagagtgcaagaaccacaggaccagtacttattcatgtcataacagagaaaggtcgtggttatccttatgcagagagagctgatgacaagtaccatggagttgtgaaattcgatccagctacaggtaaacagttcaaaagtactaacaagactcaatcttacacaacttactttgcggaagctttagtggcggaagcagaggtagacaaagacgtggttgcaattcatgcagccatgggaggtgggacagggttgaatctcttccagcgtcgcttcccaacaagatgttttgatgttggaatagcggaacaacacgcagttacttttgctgctggtttagcatgtgaaggccttaagcccttctgtgcaatctattcgtctttcatgcagcgtgcttatgatcaggttgtacatgatgttgatttgcaaaaattaccagtgagatttgcaatggacagagctggacttgtgggcgctgatggtccgacacattgtggagcttttgatgttacatttatggcttgtcttcctaacatgatagtgatggctccatctgacgaagcagagctctttaacattgttgcaacggctgctgctattgatgatcgtccttcttgtttccgttaccctagaggtaacggtattggcgtcgcattacctcccggaaacaaaggtgttccaattgagattgggaaaggtaaaattttaaaagaaggagagagggttgcgctgttgggttatggctcagcggttcagagctgtttaggagcagctgtaatgctggaagaacgtggattaaacgtaactgtagcagatgcacggttttgcaagccattggaccgtgctctcattcgcagcttatctaagtcccacgaggttctgatcacggttgaagaaggttcgattggagggtttggatcgcacgtcgttcagtttcttgctctcgatggtcttctcgatggaaagctcaagtggagaccaatggtattgcctgatcggtacatcgaccacggttcaccagctgatcaaatggctgaagctgggctcatgccatctcatatcgcagcaaccgcacttaacttaatcggagcaccaagggaagctctgtactgagaggagatctcggcggaacgtttcttctaagtactgatcaatgtcgccgaaaggaagaagcaacagaaaagtcattttcgctaatatataactgagatgttgaagagaaagattagtatgtaaa

SEQ ID NO: 7193 - DNA, 2510 bp, Brassica napus
ctgtcaccaccatcaccacatgttatcatcacttttagtggattctaaaagtacacttattgatttttcactgttcttgataacctcagttttcctaattagattctctttgttcctcataaatcatctgatctaacttacatttttcttacccaagtttttaaagtctattcctttctttaatggctctgtctgcatttgcttttccttcttacataatagccaaaggtgttttaacagattcttgtaaacaaacttctctgtcttcttctagatctttggctacagatcttccatcaccatgtcgcagacccaacaattcccattcaaacagaaaggtaaaagtgaatgcttcacttgtagagaagggagaatattactcaaacagaccaccaactccattgcttgacacaatcaattacccaatccacatgaaaaatctttccatcaaggaactgaaacaactctctgatgagctgagatcagatgtgatcttcaacgtttcaaaaaccggtggacatttggggtcaagtcttggtgttgtggagctcactgtggctcttcactacattttcaacactccacaggacaagattctttgggatgttggtcatcagtcttatcctcacaagattcttaccgggagaagagggaagatgccgacgatgaggcaaaccaatggtctctcaggtttcaccaagcgaggagagagcgaacatgattgctttggtaccggacatagctcaaccacaatatctgctggcttaggaatggctgtaggaagggatttgaaagggaagagcaacaatgtggttgctgtgattggtgatggtgctatgacagcagggcaagcttatgaagcaatgaacaacgctggatatctagactctgatatgattgtcattctcaatgacaacaagcaagtctcattacctactgctactttggatggaccaagtccacctgttggagccttgagcagtgctcttagtcggttgcagtctaacccagctctcagagagttgagagaagtcgcaaagggtgtgacaaagcaaataggcgggccaatgcaccaattggctgctaaggtagatgagtatgctcgaggaatgataagcgggacgggatcgacactctttgaagaacttggtctgtactatattggtccagttgatgggcacaacatagatgatatggtagccattcttaaagaagttaagagtgccagaaccacaggacctgtacttattcatgttgtaacagagaagggtcgtggctatccttacgcagagagagctgatgacaagtaccacggtgttgtgaaatttgatccagcaactggtaaacagttcaaaagtagtaacaagactcagtcttacacaacttactttgcggaggctttggttgcggaagcagaagtggacaaagacgtggttgcgattcatgcagctatgggaggtgggactgggttaaatctcttccaacgtcgattcccgacaagatgtttcgatgtggggatagcggaacaacatgcagttacttttgctgctggtttagcatgtgaaggtcttaagcccttctgtgcaatctattcttctttcatgcagcgagcttatgaccaggttgtacatgatgttgatttgcagaaactaccggtgagatttgcaatggatagagctggacttgtgggagctgatggtccaacacattgtggagcttttgatgttacgtttatggcttgtcttcccaatatgatagtgatggctccatcagatgaagctgagctctttcacatggttgcaaccgcttctgctattgatgaccgtccttcttgtttccgttatcctagaggtaacggtattggggtcgcattacctccaggaaacaaaggtattccacttgaggttgggaaaggtaggatcttaaaagaaggcgagagggttgcgttgttgggttatggctcagcggttcagagctgtttaggagcagcagtgatgctccaagaacgtggactaaacataaccgtggcagatgcacgtttctgcaagccgttggaccgtgctcttattcgcagcttagctaagtcgcacgaggtactgatcacggttgaagaaggttccattggcgggtttggatcccacgttgttcagtttcttgctcttgatggtcttctcgatgggaagctcaagtggagaccaatggtgttgcctgatcggtacatcgaccacggctcaccagctgaccaaatggctgaagctggactcatgccatctcatatcgcagcaactgcacttaacttaatcggagcaccatgggaagctctgtactgagagtagatatgcaacaactctaagcggatcagagggtttgttttaagtaatgataaatgttcccgccgaaaagaagcaatagagataagttctttggttatatgataactgagatggtgaagagaaactgagaagggtaaaggcgatctgtgtaaaaaagaagattagtatatgtatttt

SEQ ID NO: 7194 - DNA, 2471 bp, Brassica napus
atctaacttacatttttcttacccaagtttttaaagtctatccctttctctatggctctgtctgcatttgcttttccttcttacataatagccaaaggtgttttaacagattcttgtaaacaaacttctctgtcttcttctagatctttggctacagatcttccatcaccatgtcgcagacccaacaattcccattcaaacagaaaggtaaaagtgaatgcttcacttgtagagaagggagaatattactcaaatagaccaccaactccattgcttgacacaatcaattacccaatccacatgaaaaatctttccatcaaggagctgaaacaactctctgatgagctgagatcagatgtgatcttcaacgtttcaaaaaccggtggacatttggggtcaagtcttggtgttgtagagctcactgtggctcttcactacattttcaacactccacaggacaagattctttgggatgttggtcatcagtcttatcctcacaagattcttaccggtagaagaggaaagatgccgacaatgaggcaaaccaatggtctctccggtttcaccaagcgaggagagagcgaacacgattgctttggtaccggacatagctcaaccacaatatctgctggcttaggaatggctgtaggaagggatttgaaagggaagagcaacaatgtggttgctgtgattggtgatggtgctatgacagcagggcaagcttatgaagcaatgaacaacgctggatatctagactctgatatgattgtcattctcaatgacaacaagcaagtctcattacctactgctactttggatggacctagtccacctgttggagccttgagcagtgctcttagtcggttgcagtcaaacccagctctcagagagttgagagaagtcgcaaagggtgtgacaaagcaaataggcgggccaatgcaccaattggctgctaaggttgatgagtatgctcgaggaatgataagcgggactggttcaacactgtttgaagaacttggtctgtactatattggtccagttgatgggcacaacatagatgatatggtagccattcttaaagaagttaagagtgccagaaccacaggacctgtacttattcatgtcgtaacagaaaagggtcgtggctatccttacgcagagagagctgatgataagtaccatggtgttgtgaaattcgatccagctacgggtaaacagttcaaaagtagtaacaagactcagtcttacacaacttactttgctgaggctttggttgcggaagcagaggtagacaaggacgtggttgcgattcatgcagctatgggaggtgggactggcttaaacctcttccaacgtcgcttcccgacaagatgtttcgatgtgggaatagcggagcaacatgctgttacttttgctgctggtttagcatgtgaaggtcttaagcccttctgtgcaatctattcttctttcatgcagcgtgcttatgaccaggttgtacatgatgttgatttgcagaaactaccggtgagatttgcaatggatagagctggacttgtgggagctgatggtccaacacattgtggagcttttgatgttacgtttatggcttgtcttcccaatatgatagtaatggctccatcagatgaagctgagctctttcacatggttgcaaccgcttctgctattgatgaccgtccttcttgtttccgttaccctagaggtaacggtattggggtggcattacctccaggaaacaaaggtgttccacttgaggttgggaaaggtaggatcttaaaagaaggagagagggttgcgttgttgggttatggctcagcggttcagagctgtttaggagcagcagcgatgctccaagaacgtggcctaaacataaccgtggcagatgcacgtttctgcaagccgttggaccgtgctcttattcgcagcttagctaagtcgcacgaggtactgatcacggttgaagaaggttccattggcgggtttggatcccacgttgttcagtttcttgctcttgatggtcttctcgatgggaagctcaagtggagaccaatggtgttgcctgatcggtacatcgaccacggctcaccagctgaccaaatggctgaagctggactcatgccatctcatatcgcagcaactgcacttaacttaatcggagcaccatgggaagctctgtactgagagtagatatgcaacaattctaagcggatcagagggtttgttttaagtaatgataaatgttcccgccgaaaagaagcaatagagataagttctttggttatatgataactgagatggtgaagagaaactgagaagggtaaaggcgatctgtgtaaaaaagaagattagtatatgtattttatttttgtgatgtaactttatttagtggtgtgactgagacagagctgtacaaccatctaacatctttgtaaaatcaaatacatttcttcgtc

SEQ ID NO: 7195 - DNA, 2578 bp, Eutrema halophilum
attgtcaccactcaccaccacctccaccacattatatcagcacttaactcatttttttaagtggattctaaagtacaaattattgatttttcactgttcttgataatctcaatttttctttttcctaattaagattctctttgtttcttataaatcgtttgatttactgacattttcctaagtttttttcaagactcttattcttctcttgatggctctatctgcatttgcttttccttcttacataattgccaaaggagttttaacagattcttgtaaatcaacttctctgtcttcttctggatctttggttacagatcttccatcgccatgtccgagacccaagagttgccattcaaacagaaaggcaaaagtgagtgcttcacttgcagagaagggtgaatattattcaaacagaccaccaactccattacttgacacaatcaattacccaatccacatgaaaaatctttccatcaaggaactaaaacaactttctgatgagctgagatcagatgtgatctttaacgtttctaaaaccggtggacatttggggtcaagccttggtgttgtggagctcactgtggctcttcattacattttcaatactccacaggacaagattctttgggatgttggtcatcagtcttatcctcacaagattctcaccgggagaagaggaaagatgccgacgatgaggcagaccaatggtctttccggtttcaccaaacgaggagagagcgaacatgattgctttggtacaggacatagctcaaccacaatatctgctggcttaggaatggcggtaggaagggatttgaaggggaagagcaacaatgttgttgctgtgattggtgatggtgcaatgactgcaggacaggcttatgaagccatgaacaacgccggatatctagactccgatatgattgtgattcttaatgacaacaagcaagtctctttacctacagctactttggatggaccgagtccacctgttggagcattgagcagtgctcttagccgtttacagtctaacccagctctcagagagttgagagaagtcgcaaagggtgtgacgaagcaaataggcgggccaatgcaccaattggctgctaaggtagatgagtatgctcgaggaatgataagcgggactggatcaacactttttgaagaactcggtctttactatattggtcctgttgatgggcacaacatagatgatttggtagccattctgaaagaagttaagagtgcaagaaccacaggaccggtacttattcatgtcataacggagaaaggtcgtggttatccttacgcagagagagctgatgacaaataccatggagttgtgaaatttgatccagcgactggtaaacagttcaaaagtagtaacaagactcaatcttacacaacttactttgcggaggcattagttgctgaagcagaggtagacaaagatgtggttgcgattcatgcagccatgggaggtggtaccggtttaaatctcttccaacgtcgctttccaacaagatgtttcgatgtcggaatagctgaacaacacgcggttactttcgctgcgggtttagcttgtgaaggtcttaagcccttctgtgctatctactcgtctttcatgcagcgtgcttatgaccaggttgtacatgatgttgatttgcagaagttacctgtgagatttgcgatggacagagctggacttgtgggagctgatggtccaacacattgtggagcttttgatgtgacgtttatggcttgtcttcctaacatgatagtaatggctccatctgatgaagcagagctctttaacattgttgcaaccgctgctgctattgatgatcgtccttcttgtttccgttatccaagaggtaacggtattggcgtcgcgttacctcccggaaacaaaggtgttccaattgagattgggaaaggtaggattttgaaagaaggagagagagttgctctgttgggttatggctcagcggttcagagttgtttaggagcggccatgatgctccaagaacgtggattgaacataaccgtggcagatgcaagattttgcaagccgttggacggtgctctcattcgcagcctagctaagacgcatgaggttctgatcactgttgaagaaggttcgataggagggtttggatcgcacgttgttcagtttcttgctctcgagggtcttcttgatgggaagctcaagtggagaccaatggtattgcctgatcggtacattgaccatggctcaccagctgatcaaatggctgaagctgggctcatgccgtctcacattgcagcaacggctcttaacttaatcggtgcaccaagggaagctctgttttgagagtagttaatcatatacaaacactctacatgcaaccgaaggtttcttctttgcaaagattagttatatgtttggtttttgtaatgtaactttgtttaggggtgtgattgagatcgagctgtaacaaccatctaacatcttgtaaaaaaaaaatcaaatacatttctttgtctatcttcattaaccttttgttggaatagttgagattctagattcaat

SEQ ID NO: 7196 - DNA, 2817 bp, Arabidopsis thaliana
ccaaaatctcaagttctctgcggatgacgaaccatctcaccatctctttttttctctctcttttttttttttaatatcatcagcacggttacataaaattcgtgatccatgaagttggctttcttgtcgttttacttcatcaccccatttttttaaagtctccatctttatacttcttcaactctccaccaccaccattgtcaccaccacatttaaacacacactttcacttgtagtgggattcgaaagtgcgttttattcatttgttttactgtttttgataacctcaaaatttgcctaaattttattctctataaatccttatatgttttacttacattcctaaagttttcaactttcttgagcttcaaaaagtacctccaatggcttcttctgcatttgcttttccttcttacataataaccaaaggaggactttcaactgattcttgtaaatcaacttctttgtcttcttctagatctttggttacagatcttccatcaccatgtctgaaacccaacaacaattcccattcaaacagaagagcaaaagtgtgtgcttcacttgcagagaagggtgaatattattcaaacagaccaccaactccattacttgacactattaactacccaatccacatgaaaaatctttctgtcaaggaactgaaacaactttctgatgagctgagatcagacgtgatctttaatgtgtcgaaaaccggtggacatttggggtcaagtcttggtgttgtggagcttactgtggctcttcattacattttcaatactccacaagacaagattctttgggatgttggtcatcagtcttatcctcataagattcttactgggagaagaggaaagatgcctacaatgaggcaaaccaatggtctctctggtttcaccaaacgaggagagagtgaacatgattgctttggtactggacacagctcaaccacaatatctgctggtttaggaatggcggtaggaagggatttgaaggggaagaacaacaatgtggttgctgtgattggtgatggtgcgatgacggcaggacaggcttatgaagccatgaacaacgccggatatctagactctgatatgattgtgattcttaatgacaacaagcaagtctcattacctacagctactttggatggaccaagtccacctgttggtgcattgagcagtgctcttagtcggttacagtctaacccggctctcagagagttgagagaagtcgcaaagggtatgacaaagcaaataggcggaccaatgcatcagttggcggctaaggtagatgagtatgctcgaggaatgataagcgggactggatcgtcactgtttgaagaactcggtctttactatattggtccagttgatgggcacaacatagatgatttggtagccattcttaaagaagttaagagtaccagaaccacaggacctgtacttattcatgtggtgacggagaaaggtcgtggttatccttacgcggagagagctgatgacaaataccatggtgttgtgaaatttgatccagcaacgggtagacagttcaaaactactaataagactcaatcttacacaacttactttgcggaggcattagtcgcagaagcagaggtagacaaagatgtggttgcgattcatgcagccatgggaggtggaaccgggttaaatctctttcaacgtcgcttcccaacaagatgtttcgatgtaggaatagcggaacaacacgcagttacttttgctgcgggtttagcctgtgaaggccttaaacccttctgtgcaatctattcgtctttcatgcagcgtgcttatgaccaggttgtccatgatgttgatttgcaaaaattaccggtgagatttgcaatggatagagctggactcgttggagctgatggtccgacacattgtggagctttcgatgtgacatttatggcttgtcttcctaacatgatagtgatggctccatcagatgaagcagatctctttaacatggttgcaactgctgttgcgattgatgatcgtccttcttgtttccgttaccctagaggtaacggtattggagttgcattacctcccggaaacaaaggtgttccaattgagattgggaaaggtagaattttaaaggaaggagagagagttgcgttgttgggttatggctcagcagttcagagctgtttaggagcggctgtaatgctcgaagaacgcggattaaacgtaactgtagcggatgcacggttttgcaagccattggaccgtgctctcattcgcagcttagctaagtcgcacgaggttctgatcacggttgaagaaggttccattggaggttttggctcgcacgttgttcagtttcttgctctcgatggtcttcttgatggcaaactcaagtggagaccaatggtactgcctgatcgatacattgatcacggtgcaccagctgatcaactagctgaagctggactcatgccatctcacatcgcagcaaccgcacttaacttaatcggtgcaccaagggaagctctgttttgagagtaagaatctgttggctaaaacatatgtatacaaacactctaaatgcaacccaaggtttcttctaagtactgatcagaattcccgccgagaagtcctttggcaacagctatatatatttactaagattgtgaagagaaaggcaaaggcaaaggttgtgcaaagattagtattatgataaaactggtatttgttttgtaattttgtttaggattgtgatggagatcgtgttgtacaataatctaacatcttgtaaaaatcaattacatctctttgtgta

SEQ ID NO: 7197 - DNA, 2673 bp, Arabidopsis lyrata
atctttgcttcttcaactctccaccaccaccaccattgtcaccaccacattttaacacacactttcatttttagtggattctaaagtgcgtttttattcatttgtttcactgtttttgataacctcaaattccctaaaattttattctctataaatcattatattacttacttacattcccaaagttttcaactttctcttctgaggttcaaaaagttgaaatggcttcatctgcatttgcttttccttcttacataataaccaaaggaggagtttcaacagattcttgtaaatcaacttctttgtcttcttctcgatctttggttacagatctttcatctccatgtctcagacccaacaacaattcccatacaaacagaagagcaaaagtgaatgcttcacttgcagagaagggtgaatattatgcaaacagaccaccaactccattacttgacactattaactacccaattcacatgaaaaatctttctgtcaaggagctgaaacaactttctgatgagctgagatcagatgtgatctttaatgtgtcgaaaaccggtggacatttggggtctagtcttggtgttgtggagcttactgtggctttgcattacatattcaatactccacaggataagattctttgggatgttggtcatcagtcttatcctcacaagattcttactgggagaagaggaaagatgcctacaatgaggcaaaccaatggtctatccggtttcacgaagcgaggagagagtgaacatgattgctttggtacaggacacagttcaaccacaatatctgctggtttaggaatggcggtgggacgggatttgaaggggaagaacaacaatgtggttgctgtgattggtgatggtgcgatgacggcagggcaggcttatgaagccatgaacaacgcaggctatcttgactctgatatgattgtgattcttaatgacaacaagcaagtctcattacctactgctactttggatggaccaagtccacctgttggagcattgagcagtgctcttagtcggttacagtctaacccggctctcagagagttgagagaaggtatgacaaagcaaataggcgggccaatgcaccaattggctgctaaggtagatgagtatgcccgaggaatgataagcgggactggatcgtcgctgtttgaagaacttggtctttactatattggtccagttgatgggcacaacatagatgatttggtagccattcttaaagaagttaagagtactagaaccacaggcccggtacttattcatgtggtgacggagaaaggtcgcggttatccttacgctgagagagctgatgacaaataccatggtgttgtgaaattcgatccagcgacgggtaaacagttcaaaagtactaataagactcaatcttacacaacttactttgcggaggcattagtggcagaagcagaggtagacaaagatgtggttgcgattcatgcagccatgggaggtgggaccgggttaaatctatttcaacgtcgcttcccaacaagatgtttcgatgtcgggatagcggaacaacacgcagttacttttgctgcgggtttagcctgtgaaggccttaagcccttctgtgcaatctattcgtccttcatgcagcgtgcttatgaccaggcaagttgtacatgatgttgatttgcaaaaattaccggtgagatttgcgatggatagagcaggacttgttggagctgatggtccgacacattgtggagcttttgatgtgacatttatggcttgtcttcctaacatgattgtgatggctccatcagatgaagcagatctctttaacatggttgcaactgctgctgcgattgatgatcgtccttcttgtttccgttaccctagaggtaatggtattggagttgcattacctcccggaaacaaaggtgttccagttgagattgggaaaggtaggattttaaaggaaggagagagggttgcgctgttgggttatggctcagcagttcagagctgtttaggagcggctgtaatgctcgaagaacgcggattaaacgtaactgtagcagatgcacgattttgcaagccattggaccgtgctctcattcgcagcttagctaagtcgcatgaggttctgatcacggttgaagaaggttcgattggagggtttggatcgcatgttgttcagtttcttgctctcgatggtcttctcgatggcaaactcaagtggagaccaatggtactgcctgatcggtacattgatcacggtgcaccagctgatcaactagctgaagctggactcatgccatctcacatcgcagcaaccgcacttaacttaatcggtgcaccaagggaagctctgttttgagagcaagaatcggttggctaaaacatatatatacaaacactctaaatgcaacacaaggtttcttctaagtacttgatgaaaattcccaccgaaaagtccgttggcaacagctatatatttactaagatggtgaagagaaaggcaaaggcaaaggttgtgcaaagattagtattatgataaaactggtatttgttttgtaatttttggttaggggtctgatggagatcgagttgtacaataatcatctaacatcttgtaaaaataaattacatttctttgtgtatctttcataccattgtgtga

SEQ ID NO: 7198 - DNA, 2497 bp, Cleome spinosa
tctctctctcagctctttctgagtttatcagaaaatggctctctctgcatttgcttttccttcttacataagcagaggaactacaccgacagactcttacaaatcagcacctttgtcttcttcatcgtccttgtcaacagattttccatctgtatcctccggaaaaaccaccgtccattccaaaagaaagccgggtggtgtttatgcctcacttgcagagaagggtgagtactatgccaatagaccaccaacccctttactggacacaatcaattacccaatccacatgaaaaatctttctgtcaaggagctgaaacagctgtccgacgagttgagatccgatgtgatcttcaacgtctcgaaaaccggcggacacttggggtctagcctcggtgtcgtcgagctgaccgtcgcccttcattacgtcttcaattctcctcaggacaggattctctgggatgtcggtcaccagtcttatcctcacaagattctgacggggagaagaggtaagatgaatacactgagacagaccaatggactgtctggtttcaccaagcgagcggagagcgagtacgattgctttggcgccggtcacagctccacaaccatttctgcaggcttgggtatggcagtgggaagggatttaaaggggaggaacaacaatgtggtagctgttataggagacggtgctatgacggccgggcaggcttacgaggccatgaacaacgccggatacttagactccgacatgatcgtaattctcaatgacaacaagcaagtctctctgcccacggctacattggatggaccggcccctcctgtcggagctttgagcagtgctcttagtaagttgcagtctaaccgacctctcagagagttgagggaagtcgccaagggtgtaacgaagcaaattggtgggccgatgcacgaattggctgcaaaagttgacgaatacgctcgtggaatgataagtgggtctggagctacgctgtttgaagaactcggtctctactatatcggtccggttgatggtcacaacatagacgatctagtggctatcctgaatgaagtcaagagtacacggacaactggaccggtccttatccatgttgtgaccgagaaaggtcgcggatatccatacgccgagagagctaccgacaaataccatggagttgtgaaattcgatccggcgaccggtaaacagttcaaaaccagcgcgaagactcagtcttacacgacgtattttgccgaggctttgatttcggaagcagaggcggataaagatgtagttgccattcatgcggcgatgggaggaggaacagggttgaatctcttccagcgtcgtttcccgacgagatgcttcgatgtcggaatagcggaacagcacgccgttactttcgctgctggtttggcctgcgaaggtgtcaagccgttctgcgcaatctactcgtctttcttgcaacgggcttacgaccaggttgtgcatgacgttgatctgcagaaattgccggtgagattcgcaatggatagagctggacttgtcggagcagatggtccgacgcattgtggagctttcgacgttacgtttatggcgtgtctcccgaatatggtagtgatggctccatccgatgaggccgagcttttccacatggtcgccactgctgcagccatagacgaccgtccttcttgcttccgttacccgagaggaaatggcatcggtgtcccacttcccctgggaaacaaaggggttcctctcgagatcgggagaggtaggatactgatggaaggcgagagggttgcgctcttgggctatggctcggcggttcagagctgtgtagcggcggcggccatgctcaaagaccgagacgtgaatgtaacggttgcggatgcgagattttgcaagccgctggaccgtgatctcatccgaaaactggctaagtctcacgaggttctgatcacagtcgaagaaggatcgattggcgggtttggctctcacgttgtacagttcctcgctctcgacggtcttcttgacggcaaactcaagtggacaccgatggtgctgccagatcgatacattgaccacggatcgccgtcagatcagctggccgaggccgggctgacgccttcccatatcgcggccaccgtcatgaacttactcggcagcccgagagaagccttgttttgaaagaacacgacaaagccgatgatacgatacaattctttcgacactgtggagcagaaacaggatctaaccatgcgagcaggaaccgtgttagatagagttccctccagacggaaaatgtcggaagatcttctgcaactgtcggaactggacagaggtggttgcagaaagatgaagaataggagttatagagccgttgaagaaactgcaaatcttatcattttgtatcaaaagtattagtttttttttttaaatttctgggtgtgataataaaattggtttctgaatatatacatctattgaagaacagttccc

SEQ ID NO: 7199 - DNA, 2495 bp, Cleome gynandra
tcgttatagacgtgttcttctcaagtcctctctgtcccttccttacctctctctctctctctatctctctggatttctctctcggaggaaaaattgtcagaaatggctctctctgcatttgcgttaccttcttacataaggagagggacatcatcggattcttacaagacaacatctctgtcttcttcttcgttcttgtcaacaaatcttccatctttgtttccgagcaacaccaacacccattccaaaagaaaatcagttggcgtttacgcatcaattacagaggagggtgaatattattcccatagaccaccaactcctttattggacacaatcagttatccaatccacatgaaaaatctttcagtcaaggaactcaaacaacttgctgacgagttgagatccgatgtgatcttcaatgtttctaaaactggtggacacttggggtctagtcttggtgttgttgaactcactgtagcccttcattacatctttaatactcctcaagacaagattctttgggatgttggacatcagtcttatcctcacaagattctcacggggagaagggggaaaatgcatacattaagacagactaatggattgtcgggttttaccaagcgagcagaaagcgaatatgattgctttggcacagggcacagttcgaccacgatttctgcaggcttgggtatggcggtgggaagggatttaaaggggaggaacaataatgtagttgctgtaataggagatggcgctatgacagcgggacaggcttatgaagcgatgaataatgcaggatacttggattctgacatgattgtaattctcaatgataacaagcaagtctcgttgcctacggctactttagatggacctgttcctcccgttggtgccttaagcagtgctcttagtagattacaatcgaatcgacctctcagagagttaagggaagttgccaagggcgttacgaagcaatttggtgggactatgcatcaattggctgcaaaggttgatgaatatgctcgtggaatgataagcgggtctggagctacgctgtttgaagaacttggtttatattatattggtccagttgatggtcataacatagatgatttggtgaccatcttgaatgaagtgaagagttccagaacaacaggaccggtgcttatccatgtcgtgactgagaaaggtcgaggatatccttacgctgagagagctgccgacaaataccatggagttgtaaaattcgatcccgcaacgggtaaactattcaaaagtagtgctaagactcagtcttacacaacctatttcgccgaggcattgattgcagaagcagaggtagacaaagatatagttgccattcatgctgccatgggaggtggtacagggttgaatctctttcaacgtcgcttccccacgagatgttttgatgttggaatagcggaacagcatgccgttactttcgctgcaggtttggcgtgtgaaggcattaagcctttttgtacaatctactcgtctttcatgcaacgggcttatgatcaggtggtacatgacgtggatctgcaaaaattgccggtgagatttgcaatggacagagctggacttgtgggagcagatggtccaacacattgtggagccttcgacgtgacatttatggcatgtcttccaaacatggtagtgatggctccatccgatgaggctgagcttttccacatggttgctacggctgcagctatagatgaccgcccttcttgcttccgttaccccagaggcaatggcattggcgtccctcttccccctgggaacaagggtgttcctcttgagattgggagagggaggatcatgatggaaggcgatagagtcgcgctcttgggctatggctcggcggttcagagctgtttagcagcggcttacatgctgaaagaacgcgatgtgaagataacggtggcagacgcaagattttgcaaacccttagaccgtgaactcattcgaagcctggctaagtcgcacgagattctgattacagtcgaagaaggttcgattggcgggtttggatctcatgtagtacagttcctcgcactggatggccttctggacggaaagctcaagtggagaccgatggtgctgccagatcgatacattgaacacgggtcgccggtggatcaactggccgaggccggactgacaccgtcacatatagcagccaccgtaatgaacttacttgggagcccgagagaagcattgttgtgatattcaaaaacattcttcaagactctgtataaagacagagatagaatctaacaatgtcagagcgttctgagcatcaaattgttcggaccatttaagatagtatcagaagatcttctgcaactgtcagatttagacacggattgaatcaggaagacagtgaagtgaagaatagtgaatttttacttcttttgtaaattttttaccatatgtatctcttgtgtaatgatggtatgcaatataattgg

SEQ ID NO: 7200 - DNA, 2395 bp, Ricinus communis
ctctctttatttgttcttgtgctagtgttggttttgtttctgcaatggctctttgtgcattttcatttcctgctcatgcaaataaggtcacaacagcaagttcagatcttcagaagtctaattatgtttcttctaatttcttattgaaaacagatcttttgggccaatccatgcaaaaatttaatcagggaaagaaaaggccagctggggtttgtgcatcactatcagagacaggagagtatcattcacagagaccaccaacacctctccttgacaccataaactatccaattcacatgaaaaatctatcaatcaaggagctaaaacaactatcggatgagctacggtcggatgttattttcaatgtttctataactggaggtcacttaggttcaagtctcggtgttgttgagctcactgttgcccttcactatgttttcaatgctcctcaagataagatactttgggatgttggccatcagtcttacccccataaaatccttaccggaagaagagacaagatgcaaacaatgagacagacaaatggactttctggtttcacgaagcgatcagagagtgaatatgattgctttgggactggccatagctctaccacaatttctgcaggcttgggaatggctgtgggcagagatttaaaaggaaggaagaacaatgttgttgctgttataggcgatggtgcaatgacagcaggacaagcttatgaagctatgaataatgcgggatacctagactctgatatgattgttattcttaatgacaacaaacaagtttctttaccaactgccaatcttgatggaccaatacctcctgttggagctttgagcagtgctctcagtagattgcaatcaaacaagcctctcagggaattaagagaggttgctaagggtgttacaaagcggattggtggacctatgcatgaattggcagcaaaagttgatgaatatgcacgtgggatgataagtggttctggatcgaccctcttcgaagagcttggattatattatattggtcctgtggacggtcacaatgtcgatgatcttgttgctattctcaaagaggttaagagtaccaaaacaacaggtccagtcttgatccatgttgttactgagaaaggacgtggttatccatatgctgagaaagctgcagataagtatcatggagtgaccaagtttgatcctgctactggaaagcaattcaagggtagtgctagtacacagtcttacacaacatacttcgcagaggctttgattgcagaagcagaagtagacaaggatgtcgttgcaatccatgctgcaatgggaggtggaacaggactaaatctcttccttcgtcggttcccgactagatgctttgatgttgggatagcagaacagcatgctgttacatttgctgcaggtctagcttgtgagggtcttaaacctttttgtgcaatctactcatctttcatgcagagggcatatgaccaggtggtacatgatgtggatttgcagaaactgcctgtaagatttgcaatggatagagcagggctggttggagcagatggtccaacacactgtggagcttttgatgtcacttttatggcatgcctccctaacatggtggtgatggctccttctgatgaggcagaactatttcacatggttgctactgctgcagcaatagatgatcgtcctagctgtttccgatacccaagaggtaatggtattggtgttcagctgccaccaggaaacaaaggcattcctcttgaggttggtaaaggcaggatattaattgaaggagaaagagtggcactcttgggttatggatcagcagttcagagctgtttagctgctgcctctctaatggaaacctatgacttacgcataacagttgccgatgctagattctgcaaacctttggatcatgccctcattcgaagtctagcaaaatcacatgaagtattgattacagttgaagaaggttcaattgggggctttggatctcatgttgcccattttctggctcttgatggtcttcttgatggaaagctaaagtggcgaccagtcattcttccagataggtacattgaccatggatcgccagctgaccagctggtagaggcaggtctgacaccatctcacatagcagcaacaatattcaacatacttggaaataaaagagaagctctacagataatgtcagcataaaaagaaagtggaaacattttccatttcttctttttgcaattctataacaatgtaaaaaggaaatacctgtaagatgtcttccatcttccattttgtgtataaaaaacatgcagtgttagacttagtacagcatcacgtaacagttcccaacttttgttagaaatgaataaaaattttcaacgtgtttt

SEQ ID NO: 7201 - DNA, 2701 bp, Ricinus communis
ttttttttctctctctcttgctttgctttgtttctgctacagtgctactgacaatgcttaactaaaaacactatatattatagataccaagatggcaagattaaaactttcaccttttgcactaagcccttctctctctctctctctcttaacactctcatttccagccacaaattcttttattatagtaccatttggtgggacatttggtcctgttaacataatctaaagtgtgtttcttgtttctgggttcttctctttttttatctctctattattggttttgagctctctttatttgttcttgtgctagtgttggttttgtttctgcaatggctctttgtgcattttcatttcctgctcatgcaaataaggtcacaacagcaagttcagatcttcagaagtctaattatgtttcttctaatttcttattgaaaacagatcttttgggccaatccatgcaaaaatttaatcaggcaaagggaaagaaaaggccagctggggtttgtgcatcactatcagagacaggagagtatcattcacagagaccaccaacacctctccttgacaccataaactatccaattcacatgaaaaatctatcaatcaaggagctaaaacaactatcggatgagctacggtcggatgttattttcaatgtttctataactggaggtcacttaggttcaagtctcggtgttgttgagctcactgttgcccttcactatgttttcaatgctcctcaagataagatactttgggatgttggccatcagtcttacccccataaaatccttaccggaagaagagacaagatgcaaacaatgagacagacaaatggactttctggtttcacgaagcgatcagagagtgaatatgattgctttgggactggccatagctctaccacaatttctgcaggcttgggaatggctgtgggcagagatttaaaaggaaggaagaacaatgttgttgctgttataggcgatggtgcaatgacagcaggacaagcttatgaagctatgaataatgcgggatacctagactctgatatgattgttattcttaatgacaacaaacaagtttctttaccaactgccaatcttgatggaccaatacctcctgttggagctttgagcagtgctctcagtagattgcaatcaaacaagcctctcagggaattaagagaggttgctaagggtgttacaaagcggattggtggacctatgcatgaattggcagcaaaagttgatgaatatgcacgtgggatgataagtggttctggatcgaccctcttcgaagagcttggattatattatattggtcctgtggacggtcacaatgtcgatgatcttgttgctattctcaaagaggttaagagtaccaaaacaacaggtccagtcttgatccatgttgttactgagaaaggacgtggttatccatatgctgagaaagctgcagataagtatcatggagtgaccaagtttgatcctgctactggaaagcaattcaagggtagtgctagtacacagtcttacacaacatacttcgcagaggctttgattgcagaagcagaagtagacaaggatgtcgttgcaatccatgctgcaatgggaggtggaacaggactaaatctcttccttcgtcggttcccgactagatgctttgatgttgggatagcagaacagcatgctgttacatttgctgcaggtctagcttgtgagggtcttaaacctttttgtgcaatctactcatctttcatgcagagggcatatgaccaggtggtacatgatgtggatttgcagaaactgcctgtaagatttgcaatggatagagcagggctggttggagcagatggtccaacacactgtggagcttttgatgtcacttttatggcatgcctccctaacatggtggtgatggctccttctgatgaggcagaactatttcacatggttgctactgctgcagcaatagatgatcgtcctagctgtttccgatacccaagaggtaatggtattggtgttcagctgccaccaggaaacaaaggcattcctcttgaggttggtaaaggcaggatattaattgaaggagaaagagtggcactcttgggttatggatcagcagttcagagctgtttagctgctgcctctctaatggaaacctatgacttacgcataacagttgccgatgctagattctgcaaacctttggatcatgccctcattcgaagtctagcaaaatcacatgaagtattgattacagttgaagaaggttcaattgggggctttggatctcatgttgcccattttctggctcttgatggtcttcttgatggaaagctaaagtggcgaccagtcattcttccagataggtacattgaccatggatcgccagctgaccagctggtagaggcaggtctgacaccatctcacatagcagcaacaatattcaacatacttggaaataaaagagaagctctacagataatgtcagcataaaaagaaagtggaaacattttccatttcttctttttgcaattctataacaatgtaaaaaggaaatacctgtaagatgtcttccatcttccattttgtgtataaaaaacatgcagtgttagacttagtacagcatcacgtaacagttcccaacttttgttagaaatgaataaaaattttcaacgtgttttagttgcagaagc

SEQ ID NO: 7202 - DNA, 2643 bp, Capsicum annuum
ttggtatatacatacaaaacactctttatcatggctttatgtgcatatgcatttcctgggattttgaacaggacagtggcagtggcttcagatgcttcaaagccaactcctttattctctgaatggattcatggaacagatctgcagtttcagttccaccaaaagcttactcaggtcaagaaaaggtcacgtacggttcaggcttctttgtcagaatccggagaatactacacacagagaccaccaacacctattgtggacactatcaactatcccattcatatgaaaaatctttctctaaaggaacttaaacaactagcagatgagctaagatcagatacaattttcaatgtatcaaagactggtggtcaccttggttcaagtcttggcgttgttgagcttacagttgctcttcattatgtcttcaacgcaccccaagatagaatactctgggatgttggtcatcagtcatatcctcacaaaatcttgactggtagaagggagaagatgtcaacattaagacaaacaaatggacttgctggatttactaaacggtcggagagtgaatatgattgctttgggactggccacagttccaccaccatctcagcaggcctagggatggctgttggaagagatctgaaaggaagaaacaacaatgttatagccgtaataggtgatggtgccatgacagcaggtcaagcttatgaagccatgaataatgctggttacctggactctgacatgattgttattttaaacgacaatagacaagtttctttgcctactgctactctggatgggccagttcctcctgttggagctctaagtagtgctttgagcaggttgcagtctaataggcctctcagagaactaagagaagtcgctaagggggttactaagcagattggtggacctatgcatgagcttgctgcaaaagttgatgaatatgctcgtggcatgatcagtggttctggatcaacattgtttgaagaacttggactttattatattggtcctgtggatggtcacaatattgatgatcttatttctattctcaaagaggttagaagtactaaaacaacaggtcctgtactgatccatgttgtcaccgagaaaggcagaggttatccatatgctgagagagctgcagacaagtatcatggagttgccaaatttgatccagcaacaggaaagcaattcaaaggcagtgccaagactcagtcatatacaacatattttgcagaggctttaattgcagaagcagaagcagataaagacattgttgcaatccatgctgccatggggggtgggaccgggatgaaccttttcctccgtcgcttcccgacacggtgttttgatgttggaatagcagaacaacatgcagtaacctttgctgctggactggcttgtgaaggcctcaaacctttctgtgcaatttattcatctttcatgcagagggcttatgaccaggtagtgcatgacgttgatttgcaaaagctgcctgtgaggtttgccatggacagagcaggtcttgttggagcagatggtcctacacattgtggtgcatttgatgttactttcatggcatgtctccctaacatggttgtaatggctccttctgatgaagcggagctatttcacattgtagcaactgctgctgccattgatgacagaccaagttgtttcagatacccaagaggaaatgggattggtgtagagcttccggctggaaacaaaggaattccccttgaggttggtaaaggcaggatattggttgaaggggagagagtggctctattgggatacggctcagcagtgcagaactgtttggctgctgcttctgtgttagaatcccgtggcttacaagtaacagttgcagatgcacgtttctgcaaaccactggaccgtgctctcataaggagccttgcaaaatcacacgaagtacttgtcactgttgaaaaaggatcaattggaggttttggatcgcatgttgttcagtttatggccttagatgggcttcttgatggcaagttgaagtggagaccaatagttcttcctgatcgatacattgaccatggatctcctgctgatcagttggcagaagctggcctaacaccatctcacattgcagcaacagtatttaacatacttggacaaaccagagaggctctagaggtcatgacataagatgcaagaactgtaaaagaatgtatattataaaatatagttttaggacaagtcaccaactagctgaaacagttgtaagctgttataactttcataagcaggttaacacataatacttattctccaaatatgtaaagtttccatggctgagccacagttcaagacctctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacccccgaaaaggggtttttaattggaaaaaaaaattttttttttttttttttttaaattttagggcccccttttttgcccgaaaaaaacccttccccccccccatttttggggaaccctttttttttaccccgcccgggaaaattttttttcccaaaaaaaaatttaagggaaaatttccttttt

SEQ ID NO: 7203 - DNA, 2722 bp, Quercus alba
atggggaggatttggcagaacagaattcggtgtctgaagcagtgtctttcacttccgctactttcagaccacacactctttcttcagcacttaataaaaacacattctctttcttatttattcaactccaccaccactaacaagcagcatttattagtggggaaacagtagcaccaatccttgcttatcttgttttcttttctgggttcttcatgctttgagctaaagtattagtctttaagttcattgggttttcttctgtgtactttgttattgctgttgttacttggttagcagttagcaatggctctttgtgcattttcttttcctgcccatgtgagcagggcagctgcttcagatcctcaaaaagttgcttcattttcatctcactttaccttgggaacagatctacagtgccaatttcagcacaagctcaatcagatacaggtcaggaaaaggccaggtggggtttgtgcatcactttcagaaaaagatgagtatcactcacaaaggccgccaactccgttattggataccataaactatccaattcacatgaaaaatctatctgtgaaggagctgaagcaactctcagatgaactgcggtctgatgttatctttaatgtttctaaaactggaggtcaccttggctcaagccttggtgttgttgagctcactgtcgctctccattatgtctttaatgcccctcaagataggatattatgggatgttggtcatcagtcttacccacacaagatcttgactgggagaagaggtaagatgcacactatcaggcagacaaatgggttagcagggttcacaaagcgctcggagagtgaatatgattgctttggcactggtcacagttctaccaccatctcagctggactgggaatggctgtggggagggatctaaaaggaaggaggaataatgtagttgctgttataggtgacggtgccatgactgcagggcaagcatatgaagccatgaacaacgctgggtaccttgactcagacatgattgttattcttaatgacaataaacaggtttctttacctactgctactctagatgggccaataccacctgtaggagctttaagcagtgctctcagtaggttgcaatctaacaggcctctcagagaactaagagaggttgccaagggagttactaaacaaattggtggtcccatgcatgaactggctgctaaagttgatgaatatgcccgtgggatgatcagtggttctggatcaaccctttttgaagagcttggactctattatataggtcctgttgatggtcacaacatagatgatcttatttccattctcaaagaggttaaaagtaccaaaacaacgggtccagttctgatccatgttgttactgagaaaggccggggatacccatatgcagagaaagcagcagacaagtatcatggagtggccaaatttgatccagcaactggaaagcaattcaaaaccaaggcacctacacagtctttcacaacatattttgcagaggctttgattgcagaagcagaaattgacaaagatattgttgcaatccatgctgcaatgggaggtggaacaggcttgaatcaatttctacgccgtttcccaacaagatgctttgatgttgggatagcagaacaacatgcagttacttttgctgcaggtctggcctgtgaaggtgttaaacctttctgtgcaatttattcatctttcatgcaaagggcttatgaccaggtagtacatgatgtggatttgcagaaattgccggtgagatttgcaatggacagagctggactggttggagcagatggtcccacacattgtggggcttttgatgtcacctttatggcctgcctccccaacatggtggttatggctccttctgacgaggcagagctctttcacatggttgccactgctgctgcaatagatgaccggcccagttgtttccgatacccaagagggaatggggttggtgttcagctaccacctgggaataaaggcattccccttgaggttggaaaaggcaggatactgatagagggtgaaagagtggcacttttgggctatggaacagcagttcagagctgtttggctgcagcatctttagtggaatcccgtgacttaagagtcacagttgcagatgcacgcttttgcaaaccattggatcgtgcccttattcgcagcttagcaaaatcacatgagtacttaattacagttgaagaaggatcaattgggggatttgggtctcatgttgctcagttcctggcccttgatggccttcttgatggtgaagtaaagtggagacctctggttctgcctgatcggtacattgaccatggatcacccgctgatcaattgactgacgcgggccttacaccatatcatattgcagcaacagtgttcaatataattggacaaacaagagaggcactggagatcatgtcttaaaagaaaactttaaaagaggtcctggttttacacttccaacaatgtacaaattaaagctgtaatgtaactttcttctatcattttttgtaaagtagtgtcaacttataaatgtaacctatactggaccaatccaatccagtacatcaaataacagcatccgcttgttatgaacaaccagggtactctaattggaaaagcatcaaaggtgtaaaacatagctaattgaagcctgttgcatggtcaattaattaattaggta

SEQ ID NO: 7204 - DNA, 2491 bp, Tabernaemontana elegans
attttacataagaagtggtacagccactcgttcttgaagtgccccacttctctatagcagcttgaatttggtttcttatctgggttgtggttctttagtgaatcttctatttgttttctgggttctggagttctctttgttttccggtatatacagattgagctatacatatgtgggatggctctctgtgcatttacatttcccgggagcttgagcaagactgtggcttcagattcattaaagaatagtcttttctactctagttggctctatgggtcagatctgccttctccaatccaagccaaaaacaaccaggtcaccaaaaggtccaatggagtgcgggcttcactctcagaaaggggggagtatttctcacagagaccacccactcctcttttggacactatcaattatcctattcacatgaaaaatctttctactaaggaattgaaacaacttgcagatgaactgcggtcggatatcatttttaatgtttcgaagactggggggcatcttggttcgagtcttggtgttgtggagctcactgtggctcttcattatgtcttcaattgcccaaaagatagaattctttgggatgttggccatcagtcttacccgcataagattttgaccgggagaagagacaagatgccgaccctcagacagacaaatgggctatctggattcactaaacgctcggaaagtgaatacgactgttttggcgctggccatagttctaccaccatctcggcaggcctaggaatggctgtgggaagggatctgaaaggaagaaaaaacaatgttgtagctgtcataggtgatggagccatgacagcaggtcaggcatatgaagctatgaacaatgctggctatctggattctgacatgattgttattctcaatgacaacaaacaagtctccttgccaactgcaacactggatggtcctgctcctccagtaggagctctgagtagtgctttgagcaggttgcagtcgaataggcctcttagagaactacgagaagttgccaagggagttaccatgcagattggtggaccagtgcatgagcttgcagcaaaagttgatgaatatgctcgtgggttgattagtggttctggatcaacactatttgaagagcttggattctattatattggtccagttgatggccacaacattgacgatcttgttgccattcttaaagaagttaagagtactaaaacaacaggtccggtgctgatccacgtcgtcactgagaaaggcaggggctatccatatgctgagaaggcagcagacaagtatcatggagttgtgaagtttgatccagcaacaggaaagcaattcaaatccagccccaaaactcaatcttatacaacatattttgcggaggctctgattgctgaagcagaggcagacaaagatattgttgctatccatgcagcaatgggagggggaacagggatgaaccttttcctacgccgcttcccaaaacgatgttttgatgttggaatagcagaacaacatgcagtaactttcgctgcaggattggcatgtgaaggcctgaaacctttttgtgctatctactcatcttttatgcaaagggcttatgaccaggtggtgcatgatgtggacttgcagaagctgcctgtccgatttgcaatggacagagcagggctggttggagcagacggtcctacacattgtggctcttttgatgtcacatttatggcatgccttccaaacatggtcgtgatggctccttcagatgaagctgagctatttcatatggtagcaaccgcagctgctatagatgacagacctagctgctttcggtatcccagaggaaatgggattggggtagagctgccacctggaaacaaaggcatcccccttgaggttggaaaaggtcggatactaatagagggggagagagcggcactcttgggctatgggacagcagttcaaagctgtttggctgcagctgctttagtagagcctcatggattacggttaacagttgcagatgcacgcttttgcaagccactggatcgtgctctcatccgcagcctggcaaaatctcacgaggttttgatcactgttgaagaaggatcaatagggggttttggatctcatgttgcccagttcatggccctagatggacttcttgatggaaatttgaagtggaggccgttggttctcccagatagatacattgaccatggatcttcagacaatcaactggcagaagctggtctcacaccatctcatattgcagcatctgtttttaacatacttggacaaacaagagaggctcttgaagtcatgtcttaaatctgaggtttctattgctcagaattctgtacaaatagtgtcatagaaattgtctacctttataattgctgtaaaatgtagtattaggcatcatctccatagttgtatcactatgtatactgcaacaagaagccaattggtttctaggttctgctgtaaa

SEQ ID NO: 7205 - DNA, 2417 bp, Nicotiana tabacum
  misc_feature (75)..(75): n is a, c, g, or t
  misc_feature (77)..(77): n is a, c, g, or t
  misc_feature (85)..(85): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (122)..(123): n is a, c, g, or t
  misc_feature (125)..(125): n is a, c, g, or t
  misc_feature (152)..(152): n is a, c, g, or t
  misc_feature (176)..(176): n is a, c, g, or t
  misc_feature (180)..(180): n is a, c, g, or t
  misc_feature (189)..(189): n is a, c, g, or t
  misc_feature (192)..(192): n is a, c, g, or t
  misc_feature (317)..(317): n is a, c, g, or t
  misc_feature (366)..(366): n is a, c, g, or t
  misc_feature (370)..(370): n is a, c, g, or t
  misc_feature (393)..(393): n is a, c, g, or t
  misc_feature (456)..(456): n is a, c, g, or t
  misc_feature (462)..(462): n is a, c, g, or t
  misc_feature (528)..(528): n is a, c, g, or t
  misc_feature (543)..(543): n is a, c, g, or t
  misc_feature (564)..(564): n is a, c, g, or t
  misc_feature (567)..(567): n is a, c, g, or t
  misc_feature (834)..(834): n is a, c, g, or t
ggctcattttctgttataaatttcctgggtttttcaattaaaacatacatacaaacaaacaccatggctttgtgnanctatgcanttccnggnattttgaanaggacagtggcttcagattnntnaaagcagagtcctttattctctgaatngtttcatggaacagatctgcagtntcanttccaacanaancttactcaggtcaagaaaaggtcacgtggggttcaggcatctttgtcagaaagaggagaatactatgcacagagaccaccaacacctcttttggacactatcaactatcccattcatatgaaaantctttctgtaaaggaacttaaacaactagcagaagaactaagatcaganacanttttcaatgtatcaaagactggnggtcaccttggctcaagtcttggtgttgttgagcttacagttgctcttcattatgtcttcaanacaccncaagataggatactatgggatgttggtcatcagtcttatcctcacaaaatcttgactggtagaagngggaagatgtcaacncttagacagacagatggactngcnggatttactaagcggtcggagagtgaatatgattgctttggcaccggccacagttcaaccaccatctcagcaggcttagggatggctgttggaagagatctgaaaggaaagaacaacaatgttatagctgtaataggtgatggtgcgatgacagcaggtcaagcttatgaagccatgaataatgccggttacctagactctgatatgattgttattttgaacgacaatagacaagtttcgttacctactgctactctagacgggccngcccctcccgttggagctctaagcagtgctttgagcaggttgcaatctaatagacctctcagagaactaagagaagtcgctaagggagttactaagcagattggtggacctatgcatgagcttgctgcaaaagttgatgaatatgctcgtgggatgatcagtggttccggatcaacattgtttgaagaacttggactttattatattggtcctgtggatggtcacaacattgacgatcttatttcgattcttaaagaagttagaagtactaaaacaacaggtccagtacttatccatgttatcaccgagaaaggcagaggttatccatatgccgagagagctgcagacaagtatcacggagtagccaagtttgatccagccacaggaaagcaattcaaagtcagtgccaagactcagtcctatacgacgtactttgcggaggctttaattgcagaagcagaagcagataaggacattgttgcaatccatgccgctatgggtggtgggaccggtatgaacctattccaccgtcgcttcccaacgcggtgttttgatgttggaatagcagaacagcatgctgtaacctttgctgctggtttggcttgtgaaggcctcaaacctttttgtgcaatttattcatctttcttgcaaagagcttatgaccaggtagtgcatgatgttgacttgcaaaagctgcctgtgagatttgcaatggacagagctggtcttgttggagcagatggtccgacgcattgtggtgcatttgatgttactttcatggcgtgtcttcctaacatggtagtaatggctccttccgatgaaacggagctatttcacatggtagcaactgctgctgccattgatgacagaccaagttgtttcagatacccaagaggaaatgggatcggtgtagagcttccggttggaaacaaaggcactccccttgaggtcggtaaaggcaggatattggttgaaggggagagagtggctctactgggatatggctcagcagtacagaactgtttggctgcagctgctgtgttagaaacccgtggtttacaagtaacagttgcagatgcacgcttctgcaaaccactggacggtgcgctcataaggagcctcgcaaaatcacacgaggtgcttatcaccgttgaagaaggatcaattggaggtttcgggtctcatgttgctcagtttatggccttagatggacttcttgatggcaagttaaagtggaggccgatagtacttcctgatcgatacattgaccacggatctcctgcagatcaattggcagaagctggtcttacgccatctcacattgcagcaacagtgtttaacattcttggacaaaccagagaagctctagaggttatgacataagatgtaaggaagtgcagaagttgtaataactgtaaaatgtctcgttgtaatatatagttctaggacaagacacccgctaaggtgagaatagttgtaagctgatataactaccataaacaagtttgacacataatacttattcctctaaatatgtaaagtgtccatggtgatccgcggttcaaccatcgattgtctcccat

SEQ ID NO: 7206 - DNA, 2543 bp, Populus trichocarpa
gaaattacaacctctttacaaaaattctttccccctctcctccatttttaactaattcatcactgacaccaaaaacttattaggggggcattactgtttgccaaattcatctgcactgtgtttccgtttctgggttcttcttcttcttgctgtttttccccccctcctttaagcagtctttcttctttgtttttctagtagttccaatggccctctctgcattttctttccctgctcatgtcaatagcgtcacaagtttagagcaccctcaaaagtttagtcttctgtcttctcatttcttatggagaacagatctgctgtcccaatctttagacaagatcaatcagatacatgtcaagaaaagggcaaatgggatttgtgcatcactatcagaaagaggagagtatcattcacagagacctccaacgcctctcttggacaccataaactatccaattcacatgaaaaatctatctgtcaaggagctaaaacaactagcagatgagttgcggtccgatgttatcttcaatgtttctaaaactgggggtcacttaggctctagccttggtgttgtggagcttactgtggctcttcactacgtttttaatgcccctcaagacaagatactatgggatgttggccatcagtcttaccctcacaagatcctgactgggagaagagacaagatgcatacaataagacagactaatggattagctggttttacaaagcggtcagagagtgaatatgattgttttggcactggtcacagctctaccaccatttcggctggcttgggaatggctgtggggagagatttaaaaggagggacgaacaaggtagtcgccgttataggtgatggagccatgacagcaggacaagcttatgaagcgatgaacaatgcagggtacctagactctgatatgattgttattcttaatgacaacaaacaagtttctttaccaactgccaacttagatgggccgataccacctgtaggagccttgagcagtgctctcagtaggctgcaatcaaacaggcctctcagagaactaagggaggttgctaagggagttacaaaacaaatcgggggaccaatgcatgaattggcagcaaaggttgatgaatatgctcgtggaatgatcagtggttctggatcaaccctctttgaagagcttggtctctactatattggccctgttgatgggcacaatatcgatgatcttattgccattctaaaagaggttaagagtacaaaaacaacaggtccagtcctgattcatgttgtcactgagaaaggtcgggggtatccatttgccgagagagctgctgacaagtaccatggagtggccaagtttgatcccgcaactggaaagcagttcaaggcaagtcctagcacacagtcttacacaacatactttgcagaggctttaactgcagaagcagaggcagacaaagatattgttgcaattcatgctgccatgggaggagggacaggcttaaatctcttccttcgccgttttccaacaagatgttttgatgtggggatcgcagaacagcatgctgtcacttttgctgcaggacttgcctgtgaaggtcttaaacctttttgtgctatctactcgtctttcttgcagagggcatatgaccaggtggtacatgatgtagatttgcagaaacttccagtaagattcgcaatggacagagctgggctggttggagcagatggtcccacacattgtggagcttttgatgtcactttcatggcatgcctccccaacatggtggttatggctccttccgatgaggcagagcttttccacatggttgctactgctactgctatagatgatcgtcctagttgtttccgctatccaagaggtaatggtgttggtgttcagctgccaccaggaaacaaaggcgttcctcttgaggttggaaagggcaggatgctgattgaaggggagagagtggcactcttaggttatggtacggcagtccagagctgtttagctgctgcctctttagtagaacgccatggtattcgtctgacagttgcagatgccaggttctgcaagccgttggatcatgcccttattcgcagcctagcgaaatcacatgagattttgattacagtggaagaaggatcaattgggggctttgggtctcatgttgttcaatttctggcccttgacggtcttcttgatggcaaactaaagtggcgaccagttgttcttcctgataggtacattgaccatggatcaccagcagatcagttggtagaagctggtctcacaccatctcacattgccgcaacagtattcagtattcttggacaaagaagagaggctctggagattatgtcatcataaagaaaatggaaacactaattttgcgttcttacaacaaattattgtagcaaacagtgcagtgttaagtacagcaacatgtataaaaagcaccaactttaggtcttactttttcatgtttggtgaactcttggaaaatggtcaatgaaaagtgattcacatttaatgaaaaaa

SEQ ID NO: 7207 - DNA, 2676 bp, Solanum lycopersicum
aaatatatatatgtacatattcatacaagtgtaccttcacattcctccacattggatcaacaccatttgatcctttttatcaaagattcattttttttttcacttaccctccaattacatcttcataaacaacattttagtgacagtagcaccaacacaccccactagaattttcttgaagtaaaccccttttttcaagaatcaagaaaccacttataaaatttgtgggttttcattgaaacaaaggaaaaaaaacagttgaattgactaatcatggctttgtgtgcttatgcatttcctgggattttgaacaggactggtgtggtttcagattcttctaaggcaacccctttgttctctggatggattcatggaacagatctgcagtttttgttccaacacaagcttactcatgaggtcaagaaaaggtcacgtgtggttcaggcttccttatcagaatctggagaatactacacacagagaccgccaacgcctattttggacactgtgaactatcccattcatatgaaaaatctgtctctgaaggaacttaaacaactagcagatgaactaaggtcagatacaattttcaatgtatcaaagactgggggtcaccttggctcaagtcttggtgttgttgagctgactgttgctcttcattatgtcttcaatgcaccgcaagataggattctctgggatgttggtcatcagtcttatcctcacaaaatcttgactggtagaagggacaagatgtcgacattaaggcagacagatggtcttgcaggatttactaagcgatcggagagtgaatatgattgctttggcaccggccacagttccaccaccatctcagcaggcctagggatggctgttggtagagatctaaaaggaagaaacaacaatgttattgccgtaataggtgatggtgccatgacagcaggtcaagcttatgaagccatgaataatgctggttacctggactctgacatgattgttatcttaaacgacaatagacaagtttctttacctactgctactctggatgggccagttgctcctgttggagctctaagtagtgctttgagcaggttacagtctaataggcctctcagagaactaagagaagtcgcaaagggagttactaagcagattggtggtcctatgcatgagcttgctgcaaaagttgatgaatatgctcgtggcatgattagtggttctggatcaacattgtttgaagaacttggactttactatattggtcctgtggatggtcacaacattgatgatctaattgcgattctcaaagaggttagaagtactaaaacaacaggtccagtactgatccatgttgtcactgagaaaggcagaggttatccatatgctgagagagctgcagataagtatcatggagttgccaagtttgatccagcaacaggaaagcaattcaaagccagtgccaagacacagtcctatacaacatattttgccgaggctttaattgcagaagcagaagcagataaagacattgttgcaatccatgctgccatggggggtgggaccggaatgaaccttttccatcgtcgcttcccaacaaggtgttttgatgttggaatagcagaacaacatgcagtaacctttgctgctggattggcttgtgaaggcattaaacctttctgtgcaatctattcgtctttcatgcagagggcttatgaccaggtagtgcatgacgttgatttgcaaaagctgcccgtgaggtttgcaatggacagagcaggtcttgttggagcagatggtccaacacattgtggtgcatttgatgttacttacatggcatgtcttcctaacatggttgtaatggctccttctgatgaagcggagctatttcacatggtagcaactgctgccgccattgatgacagaccaagttgttttagatacccaagaggaaatgggatcggtgtagagcttccggctggaaacaaaggaattcctcttgaggttggtaaaggtaggatattgattgagggggagagagtggctctattgggatatggctcagcagtgcagaactgtttggatgctgctattgtgctagaatcccgcggcttacaagtaacagttgcagatgcacgtttctgcaaaccactggaccatgccctcataaggagccttgcaaaatcacatgaggtgctaatcactgtcgaagaaggatcaattggaggttttggatctcatgttgttcagttcatggccttagatgggcttcttgatggcaagttgaagtggagaccaatagttcttcctgatcgatacattgaccatggatctcctgttgatcagttggcggaagctggcctaacaccatctcacattgcagcaacagtatttaacatacttggacaaaccagagaggctctagaggtcatgacataagatggaagaagcgtagaaagatatatagtatattgtaaaatatagttttaggtcatgacataagcagattaacatatactttatcctccaaaatatgtttaaagtttccatggctgagttcaagccctcctcttagtctccaccatgacttatgattaactcatatggtttctgattgtgtaaccggttcttgatttttcgagttatgaagatgaatgaaaatgaaagattttacttttagaa

SEQ ID NO: 7208 - DNA, 2639 bp, Gossypium hirsutum
atgttcattttctatagacaaagcctttattttttttttataagagtatataaatatagtcttgacggaaggcttcgacacagtcatccacttagtaccatcatcaagcaataaagcagggtgacatgacggtgcaatagtcaataaccaaattgtctataaatctatcattgattggatagcctttcattcttgcactcaaagagtggaaacttttctgggttcttctcgttttgtgctcttagtcagcagttgcagtcctttattgctctttggagattgtatagtctttagtcatggccctttgtgcatcttcatttcctgccattatcaactggggtgcagcttcagatcctcaaaaatccactccttttgcttctcattttcttggtggatcagatctggttttgcagccattgaagaagctcaatcaggtcaagaaaaggccaggtggggtttatgcatcactatcagaaggagctgaatatcactcccaaagaccagcaacgcctctcttggacactataaactatccaattcatatgaaaaatctctctgtcaaggaactgaaacaactatctgaagaactgcggtctgatgtgattttcaatgtttcaaaaactgggggtcacttgggttcaagccttggtgtggttgaactcactgtggctcttcattatgtcttcaatgcccctagagacaagatattgtgggatgttggtcatcagtcttaccctcacaaaatcttgactgggagaagacataagatgcataccatgaggcaaactaatggattggccggattcacgaaacggtcggagagtgaatacgattgcttcgggactggtcacagttcaaccacaatctctgcaggcttggggatggctgtgggaagggatctgaaaggtgaaaggaatcatgttgttgctgtcataggtgatggtgctatgactgcaggacaagcttacgaagcaatgaacaatgccggatatcttgattctgatatgattgttattcttaatgacaataaacaagtttctctgccaactgccaatctcgacggacctataccacctgtgggagctttgagcagtgctctcagcaggctgcaatcaaacaggcctcttagagaactaagagaggttgcaaagggagttaccaagcaaatcggtgggcctatgcatgaactggctgcaaaagttgatgagtatgctcgtggaatgatcagtggttctggatctacacttttcgaagaacttggactatattatattggacctgttgatggccacaacatcgatgatttagtttctattctcaaagaggttaagactactaaaacaacgggtccggtcttgatccatgttgtcactgagaaaggccgaggttatccatatgcagagagagctgctgacaagtatcacggagtggtgaagttcgatccggcaactggaaagcaattcaaaggcaattctgctacccagtcttacactacatattttgctgaggctttgattgcggaagctgaggcagacaaaaatattgttgccatccatgctgcaatgggaggtggaaccggattaaacctcttcctccgccggttcccacaaagatgtttcgatgtggggatagccgaacaacatgctgtcacctttgctgcaggcttggcctgtgaaggcttgaaacctttttgtgcaatctactcatcattcatgcaaagggcatatgaccaggtcgtacacgatgtggatctgcagaagctgcctgtaagatttgcaatggacagagctggcctcgttggtgcagatggtccaacacattgtggggcttttgatgtcactttcatggcttgcctccccaacatggtggtaatggctccttctgatgaagctgaacttttccatatggttgcaacagctgctgccatagatgaccgtcctagctgtttccgttacccaagaggaaatgggatcggagttcagttaccacctgggaaaaaaggggttccactggaggttggcaaaggcagggtactaattgaaggggaaagagtggcactattaggctatggaagtgcagttcaaagctgcttagcagctgcctctttattggaatcgcatggcttaaggctgaccgtagcagatgcacgattttgtaagccattagatcacgccttgatccggaaactggcaaagtcacacgaagtactgatcacagtcgaagaaggatcaatcgggggctttggttctcatgtggcacagttcctagcacttgatggtcttcttgatggcaaagtaaagtggaggccattggttcttcccgatcgatacattgaccatggctcacccgtggaccagttggctgaagctggtcttacgccatcccacatagccgcaacggtgttcaatgtgcttgaacaaaaaagagaggctcttgaggtcatgtcctcaagaaactgaagaagtcaacaactttgtacaaaattttacgttttgttttcttttcaaatcagtgatggttaaatatataataatataaataatcttagttaccataaataattattatgtaacccaacaactttacgagtaatatcacatatctgagttcacatcaaaaaaaaaaaagtaccgactgcg

SEQ ID NO: 7209 - DNA, 2559 bp, Hevea brasiliensis
tgacttggtcccgctcctaaaaccctctcgacatcttctttgttggccaccacaagctgattttaatactgaatcacctcctcaatagtggtgcattcggacccataatcacaatctccattgtgtttttgtttctgggttcttcttcctcttctttttatctctattcacaatttcgaactgtttttgaactctttttgttgcttgcttgcttctgttggttctctatctgtaatggctctctctgcatgttcatttcctgcccatgtaaacaaaaacacaatctcagatcttcaaaagtacagctatgtcccttctcattccttatggagaaaaaatccgttggcccaatctctagacagactcaatcaggcaaagagcaagaaaaggccagaagggatttgtgcatcactgtcagagagagaagaatatcactcacagagaccaccaacacctctcttggacaccacaaactatccaattcatatgaaaaatctatcaatcaaggaactaaaacaactagcagacgagctgcggtcagatgttatcttcaatgtttctagaactgggggtcacttaggatcaagccttggtgttgttgagctcactgtggctcttcactatgttttcaatgctcctcaagacaagatactgtgggatgttggccatcagtcctacccacacaaaatcctgactgggagaagagaaaagatgcacacaatcagacagacaaatggactttctggtttcacgaagcgatcagagagtgaatatgattgctttgggactggccatagctctaccactatttctgcaggcttggggatggcagtggggagagatttaaaaggaaaaaaaaacaacgtagttgctgttataggtgatggtgccatgacagcaggacaagcttatgaagctatgaacaatgcagggtacctggactctgatatgattgttattctcaatgacaacaaacaagtttctttaccaactgctactcttgatggacccataccaccagtgggagctttgagcagtgctcttagtaggttgcaatcaaacaggcctctcagggaactaagagaggttgctaagggtgtcacaaagcagattggtggacccatgcatgaacgggcagcaaaggttgatgaatatgctcgtgggatgatcagtggttctggatcaaccctcttcgaagagcttggattatattatattggtcctgttgatggccacaacatagatgatcttatagctattctcaaagaggttaagagtactaaaacaactggtccagtcttgatacacgttgtcactgagaaaggtcggggatatccatatgctgagaaagctgcagacaagtaccacggggttaccaagtttgatcctgcaactggaaaacaattcaagggcagtgctattacacagtcttacactacatactttgcagaggctttgattgcagaagcagaagtggacaaggatattgttgcaattcatgctgcaatgggaggtggaacaggcttaaatctcttccttcgccgtttcccaacaagatgctttgatgttggaatagcggaacagcatgcagttacatttgctgcaggattagcctgtgaaggccttaaaccattttgtgcaatctactcatctttcatgcagagggcttatgaccaggtagtccatgatgtggatttgcagaagctgccagtaagatttgcaatggacagagctggactggttggagcagatggtcccacacattgtggagcttttgatgtcacttttatggcatgtctccctaacatggttgtgatggctccttctgatgaggcagaactttttcacatggttgccaccgctgccgccatagatgatcgtcctagctgcttccgatatccaagaggtaacggtgttggtgttcagctgccaccaggaaacaaaggcattcctcttgaggttggaaaaggcaggatattgattgaaggggaaagagtggcactcttgggttatgggacagcagttcagagctgtttggctgctgcctctttagtggaaccccatggcttgcttataacagtagcagatgcgagattctgtaaacctttggatcacaccctcattcgaagcctagcaaaaccacatgaagttttgataacggttgaagaaggatcaattgggggctttggatctcatgttgcacattttctggcccttgatggtcttcttgatggcaaactgaagtggcggccactcgttcttccagataggtatattgaccatggatccccgtctgtccagttgatagaggctggtctaacgccatctcacgttgcagcaacagtactcaacatacttggaaataaaagagaagctctgcagataatgtcatcatagagaaagtggaaacataacggttttgcactttcaacaatgtaaaatagaataattgcaagatttattatgtcatcatccatttgcgtatgaaatgtaattttagaatcactacagaatcatgtaacagcaccaactttggatagaattaataaaagtttcaac

SEQ ID NO: 7210 - DNA, 2516 bp, Citrus sinensis
gcaagcactgaatacatttactgtgagaagaagactcaccagtcacgagcgtttttaattatatactaatttttcatcgttagcatattattcttcactgactgcgtgatgttttcttttgtgggttcttctatgcaatagctgttatggctctctccgcattctcattcccgacttatgtcagcaaagcaacaaattcggatccccacaaatcttctcctgttacttctcatttctttggagcagctcttttttcccatttctcacaaaagctcgacaatcatcagatacagctcaagaaaaggccaaatggggtttgtgcatcactttcagaaagaggagagtatcactcacaaagaccaccaacacctctcttggacaccataaactatccaattcacatgaaaaatctatccatcagggagctgaaacaactggcagatgagttgcgggccgatgtcatattcaatgtttcgaaaaccgggggtcacttgggctcaagtcttggtgtgattgagcttaccgtggcccttcattatgttttcaatgctcccaaagaccggatactgtgggatgtcggtcatcagacttaccctcataaaatcttgactgggagaagggataagatgcatacaatgaggcaaacagatggcctttctggattcactaaaaggtctgagagtgaatatgattgctttggaaccggccacagttctactagtatctctgccggattgggaatggctgtgggtagggaccttaaaggaagaaagaataatgtggttgctgttattggtgatggtgccatgactgcaggccaagcctatgaagccatgaacaacgctgggtacctagattctgacatgattgttattcttaatgacaacaagcaggtttctttacccactgctactctagatgggcccataccacctgtaggtgctttgagcagtgctctcagcagattgcaatcaaacaggcctctcagagaactcagagaggttgcaaagggagttaccaagcaaataggtgggcctatgcatgaactggctgcaaaagttgacgaatatgctcgtggaatgatcagtggttctggatcaacactgtttgaagagcttggactctattatatcggtcctgttgatggtcacaatgtagatgaccttgttgccattcttgaagaggttaagaatactaaaacaacaggtccagttctgattcatgttgtcactgagaaaggcagaggatatccctatgctgaaaaggctgcggacaagtaccatggtgtggcaaagtttgatccggccactggaaagcaattcaaatccagtgccaggacccagtcttatacaacatactttgcagaggctttgattgcagaagctgaggtggacaaagatgttgttgctatccatgctgcaatgggaggaggaacagggctgaatctcttccttcgccgtttccctactagatgctttgatgttgggatagcagaacagcacgctgttacttttgccgctggtctggcctgtgaaggccttaaacctttttgtgcaatctactcttctttcatgcagagggcatacgaccaggtggtacatgatgtggatttgcagaagctgcctgtaagatttgcaatggacagagctggacttgttggagctgatggtcccacacattgtgggtcttttgatgtcacttttatggcatgccttccgaacatggtggtaatggctccttctgatgaggcagagctttttcacatggttgccactgctgctgctatagatgaccgccctagctgtttccgttacccaagaggaaatgggattggtgttgagctgccaccaggaaacaaaggcattcctcttgaggttggcaaaggcaggatactgattgaaggtgaaagagtcgcactcttgggctatggtacagccgttcagagctgtttagctgcttctgctttattggaatcccatgggttacggctgactgtagctgatgctcgattctgtaaaccactggatcatgccctcattcgtagcttggcaaaatcacatgaagttttgattactgtggaggaaggatcaattgggggttttggatcacatgttgttcagttcctcgctctcgatggtcttcttgatggcacggtcaagtggagaccacttgtactccccgatcgatatattgaccatggatcacctgctgaccagttggctcaagctggtcttacaccatcccacattgcggcaacagtattcaacattcttggacagacaagagaggctcttgagataatgtcattcaaaagctgaagaatacacaattattgccaatattctccacaatgtacaaatataagaactgtaagaagttatatacatttcagcctcggcactgtagaaattgcttttgttagcattggtttatttagtttacatcaaccacatcattcaacttcaccagacaccaacttgattagaaatcaaagagtacttcatgattagaagttc

SEQ ID NO: 7211 - DNA, 2432 bp, Cucumis melo
ttggatttcttcacttgggttttgatttttgcgattgaagtagtttgattttgagagttctactaatggcgctctgtatgctaacttttcctgctcatgttagccgagttggattgaaagagcatgatggttcaagtgttgctgtttcttctcggttcttatggggaacggatctggttttccgatttcagaaaagggttaatcaggtcaagaaaaggccaggtgggatctgtgcatcactttcagagacgggagagtatccttcacagaggccaccaactcctcttttggatacaataaactatccaattcatatgaaaaatctatccgtcaaggagctttatcaactagctgatgaagtaagatccgatgtcatcttcaacgtttctaaaactggtggtcacttgggttccagccttggcgtggtggagctcacggtggctcttcactacgtcttcaatgctccacaggacagaattttgtgggatgttggtcatcagtcttatccacacaaaattctaactggaaggagggacaaaatgtcaactattagacagacgaacgggttgtcgggattcacgaaacgctcagagagtgagtttgattgctttggtgcagggcacagctccaccaccatctcagcaggcttaggaatggctgtgggaagggatcttaagggaagaaagaataatgtgattgcagtaataggtgatggtgccatgactgcagggcaagcttatgaagccatgaacaatgctgggtaccttgactcggacatgattgttattcttaatgacaacaaacaagtctctttaccaactgcaaccctcgacgggcctgtaccacctgtgggagctttgagcagtgctctcagcaggctgcagtcaaacaggcctctcagagaactgagagaggtagccaagggtgtcacaaaacaaattggtggtcctatgcatgaattggctgcaaaagttgatgaatatgctcgtgggatgattagtggttctggatcaacattatttgaggagctcggactctattatatcggccctgtcgatggtcataacgtggatgatcttgtctccattcttaaggaagttaagagtacaaaaaccactggtccagtcctcatccatgttgtcaccgagaaaggacgaggctatccgtatgctgaaaaagctgctgacaagtaccatggagtcacaaagtttgaccctgctactgggaaacaacagaaatccaaggctccaacgcagtcgtacacgacatacttcgcagaggcattgattgcagaagctgaaagggacaaagatattattgcaatccatgctgcaatgggaggaggcacaggcttaaatctctttcaaagacgttttccaacaagatgctttgatgttggcatagctgaacagcatgctgttacatttgctgctggtttggcttgtgaaggccttaaaccattttgtgcgatatattcatcattcatgcaaagggcgtatgatcaggtagttcatgatgttgatttgcaaaagttgcccgtgaggtttgcaatggatagagcaggcttagttggagcagatggccccactcattgtggttctttcgatgttacgtttatggcatgcctgcctaacatggtggtcatggctccgtctgatgaggccgaactctttaacatggtcgctacagctgcagctatagatgaccgacccagttgcttccggtatccacgaggtaatggtatcggtgtagagctgccaccagggaataagggcattcctatcgaggttgggaaagggaggattttacttgaaggggaaagagttgccctgttgggctatggaacggcagttcaaaactgtttggctgctgcatctatggtcgaacgccatggcttacgaataaccgttgcagatggacgtttctgcaagccactcgaccgtgccctcatccgaagtctagctaaatcgcacgagattttaatcacagtggaagaaggatcgattggaggatttgggtctcatgtcatccagtttctggctcttgatggccttcttgacggcaccttgaagtggagaccactagtccttcccgaccgatacatcgaccacggatcaccagcagaccaactggctgaagcaggtcttactccgtcacatattgctgctacagtattcaatatgctaggacaaaccagggaagctcttgagatcatgacatagaagagaactttatgagtcgcagcgttccactttaatgtaatgtacaaatttgaaaatcgcttatctagtttcgtcatacttatgtatacttaccactacacattatcagtctaggctgtataaacaaatacttctcgtacaattctagtaagcatatgatttaatgcaagatttttattttcttcgtgacctaaaaaaaaaaaaaaaaaa

SEQ ID NO: 7212 - DNA, 2767 bp, Citrus clementina
agcttctgaatacgtaggccgaacaaacaaaagcattcaaatttgttgtgtcctctaagaacttcatcctttaacagacccactaaatttcccttcagcattatcaaccacaaacgcgcattcagatttcttccttcatttgtttattttatttttttaatatatttaatatttatattcaacctcttcacttcagcggcagtcagcaccagcaagcactgaatacatttactgtgagaagaagactcaccagtcacgagcgtttttaattatatactaatttttcatcgttagcatattattcttcactgactgcgtgatgttttcttttgtgggttcttctatgcaatagctgttatggctctctccgcattctcattcccgacttatgtcagcaaagcaacaaattcggatccccacaaatcttctcctgttacttctcatttctttggagcagctcttttttcccatttctcacaaaagctcgacaatcatcagatacagctcaagaaaaggccaaatggggtttgtgcatcactttcagaaagaggagagtatcactcacaaagaccaccaacacctctcttggacaccataaactatccaattcacatgaaaaatctatccatcagggagctgaagcaactggcagatgagttgcgggccgatgtcatattcaatgtttcgaaaaccgggggtcacttgggctcaagtcttggtgtgattgagcttaccgtggcccttcattatgttttcaatgctcccaaagaccggatactgtgggatgtcggtcatcagacttaccctcataaaatcttgactgggagaagggataagatgcatacaatgaggcaaacagatggcctttctggattcactaaaaggtctgagagtgaatatgattgctttggaaccggccacagttctactagtatctctgccggattgggaatggctgtgggtagggaccttaaaggaagaaagaataatgtggttgctgttattggtgatggtgccatgactgcaggccaagcctatgaagccatgaacaacgctgggtacctagattctgacatgattgttattcttaatgacaacaagcaggtttctttacccactgctactctagatgggcccataccacctgtaggtgctttgagcagtgctctcagcagattgcaatcaaacaggcctctcagagaactcagagaggttgcaaagggagttaccaagcaaataggtgggcctatgcatgaactggctgcaaaagttgacgaatatgctcgtggaatgatcagtggttctggatcaacactgtttgaagagcttggactctattatatcggtcctgttgatggtcacaatgtagatgaccttgttgccattcttgaagaggttaagaatactaaaacaacaggtccagttctgattcatgttgtcactgagaaaggcagaggatatccctatgctgaaaaggctgcggacaagtaccatggtgtggcaaagtttgatctggccactggaaagcaattcaaatccagtgccaggacccagtcttatacaacatactttgcagaggctttgattgcagaagctgaggtggacaaagatgttgttgctatccatgctgcaatgggaggaggaacagggctgaatctcttccttcgccgtttccctactagatgctttgatgttgggatagcagaacagcacgctgttacttttgccgctggtctggcctgtgaaggccttaaacctttttgtgcaatctactcttctttcatgcagagggcatacgaccaggtggtacatgatgtggatttgcagaagctgcctgtaagatttgcaatggacagagctggacttgttggagctgatggtcccacacattgtgggtcttttgatgtcacttttatggcatgccttccgaacatggtggtaatggctccttctgatgaggcagagctttttcacatggttgccactgctgctgctatagatgaccgccctagctgtttccgttacccaagaggaaatgggattggtgttgagctgccaccaggaaacaaaggcattcctcttgaggttggcaaaggcaggatactgattgaaggtgaaagagtcgcactcttgggctatggtacagccgttcagagctgtttagctgcttctgctttattggaatccaatgggttacggctgactgtagctgatgctcgattctgtaaaccactggatcatgccctcattcgtagcttggcaaaatcacatgaagttttgattactgtggaggaaggatcaattgggggttttggatctcatgttgttcagttcctcgctctcgatggtcttcttgatggcacagtcaagtggagaccacttgtactccctgatcgatatattgaccatggatcacctgctgaccagttggctcaagctggtcttacaccatctcacattgcggcaacagtattcaacattcttggacagacaagggaggctcttgagataatgtcattcaaaagctgaagaatacacaattattgccaatattctccacaatgtacaaatataagaactataagaagttgtatacatttcagcctcggcactgtagaaattgcttttgttagcattagtttatttagtttacatcaaccacatcattcaacttcaccagacaccaacttgattagaaatcaaagagtacttcatgattagaagttcaaagctcttgaaatcttctcatcatgattttgtagttatg

SEQ ID NO: 7213 - DNA, 2768 bp, Citrus sinensis
agcttctgaatacgtaggccgaacaaacagaagcattcaaatttgttgtgtcctcttaagaacttcatcctttaacagacccactaaatttcccttcagcattatcaaccacaaacacgcattcagatttcttccttcatttgtttattttatttttttaatatatttaatatttatattcaacctcttcacttcagtggcagtcagcaccagcaagcactgaatacatttactgtgagaagatgactgaccagtcgcgagtgtttttaattatatactgatttgccgtcgttagcatattattcttcactcactgcgtgatgttttcttttctgggttgttctatgcaatagctgttatggctctctccgcattctcattcccgacttatgtcagcaaagcaacaaattcgggtccccacaaatcttctcctgttacttctcatttctttggagcagctcttttttcccatttctcacacaagctcgacaatcatcagatacagctcaagaaaaggccaaatggggtttgtgcatcactttcagaaagaggagagtatcactcacaaagaccaccaacacctctcttggacaccataaactatccaattcacatgaaaaatctatccatcagggagctgaagcaactggcagatgagttgcgggccgatgtcatattcaatgtttcgaaaaccgggggtcacttgggctcaagtcttggtgtgattgagcttaccgtggcccttcattatgttttcaatgctcccaaagaccggatactgtgggatgtcggtcatcagacttaccctcataaaatcttgactgggagaagggataagatgcatacaatgaggcaaacagatggcctttctggattcactaaaaggtctgagagtgaatatgattgctttggaaccggccacagttctactagtatctctgccggattgggaatggctgtgggtagggaccttaaaggaagaaagaataatgtggttgctgttattggtgatggtgccatgactgcaggccaagcctatgaagccatgaacaacgctgggtacctagattctgacatgattgttattcttaatgacaacaagcaggtttctttacccactgctactctagatgggcccataccacctgtaggtgctttgagcagtgctctcagcagattgcaatcaaacaggcctctcagagaactcagagaggttgcaaagggagttaccaagcaaataggtgggcctatgcatgaactggctgcaaaagttgacgaatatgctcgtggaatgatcagtggttctggatcaacactgtttgaagagcttggactctattatatcggtcctgttgatggtcacaatgtagatgaccttgttgccattcttgaagaggttaagaatactaaaacaacaggtccagttctgattcatgttgtcactgagaaaggcagaggatatccctatgctgaaaaggctgcggacaagtaccatggtgtggcaaagtttgatccggccactggaaagcaattcaaatccagtgccaggacccagtcttatacaacatactttgcagaggctttgattgcagaagctgaggtggacaaagatgttgttgctatccatgctgcaatgggaggaggaacagggctgaatctcttccttcgccgtttccctactagatgctttgatgttgggatagcagaacagcacgctgttacttttgccgctggtctggcctgtgaaggccttaaacctttttgtgcaatctactcttctttcatgcagagggcatacgaccaggtggtacatgatgtggatttgcagaagctgcctgtaagatttgcaatggacagagctggacttgttggagctgatggtcccacacattgtgggtcttttgatgtcacttttatggcatgccttcctaacatggtggtaatggctccttctgatgaggcagagctttttcacatggttgccactgctgctgctatagatgaccgccctagctgtttccgttacccaagaggaaatgggattggtgttgagctgccaccaggaaacaaaggcattcctcttgaggttggcaaaggcaggatactgattgaaggtgaaagagtcgcactcttgggctatggtacagccgttcagagctgtttagctgcttctgctttattggaatccaatgggttacggctgactgtagctgatgctcgattctgtaaaccactggatcatgccctcattcgtagcttggcaaaatcacatgaagttttgattactgtggaggaaggatcaattgggggttttggatctcatgttgttcagttcctcgctcaggatggtcttcttgatggcacagtcaagtggagaccacttgtactccctgatcgatatattgaccatggatcacctgctgaccagttggctcaagctggtcttacaccatctcacattgcggcaacagtattcaacattcttggacagacaagggaggctcttgagataatgtcattcaaaagctgaagaatacacaattattgccaatattctccacaatgtacaaatataagaactataagaagttgtatacatttcagcctcggcactgtagaaattgcttttgttagcattagtttatttagtttacatcaaccacatcattcaacttcaccagacaccaacttgattagaaatcaaagagtacttcatgattagaagttcaaagctcttgaaatcttctcatcatgattttgtagttatg

SEQ ID NO: 7214 - DNA, 2615 bp, Vinca minor
ggagttttgaggtatatttgtgatggctctctgtgcatttgcatttccagggggtttgaacaaggctttggctgcttcagattctctcaagaacactctttttggctctaatgggctttatgaatcagatctactttctccattacaatccaaaaacccccaggtcatcaaaaggtgtaatggagtgagggcatcactctcagaaagaggggagtatttttcgcagcgaccgccaactcctcttctggacactattaattacccaattcacatgaaaaatctttctaaaaaggaattgaaacaacttgcagatgaactaagatcagatgttatctttaacgtttctaagacggggggtcatcttggttcgagtcttggtgttgttgagctcaccgtcgctcttcattacgtcttcaattgcccacaagatagaattctttgggatgttggccatcagtcttaccctcataagattctgactgggagaagggacaagatgtcgacgttgagacagacaaacgggctatgcggattcactaaacgctctgaaagtgaatacgactgctttggggctggccatagttctaccaccatctcagcaggcctaggaatggctgttggaagggatcttaaaggaagaaaaaacgatgttgtggctgtaattggcgatggagctatgacagcaggtcaggcatacgaagccatgaataatgccggctatcttgattcggacatgattgttattcttaatgacaacaaacaagtctccttgccaactgcgacactggatggtcctgctgctccggtaggagctctgagtagtgctttgagtaggctgcaatccaataggccacttagagaactaagagaagttgccaagggggttaccaagcagattggtggatcagttcatgagcttgcagcaaaagttgatgaatatgctcgtggaatgattagtggttctggatcgacatattttgaagagcttgggatgtattatattggtccagttgatggccacaacattgatgatcttgttgccattcttaacgaagttaaaagtactaaaacaacaggaccggtactgatccatgttatcaccgagaaaggcaggggctatccctatgctgagaaagctgccgacaagtatcatggagttgtgaagtttgatccagcgacaggaaagcaattcaaatcgagcagcaacaccaagtcttacacaacatattttgctgaggctctgatcgctgaagcagaggcagataaagacatcgttgctattcatgcagcaatgggaggtggaacagggttgaacattttccaacgtcgcttcccaggccgatgttttgatgttggaatagcagaacaacatgccgtaacctttgctgcaggattagcatgtgaaggtctaaagcctttttgtgctatctactcgtctttcttgcaaagggcttatgaccaggtagtgcatgatgtggacttgcagaagctgcctgtacgatttgcaatggaccgagcagggctggttggagcagacggtcctacacattgtggcgcttttgatgttacatatatggcttgccttccaaatatggtagttatggctccttcagatgaagccgagctatttcacatggttgcaactacagctgctatagacgatagacctagttgcttaaggtaccctagagggaatgggataggcgtaggtctaccacccgcaaacaaaggcattcctcttgagattggaaaaggacggatattaagagaaggcgagagagttgcactcttaggctacggatcagcagttcaaaactgtttggctgcagctgatttacttgaatatcacggtttacgattaacagttgcagatgcgcgcttttgcaagcctctagaccgtgctctcataaggagccttgtaaaatctcacgaggttttgatcaccgttgaagaaggatcaatcggtggctttggatctcatgtagttcaattcatggccttagatggacttcttgatggcaatgtgaagtggaggccattggttcttcccgatagatatatcgatcatggatctccggctgatcaactggcggaagctggtcttacaccgtctcatatagcagcatctgtttttaacattcttggaaaaacaagagaggctcttgaagtcatgtcctaaattttaaggtttctgttttttataattctacccaaaatagaattgttttttttggggtgtaaaatgttgtagtttaatttaggtacatctctaagttgagaaccggctccagtgcataacatttattgtttcgcccttggcggaataattatggaccgtccgataaaaaatttgaccgctgaaatcatttgagtcttgataaatatcatgaagaaaagttaaatgaaatgatttcagttgtcagatgttaaatccgacagcccgtaattgttttgcacggtgcgaaaaaatggatgtaccgcattgtagcctgattgtctattgtatctaatataagttgtttttttaatccatttaaaggagggtcgatagtggttccccacttctcctccagcgtgactcgaacttccgatctacccgttgaaaataaagcgtc

SEQ ID NO: 7215 - DNA, 2591 bp, Arnica chamissonis
ataaacaccttcttcctccactcaagctcaccccttttctatccgattgctatccgggtctccgtaccaccacacatttctcatttcttgatccaatctgcccaatcaaatcgaaactttctgcgatggcgctttgtgcgtttgcatttccggcacagatgaatcaccggtcgattactaattctcctgtgtttcaacattgcttgtttggaagggatctacaacaccatcaatcctcacacaaaccctttttcaatcagtcaagtaaaagagtaggtgtggttgaagcaacactgtcggagagaggtgagtatcactcgcagagacctcctactccacttttggacaccatcaattacccaattcacatgaaaaatctctcgattaaggaattgaagcaactagctgatgagttgcgatctgatgtcatctttaatgtttctaaaactggtggtcatttgggttcaagccttggtgtggtggagctcacggtggctcttcattatgtcttcaatacgcctcaagataagatactttgggatgttggtcatcagtcttacccacataaaatcttgactggaagaagagacagaatgcataccattagacagacaaatgggttggcaggcttcaccaaacgtgctgaaagtgagcatgattgtttcggcacggggcatagctctaccaccatttctgcagggttaggtatggctgtgggaagggatttaaaaggaggaacaaatgatgtagttgctgttataggtgacggtgctatgaccgctggccaagcttatgaagccatgaacaatgcaggttatcttgattcagatatgatagttatccttaacgacaataaacaagtctcattaccaactgcaacacttgatggccctatagctcccgttggagctttaagcagtgctcttagtagattacaatctaaccgccctcttagggaactgcgtgaagttgccaaagaagttaccaaacaaattggcgggcccatgcatgaaattgctgctaaagttgatgaatatgctcgtggtatgattagtggttcagggtcgacactttttgaagaacttggtttatattatattgggcccgttgatggccatagcattgatgatcttgttgccattcttaaagaggttaagagtactaaaacaacgggcccggttttgatccatgttattacagagaaaggtagaggatatccatatgctgagaacgctgctgataagtaccatggtgtggcaaagtttgacccagcgacagggaaacaattcaagtcgagtgcaccaactcagtcttacacgacttactttgcagaggcattgattgctgaagctgaggtggataaaagagttgtgggcatccatgctgcaatgggtggtgggaccggaatgaatctattccatcgccgattcccaagtcggtgttttgatgtcgggattgctgaacaacatgcggttacttttgctgcggggttggcgtgtgaaggtcttaaaccattttgtgcaatttactcatcattcctgcaaaggggttatgatcaggttgtgcatgatgtggatttgcagaagttgcctgtgagatttgcaatggaccgagctgggcttgttggtgcagatggcccgacacattcgggctcgttcgatgtcacttacatggcatgcctcccgaacatggtggtcatggctccttctgatgaggctgagctttttcatatggtggcaaccgctgctgccattgacgacagacctagttgtttccgctacccacggggaaacgggataggcgttcccttgccacctggcaacaaaggcattcctctcgagattggaaaaggtcgaataatgattgaaggagagcgggttgcgctcctagggtatggaacagcagttcagagctgcttggctgcagccagtttagtacaaggacgaggtttaaacataacagttgcagacgctcgtttttgcaaaccgttggaccagaatctcatccgagcccttgcaaagtcacacgaggttttgatcacggttgaagaaggatcgataggtgggttcgggtcacacgtagctcatttcatggcattagatggtcttcttgatggaaaactgaagtggagaccactagtgcttccagaccgttacatcgaccacggtgcaccggatgaccaactagccgaagccgggttgactccatcgcatatagctgcaaccgtattcaatgtacttgggcaaacacgagaggctttggaggttatgtcatagaggattcttgtgtgatgtacacaaatggatatatttatctgcatagatgtacaacagttatggctcaacttttaacggtctagaaatagtcaaccctttgtaaaaagtcaactgaattggattgggtttgtaaagttttggatggtttggtacatcgtacagaaaccagtattccttaatggtcaaaaacccgatccgatttcaatagctaaaactggtgagttattacgtggtacgggtcaatactaaaagactcattttaaaacccgattatttaaactggagacccgataaccagtaaaacgggtatggtat

SEQ ID NO: 7216 - DNA, 2692 bp, Humulus lupulus
gtgatatgatatttggtgcgagtacaaaaaaaccctctctccgggttggccactttggtcttttaaaaaaaggttttcactcagtgacactcactatcaacctctcaaattttttcttttatataacgctccaccataccataccatctctaccacctcttccttagtgggaatttaggctcttcttcttgggcattccattaataactcggtgttctttttctggggttttctccatttgacctctagttaaggttttgaagctgcttgaggtttgttattgtctcttttcttcttgtaatggcgttttgtacattatcatttcctgctcatattagccgggcaaccacaccagtttcggatcttcacaaaactagctctttctcttctcggttttattggggagcagatctgttgcggccatctcaatacaagcaggtcaggaaaatacaaagtggggtttatgcatcactgtcagaaagtggagaatatcactcaaggagaccaccaactcctctcttggacacaataaattttccaatacatatgaaaaatctctctgttaaggagcttaaacagttatcagatgaactacggtctgatgtcatcttcaacgtttctaacaccgggggtcacctgggctcaagcctcggtgttgtcgagcttactgtggctcttcattatgtcttcaatactcctcaagataggatactatgggatgttggtcatcagtcctaccctcataaaatcctgactggaagaagagataagatgcacaccatgaggcaaaccaatgggctagccggattcactaagcggtctgagagtgaatacgattgttttgggactggtcatagctctaccaccatctcagcaggcttgggaatggccgttggaagggatcttaagggaagaaagaataatgtagtggctgtcataggtgatggcgccatgaccgcaggtcaagcttatgaagccatgaataatgctgggtaccttgattccgatatgattatcatccttaacgacaataaacaggtttctctacctactgcttctcttgatgggcccataccacctgttggagctttgagtagtgctctcagtaggctgcaatcaaacaggcctctcagagaattaagagaagtagccaagggagttactaaacaaattggtggatcagtgcatgaattggctgcaaaagttgatgaatatgctcgtggtatgataagtggttctgggtcaacactatttgaagagcttggactctattacataggtccagttgatggtcacaatatagatgatcttatttccatactaggagaggttaagagcactaaaacaacaggtccagtcttgatccattgcatcactgagaaaggacgaggatatccatatgcagagaaagctgctgataagtaccatggggtggccaagtttgatccagcaactggaaagcaattcaaaggcacttctagcacacagtcatacacaacatacttcgcagaggctttggttgcagaagcagaagcagacaaagatgttgtggcaatccatgctgcaatgggtggtggaacaggcttgaatctcttccttcgccgttttccaacaagatgtttcgatgttgggatagcagaacagcatgctgttactttcgctgctggtttggcctgcgagggccttaagcctttctgtgcaatatactcatctttcatgcagcgggcctatgatcaggtagtacatgatgttgatttgcagaagttgccagttagatttgcaatggacagagctggacttgttggggctgatggtcccacacattgtggcgcttttgatgtaactttcatggcatgcctccctaacatggtggtgatggctccttctgatgaggctgagctcttccacatggttgccactgccgctgccatagatgacagacctagttgtttccgttaccccaggggaaatggaactggtgttgcacttcctcaagggaataaaggcatcccccttgagattggaaaaggcagggtattggttgaaggggagcgagtagcacttttaggctatggaacagcagttcagagttgtttggctgcagcagccttagtcgaaccgcacggtctacggctaacagttgctgatgctcgcttttgcaagcctttggatcatgccctcattcgcgaacttgccaaaaatcacgagtttttgattacagtagaagaaggatctataggaggttttggatctcatgttgctcagtttatggcccttgatggccttcttgatggcaaaacaaagtggagaccaattgttctacctgatcgatacattgaccacggtgcgcctgctgatcagttagccgaagctggtctcacgcctcctcacattgcagccactgtttttaatgtactaggacaaacaagagaggccttgaaggttatgacgtgagtgagaatcaagaaacttatatagaagataattttttttttacacatttcataaagtaaaaaagaacaaaaatatatatgttgacgtgatgaataagtttatagtttgtgtaaaggtaattagcatttaaggcaatgtgatccttctccttctaatttctcaaagtagcaaggctagctatcaatgcagaagaaaccgactgatcaaatatacacacgagtagagtctccttaaagcg

SEQ ID NO: 7217 - DNA, 2477 bp, Lippia dulcis
gggggagggagaatagaatcaagcaccatttctacatgcacaacagagtaaagttggaatctttgtaaggaaagaaaaataccttttggaaaatctctgaatctccaatttgtgggattttttttggagagaaagggagagagagatggctctctgcacatttgcctttcctgggaatttgagcaaaggagtagtggctgctgaagttcaaaaacagaccactttaagctctcagtggctacacggattggatctgcagccaaacggtttctgcaagagtaatcaggtaaagaaaagaccaactggagtttgtgcttcattgtcagaaagaggagagtatttctcgcagaagcctccgactcctcttttggacactatcaactatccaattcacatgaaaaatctatctacgaaggaactgaaacaacttgctgatgaactacgatctgatgttattttcaacgtctctaagactgggggtcatcttggttcaagtcttggtgttatcgagctaactgttgctcttcactatgtttttaatgctcctcaagataagatactttgggatgttggccaccaggcttatccgcacaaaattttgactggaaggagagaaaagatgccgactttaaggcaaacaggcggtctttctggttttactaagcgggccgagagcgattatgattgttttggtgccggtcacagttcaacaaccatctctgcgggactaggaatggctgtggggagggatctaaaaggaagaaagaacagtgtcgtggctgtgataggtgacggagctatgactgctggtcaggcatatgaagcaatgaacaatgctggttacttggattctgatatgattgttattctcaacgacaacaagcaagtttctttacccactgccaatttagacggcccaatccctcccgttggtgccttgagtagtgctttgagcaggctgcagtccagtagggaactaagacaactcagagaagttgccaagggagttacaaagcaaattggagggcctatgcacgagcttgcagcaaaagtagatgaatatgctcgtgggatgattagtggttctggatcgtcactctttgaagagcttggactttattacattggtccggtcgatggtcacaacattgatgatcttacagcaattcttaaagaagtcaagagtactaaaataactggtccggttttgatccatgttgttaccgagaaaggcaggggatatccttatgctgaaatggctgcagataaataccatggggtgaccaaatttgatccagcaactggaaagcagttcaaatcgagtgctccaacacagtcttacacgacctactttgcggaggctctgattgcagaagctgaagcagacaaggatgtcgttgcaatccatgctgcaatgggaggcgggaccggtttgaatctcttccagcgccgtttccctacgaggtgctttgatgttggaatagcagaacaacatgctgttacttttgctgctggtttggcttgtgaaggcatcaaacctttttgcgccatctactcctcttttttgcaaaggggttatgatcaggtagtgcatgatgttgatttgcagaagctgccagttaggtttgcaatggatagagccggcttagttggagcagatgggcccactcattgcggtgcttttgatgttgcgttcatggcatgccttccaaacatggttgtgatggctccttcagatgaggtcgaactatttcacatggttgcaactgctgccgctatagatgataggccgagctgtttccggtatccgagaggcaatggtatcggcctagagttgccaccaggaaacaaagggactccccttgaggtcggaaaggggcgtatattgattgaaggggagagagtggctctcttaggttatggctcagcagttcagagctgtttggctgcagctgcattggtcgaaccccgcggcttacagataacagttgcagatgctcgcttctgcaagccgttggatcatgctcttatacgcagcttagccaaatctcacgaaatcttgatcaccgttgaagaaggctcgatcggtggttttggatctcatgtagtccagtttatggcccttgatggacttcttgatggcaacctaaagtggaggccgttggttcttcccgatcgatatatcgaccacggagccccggccgatcagcttatggaagctggcttgacgccttctcatattgcagccacagtttttaatatgcttgggagatctagggaggctctagaggtcatgtcctagatgcaagatttgtacaaaatgataatgatatatagagtctgaaaactaggcctttgttagcaactgtaaaatgtagtcttatagaactgcactcttttttttttctgtataatctcagattgccgctctattaactaaaaggatcgagggccgtcccctggttatatattgatgg

SEQ ID NO: 7218 - DNA, 2639 bp, Citrullus lanatus
cagcccacgcttcgttttttcattggattttttcatttttttcttgttaatttaattcttccactttcaaattaccacttcccttagtggcaaaaacagttcattcaatttcttctaccgtgtctctctctataagacacgtagaaagtgggtgcggaacaagagagagagagagagagagagagagaggggatcaaagcatttttctctttttctttttttatttttcttggatttcttcacttgggttttgatttttgcgactgaagtcgtttgatttgagctctaatggcgctgtgtacgctaacttttcctgctcatgttagccgagttgcagtgaaagagcacgatggttcaagtgctgtttcttctcggttcttatggggaacggatctggtgttccgatttcagaaaagggtcaatcaggtcaagaaaaggccaggtgggatctgtgcatcactttcagagatgggggagtatccttcacaaaggccaccaactcctcttttggacacaataaactatccaattcatatgaaaaatctatccatcaaggagctttatcaactagctgatgaagttagatcggatgtcatcttcaacgtttctaaaactggtggtcacttgggttccagccttggcgtggtggagctcacggtggctcttcactatgtcttcaatgccccacaggacagaattctgtgggatgttgggcatcagtcttatccacacaaaattctaactggaaggagggataagatgtctactattagacagacaaacgggttgtcgggattcacgaaacgctccgagagtgagtttgatagctttggcgcggggcatagctctaccaccatctccgcaggcttaggaatggctgtgggaagggatcttaagggaagaaagaataatgtggttgcagttataggtgatggtgccatgactgcagggcaagcttatgaagccatgaacaatgccgggtacctcgactcagacatgatcgttattcttaatgacaacaaacaagtctctttaccaactgcaactctagatgggcctgtaccgcctgtgggagctttgagcagtgctctcagtaggctgcagtccaacaggcctctcagagaattgagagaggtagccaagggcgtcacaaaacaacttggtggtcctatgcatgagttggctgcaaaagttgatgaatatgctcgtgggatgattagtggttctggatcaacgttatttgaagagctggggctctattatattggccctgttgatggtcataacgtggatgatcttgtctccattcttaaggaagttaagagtacaaaaaccactggtccagtcctcatccatgttgtcactgagaaaggacgaggctatccatatgctgaaaaagctgctgacaagtaccatggagtcacaaagtttgatcctgctactggaaaacaacagaaacccaaggctccaacgcagtcgtacacgacatactttgcagaggcattgattgcagaagctgaaaaggacaaagatattattgcgatccatgctgcaatgggaggaggcacaggcttaaatctctttcaaagacgttttccgacaagatgctttgatgttggcatagctgaacagcatgctgttacatttgctgctggtctggcttgtgaaggccttaaaccattttgtgcgatctattcgtcgttcatgcaaagggcatatgaccaggtagttcatgatgtggatctgcaaaagttgcccgtgcgatttgcaatggatagagcaggcttggttggagcagatggcccaacccactgtggcgctttcgatgttacttttatggcatgcctgcctaatatggtggtcatggctccgtctgatgaggctgaactctttaacatggttgctacagctgcagccatagatgaccgacccagttgcttccggtatccacgaggtaatggtatcggtgtagagctgccaccagggaataaaggcattcctattgaggtcgggaaagggaggattttacttgaaggggaaagagttgccctgttgggctatggaacggcagttcaaaactgtttggctgctgcatctatggttgaacgccatggcttacgaataacagttgcagatggacgtttctgcaagccactcgaccgagccctcatccgaagtctagctaaatcacatgagattttaatcacagtggaagaaggatcgattgggggatttgggtctcatgtcatccagtttctggctcttgatggccttcttgacggcaccttgaagtggagaccgcttgtccttcccgaccgatacatcgaccatggattgccagcagaccaactggctgaagcaggtcttactccatctcatattgctgctacggtatttaatatgctaggacaaaccagggaagctcttgagattatgtcatagatgacaactttacgagtcgtagcgttccacttcaatgtaatgtacaaatttgagaatcgcgtatttagttcggtcatacttgcgtatacttataactataccttatcagtctaggctgtatcaacaaatacttctcatacaaggcttctagcatatgcttggatgcaagattcttaattttcttggtgaccgaactg

SEQ ID NO: 7219 - DNA, 2705 bp, Catharanthus roseus
gaagaattgtaaagtccattttatttgagaagtggtactgccacttgtgttgttcttgaagtgacccagtttttaataagcaacttgaagtggaatttcttatctggggttgtgattctttagtgaatcttcaatcccttttctgggttttgggtttctctttgattttctgttgatacagacagattgaggtatatatctgtgatggctctctgtgcatttgcatttccagggagtttgaacaaggctgtggcttcggaatctcttaataacagtcttttctgctccaattggctatatgggtcggatctgctttctccattccaatccaaaaaccaccaggtcatcaccagaaggcctaataatggagttcgggcatccctgtcagaaatgggggagtatttctcgcagagaccaccgactcctcttttggacagtattaattatccagttcacatgaaaaatctttctaataaggaattgaaacaactagcagatgaagtacgttcagatatcatttttaatgtttcaaagaccggtggccatcttggttcgagtcttggtgttgtagaactcactgtggctcttcactatgtcttcaattgcccacaagatagaattctttgggatgttggacatcagtcttaccctcataagattctgactggtagaagagacaagatgccaaccctgagacagacaaatgggctatctggattcactaaacgctccgaaagtgaatatgactgctttggggctggccacagttctaccaccatctctgcaggactaggaatggctgtcgggagggatctgaaagggagaaaaaacaatgttgtagctgtcataggtgatggagccatgacagccggacaggcatatgaagccatgaacaatgctggctatctggattctgacatgattgttatactcaatgacaacaaacaagtctccttgccgactgcaacactggatggtcctgctcctccagtaggagctctgagtagtgctttgagcaggttgcaatccaataggcctcttagagaactaagagaagttgccaagggggttaccaagcagattggtggtccagtgcatgagcttgctgcgaaagttgatgaatatgctcgtgggatgattagtggttctggatccacactatttgaagagcttggattctattatatcggtccagttgatggccacaacattgatgatcttgttgccattcttaaagaagttaaaagtaccaaaacaacgggaccagtgctgatccatgttgtcaccgagaaaggcaggggctatccatatgctgagagagcagccgacaagtatcatggagttgtgaagttcgatccatcaacaggaaagcaattcaaatccagcagcaacactcagtcttatacaacatactttgcagaggctctgatttctgaagctgaggcagataaagatattgtcgctattcatgcagcaatgggagggggaacagggatgaatcttttcctacgtcgcttcccaagacggtgctttgatgttggaatagcagaacagcatgctgtaacctttgctgcaggattggcatgtgaaggcttaaaacccttttgtgcaatctactcttctttcatgcaaagggcttatgaccaggtagtccatgatgtggatttgcagaagctacccgtgcgttttgcaatggacagggcaggactggttggagccgatggtcccacacattctggctcttttgatgtcacatttatggcttgccttccaaacatggtagtaatggctccttcagatgaatctgagctgtttcacatggttgcgaccgcagctgctatagatgacagacctagctgcttaaggtaccctagaggaaacggtgtaggtgtacagctgccacctggaaacaaaggccttcctcttgaggttggaaaaggtcggatattaatagagggagagagagtggcactcttaggctatggagcagcagttcaaaactgcttggctgcagctgcattggtagagtctcatggtttacgggtaacagttgcagatgcacgcttttgtaagccactcgatcatgaactgatacgtagccttgcaaaatctcacgatgttttgatcactgttgaggaaggatcgattggtggtttttcttctcatgtagctcagttcatgtccctagatggacttcttgatggcaatttgaagtggaggccattggttcttcctgatagatacatcgaccatggatcaccggctgaccaaatggcagaagccggtctcacaccgtctcatatagccgcaactgtttttaacatacttggacaaacaagagaggctttggaggttatgtcataaatcttcttaggatgaggtttctatttctcagaaaaagatagaatggttggagaaaattgctgtaaaatgtagtgttatgtacatttctttctcttgaatagtatcatcatatgattctgctaaatgattttaaggtctcatgtaacatggaaacaacagattaacatatatacaagaaaactctattgaggcttatatttagcagctttcataattagatatttagcagcttctatatttagctcattctcttatttaaatatttctatatgcagaaatcctaaatcttataggatatttacttttctaattgtttaggaaagtaacccactatataatgt

SEQ ID NO: 7220 - DNA, 2824 bp, Eucalyptus grandis
ggctcaggattaaagaagcttaccagtaagcattcactatagcaactctaagcattcactattaaccttccccctctctctctctctctctctctctcgctctcgcttggtggagtctctatcgaccacaaagacagtctaatttggaaaccgactctgccactactagcgccaattcaagtggtggcgaatacagagtaaagggtcgaccggtcgttcactcgatcattcattccaatacccactttcatctttttggcttactcgttttcccgtgttgccggggaatccgggttggtcgtttcctattctgggtctctgtttcttggagctccggcggtacaaattcccggttcttggagtcccctgcttttcgcttatttgctctgtggcccctttttaagctgttggcttccatcggtccgcgggtgcatcgggagatatggcactctgcgcattctcgttcccggcccatatcaaccgggccacagcttcggacgctcagaggaatgcctctctctcttctcatttcgtggggggctcagatctgctggtgcaatcccagcacagcctcgctcaggtccaggtgagaaaacgacctggtggggtttatgcatcactgtctgagagcggagagtattactccaagaggccaccaacacctctattggacaccgtaaactatcctcttcacatgaaaaatctagccatcaaggagctgaagcagctagcggacgagcttcgttccgatgtcatattcaacgtttccaagactggcggccacttgggctcgagcctgggtgtcgttgagctcaccgtggctcttcattatgtcttcaatgctcctcaagacaggatcctttgggatgtcggccatcagtcttacccacataagattctgactgggaggagagacaaaatgcaaacgattaggcagactaatgggttggcagggttcacaaagcgctcggagagtgaatacgattgctttggcactggtcatagttctacaactatctctgctggtttgggtatggctgttggaagggatctaaagggaaggaaaaataatgtggttgctgtcattggcgatggtgccatgactgcaggtcaagcttatgaagccatgaacaatgctgggtatttggactctgatatgattgtcattctcaacgacaacaaacaggtctcattgcccactgctaatcttgatggacctatacctcctgtaggagcgttgagcagtgctctgagtagattacaatctaacaggcctcttagagaacttagagaagtcgcaaagggtgttaccaagcaaattgggggacctatgcatgaactcgctgcaaaagttgatgaatatgctcgagggatgatcagtggatctggatccaccctgttcgaagagcttgggctctattatattggtcctgttgatggccataacattgatgatctagtttcgattctcaaagaggtgaagagtaccaaaacaactggtccagttctgatccatgttgtcactgagaaaggtcgaggatacccttatgctgaaaaagctgcagataagtaccatggtgtggttaaatttgatcctgcaactggaaagcagttcaaatcaagcccagccacgcagtcttacactacatactttgccgaggctttaattgcggaagcggaagcggataaagatattgttgctattcatgctgcgatgggagggggcacagggttaaatctcttccttcgccgcttcccaaccagatgttttgatgttgggattgcagaacaacatgccgtcacttttgctgctggtctagcgtgtgaaggcattaaacctttctgtgcaatctactcgtctttcttgcagagggcttatgaccaggttgtgcatgatgttgatctgcagaagttgcctgttagattcgcgatggatcgagcaggactggttggagctgatggccctacacactgcggtgcttttgatgttacttttatggcatgcctccctaacatggtggtaatggctcctgcggacgaggcagagcttttccacatggtggctactgctgctgccatcgacgacagaccaagttgtttcagatacccacgaggaaatggagttggcgttccgctgccgccaggaaacaaaggcacaccacttgagattggaaagggaagaatacttttagaaggagagagagtggcgctcttgggctacggaacagcggtgcagggctgcttagctgcggctgcattgattgaaacccatggcttcaaaataacagttgctgatgcgcgcttctgcaaacctttggatcatgcccttatccgaagccttgcaaaatcgcatgaggttttgatcacagtcgaagaaggttcaataggagggttcgggtctcacgtcgctcagttcctggcccttgatggccttcttgacggcacagtaaagtggaggcctcttgttctgcccgatcgctacattgaccatggatcgcctgccgaccaaatagctcaagccggtctgaccccagcacatatcgcagctactgtattcaacgtagtaggaaaaacaagggaagctttggaaatcatgacataaaggaattctcccacaggctcttttttttattctctcacaccatgtacaaacaggatgctacaacaataacagtatagcttgtcacaagtcatttgtcgatctgtagtgctcttattgttgcaatgtgggcgattcattatttataagaagagcatcaccatatacgctaggggaaaaaagtgaagaataaaggaaagacaaataagaaaaggaaagataaat

SEQ ID NO: 7221 - DNA, 2673 bp, Lotus japonicus
ctttgtcggtttcctttctccattcctagttcttcccacctctctctctctctctctctctctccaccatcatcactcacattctgctagtgccccattataaaaccttcaacctttgacctttttcattcactctttcccctttttgttaacattccctcttccattgttttctgggtatctcttgtttctgtctctgaattctgttttcttcagtttctggttggctttctctgtcatggatctctgtgcatttgcttgtcctgcctttgtgaaccgagtcacaccttctgagcctcgaagattacttcattctcaatggggtgttgatttgctcagcctctctcagctcagacactaccaggtgaagaaaaagtgtggtggtggggtttatgcttcactatcagagaggggggagtattattctcaaagaccgccaactccgttactggacaccataaattatccaattcatatgaaaaatctctctgccaaggagctgaaacaactagcggaggaactgcgttctgatgttattttcagtgtttctagaactgggggtcatttgggctcaagccttggtgttgtggaactcactgttgccctacactatgtcttcaatgcccctcaggacaagatactgtgggatgttggtcaccagtcatatccacataaaatactcactggtagaaggggtaagatgcataccttgagacagactgatggattatctgggtttacaaaacgctctgagagtgaatttgattgttttggaactggtcacagctcaacaactatttcagctggacttggaatggctgttggaagagatctgaagggaaaaaagaataacgtaattgctgttattggtgatggggccatgacagcagggcaagcttatgaagctatgaataatgctggatatctcgattctgacatgattgttattctaaatgacaacaaacaggtctctctgccgactgctaatcttgatggaccgataccaccggtaggagctttgagcagtgcactcagtagattacaatcaaacagaccacttagagaactcagagaggtcgccaaggggttaacgaaacaaattggagggcctatgcatgaattggccgcaaaggttgatgaatatgctcgtggcatgatcagtggttctggatcatcactttttgaagagcttggactttactatattggtcctgttaacggtcataacatagatgatcttgttgccattctcaatgaagttaaaagtacccaaacaactggtcctgttttaattcatgttatcacagaaaaaggccggggatacccatatgcagagaaagcagcagacaagtaccatggagttaccaagtttgacccaacaactggaaagcaattcaaagccaaggctaccacccagtcctacacaacatactttgcagaggctttaattgcagaagctgaagctgacaaagacattgttgcaatccatgctgcaatgggaggtggaactggcatgaatctcttcctccgccgtttcccaacaagatgctttgatgtggggatagcggaacagcatgctgttacatttgctgcaggtctagcttgtgaaggtgttaagcctttctgtgccatttactcatcattcatgcagagggcttatgaccaggtggtgcatgatgtagatctgcagaagctgcctgtaagatttgcaatggacagagctggattagttggagcagacggtcccacgcattgtggtgcttttgatgtcacttttatggcatgcctccctaacatggtggtgatggctccttctgatgaagcagagcttttccacatggttgccactgcagcagccattgacgatcgaccgagttgtttccggtacccaaggggaaacggcattggtgttgaactaccaaaagggaacaaaggcattcctcttgaggttggaaaaggtaggatacttattgaaggagaaagagtggccctgttgggctatggaagtgctgttcagaactgtttggctgcagcttccttagtggaacgtcatggcttacgcataaccgttgccgatgcacgattctgcaagccattggatcggtccctgattcgcagcctggcaaaatcacatgaggttctgatcacagtagaagaaggatcaattggaggatttggttctcatgttgctcagttcatggcccttgatggccttctagatggaaaattgaagtggaggccagtggttcttccagatcgatatattgagcatgggtcgcctaatgatcaattgtcttcagctggtcttgcaccatctcacatagcagcaactgtgttcaacattcttggacagacaagagaggcactagaagtcatgtcatgaaagataatgtagtgtagggggttcaaaatttcagtccccacaatgtacaaagaaatcatgattcaccttgtgtaatttgaagaagtaacatattgatgtaaatttatttgagtggatcatgcaggctttcaaattatcaaatagcaatacctactagttgcagaggagagaaaaaaaaatcctaactttttcgatgggttcaaaaggaaacccattatattacctgaactgaaatttaaagttgataggttaaagaaaacattgccttcttggtaaggaagttagttcat

SEQ ID NO: 7222 - DNA, 2469 bp, Glycine max
gcaaacgtagaatcaaatcaatccctcctgcgttcttcaatttattttctttctgcttctcatggatctctcctcactctcttcataccgcactgtcggagtaacaccttctgatcctcgaaaatcacttcctcaatggggtcttcatttcctctcctacactcacaggctcaaccagattaagaaaaggtcaagtggggtatatgcatcactatccgagagagagagaggagagtattattcccagagaccgccaactccgctactagacaccgtcaactatcctattcatatgaaaaatctctctaccaatgagctgaaacaactcgcagatgaactgcgttctgatgttattttcagtgtttctagaactgggggccatttgggctcaagtcttggtgtggtggaactcaccgttgcactccactatgtctttaatgcccctcaggacaagatactctgggacgttggtcaccagtcttacccgcataagatactcaccggtaggagggacaagatgcataccatgaggcagacaaatggcttgtctggcttcaccaaacgttccgagagtgaatttgattgttttggcactggtcacagctccaccactatttcagccggacttggaatggctgttgggagagatctgaagggaagaaagaataacgtggttgctgttataggtgatggtgccatgacagcaggccaagcttatgaagccatgaacaatgctggatatcttgattctgacatgattgttattctaaatgacaacaaacaggtctctttaccaactgctactcttgacggacccataccacctgtaggagccttgagtagcgctctcagtagattacaatcaaataggcctcttagagaattgagagaggttgccaagggagttactaaacgaattggaggtcctatgcatgaattggctgcaaaagttgacgagtatgctcgtggcatgatcagtggttctggatcatcactttttgaagagcttggactctactatattggtcctgttgatggtcataacataaatgatcttgttgccattctcaatgaagttaaaagcactaacacaaccggtcctgtattgatccatgttatcactgaaaaaggccgtggatacccatatgcagaaaaggcagctgacaaataccatggggttaccaagtttgatccaccaactgggaagcaattcaaatccaaggctaccactcggtcttatacaacatactttgctgaagctttgattgcagaagccgaagctgacaaagacgttgttgcaatccatgctgctatgggaggtggaactggcatgaatctcttccatcgccgtttcccaacaagatgctttgatgtggggatagcagaacagcatgctgttacatttgctgcaggtctggcttgtgaaggtcttaaacctttctgtgcaatttactcatcattcatgcagagggcttatgaccaggtggtgcatgatgtggatttgcagaagctgcctgtaagatttgcaatggacagggctggattagttggagcagatggtcccacacattgtggttcttttgatgtcacatttatggcatgcctgcctaacatggtggtgatggctccttctgatgaagccgaacttttccacatggttgccactgcagcagccattaatgatcgacctagttgtttccgatatccaaggggaaatggcattggtgttcaactaccaactggaaataaaggaactcctcttgagattgggaaaggtaggatattgattgaaggggaaagagtggctctcttgggctatggatcagctgttcagaactgtttggctgcagcttccttagtggaacatcatggtttgcgtgtaacagttgctgatgcacgtttctgcaaaccactggatcgttccctgattcgcagcctggcaaaatcacatgaggttttgattacagttgaagaaggatcaattggaggatttggttctcatgttgctcagttcatggcccttgatggccttatagatggcaaattgaagtggaggccaatagttcttccggatcgttatatcgaccatggatcacctgctgaccaattgtctttagccggtcttacaccatctcacatagcagcaacagtgttcaacatactaggacaaacaagagaggcactagaggtcatgtcttagaaatattaaggggttcaatttttcactttacacgatgtacaatgcataacatgattcaccacgtgtaatataatatgaaaaagtaatgtaatactgtgaaattttgaagtatatgatgcaggtcgtcatatggtaaaacaactagttataaaggagaaaaatctgaacttttatgtaagtgcaaaagaatagcctttctgacatggtctaaactgaatttgaaatctgacgtgaagatgaagaaagcaaacattgctaatttgctgtgg

SEQ ID NO: 7223 - DNA, 2512 bp, Triphysaria pusilla
aaggaaaaaaagcaatttaattccaagagatcttctttttacacaactcattttaaacacttcaaagaatccttgcatttgttccaatctctctctcacacacacatttcccatgaaaatctctcagaaacaagaaagaaaggcaaaacagaactaaaaagcccatttctacctgcccacccaataaagtttgaatctttgttgatattattctgagatctgtaaaagtatatatatacttgatggctctttgtacatttagctttactgggaaatatgttagcaatggcttattgggttcagatactcaaaggcaaacaagtttatgctaccagtccccttttcacaagaataaccaggagagaaaaagggctattcgagtttatgcatcattgtccgaaaatggcgaatatttttcaagaaagcctccaacccctcttttggacaccatcaattacccaattcacatgaaaaatctctccacaaaggaattgaaacaacttgtcgatgaactaagatcggatgtaatatttaatgtctcgaacactgggggccatctcgggtcgagcctcggtgtagttgagctaactgtggctcttcattttgttttcaatgctccacaagataggatactttgggatgttggtcatcagtcttatccgcacaaaatcttgaccggaagaagagacaagatgccgactttaagacagactgacggtctttctggctttactaagcggtctgagagcgaatacgattgtttcggtaccggtcatagttctacaactatatctgctggattaggaatgtcggtggggagggatctaaaaggaagaaagaatcacgtggtggccgtgataggtgacggggctatgacagctggacaggcctacgaagcaatgaacaatgcaggttacttggactcggatatgatagttattcttaacgacaataagcaagtttcgttacccacggctaatctggacgggcccactgctcctgttggagcattgagcagtgctctgagcaggttgcagtcgaaccggccactcagagagctaagagaagttgctaagggagttacaaagcagctcggagggcccatgcacgagctggcagcaaaagtggacgaatatgctcgtggtctgataagcggttcagggtcaacactcttcgaagagcttgggctttactatatcggcccggttgatggtcacagtatcgatgatctaaccgcaattcttaaagaagtcaaaagtactaaaacgacaggcccggtgttgatccatgtcatcaccgagaaaggccggggatatccttatgctgaaaaagctgcagataaataccacggagtgacaaagttcgatcctgcaaccgggaaacaatttaaaaccagcgcaccgactcagtcttacacaacctactttgccgaggctttgatagcagaagcagaaaaggacaacgatattgtcgctattcatgctgcaatgggaggtgggaccggcttgaacttattccaacgccgttttccgacgagatgtttcgatgtcgggatagctgaacaacatgccgtcacttttgctgccggtttagcatgtgaaggcgtgaaaccattttgtgcaatctattcgtctttcttgcaaagagcttacgaccaggtagtgcatgatgttgatctacaaaagctgccagtgagatttgctatggacagagccggtttagtaggagcagacgggcccacacattgtggggctttcgacgtcacatttatggcttgccttccaaacatggtagtaatggctccatcggacgaggccgagctatttcacatggttgcaactgctgctgctatagacgacagaccaagctgtttccgttatccaagaggcaacggtataggagcagagctgcctaacggaaacaaaggcaatccgctcgaggttgggaagggacgtatactgattgaaggggagagagtggctttattgggttacgggacagccgttcaaagctgtatggctgcagcggccttggtagaatcgcgtggtctacggttaacggttgctgatgctcgtttctgtaaaccgttggattatggtcttatacgtagcttggccaaatcgcacgaggtcttaatcactgtggaagaagggtcgattggtggttttggatctcatgtggttcagttcatggcattggatggacttcttgatggcaagttaaagtggaggccaatggttcttccggatcggtatatcgaccatggatctccgaactatcaacagatggaagcgggtttaatgccttctcatattgcggcgacggtttttaatatacttgggaaagctagggaggctctggaggttatgttgtagatgcagagctaaggatatatgaaaattgagaaaaaacaagactttgttctaccaatggatataatattatattacagatcaaatgctatttttgtttataagatactaataatagcaactttgtttaatcaattgga

SEQ ID NO: 7224 - DNA, 3330 bp, Theobroma cacao
aggagaccagattgtaggtggtaaaggacaaacccatctctccatcgaggaatagatacaatggaaaaagtaggcgggcattgcacaatctatctcccaatctatccactcctgatttccattgacgtggcccaatgagagaacgacctgccacctcaatcgtgaagcattgcagcctagccttgctgtccctgtaataataaaacccctgtaatgaattgaaagccaaagactaaaaagctccgtgtctttcttggtttattttctagtcttttaaccgtcacttttagtccacaggcgtgttcggaagactgatttctcttttatttttttcttatttatgtttgtttatttttaagaaattaggcttagtccaaattcaagttactcctccactagcatcagcaataaacacagtgaaaagacaggccatagccatgaccaaatactttataaatcttcttcgttgagtggatttctttcactcttgcactctaaacggcggagactttttctgggttgttctcattttgagctctagtgacagctttttttaagaggcctgttaatagttccatttctctctgtatattcttggccatggctctctgtgcattttcatttcccgctcatatcaaccgggcagcagcttcagatcctcaaaagtctacttcttttgcttcccatttgcttggtgggacagatctgcttttccagccattacataagctcaatcaggtgcaggtcaggaaaaggccaggtggggtttgtgcatcactatcagagagagcagaatatcactcccagagaccaccaacacctctcttggacactataaactatccaatacacatgaaaaatctttctgtcaaggaactaaaacaactagcagatgaattgcggtctgacgtaattttcaatgtttcaaaaactgggggtcacttaggctcaagccttggtgtggttgaactcactgtggctcttcattatgtcttcaatgcccctaaagacaaaatattatgggacgttggtcatcagtcttaccctcacaaaatcttgactgggagaagagataagatgtatactatgaggcaaactaatggattggcaggattcacaaaacgatcagagagtgaatatgattgctttggcactggtcacagttcaaccacaatctctgcaggcttgggaatggctgtgggcagggatctaaagggagaaaggaataatgtagttgctgttataggtgatggtgccatgactgcagggcaagcttatgaagccatgaacaatgcgggatacctggattctgatatgattgttattcttaatgacaataaacaagtttctctgccaactgctacgctagatggacctataccacctgtgggagctttgagcagtgctcttagtaggctgcaatcaaacaggcctcttcgagaactaagagaggttgccaagggagttaccaagcaaattggtgggcctatgcatgaactggctgcaaaggttgatgagtatgctcgtggaatgatcagtggttccgggtcaacactttttgaagagcttggactatattatattggacctgttgatggtcacaatatagatgatttagtatctattctcaaagaggttaagagtactaaaaccacaggtccggttttgatccatgttgtcactgagaaaggccgaggttatccatatgcagagagagctgctgacaagtaccatggagttgtaaagtttgatctggcaactggaaagcaattcaaaggcagttctgctacccagtcatacactacatattttgcagaggctttgattgcagaagcagaggctgacaaaaatattgttgccatccatgctgcaatgggaggtggaacaggattaaatctcttccttcgccgtttcccagagagatgttttgatgttgggatagcagaacaacatgctgtcacttttgccgcaggtctggcctgtgaaggcctcaaaccattttgtgcaatctactcatcatttatgcaaagggcttatgaccaggcaagctactaaagctttctacattatttcctatcttttacaaattgttgtacatgatgttgatctgcagaagctgcctgtaagatttgcaatggacagagctggccttgttggtgcagatggtcccacgcattgcggggcttttgatgtcacttttatggcatgcctccccaacatggtggtcatggctccctctgatgaagctgagctttttcacatggtagccacggctgctgccatagatgaccgtcccagctgtttccgttacccaagaggaaatgggttgggagttcaggtgccacctggaaacaaaggagttccacttgagattggaaaaggcagggtactgattgaaggggaaagagtggcactattaggctatggatcagcagttcagagctgtttaggtgctgcctctttattggcatcacatggcttacggttgacagttgcagacgcccgattttgtaaaccattggatcacactctcatccgcaagctggcaaaatcacatgaggttctcattacagtggaagaaggatcaatcgggggctttggttctcatgtcgcacagttccttgcccttgacggtcttcttgatggcacagtaaagtggaggccacttgttcttcctgatcggtatatagaccatggatcaccagctgaccagttggccgaagctggtcttacaccatcacacattgctgcgacagtattcaatgtactcggacaaaaaagagaggctcttgagattatgtcctcaagaaactgaagaaccccatcagcttgaatttcccataatgtacaaaattttgtttttcctgttacattgatgtaaaaagaagaatcacatcctaggaattgtactactttgccatataatgtaatatgtaacagaacaatttgatttaaacttatgaagtaatatctgaatttacaaatcttggaagtcttgccacctttggcataatagtacatttatggctaagtaattggctactgtcctatcttctagcccatcatgttgtcagcaatttgttggtattaaatcaaagggagccatcctgcgttttatgaaattcttccaccgtcaagcatgttgttagatcattcaggtttagtggatggcaatgtcatcaacagtgacacatgtatgagaacattaagagttaaatctatgcatgcatgacacttggccaagttgtagttgtcttcaaaagcttgttagtggcattgaattttcaacagcaaaatggtacacatgattaatttgcttaaaaagtttat

SEQ ID NO: 7225 - DNA, 2707 bp, Malus domestica
gagtaatcacatatacaaagtcaccatttttggtctttgaaaaaagctcttaatttccaatacactgctcatccactcattctctctctctctctctctctctcccccccacccccccttctctttattttattcagtaactcccactgacactatcaccatttcagtggggaaaactctgagactcccagagaccttagtttcttaatacccttttctgggttcctctccatttcacctctgattgcaaatttgaagctcttgagctccatttcttcttcttcttcttcttgttgttcttgtatatgcaatggctctctgcgcattctcatttcctgcacatatcagcaaaccagcagcatctgcagatgctcagaaatcccacttctctgtgggaacacctcttccatgcccatctcagcagaagctcaatcaggtgatgagaaaaaggccaagtgggatttgtgcatcactgtcagagagaggggagtatcactcacagagacctcccactcctctcttggacaccatcaactatccaattcacatgaaaaatctttctgtcaaggagcttcaacaactagcagatgagctgaggtctgatgtgatcttcaatgtttcaaaaactggaggccacctcggttcaagccttggtgttgtggagctcactgtggctcttcactatgtcttcaatgctcctcaggacagaatcttgtgggatgttggccatcagtcttacccacacaaaatcttgactggaaggagagataagatgcacaccatgagacagacaaatggattagccggcttcactaagcgctctgagagcgaatacgattgctttggcactggtcacagttccaccaccatctctgcaggcttggggatggcagtaggaagggatctaaagggaggaaacaatcatgtagttgctgtaataggtgatggtgccatgacagcaggacaagcatatgaagccatgaacaacgcggggtacctcgactctgacatgattattattcttaatgacaataaacaggtttctttacctaccgctagtcttgacggacccatcccgccggtaggagctttgagtagtgctctcagtaggttgcaatcaaacaggccgctcagagaattaagagaggtcgccaaaggtgttactaaacaaattggtggccctgtgcataatctggcagcaaaagttgatgagtatgctcgaggaatgatcagtggtactggttcttcgctatttgaagagcttggactatattatataggtccagtcgatggtcacaacatagatgatcttatttccattctcaaagaggttaaaattaccaaaacaacgggtcctgtcctgatccaccttatcactgagaaaggcaggggatatccgtatgcagaaaaagcggcagacaagtaccatggagtggccaaatttgatccggcaaccggaaagcaattcaaagcaagtgctagtacacaatcttacacaacatactttgcagaggctttgattgcagaagctgaagcggacaaagatattgttgctatccatgctgcaatgggaggtggaacagggatgaatctcttcctccgccgttttccaacaagatgctttgatgttggaatagcagaacagcatgcggttacttttgctgctggtctggcctgtgaaggcctaaaacctttctgtgcaatttactcatctttcttgcagagagcttatgaccaggtagtacatgacgtagatttgcaaaagcttccggttagatttgctatggacagagctgggctggtcggagctgatggtcctacgcattccgggtcttttgatgtcactttcatggcatgccttcctaacatggtggtgatggccccttctgatgaggcagagcttttcgatatggtagccactgctgctgccatagatgaccgaccaagttgtttccgatacccaagaggaaatggggttggtgttgagctgccactagggaataaaggaactcctctcgaggtaggaaaaggaagaatattgatcgaaggggaaagagttgcacttttgggttacggagcagcagtacagagctgtttggctgcctcctctttggtggaatcccatggtttgcaccttacagttgctgatgcacgattttgcaaaccactggaccgagctctcattcgcagccttgcaaggtcacatgagtttctgataactgtggaagaaggatccatcggagggtttggttctcacgttgctcatttcctggcccttgatggccttcttgatggaaaactcaagtggagaccaattgttcttcctgaccggtacattgaccacggttcccctgctgatcaattggccgaggccggactcaccccttctcacattgcagcaaccgtattcaatatgcttggacaagcaagagaggccctggagataatgtcatgaagacagaaatttacaaagcagcaccattttttttgctgtatacaaaaccgaaactgtgacgctctctatttccatccgtataaaaagtcccatatttgagcaaggtgttgcattaggtagctgaaggaaacctaaacaattcagttcatcaattaggagctccaactagttgaggcacctgagattgtaacatgtcctacaaacgcaagaaccgatttgtgactagaagaaaactctttttgagtcttttgc

SEQ ID NO: 7226 - DNA, 2900 bp, Euphorbia peplus
ttgaacgtgatcgaatccggctgaatacccttcctttccatctcatctatcaccccaaatgcacaatctttcctccccatttcacaataccctttaatcaaagtgttatacgaaacaacatcaggtacaatccctaaaccctcaggtaaacccctaataatctcctcgagttgatcatacttcccggcatcaatacacgcagccaacagcgcgttaaacgaacgcgtggtccgctcgcatttcagctcaggcatttcatcgaacagtttgttggcatgatcaaacatcccggcgcggccatagaggaggataaggcgcgtggtgaaattctcattggtgatgtcatcatacttcttttgatgttcgacgatttcttcgaccatggaaagttggttggcggattttaggcggcggacgacggcgaaatagtctttgtggttttgggcgcggaatttcggggactccgacgattttttgaggtcgtcgacgagtttttgaagcttgtgggacttccgggtgacggtggtcggagttgaggcggcgacgagtttttgaagcttgtgggacttctgggtgacgttggtcagagttgcggcggcggagagtttttgaagcttatgggacttccgggtgacggtggccggatttgcggcggcgacggcggcggaggtggtggcgcgaacgttgaagatagcatggagacggctgtagaggacgacattttttgttagttgtttttgtttatccattaatggctctttgtgcattttcatttcctgctcatgtgagttcagatctgtgtaaggatggttatggttcttggcattctttgtggagaagaacagagaaatctcagcataaacttaatcaggctaaacaaaaaagaaggcaaagtggggtttgggcaacactatcagaaagaggggaatatcagtcccaaaaaccagcaactcctctcttggacaccataaattacccaattcatatgaaaaatctttcaactaaggagctaaaacagctagcggatgagctgaggtctgatgtgattttcaatgtttcgaaaaccggaggtcacttaggatcaagccttggtgttgttgagttaactgttgctcttcactatgtttttaatacccctcaagacaggattctctgggatgttggccatcagtcatatccacacaaaatcttgactggtagaagagataagatgcacacaatgagacaaacaaatggactttctgggtttaccaaacgctccgaaagcgaatatgattgttttgggactggtcatagctctactaccatttctgctggtttaggaatggcggtcggccgagatttgaaaggaaaaagtaacaatgtagttgcagttataggcgatggagccatgacagcaggtcaagcttatgaagctatgaacaatgccggatacttggattccgatatgattgttattcttaacgacaacaaacaagtctcgttaccaactgctaatctggacgggccaattcctcctgtcggagctttaagcagtgctcttagtcggctgcaatccaacaaacctcttcgagaactaagagaagttgcaaagggcgttacaaagacgattggtggaccaatgcatgaattggcagcgaaagtcgatgaatatgctcgtggtatgatcagtggttcgggttcaactctttttgaagagcttggactatattatattggtccggttgatggtcacaacattgatgaccttatcgccattctcaaagaggttaagagtactaaaactactggtcctgtcttgatccatgttgtaaccgagaaaggccgcggttatccttatgctgagaaagctgcagacaagtaccacggagtgacgaaattcgatcctgctaccggaaagcaattcaaggccagtgcaagtacacagtcatacacaacatacttcgcggaggcattgatagcagaagccgaagcagacaaggatatagttgcaattcatgctgcaatgggaggcggaacaggcttaaatatgttccttcgtcgattcccatcacgatgcttcgacgttggcatagcagaacagcacgctgttacatttgctgcaggactcgcttgcgaagggcttaaacccttttgtgcaatctattcatcttttatgcagagggcttatgaccaggttgtacatgatgtagatttgcagaagttgcctgtgagattcgcaatggatagagcagggcttgtcggagcagacggtccgacacattgtggagcttttgatgtaacttttatggcatgtcttcctaatatggtagtcatggctccgtctgatgaagccgagctttttcatatggttgcaactgctgctgcaattgatgatcggccgagctgtttccggtatccgagaggtaatggcattggagttcagctaccaccaggaaacaaaggcatcccacttgaggttggaaaaggaaggatcttgatggaaggagaaagagtggcactattgggatatggaacagcagttcagagttgcttggctgcagcatctataatggaatcacatgagatcagtataacagttgcagatgcaagattctgcaaaccgttggatcatgatcttatacgtagactcgctaaatcgcatgaaatcttgattacagtcgaagaaggatcaattggtggttttggttctcatgttgctcattttctagctcttgatggtcttcttgatggcaaactaaagtggcggccgattgttcttcccgatcaatatatcgagcatggatcgccagcggatcaattggtttgggcaggtctaacaccatctcacattgcagcaaccgtatttaacattcttggaaataaaagagaggctctacagataatgtcctcttaaaaga

SEQ ID NO: 7227 - DNA, 2970 bp, Glycine max
accttgttcctcacaataattctctcctacctcttgtgttttgcttcagtcatgtctctctctgcattctcattccctctccatctgagacaaacaacaccaccttctgatcctaaaacatcatcaacccctttgcctttgtcttctcactcccattggggtgcagatctgctcacacaatcccaacgcaaactcaaccaggtgaaaagaaggccacatggggtatgtgcatcactatcagaaatgggggagtattattctcagaaacctcctactccactgttggacaccataaactatccaattcacatgaagaatttggctaccaagaaactgaaacaacttgcggatgagctgcgttctgatgttattttccatgtttctagaactgggggtcatttgggatctagccttggtgttgtagaactcactattgcccttcactatgttttcaatgctcctaaggacaaaattttgtgggatgttggtcatcagtcttatcctcataagatactcactggtagaagggataagatgcataccatgaggcagacagatggattggccgggtttacaaaacgatctgagagtgattatgattgttttggcactggtcacagctccacaacaatatcagcaggactgggaatggctgttgggagggatctgaagggagacaagaataatgtagttgctgttatcggtgatggtgctatgacggctggtcaagcttatgaagccatgaacaacgctggatatcttgattccgacatgattgttattctaaatgacaacaagcaggtctccctaccaactgctaatctcgatggtcccataccacctgtaggtgctttgagtagtgctctcagtaagttacaatcaaacagacctcttagagaactcagagaggttgctaagggagtcactaaacaaattggtggcccaatgcatgagttagctgcaaaagttgatgaatatgcgcgtggcatgatcagcggttctggatcaacactatttgaagagcttggactttactacataggtcctgttgatggtcataatatagatgatcttgtgtccattctaaatgaagttaaaagtactaaaacaactggtcctgtgctgctccatgttgtcactgaaaaaggccatggatatccatatgcagaaagagcagcagacaagtaccatggagttactaagtttgatccagcaactggaaaacaattcaaatccaatgctgccacccagtcatacacaacatactttgcagaggctttaattgctgaagcggaagctgacaaagacattgtcggaatccatgctgcaatgggaggtggaactggcatgaatctcttccttcgccgtttcccaacaagatgctttgatgtggggatagcagaacagcatgctgttacatttgcggctggtctggcttgtgaaggccttaagcctttttgtgcaatttactcatcatttatgcagagagcttatgaccaggtggtgcatgatgtcgatttgcagaagctgcctgtaagattcgcaatggaccgagccggattagttggagcagatggtcccacacactgcggtgcatttgatgtcacttttatggcatgcctccctaacatggtggtgatggctccttctgatgaagcagagctttttcacatggttgcaactgcagctgccattgatgatcgacccagttgtttccgatacccgaggggaaatggtattggtgttgagctaccactagggaataaaggcattcctcttgagattgggaagggtaggatactaattgaaggagaaagagtggccttgttgggctatggatcagctgttcagagctgtctggctgctgcttccttgttggaacatcatggcttgcgcgcaacagtggcggatgcacgtttctgcaagccattggaccgttcccttattcgcagccttgcccaatcgcacgaggttttgatcactgtggaagaagggtcaataggaggattcggatctcatgttgttcagttcatggcccttgatggccttcttgatgggaaattaaagtggaggccaattgttcttcctgattgttacattgaccatggatcaccggttgaccaattgagtgcagctggtcttacaccatctcacatagcagcaacagttttcaatctacttggacaaacaagagaggcactagaggtcatgacataaaacaaatgcaaaggggttcaatttttgttccctgcaatgtacaaagtagcgtgattcacccagtgtaatacaaatgtgtttgttaaaaaataatagaaatggaaaatgcagattgacaaataatagtgccaacaaatggttaaacgaataaacaaacacaattggtagtgtatcttcatattttgatatgacggggaaaagatttagctgaaggcatgacagaaacgaatttttagctatgagaggactcttgaatgtgaatgtcgaagatgacgttggtatgccattacatcttagtcattgaaaatgtccctaagaggtccacctaaacatttgcattacgttctagtggaaaaagtaaagtccaaaaaaattattatcctcatggcaaacagcttttggtaatttaagatatcgaatttcctcattctttctgtgtagctcttgtagaattttgtaacttcatttatggcactaccatggttgaatttttcatcaatttcccatggcttcaagtcttccattattatcctttgtgtttcaaaggtggtaggcagaccagtatctcttacccaagggcaaaatataaattttatggcttgaagtcttccatcatttatggcactaccatgctttattccaagtcaaaagaaaacatctataatatcaattttgccaagggaaaaatatagtttgtaccaaggatgattaaccaagttccaccatggtacttgtccggaatctgaaagaaac

SEQ ID NO: 7228 - DNA, 2601 bp, Manihot esculenta
tcggccccgcttctaaacctttctcccgacatcttctttgtctgttaagagctcattttattactgaaatccaccccattgcggttcttttattaaagtatcacaatctcattagcggttcatttggacccataaccggaatctgtccttttgtttctgggttcttttaattcttcctcctctttgcttgtttctgtattcaaatttggaacttgttttgagctccttctgttgattttctatctgcaatggctctctctgcatgttcatttcctgctcatgcaaacagggctacaatctcagatcttcagaagtacagttatgtctcttctcatttcttatggagagcagatctattggctcaatctcttcacagacttaataaggtaaagagcaagaaagggccaggaggggtttgtgcatcactgtcagagagaggagactatcactcgcagagaccaccaacacctctattggataccataaactatccaattcatatgaaaaatctatcaatcaaggaactaaagcaactagcggacgagctgcggtccgacgttatcttcaatgtttctagaactggaggtcacctgggatcaagccttggtgttgttgagctcactgtggctcttcactatgttttcggtgctcctcaagacaagatactgtgggatgtcggtcatcaggcttacccacacaaaatcctgactggaagaagagacaagatgcacactatgagacagactaatggactttctggcttcacgaagcgatcagagagtgaatatgattgctttggaactggccatagctctaccactatatctgctggcttggggatggcagttgggagagatctaaaaggaagaaagaacaacgtagttgctgttataggcgatggtgccatgacagctggacaagcttatgaagctatgaacaatgcggggtatctggactctgatatgattgttattctcaatgacaataaacaagtttctttaccaactgctacccttgatggacccataccaccagtgggagctttgagcagtgctcttagtagattgcaatcaaacaggcctctcagggaactaagagaggttgctaagggtgttacaaagcggattggtggacccatgcatgaattggcagcaaaggttgatgaatatgctcgtggtatgatcagtggttctggatcaacgctctttgaagagcttggattatattatattggtcctgttgatggccacaacatagatgatcttatatctattctcaaagaggttaagagtactaaaactacaggtccagtcttgatacatgttgtcactgagaaaggtcggggatatccatatgctgagcaagctgctgacaagtaccatggggtgaccaagtttgatcctgcaacaggaaagcaattcaaggcaagtgctagtacccagtcctatacaacatactttgcagaggctttgattgcagaagcagaagcagacaaggatattgttgcaattcatgctgcaatgggaggtggaactggcttaaacctcttccttcgtcgtttcccaacaagatgctttgatgttggaatagcagaacagcatgcagttacatttgctgcaggattagcctgtgaaggccttaaaccattttgtgcaatctactcatctttcatgcagagggcttacgaccaggcaagccagtatatattcttggtagtacacgatgtggatttgcagaaactgccagtgagatttgcaatggacagagctgggctggttggagcagatggtcccacacattgtggagcatttgatgtcacttttatggcatgcctccctaacatggtggtgatggctccttctgatgaggcagaactttttcacatggttgctactgcagctgccatagatgatcgtcctagctgtttccgatatccaaggggtaatggtgttggcgttcagcttccctcaggaaacaaaggcattcctcttgaggttggtaaaggcaggatattgatagaaggggaaagagtggcactcttgggttatggtacagcagttcagagctgtttggctgctgcctctttagtggaaccccatggacttcgtataacagtagcagatgctagattctgtaaacctttggatcatgccctcattcgaagcctagcaaaatcacatgaaattttgataacagttgaagaaggatcaattgggggctttggatctcatgttgcccattttctggcccttgatggtcttcttgatggcaagctgaagtggcgaccgctcgttcttcccgataggtacatcgaccatggatccccggctgaccagttggtacaggctggtctaacaccatctcacattgcagcaacagtattcaacatacttggaaatagaagagaagctcttcaaataatgtcatcatagagaaagtggaaacattccagttttgcactttgcaatattgtaaaatagaacaacagcaagatctattgtcatcttccatttgtgtatgatatgtaatttcagaatcaatattgcagcatcatgtaacagcaccaacttcgattagaatcaatgaaatatatatatatac

SEQ ID NO: 7229 - DNA, 2564 bp, Helianthus annuus
tacgcggggaacccaacccaacccaaattcaccaccaccgtaaaccaccgctccaatccaccacaaccccacctctgatcaccacccacattcccattttttcttcaaatccaacattcccaccatggcgctttgtgggtttgcatttccaatcaaccaccggtcgatcagttcccacacaattcaacattgtttctttggtaaagatctgcatcagggtcaatcttgttcgcacaaaccctttaatcagttgagtaaaagatcaggtgttgttcaagctacactgtctgaaagaggtgagtatcactcacagagacctcctactccacttttggacaccataaattacccaattcacatgaagaatctgtccattaaggaattgaagcaattagctgatgagcttaggtctgatgtcatctttaatgtatcgaaaaccggtggtcacttgggttccagccttggtgtggtggagcttacggtggcgcttcattacgtgttcaatacgccacaagataagatactttgggatgttggtcatcagtcttacccgcataaaatattgactggaagaagggaccggatgcataccattagacaaacaaacgggctggcgggtttcaccaaacgggctgaaagcgagcatgattgttttggcacgggccatagttcaaccaccatttctgcagggttaggcatggctgtggggagggatttaaaaggtggaacaaacgacgtagtagctattataggtgacggtgcgatgaccgcgggtcaggcttacgaagccatgaacaatgcgggttatctagattctgatatgatcgtcatccttaatgacaataaacaagtctcgttaccaactgcaacacttgacgggcctatacctcccgttggagctttaagcagcgctcttagtaggttacagtctaaccgtcctcttagggaactgcgtgaagttgccaaagaagttaccaaacaaattggtgggcccatgcatgaacttgctgctaaagttgatgaatatgcccgtggtatgattagtggttccgggtcgaccctgtttgaagaacttgggttatattacattgggcccgttgatggtcatagcatcgatgatcttgttgccattcttaaagaggttaagagtactaaaacgacgggcccggttttgattcatgtcattacagagaaaggcagaggatatccatatgccgagaaagctgctgataagtaccatggtgtggcgaagtttgacccggcaacagggaaacaattcaagtcaagcgcaccgactcagtcctacacgacttactttgcggaggccttgattgctgaagctgaggccgataaacaaattgtggctatacatgctgcgatgggtggtgggaccgggatgaatctattccatcgtcggttcccgagtcgatgtttcgatgtcgggattgctgaacaacacgcggttacttttgctgcgggtttggcgtgtgaaggcctaaaaccattttgtgcgatttactcatcgttcctgcaaaggggttatgatcaggtagtgcatgatgtagacttgcagaagttgcctgtgaggtttgcgatggatcgggctgggcttgttggtgcggatggcccaacacattcgggctcgtttgatgtcacttacatggcgtgccttccgaacatggtggtcatggctccttctgacgaggctgagctgtttcatatggtggcaaccgctgctgccattgacgacagacctagttgttttcgttatccgcgtggaaatgggataggcgttccgttgccacctggcaacaaaggcgttcctctcgagattgggaaaggccgaataatgatcgaaggagaacgagtcgcgcttctagggtatgggacagcagttcaaagctgcttaacagcagcgggtttagtaaaagaacgaggcttaaacataaccgttgccgatgctcgtttttgcaaaccgttggaccataatctcatccgggcactcgcaaagtcacacgaggtgttgatcacggtcgaagaaggatcgatcggcgggttcggctcacacgttgctcatttcatggcactagatggtcttcttgatggaaaactgaagtggagaccactggtgcttccggaccgctacatcgaccatggtgcaccggatgaccagctagcagaagcggggttgactccatcgcatatagccgcaaccgtattcaatgtacttgggcaaacaagagaggctctggaggttatgtcatagagggttcttgtcatcttgtgtgatgagtgatatacaagagttgttgctcaacttttaacagtgtgaagatagagtcaaaaccctttgtaaaaagtcagctgaactggattgggtttgttgacttgttatgtagtaagcaaagtggttcgggtcaatactaaaagacccgttttagaacccgaccgtttagactggagacccgataaaaagttacaatgggtatatgtatacaaagttttattattctttgtgttttgttaatgtattagtatagggaatcatgttaaagagaagctta

SEQ ID NO: 7230 - DNA, 2726 bp, Malus domestica
gagtaatcacatatacaaagtcaccatttttggtctttgaaaaaaggctcttaatttccaatacactgctcatccactcattctctctctctctctctctctccccaccccccccttctctttattttattcagtaactcccactgacactatcaccatttcagtggggaaaactctgagactcccagagaccttagtttcttaatacccttttctgggttcctctccatttcacctctgattgcaaatttgaagctcttgagctccatttcttcttcttcttcttcttcttgttcttgtatatgcaatggctctctgcgcattctcatttcctgcacatatcagcaaaccagcagcatctgcagatgctcagaaatcccacttctctgtgggaacacctcttccatgcccatctcagcagaagctcaatcaggtgatgagaaaaaggccaagtgggatttgtgcatcactgtcagagagaggggagtatcactcacagagacctcccactcctctcttggacaccatcaactatccaattcacatgaaaaatctttctgtcaaggagcttcaacaactagcagatgagctgaggtctgatgtgatcttcaatgtttcaaaaactggaggccacctcggttcaagccttggtgttgtggagctcactgtggctcttcactatgtcttcaatgctcctcaggacagaatcttgtgggatgttggccatcagtcttacccacacaaaatcttgactgggaggagagataagatgcacaccatgagacagacaaatggattagccggcttcactaagcgctctgagagcgaatacgattgctttggcactggtcacagttccaccaccatctctgcaggcttggggatggcagtaggaagggatctaaagggaggaaacaatcatgtagttgctgtaataggtgatggtgccatgacagcagggcaagcgtatgaagccatgaacaacgcggggtacctcgactctgacatgattattattcttaatgacaataaacaggtttctttacctaccgctagtcttgacggacccatcccgccggtaggagctttgagtagtgctctcagtaggttgcaatcaaacaggccgctcagagaattaagagaggtcgccaaaggtgttactaaacaaattggtggccctgtgcataatctggcagcaaaagttgatgagtatgctcgaggaatgatcagtggtactggttcttcgctatttgaagagcttggactatattatataggtccggtcgatggtcataacctagatgatcttatttccattctcaaagaggttaaaattaccaaaacaacaggtcctgtcctgatccaccttatcactgagaaaggcaggggatatccgtatgcagaaaaagcggcagacaagtaccatggagtggccaaatttgatccggcaactggaaagcaattcaaatcaagtgctagtacacaatcttacacaacatactttgcagaggctttgattgcagaagctgaagcggacaaagatattgttgctatccatgctgcaatgggaggtggaacagggatgaatctcttcctccgccgttttccaacaagatgctttgatgttggaatagcagaacagcatgcggttacttttgctgctggtctggcctgtgaaggcctaaaacctttctgtgcaatttactcatctttcttgcagagagcttatgaccaggtagtacatgacgtagatttgcaaaagcttccggttagatttgctatggacagagctgggctggtcggagctgatggtcctacgcattccgggtcttttgatgtcactttcatggcatgccttcctaacatggtggtgatggccccttctgatgaggcagagcttttcgatatggtagccactgctgctgccatagatgaccgaccaagttgtttccgatacccaagaggaaatggggttggtgttgagctgccactagggaataaaggaactcctctcgaggtaggaaaaggaagaatattgatcgaaggggaaagagttgcacttttgggttacggagcagcagtacagagctgtttggctgcctcctctttggtggaatcccatggtttgcaccttacagttgctgatgcacgattttgcaaaccactggaccgagctctcattcgcagccttgcaaggtcacatgagtttctgataactgtggaagaaggatccatcggagggtttggttctcacgttgctcatttcctggcccttgatggccttcttgatggaaaactcaagtggagaccaattgttcttcctgaccggtacattgaccacggttcccctgctgatcaattggccgaggccggactcaccccttctcacattgcagcaaccgtattcaatatgcttggacaagcaagagaggccctggagataatgtcatgaagacagaaatttacaaagcagcaccattttttttgctgtatacaaaaccgaaactgtgacgctctctatttccatccgtataaaaagtcccatatttgagcaaggtgttgcattaggtagctgaaggaaacctaaacaattcagttcatcaattaggagctccaactagttgaggcacctgagattgtaacatgtcctacaaacgcaagaaccgatttgtgactagaagaaaactctttttaagtcttttgcatggtgtcttttgagtttttaa

SEQ ID NO: 7231 - DNA, 2809 bp, Fragaria vesca
tcccatttttggtccctgaaattgttttaacttccattgccaattggacaccaactttaccatctaccacacacaccataaccataacgcctttcagtttctctctttctctccttattttatgtaacctccactgacaccttcacacctttcatcaccaccacactggttcctcagtggaaacaaacaacaactgctcttccttattagcccccctcacccctcacccttctcctcacttctctcatcttctctgggtcctcttctccagtttctctcagctttcaagctctctctccctctctcttcatctctctctctccttgttgctctgctacatgcaatggctctcagcacattctcaatctcaactcagaaacccacctctaagttctcatcccatttctcttttggaccagctctgccatgccctcaacaacaaaagctcttcaatcaggtaaagaaaaggacaactgggatatgtgcttcactgtcggagagtggagagtatcactcacaaagaccacccactcctctcttggacactatcaactatccaattcacatgaaaaacctttctgtcaaggagcttaaacaattagctgatgagctgaggtctgatgtcatcttcaacgtttcaaaaacgggaggtcacctaggatcaagccttggtgttgtggagctcactgtggctctccactatgtgttcaatgctcctcaggataagattctgtgggatgttggtcatcagtcttacccacacaaaatcttgactgggagaagagataagatgcagactatgaggcagaccaatgggttagctggtttcacaaaacggtcggagagcgagtatgattgctttggcactggtcatagttctactactatctctgctggcttgggaatggccgttgggagggatctaaagggaaaaaacaatcatgtggtggctgttattggtgatggtgccatgacagcagggcaagcttatgaagcgatgaacaatgcgggttaccttgattctgacatgataattattctcaacgataataaacaggtttctttacctactgccaatctcgatggacccatacctccagtaggagctttaagcagcgctctgagtaagttgcagtcaaacaggcctcttagagaattaagagaggttgccaaaggagttaccaaacaaattggtggttctgtgcatgaactggcagcaaaagttgatgagtatgctcgtggaatgatcagtggctctggctcaaccctgtttgaagagctgggactatattatattggtccagtcgatggtcacaatgtggatgatctgatagcgattttgcaggaggttaaaacaacacaaacaaccggtcctgtcctgatccacctgatcacggagaaaggtcgaggttatccatatgcggagaaggctgcagacaagtaccatggagtggccaagtttgatcccgcaactggaaagcagttcaaagctgctgctagcacacagtcctacacaacatactttgcagaggctttgattgcagaagccgaagcagacaaagatattgtagcaatccatgctgcaatgggaggtggaacaggcatgaatctcttcctccgccgttttccaacaagatgctttgatgtcggaatagcagaacagcatgctgttacatttgccgcaggtcttgcctgtgaaggcctgaaacctttctgtgcaatttactcatctttcttgcagagggcttatgaccaggtcgtacatgatgtggatttgcagaaactgcctgtgagatttgctatggatagagctgggcttgttggagccgatggtcccacacattgtggggcttttgatgttacttttatggcatgcctccctaacatggtggtcatggctccttctgatgaggcagagctctttcatatggtagccactgctgctgccattgatgatcgtccaagttgtttccggtacccaagaggaaatgggattggtgtagagctgccggcaggaaataaaggcactcctcttgagataggaaaaggaagaatattgattgaaggagaaagagttgcactcttgggctatggatcagccgtccagacatgtttggctgcagcaactttggtggaacctcttggcttgagtctgacggttgctgatgcacgattttgcaaaccgctagatcatgctcttatccgcaaacttgcaaaatcgcatgagtttttgattactgtggaagaaggatccattggaggctttggttctcatgttgtccagttcctggctcttgacggccttcttgatgggaacctgaagtggagacctctggttcttcctgatcggtacattgaccacggtgccccagccgatcagttggccgatgccggcctcactccttcccatattgcagcaacagtactcaatatgcttggacaaacaagagaggcactgcaggtaatgtcatgaagggagtattattctcagactgagtgagacctgtcaagttctatattttacctttccatctgtataaaagtaaagagtagcattagttgaagccaacgtaaacaatccctacatcagttagcaatttagcagctccaactagttgaagtcacagagagtttagtgtcctataaattcagggatgatttagtaagactagaagggagctcttgtgtcttttgcattggtgtcaacttgtgtgtatttatcaactgtttggcaatccaattctgagttctcaaatacttgctcaattctttgctaaatcattttccctggtttgggtggaagaatcca

SEQ ID NO: 7232 - DNA, 2300 bp, Prunus persica
ttcttctacgtgcaatggctctttgtacattctcatttcctgcacatatctaccggccaacaacacattcagatgctcagaaatccacctctttgttttcccatttctcttgggaaacagttctgccatgccaatctcagcacaagctcaatcaggtcatgaggaaaaggccagctgggatttgtgcatcgctgtcagagagtggggagtatcactcacagagaccacccactcctctcttggacaccataaactatccaattcacatgaaaaatctttctgtcaaggagcttaaacaactagcagatgagctgaggtctgatgtcatcttcaatgtttctaaaactggaggtcacctgggctcaagccttggtgttgtggagctcactgtggctcttcattatgtcttcaatgctcctcgagataggatcttatgggatgttggccatcagtcttatccacacaaaatcttgactgggaggagagataagatgcacactatgaggcagacaaatggtttagctggcttcactaagcgctctgagagtgaatatgattgctttggcactggtcacagttctaccactatctcagcaggcttggggatggcggtgggaagggatctaaagggaggaaataatcatgtagttgctgtaataggtgatggtgctatgacagcagggcaagcttacgaagccatgaacaacgctgggtacctcgattctgacatgattataattcttaatgacaataaacaggtttctttacctactgccagtcttgatggacccatacctccagtaggagctttgagtagtgctctcagtaggttgcaatcaaacaggccactcagagaattaagagaggttgccaaaggagttaccaaacaaattggtggtcccgtgcataatctggcagcaaaagttgatgagtatgctcgtggaatgatcagtggtaccggttcatcactatttgaagagcttggactatattatattggtccagtcgatggtcacaacttagatgatcttatatccattctcaaagaggtgaaaagtaccaaaacaacaggtcctgtcctgatccaccttatcactgagaaaggccggggatatccatatgcagagaaagctgcagacaagtaccatggagtggccaagtttgatcctgcaaccggaaagcaattcaaagccagtgctagtacacagtcttacacaacatactttgcagaggctttgattgcagaagctgaagcggacaaagatattgtagcaatccatgctgcaatgggaggtggaacaggcatgaatctcttcctccgccgttttccaacacgatgctttgatgttggaatagcagagcagcatgcggttacttttgctgcaggtctggcctgtgaaggcctaaaacctttctgtgcaatttactcgtcttttttgcagagggcttatgaccaggcaagctaatagcttcttccatatacgtggtacatgatgtagatttgcagaagctgcctgtgagatttgccatggaccgagctggactggttggagctgatggtcccacgcattgtgggtcttttgatgtcacttttatggcatgcctgcctaacatggtggtgatggctccttctgatgaggcagagcttttccatatggtagccacggctgcggccatagatgaccgaccaagttgtttccgatacccaagaggaaatggggttggtgttcaactgccgacagggaataaaggcactcctcttgaggtaggaaaaggcagaatattgattgaaggggaaagagtggcacttttgggatatggagcagcagttcagagctgtttggctgcatcctctttggttgaatcccatggcttgcgcctaacagttgctgatgcacggttttgcaaaccactggatcgtgctcttattcgcagccttgcaaaatcacatgagtttttgattactgtggaagagggatccattggagggttcggatctcacgttgctcagttcctggcccttgatggccttcttgacggcaagcttaagtggagaccgctggttcttcctgaccggtacattgaccatggttcccctgctgatcaattggtcgaagccgggctcaccccttctcatattgcagcaacagtattcaacgtacttggacaaacaagagaggcattgaagataatgtcatgaagggaaactaaagagttcccgtttttcactgtatacaaaaccaaaactgtaatgatttatatttagtttccccatctgtataaagtagcatatttgagca

SEQ ID NO: 7233 - DNA, 2561 bp, Vitis vinifera
ggtcggtcaatcaatcttacccagacgagtattgggtttctgtcccttttttttttttttgtttggtattcacatctctctaccaccagcaccaccattatctccactaccggggagtgggggaagcactgctttttctctctgtcttttctggattgttcttgctttggtctgtgctcaagcttctgcatttgctgagagttgaaatggctctctgtacgctctcatttcctgcccattttagccaggctgctgcttcaaatcctcagagacttactcctcagtgttcccatttgttcttgggggtggatttgcagtgccaatcccagcaaaggagtaaggccaggaaaaggccaaatggggtttgtgcatcactttcggatagggaggagtatcattcccagagaccaccaactcctctcctggacactatcaattatccaattcacatgaaaaatctgtctgtcaaggagctgaaacaactcgcagatgaactaaggtctgatgttgtcttcaatgtttccaaaactgggggtcacttgggctccagcctcggggttgtggagctcactgtggctcttcattatgtcttcaatgcccctcaagacaggatactatgggatgttggtcatcagtcttacccacacaaaattctaactgggagaagagatcaaatgcataccatgaggcaaacagatgggttagcgggattcaccaagcgctcggagagtgaatatgactgctttggaaccggccacagttctactaccatctcagcaggcttgggaatggcggtcggccgggatctaaaaggaaaaaacaacaacgttattgctgtcataggtgatggagccatgactgcagggcaagcttatgaagcaatgaacaatgctgggtacctggattctgacatgattgttatccttaatgacaacaagcaggtttctttacccactgctactctagatgggcccataccacctgtaggagctttgagcagtgctcttagtaggttacaatcaaacagacctcttagagaattacgagaggttgccaagggcgttaccaaacagattggcggaccgatgcatgaattggctgcaaaagttgatgaatatgctcgtgggatgatcagtggttctggatcaacactttttgaagagcttggactctattatataggtcctgttgatggccacaacatagatgaccttgttgccattctcaaggaggttaagagtaccaagacaacaggtccagttctgatccatgttgtcacagagaaaggccgcggatatccatatgctgagaaagctgcagataagtaccatggagtgaccaagttcgatcctgctactggaaaacaattcaaatccagtgctcctactcagtcctacacaacatattttgcagaggctttgattgcagaagcagaggtggacaaggatattgttgcaattcatgcagcaatggggggtggaacgggcttgaatctcttccatcgccggttccccacacgatgctttgatgttgggatagcagaacagcatgctgttacctttgctgctggtctagcctgtgaaggcattaaacctttttgtgcaatctactcatctttcatgcagagagcttatgaccaggtggtgcatgatgtagatttgcagaagctgccagtgaaatttgcaatggacagagctgggctggttggagcagatggcccaacacattgcggagcttttgatgtcactttcatggcttgccttccaaacatggtggtgatggctcctgctgatgaggccgagctttttcacatggtggccacagctgctgccatagatgacaggcccagttgtttccggtacccaagaggaaatggggtgggtgttgaactgccaccagggaacaaaggcattcctattgaggttggaaggggccgaatattgattgagggggagagagttgcactcttgggctatggaacagcagtacagagctgtttggttgcgtcttctttgctggaacaacatggcttacgaataacagtcgcagatgcccgcttctgcaaaccattggaccatgctcttattcgtagcctagcaaaatcacatgaagttttgattacagtagaagaagggtcaattggtggttttgggtctcatgttgctcagtttttggcccttaatggtcttcttgatggcacaacaaagtggagtcccatggttcttcctgatcggtacatagaccatggagcgccagcggaccagttggccatggcgggtctgacaccatctcatattgcagcaacagtattcaatatacttggacaaacaagggaggccctggagatcatgtcatagacagatacatcagcttttcattctctcaacattgtacaaatataatatgaactctcagaatttaaccttcttcaatataaagaaattgtgtcagcaataaggcttgaaagtgcttaatatagaaattgaatctccctcagatctcaactctgaatatgaatgctcaagaaaaaagtgttgggtagtgttgaattcttgagtccc

SEQ ID NO: 7234 - DNA, 2615 bp, Tripterygium wilfordii
atatggaaggctataatggccacctctctctatcgtgctttttaacctcttctccactatcaccagtcctacttagtggacaaagagaaccatctttttcattttcttcatcatctctgcacttgccattacgtactgtgctctctttgtgtcaattgcatttgattttgggacaattttaggcctctttgctggtgctcctgttggtgggtctgtaatggctctctgtgcattttctttccctgctcaaatcaacaaggcaggccttttggattctcagaagaccagttctttatcttctcatttgttatgtggaccggatctgttctgcctgcctctatacagactcaatcagttgcagccggggaaaaggccaaaaggggtttgtgcatcactgtcagaaatgggagagtatcattctcaaaaaccaccgacacctctcctggacaccgtaaactatccaattcacatgaagaatctatctatgaaggagctgaatcaacttgcagatgagctgcgttccgatgtcatatttaatgtctccaaaactgggggtcatttaggctcgagccttggtgtcgtggaactcaccgtggcacttcattatgtgttcaattgtcctcaagacaagatactatgggatgttggtcatcagacttacccccacaaaatccttactgggagaagggataagatgagcacaataagacagacaaatgggttgtccggattcacgaagcgttcggagagtgaatatgatagctttggtgctggtcacagctccactagcatctctgctggcttagggatggctgtgggaagggatttaaaaggtagaaagaacaatgttattgcagtaataggtgacggtgccatgacagcgggacaagcttatgaagccatgaataatgcagggtacctggatactgatatgattgtcatccttaatgacaacaaacaggtttctttgcccacagctactctcgatgggcccattccaccagtaggagctttgagcagtgctcttagtcggctgcaatcaaacaggcctctccgagaactgagagaggttgcaaagggagttaccaagcaaatcggtggaccgatgcatgaactggcagccaaagttgatgaatatgctcgggggatgatcggtggttctggctctacattgtttgaagagcttggactttattatattggtcctgttgatggccacaacattgatgatcttgtttccattctcaaagaggtgaagagtacaaagacgacaggtccagtcctaatacatgttgtcacggaaaaaggtcgtggatatccatatgcagagagggctgcggacaagtatcatggagtagcgaagtttgatccagctactggaaatcagttgaaagcaagggctcctacaaagtcttacacaacttattttgccgaggctttgattgctgaagcggaggcagataaagagatcgttgcaatccatgctgcaatgggtggtggaacaggattgaatcttttccatcgccgcttccccacaagatgctttgatgttgggatagcggagcagcatgctgttacttttgctgcagggttggcttgtgaaggcatcaaacctttttgtgcaatatactcatccttcttgcagagggcgtatgaccaggtgatacatgacgtcgacctgcagaagctgccggtaagatttgcaatggacagagccggactggtcggtgcagatggtccgacacattgtgggtcgtttgacgtcactttcatggcatgccttcctaatatggttgtgatggctcctgctgatgaggcagagctttttaacatggttgctaccgctgctgccataaatgataggcctagttgtttccgatatccaagaggtaatgggataggcattcagcttcccccaggaaacaaagggattccacttgaggtcgggaagggaaggatattgattgaaggggagagagtagcactattggcatatgggacagcagttcagagctgtttagccgctgcctctctggttgaatctcatggcttgcaattaaccgttgcagatgcaagattctgcaagccattggaccgcgccctcatttgcagcctagcaaaatcgcatgaagtgttgattacagtagaagaaggatcaattggtggctttggatctcatgttgctcagttcatggcgcttgaaggtcttcttgatggtaaattaaagtggagaccacttgttcttcctgatagatatatcgaccatggctcgccagctgaccagttggccgaagccggtctcacttcgtcccacattgcagccacagtgttcaacatacttggactaacaagggaggctctagaaaccatgtcattgagaaactgagagtgcatagcgatttcacgttcccccgacaatgtaaatatatgtcttgtaatttttgtcttcgaagacttaccacaggagaacatgtgacccagtggtgcaacctagagatcatagattcaatttctgtaaaaaaaaacatcttcacatattatgtccccgaccctacttactatggaagccttgtatacgacagttggtttagtgtaaaacttttgcacataccaac

SEQ ID NO: 7235 - DNA, 2502 bp, Ambrosia trifida
attcccacaattattatctttataaaaaaaatccaatctttataatctttatcatggccctttgtgggtttgcatttcctgcacatatcaaccacaggtcaatcactccccacacttctttgatccaacattgcttctatggaaaagatctgcaaaagggtcaatctttttctcacagaccctttaatcagttaggtaaaagatcaggtgtggttgttcaagcaacactgtcagagagaggagagtatcactcacagagacctcctactcctctttggacactattaattacccaattcatatgaagaatctatcaattaaggaactgaagcagctagctgatgaggttaggtctgatgtcatctttaatgtatcgaaaaccggtgggcatttgggttcgagtcttggtgttgtggagcttacggtggctcttcattacgtgttcaatacgccacaagataagatactttgggatgttggtcatcagtcttacccgcataaaatattgactggaagaagggatcggatgcataccattagacagacaaatgggttggccggtttcaccaaacggtctgaaagcgagcatgattgttttggcacggggcatagctctaccaccatttctgcagggttaggtatggctgtgggaagggatttgaaaggaggaacaaacgatgtagttgctattataggtgatggtgctatgaccgcgggtcaagcttacgaagccatgaacaatgcgggttatctagattcagatatgatagttatccttaatgacaataaacaagtctcgttaccaactgcaactctagatgggcctatacctcccgttggagctttaagcagtgctcttagtaggttacagtctaaccgtcctctaagggaactgcgcgaagtagccaaagaagtaaccaaacaaattggtgggcccatgcatgaacttgctgctaaagttgatgaatatgcccgtggtatgattagtggttcagggtcgagtctgtttgaagaacttggtttatattacattgggcctgttgatggtcacagcattgatgatcttgttgccattcttaaagaggttaagagtactaaaactacgggcccggttctgatacatgttattactgagaaaggtagaggatatccatacgctgagaaagccgctgataagtaccatggtgtggcaaaatttgacccggcaacagggaaacaattcaagtcaagtgcaccgactcagtcttacacgacttactttgcagaggcgctgattgctgaagctgaggaagataaaaaaattgtggctatccatgctgcgatgggtggtgggacggggatgaatctattccaccgccgattcccaagtcggtgttttgatgttgggattgccgaacaacacgcggttacttttgcagctgggttggcgtgtgaaggccttaaaccattttgtgcgatatactcatcgtttctgcaaaggggttatgatcaggtagtgcatgatgtggatttgcagaagttgcctgtgagatttgcaatggatcgggctgggcttgttggtgccgatggcccaacacattcgggctcatttgatgtcacttacatggcatgcctaccgaacatggtggtcatggctccttctgacgaggctgagctttttcatatggtggctactgctgctgccattgatgacagacctagctgcttccgttatccacgtggaaacgggataggcgttcccttgccacctggcaacaaaggcgttcctctcgaggttggaaaaggtcgaattatgcttgaaggagaacgggttgcgctcctaggatatggaacagcagttcagagttgcttagctgcagccggtttagtaaaacaacgaggtttaaacataacagttgcagatgctcgtttctgcaaaccgttggaccatcatctcatccgggcccttgcaaagtcacacgaggtcttgatcacagttgaagaaggatccataggtgggttcggttcacacgttgctcatttcatggcactagatggtcttcttgatggtaaactgaagtggagaccactggtgcttccagaccgttacatcgaccatggtgcaccagatgaccagctagccgaagcagggttgactccatcgcatatagccgcaactgtattcaatgtacttggtcaaacaagagaggctctggaggttatgtcatagagggttcttgtgtggtaagtgatgtgcacaaatagatatatttatctgcatagagggttcttgttgctcaacttttaacagtgtgaaaatagagttgaaatcatctgtataaagtcaaccgaaacgtattgggtttgttgacttattacctggtacgggtcaatactaaaagacccgtcttagaacccgatcgtttaaactggagacccggtaaaagttcaatgggtatgtatacaaaattttctgtctttgtgtgtttgttgttgtattattatttggaattatgttaaaaa

SEQ ID NO: 7236 - DNA, 2668 bp, Mimulus guttatus
gctgtcaatatatataaatgctccaccaagaaaagcaattaccaattttctgattaataatcaagaatcctctgcatttattacaactcttttttgtaaatctccttctgtaaatcttcttctaccttcttacacacacacacacatcattcaaaaaattaaccttttttattaccttccttaatagttcaaatataagcagagagtgaaaaaaaaaacacacagtaaagttggaatgtgtgtgtgagcagacaagagtaagagctgattattattttgagctaaatctccaactttttttttcctgttaaaatctttgtacagaagtgtgtgtgtatatatataattatatatacatacatatgcgatggctctctgcgcatttccatttactgggagtttgagcaaagggttaacgggtacccattggctaaacgggtcgggtttacagccccacccttgctgcaagaagaatcatcagaaggtaagaaaaagctcaaatggagttcatgcatcactgtcagaaagaggtgaatacttctcccaaaaacccccaactccacttcttgacactatcaactatccaattcacatgaagaatctctccacaaaggaactgaagcaactagccgacgaactacgatccgatgtcattttcaatgtctcgaaaaccggcggccatctcggttcgagtctcggtgtaatcgaattaaccgttgcccttcatttcgttttcaacactcctcaagatagaatactctgggatgttggtcatcaatcttatccgcataagattttgaccggaagaagagacaaaatgccgactttaagacagacaaacggtctttcgggttttactaaacggtccgaaagtgattacgattgctttggcaccggccatagttctaccacaatctctgctggattaggaatggctgtggggagggacttaaaagggaaatcgaacaacgtggtggctgtaataggcgatggggcgatgacagctggacaagcgtacgaagcaatgaataacgccggatatcttgattcggacatgattgttattcttaatgataacaaacaagtttctttgccgactgctaatttggatgggcccaccgctcccgtgggagcgttgagtagtgctttgagcaggttgcagtctaatcgtccgcttagagaactaagagaagttgctaagggagtgacgaagcagataggtgggcccatgcacgaactggcagcaaaagtagacgaatacgcccgtggcctaatcagcggttcgggttcaacattctttgaagaactcggactttattacatcggtccagtcgacggtcacaatcttgacgaccttacagcaatccttaatgaagtcaaaagtactaaaacaaccggtccagtcttgatccacgtcatcaccgagaaaggcaggggttacccttacgcagaaaaagccgcagataaatatcacggagtgacgaaattcgatccggcaactggaaagcaattcaaatcgagcgctccgactcagtcatacacaacttactttgcagaggctttgatagccgaagcagaagcggataaggatatagttgcgatacacgcagctatgggaggtgggaccggcttaaacctcttccaacgccgttttccgacaagatgcttcgatgtcggaatagccgaacagcatgcagtaactttcgccgcaggtttagcctgcgaaggcattaaacccttttgcgcaatctactcatctttcttgcaaagagcttacgaccaggtagtgcatgacgtggacttgcagaagcttccggtgagatttgctatggacagagctggattagttggggcagatgggcccacgcattgtggagcgttcgacgtgacttatatggcatgtttaccaaacatggtggtgatggctccttcggacgaggctgaattatttcacatggttgcaactgcagctgctatagacgataggccgagttgtttccgttttccgagaggcaacggtgtagggatagagttgccaaagggtaataagggcattcccattgagatagggaaggggcgagtattgatcgaaggggagagagtggctctattgggatacgggacagctgtccagagctgtatggctgcagctgcattgttggagccccacggtataaggttgacggttgctgatgctcgattttgtaagccgttggatcatgatcttatacgaagcttggccaaatcgcaccaagtcttgatcactgttgaagaaggttccatcggtgggttcggatcccacgtagcgcagttcatggctctcgatggacttcttgatggtaatttgaagtggaggccattggttctgcccgaccgatatatcgaccacggatcgccgatcgatcaacagatggaagccgggctaacaccttctcacattgcagcaactgtttgcaacattcttggcaaagcaagggaggcactagagattatgtcctagaacatgtaacaattattacaacattaatttctccaaaattaaaactagttatatatttagtctttagattaaactctgattttagtttcctataatcagattgcagctcaaagttgcattagatacatatgaaatatatataaaattgctcactctagtgtgtttctt

SEQ ID NO: 7237 - DNA, 2298 bp, Amorphophallus konjac
ctccccccccccaatggccctctccacggcctcattcccttgccatttgcatagggtggttgcctcggatccccacaagtccgccctcctcgcctcgcactcgcggctgctcgggggaggagacgatgagctacagcagcagcagcagcacaagctcttcaaggtcaaaagaaggccacgtgtttgtgcatctctttcagagaagggggagtatttctctcagaggcccccaactcctctattggacactatcaactatcctatccacatgaagaacctatccatcaaggagctgaaacaactcgcggatgagctgcgctctgatgtcatcttcaatgtgtcgaaaacgggtggccacctgggctcaagccttggagtcgtggagttaacggtcgccctccattatgtcttcaataccccgcaggacaagatactatgggatgttggtcaccagtcatatccgcacaaaatactcacgggaagaagggacaagatgccaacaatgagacagacaaatggattatctggattcacaaaacgttctgagagtgagcatgactgctttggtactgggcacagctccacaagcatctcagcagccctaggcatggctgttggaagggacctgaagggcaggaagaacaatgtgattgcagttataggtgatggggccatgacagctggacaagcttatgaggcaatgaacaatgctggatatctcgactcagacatgattgtcatcttgaatgacaataagcaggtctctttgcctactgctactcttgatgggcccatacctccagttggggctttgagtagtgcactcagtagattgcagtccagtagaccactcagagaactgagagaggtcgccaaaggagtaacaaagcaaattggtgggtcaatgcatgaactagctgccaaagttgatgagtatgctcgaggaatgatcagtggatctggttcaacactgtttgaagagctcggtctctactacataggcccagtagatggccataacatggatgaccttgtcaccatactcaaggaagtgaaaagtaccaaaacaacaggccccgtactcatacacgtagtgaccgagaaagggcgaggttatccttatgcagagaaagcggctgacaagtaccatggagttgcaaagtttgacccagcaacaggaaaacaattgaagtctagctccaagactcaatcctacaccaactattttgcggaggcactggtagctgaggccgaggcagataaggatataattgcaatccatgcggcaatgggaggtggaacaggccttaacctcttccaacgccgcttcccaaccaggtgcttcgacgttggaattgcagaacagcatgctgtcacctttgcggctggccttgcctgtgagggcctcaagcccttctgtgccatttactcatctttcctgcaacgggcatatgaccaggtgatacatgatgtcgacttgcaaaaattgccagtgcgatttgcattagacagggcaggacttgttggagctgatggccctacacactctggatcctttgacgtcacatacatggcatgcctgccaaatatggtggtcatggctccgtccgatgaggcagagctctttcacatggtggcaaccgccgcagccattaatgacaggccctcatgcttccgctacccaaggggaacggcatcggtgtccccctgccagctggaaacaaaggtgttcctctcgaggtcgggaaagggcgaattcttattgggggtgagcgagtagctctgctgggttatggaactgcagtgcaaagttgcttggctgcggcttctgtactcgaaaaacatggtctgaaaataactgtagcagatgcacgtttctgcaagccactggaccaaactcttattcgcggcctggccaaatcacatgaggtcctgataaccgttgaggagggatcaatcggaggttttggctctcatattgctcagttcatggccctcaatggcctccttgacggaacaacaaagtggagaccgatggttctgcctgatcgctacatagatcatggatcaccttctgatcaattggccgaagccggcctgaccccatcacatatagcagcaactgttttcaacatccttggacagactagagaggctctggggataatgtcatagtaagagattcatgggctgagatggggtactttttctgttttttttctgcagtgtataaaggcttgtaagataagttgccatgttgtacgataagggaggaatatatcgaattaatgcatgttt

SEQ ID NO: 7238 - DNA, 2649 bp, Vinca minor
ttggtctgtgattctttaagtaaaatttcaatcctttttctgggttcttggagaattgaggtatatctatgatggctctttgtgcatttgcatttccagggactttgaacaaggctgtggcttcttcaaattctctcaagaacagtcttttctgttctaattggctttatggctcagattttctctctcctttccagtccaaaaactccaaggcgatcaaaaggactaatggagtgagggcaacactctcagaaagtggggagtatttctcgcagagaccagcgactcctcttttggacacaattaattatccaattcacatgaaaaatctttctaaaaaggaactgaaacaacttgcagatgaactacgatcagatgtcatctttaacgtgtctaggaccgggggtcatcttggttcgagtcttggtgttgttgagctcactgtggctcttcattatgtattcaattgccctcaagatagaattctttgggatgttggccatcagtcttaccctcataagattctgaccgggaggagggacaagatgtcgaccttgagacaaacaaatggcctatgcggattcaccaaacgctctgaaagtgaatacgactgctttggcgctggacacagttctaccaccatctccgcaggcctaggaatggctgtgggaagggatcttaaaggaagaaaaaacaaagttgtggctgtcatcggtgatggagccatgacagcgggacaggcatacgaagctatgaataatgccggatatcttgattctgatatgattgttattctcaacgacaacaaacaagtatccttgccaactgcgactttggatggtcctgctcctcctgtaggagctctgagtagtgctttgagtaggttgcaatccaataggcctcttagagaactaagagaagttgccaagggggtcaccaagcagattggtggatcagtgcacgggcttgcagccaaagttgatgaatatgctcgtggattgattagtggttctggatcgacattctttgaagagcttgggatgtattatatcggtccagttgatggacacaacctggatgatcttgtttccattcttaacgaagttaaaagtactaatacaacaggacctgtgctgatccacattgtcaccgagaaaggcaggggatatccctatgctgagaaagcagcagacaagtatcatggagttgtgaagtttgatccagcgacaggaaagcaattcaaatcgagcagcaaaactcagtcttatacaacatactttgctgaggctctgattgctgaagcagaggcagataaagacgtcattgctatacatgcagcaatgggaggtggaacagggttgaacattttccaacgtcgcttcccaggacgatgttttgacgttggaattgcagaacaacacgccgtaacctttgctgcaggactggcatgtgaaggcctaaagcctttctgtactatctactcatctttcttgcaaagggcttatgaccaggtagtgcatgatgttgacttgcagaagctgcctgtgcgatttgcaatggaccgagcagggctggttggagcagacggtcctacacattgcggcgcttttgatgtcacgtatatggcttgccttccaaatatggtagtgatggctccttcagatgaagccgagctatttcacatggttgcaactgcagcagctatcaacgatagacctagctgcttaaggtatcctagaggaaatgggataggtgtagagctaccccctcgaaaaaaaggcatccctcttgaggttggaaaaggtcgaatattaagagaaggcgagagagttgcactattgggctatggaacagcagttcaaaactgtttggctgcagctgatttactagaatatcacggtttacgattaacagttgcagatgcgcgcttttgcaagcctctagaccgtgctctcataaggagccttgtaaaatctcacgaggttttgatcaccgttgaagaaggatcaatcggtggctttggatctcatgtagttcaattcatggccttagatggacttcttgatggcaatgtgaagtggaggccattggttcttcccgatagatatatcgatcatggatctccggctgatcaactggcggaagctggtcttacaccgtctcatatagcagcatctgtttttaacattcttggaaaaacaagagaggctcttgaagtcatgtcctaaattttaaggtttctgttttttataattctacccaaaatagaattgttttttttttgggtgtaaaatgttgtagtttaatttaggtacatctctaagttgagaaccggctccagtgcataacatttattgtttcgcccctggcggaataattatggaccgtccgataaaaaatttgaccgctgaaatcatttgagtcttgataaatatcatgaagaaaagttaaatgaaatgatttcagttgtcagatgttaaatccgacagcccgtaattgttttgcacggtgcgaaaaaatggatgtaccgcattgtagcctgattgtctattgtatctaatataagttgtttttttaatccatttaaaggagggtcgatagtggttccccacttctcctccagcgtgactcgaacttccgatctacccg

SEQ ID NO: 7239 - DNA, 2656 bp, Aquilegia formosa
aaaaggcaagctctcaaggacatgtttcagttctgtgtgcaattctctaatgaccacaactaccaatatccaccacacatataaatcataatatacatttcttcccactttcaatttttctgtgttttcagcacttattagtgctgcaatgtcccatctatttctttatctctagctcatcatttccatcaagattccttcatagcttattaactaacttgttggtcattgttcatattttttttttccttctaagtttatcacaagagctctctctatttctgtcaattgtttcttctttgtttttgtctaaaatggctctctctacattcccctttgcttcttacttacctagagcactatcttcagactcacataacaccagttctttgtcttctcacttactttggggaacagatctgcaatacccatctcagcaaaatcttgttcaggtcagaaaaaggtcaggtggtgtttgggcttcactgtcagagaagggggagtatcattcacagagaccaccaactccacttttggacacaattaactatcctattcatatgaaaaatctctctattaaggaactcaaacaacttgctgatgaagtgaggtctgatgtcatatttaatgtttccaagactgggggtcaccttggttcaagcctcggcgtagttgaactcactgtggctcttcactatgtctttaatcttccacaagacaagatactttgggatgttggacatcagacttatccacataaaatcctgactgggagaagagataaaatgcacacattgagacaaacagatggacttgcaggatttactaaacgctctgaaagtgaatacgattgcttcggcgctggtcatagttctactagtatctctgcaggacttggaatggctgtaggaagggatctgaagggcagagacaaccatgtagttgctgttataggggatggtgctatgactgcagggcaagcctatgaagccatgaacaacgctgggtatcttgattctgatatgatagtaatccttaatgacaacaagcaagtttccttgcccactgcaagtcttgatggtcccataccaccagtgggagcactaagcagcgctctcagcaggttacagtccagtagacccctcagagaattaagagaagttgctaagggagttacaaagcagataggagggcctgtgcatgaactagctgctaaagttgatgaatatacacgtgggatgatcagtggttctaattcatcactatttgaggagctgggtctctattacattggtccagtggatggtcacaacgtagacgatcttgtgactattctgaaagaggtgaagagtactcatacaacaggtccagttctcattcatgttgtgactgataaaggccgaggatacccatacgcagaaagagctgcagacaagtaccatggtgtgaccaagtttgatccagcgactggaaaacaattcaaaggcagcagcaatactcagtcttacactacctattttgcagaggctttgattgccgaagcagaagtagacaaggacattgtagccatccatgccgcaatgggaggaggtacaggcatgaatctcttcctccgccgctttcctacaagatgctttgatgttggaatcgcggagcagcatgctgtaacatttgcagcaggccttgcttgtgaaggccttaaacctttctgtgcaatatattcgtccttcttgcagagagcttatgaccaggcaagtggtacatgatgtcgatctacaaaagttaccagtgaggtttgcactagatagggctgggctagtcggagcagatggtcccacacatgctgggtcatttgatgtcacttacatggcatgccttccaaacatggtggtgatggctccttcagatgaagcagagctttttcacatggttgcaaccgctgctgcaatagatgatcgacccagttgtttccgatacccaagaggaaatgggattggtgttgagttgccacctggcaacaagggcattcctctggaggtaggaaaaggtcggatactgatcgagggtgagagggtggcactcttgggctatggatcagcagttcaaagctgcttggcagcagcttctttagtagagcgccatggtttgaggttaacagttgcagatgcacgcttctgcaaaccacttgaccaagccctggttcgtgctctagctaaatcacatgatattctaattacaatagaagagggctcaattggtggctttgggtctcacgttgctcaattcttggcccttaatggccttcttgatggaaatttaaagtggagaccactggttcttcctgacagatacattgaccatgggtcaccagttgatcaaatgatggaagctggattgacaccatctcacattgccgcgactgtgttcaaccttcttggacaaacaagggaagctctcgagttcatgtcgtcgagcagttaatacaaaaaatgtgggacatttccccttcactgtgtatattagatatgtcagaaatatatcatcaattaacatgaaagctgcagaattattaacaaagtgattgaccatacccaaactcatcatcttgtgcaaatgcatagtgcagtactaagaaatggttgatagattactagat

SEQ ID NO: 7240 - DNA, 2373 bp, Malus domestica
atccactctctctctctctctctctctctctctctcttcatatgttattctgtaactcccactgacactatcaccgtttcaatgggataaactcttgagagtcccagagaccttcatttctcaagacccttttctgggttcttcttcttttcccctcttatcacaaacttgaagttcttgagctccattccttgttattctacatgcaatggctctctgcacattctcttttcctgcagatatcagcagatcagcagcatctgcagatgctcagaaatccctcttctctgtgggaacatctctgccatgcccatctcagcagaagctcaatcaggtggtgagaaaaaggccaagcgggatttgtgcatcactgtcagagagagaggagtattactcacagagacctcccactcctctattggacaccatcaactatccaattcacatgaaaaatctttctgtcaaggagcttaagcaactagcagatgaactgaggtctgatgtgatcttcaatgtttctaaaactggaggacacctgggttcaagccttggtgttgtggagctcactgtggctgttcactatgtgttcaatgctcctcaggacagaattttgtgggatgttggccatcagtcttacccacacaaaatcttgactggaaggagagataagatgcacaccatgagacagacaaatgggttggccggcttcactaagcgctctgagagcgagtacgattgctttggcactggtcacagttctaccaccatctctgcaggcttggggatggcagtagggagggatctaaggggaggaaataatcatgtagttgctgtaataggtgatggtgccatgacagcaggacaagcatatgaagccatgaacaatgcggggtaccttgattctgacatgattattatccttaatgacaataaacaggtttctttacctactgccagtctcgacggacccatcccgccagtaggagctttgagtagtgctctcagtagattacaatcaaacaggccactcagagaattaagagaggttgccaagggagttaccaaacaaattggtggctctgtgcataatctggcagcaaaagttgatgagtatgctcgaggaatgatcagtggttctggttcatcactatttgaagagcttggattatattatataggtccagttgatggtcacaacatagatgatcttatttccattctcaaagaggttaaaattaccaaaacaacgggtcctgtcctgatccaccttgtcactgagaaaggccggggatatccgtatgcagaaaaagcggcagacaagtaccatggagtggccaagtttgatcctgcaaccggaaagcaattcaaggccagtgctagtacacaatcttacacaacatactttgcagaggctttgattgccgaagctgaagcggacaaagatattgttgcgatccatgctgcaatgggaggtggaacagggttgaatctcttcctccgccgttttccaacaagatgctttgatgttggaatagcagaacagcatgcagttacttttgctgcaggtctggcctgtgaaggcctaaaacctttctgtgcaatttactcatctttcttgcagagagcttatgaccaggtagtacatgacgtagatttgcaaaagcttccggttagatttgctatggacagagctggactggtcggagctgacggtcctacgcattctggttcttttgatgtcactttcatggcatgtctgcctaacatggtagtgatggccccttctgatgaggcagagcttttccatatggtagccactgctgctgccatagatgaccggccaagttgtttccgatacccaagaggaaatggtgttggcgttgagctgccactagggaataaaggcactcctctcgaggtaggaaggggaagaatattgatcgaaggggaaagagttgcacttttgggttacggagcagcagtacagagctgtttggctgcctcttctttggtggaatcccgtggtttgcgcctaacagttgctgatgcacgattttgcaaaccactggaccgagctctcattcgaagccttgtgaagtcacatgagattttgattaccgtcgaagaaggatccatcggagggtttggttctcacgttgctcatttcctggccctcgatggccttcttgatggaaaactcaagtggagaccgattgttcttcctgaccggtacattgaccacggttcccctgttgatcaattggccgaagccggactcaccccttcacacattgcagcaacagtattcaatatgcttggacaatcaagagaggccctggagatagtgtcatgaaaacagaaattacaaagcag

SEQ ID NO: 7241 - DNA, 2587 bp, Flaveria ramosissima
ttatccctccgatcaccacctccgccatcgtaccaccacacattcctaattcccccttttctccattcaattcgctcaatcaccgtccaaatcgaccctttttcaatggccctttgtgggttcgcatttccggcgaatatgaaccaccgggcgattggttctcacgctcctgtggtgcagcattacttctttggtaaagatctgcaacacccgcaatcgtcccacaagcccttcaatcagttgagtaaaagggtaggtgtggttcaagcgacaatggctgatagaggtgagtatcactcgcagagacccccgactccgcttttggacaccattaattacccaattcacatgaagaatctctcgatcaaggaactgaagcaactagctgatgagctgcggtctgatgtaatctttaatgtttctaagactggtggtcatttgggttcgagcctcggtgtggtggagctcactgtggctcttcattatgtgttcaatacgccgcaagataagatcctttgggatgttggtcatcagtcttacccgcataaaatattgacgggaagaagagaccgaatgcatactattagacagacaaacgggttggcaggcttcactaaacgctctgaaagtgagcatgattgttttggcacggggcatagctctaccaccatttctgcgggattaggtatggctgtgggaagggatctaaaaggtggaacaaacgatgtagttgctatcataggcgatggtgctatgaccgcgggtcaagcctatgaagccatgaacaacgcgggctatctagattcagatatgatagtcatccttaacgacaataaacaagtctcattaccaactgcaacacttgacgggcctacacctcctgttggagctttaagcagtgctctcagtaggctacaatctaaccgccctcttagggaactgcgtgaagttgccaaagaagttaccaaacagattggcgggcccatgcatgaacttgcagctaaagttgatgagtacgcccgtggtatgattagtggttcaggttcaacactgtttgaagaacttggtttgtattacatcgggccagttgatggtcatagcattgatgatcttgttgccattcttaaagaggtcaagagtactaaaacaacgggtccggttttgattcatgttattacagagaaaggtagaggatatccatatgcagagaaagctgctgataagtaccatggtgtggcgaaatttgaccctgcaactgggaaacagttcaagtcaagtgcagcaactcaatcttacactacttactttgcagaggcattgattgctgaagctgaggtggataaaaagattgtgggtatccatgctgcaatgggtggcgggactgggatgaacctatttgaccgccggttcccgaaccggtgttttgatgtcgggatcgctgaacaacacgcggttacttttgctgctggtttggcctgtgaaggccttaagccattttgtgcaatttactcatcattcctgcaaaggggttatgatcaggtggtgcatgatgtggacttgcagaagttgcctgtgaggtttgcaatggaccgagctgggctcgttggtgcagatggcccgacacactcgggctcgtttgatgtgacttacatggcgtgcctcccgaacatggtggtcatggctccttctgatgagggtgagctttttcatatggtggcaaccgctgcagccattgatgacagacctagttgcttccgttatccccgtgggaatggggtaggcgccacattgccacctggcaacaaaggctttcctcttgaggttggaaaaggtcgaatactgatcgaaggagagcgtgtcgcgctcttaggctatggaacagcagtccagagttgcttggtagcagcccgtttagtacaagaacgaggcttaaacataaccgttgcggatgcccgtttttgcaaaccgttggaccataatctcatccgggccctcgcaaagtcacacgaggtcttgatcacggttgaagaaggatcagttggcgggttcggctcacacgttgctcacttcatggcactagatggtcttctagatggaaaactaaagtggagaccactggtgcttccggaccgttacatagaccatggtgcgcctgatgaccaactagccgaagcgggcctgactccatcacatatagctgcaaccgtattcaacgtactcgggcaaacaagagaggctctggaggttatgtcatagagtaatcttgtgtgttcagtggtgtgcacaaatggatataagtatatgcatagatgtacaacagttgttgctgaacttaagagtctgaaaatagagtcaaccctttgtaaaaagtcaactgatttgggttgggcttgtaaagttatggatagtttggtgcatcttgagaaaccaatattccttgatatttataaaacccgacccgagtttagtaattaaattgttgacttttaggtggtaaggaaatgggtccgggttaataataaaaaacccatattagaacccggttatttaaactggaggcccaataacaggtatcatatgagatatt

SEQ ID NO: 7242 - DNA, 2541 bp, Plantago ovata
catcacttatctatacagacaaaaccacttcctattttcttgagacagatttcctatcattttctcatcaatgcaaactcaaacttggaatctttttcagtaaagaagactaactatactttgtatttaatttttcccaagatacctgttatctttttccagttttgttcatcttagtgaagatgatggctctctgtacatttcctgcacatgggacttggaccaaatctgtggttggtgattctcataagcagactcctcaccagttgttctctggaagggatctgcaacctcaaactttcacaaccagctttcagggcaagaagaggtcatcaagtggggtctgtgcctcattatcagatggaggagagtattactcacagaggcctccaactcctcttttggacactatcaattatcccattcacatgaagaacctttctactaaggaactgaaacagctggcagatgaactgcggtccgatgtatttttaatgtgtcgaagaccgggggtcatcttggttcgagcctcggtgttattgagcttaccgtggctcttcattatgtttttaatgcccctcaggataagatactctgggatgttggccaccagtcgtatccgcataagattttgactggtagaagagacaagatgccgactttgaggcagactgatggtctatctggttttactaagcggtctgagagcgagtatgattgctttggtacaggtcacagttctacgactatctcagcaggattaggaatggcggtgggaagagatctaaaaggaaagaaaaacagcgtcatagctgtgatcggtgatggtgctatgacagcaggtcaggcatatgaagcaatgaacaatgctggatacttagattctgacatgattgttatccttaatgacaacaaacaagtttctttacccactgctaatctggatggtcccattcctcctgttggagctctgagtagtgctttaagtaggctgcaatccaatcgacctctcagagaactgagagaagtcgccaagggagtaacgaagcagataggtggtccgatgcacgagcttgcagcaaaagtggatgaatatgcccgtgggatgatcagtggttctggatcttcgctgtttgaagagcttggactttattatattggtccagttgatggtcacaatattgatgatttgacgacaattcttaaggaagtgaagagtactaagacaactggtccagttttaatccatgttgtgactgagaaaggcagaggatatccatatgccgaaaaggctgcagacaagtaccatggtgtgagcaagtttgatccggcaactggaaagcaaacgaaaaccagtgccccaactcagtcttacacgacctactttgcagaggctttgattgcagaagctgaagcagacaagaacattgttgctatccatgctgcaatgggaggtggtacaggtttgaacctgttcctacgccgatttcctaacagatgctatgacgttggtatagcagaacaacatgcggttacatttgctgctggtttggcttgtgagggtatcaagccattttgtgctatctactcgtctttcttgcaaagggcttatgaccaggttgttcatgacgttgatttgcaaaagctgcccgtaaggtttgcgatggacagagctggcttagttggagcagacggtccaacacattgtggcgcctttgatgtgacttttatggcatgcctcccgaacatggtcgtcatggctccttcggatgaggctgagctgtttcacatggtagcaactgctgctgccatagatgacaggccaagctgtttccgatacccaagaggtaacgggataggagtggaattgccccaaggaaacaaaggcataccccttgaggttgggagaggcagaatactgatggaaggtgagagagtggctttgttgggatacggatcagctgtgcagagttgcttggcagcagctgctatggtagaagagcatggtttgcggttaacagttgcagatgcacgcttctgcaagccgttggaccatgctcttattcgcagtttggctaaatcgcatgagatcgtgatcactgtggaagaagggtcaattggtggtttcggatctcatgttgctcattttatggccatcgatggccttcttgatggcaagctaaagtggagacctctggttcttccagacaagtatatagagcacggagcaccaatcgatcagatgagagaagcaggattgacagcctctcacatagcggcgacagtttttagtttacttgggaaatctagggaggcattgcagatcctgtcctagatctgcatttgtacaggatgaatgaagtaactggaaactaatttgcttatatatatatcatgtttataaccgtaaataatttcatggagtcagatagatattagcttttatgattaggttgctgcttagattcaccggaagataaccctttgtattgtatgtatgatgtatgtatttaccttcataaccgatctagggtattgatg

SEQ ID NO: 7243 - DNA, 2336 bp, Amsonia hubrichtii
ttctttgatttttcgtatatgtgcgatggctctctgtgcattcacatttcctgggagtttgaacaaggctgtggcttcagattctttaaagaacagtctttcctactctaattggctatatgtgtcagatctgccttctccattccaatccaaaagcaaccaggtaaccaaaaagtccaatggagtacgtgcatcactctcagaagggggggagtatttctcgcagagtccaccgactcctcttctggacactattaattatccaatccacatgaaaaatctttctactaaggaattgaaacaacttgcagatgaactacgttcagatatcgttttcaatgtttcgaaaacagggggtcatcttggttcgagtcttggtgttgttgagctcactgtggctcttcattatgtcttcaattgcccccaagatagaattctttgggatgttggccatcagtcttaccctcataagattttgactgggagaagagacaagatgccgaccctgagacagacagatgggctatctggattcactaaacgctcggaaagtgaatacgactgctttggtgctggccacagttctaccaccatttcggcaggtctaggaatggctgtgggaagggatctgaaaggaagaaaaaacaatgttgtggctgtcataggtgatggagccatgacagcaggtcaggcatacgaagccatgaataatgctggctatctggattctgacatgattgttattctcaatgacaacaaacaagtctccttgccaactgcaacgctggatggtcctgctcctcctgtaggagctctcagtagtgctctgagcaggttacagtccaataggcctcttagagaactcagagaagttgccaagggggtgaccaagcagattggaggaccagtgcacgagcttgcagcgaaagttgatgaatatgctcgtgggttgattagtggttctggatcgactctatttgaagagcttggattctattatattggtccagttgatggccacagcattgacgatatggttgccattcttaaagaagttaagaataccaaaacaacaggtccagtgctgatccacgttgtcactgagaaaggcaggggctactcatatgcagagaaagcagcagacaagtatcatggagtcgtgaagtttgatccggccacaggaaagcaattcaaatccaacaccaagactcagtcttatacaacatattttgccgaggctctgattgctgaagcagaggcagataaagacattgttgctatccatgcagcaatgggaggggggacagggttgaaccttttcctacgtcgcttcccaagacgatgttttgatgttggaatagctgagcagcatgctgtaacttttgctgcaggattggcgtgtgaaggcctgaaacctttttgtgctatctactcatctttcatgcaaagggcttatgaccaggtagtgcatgacgtggacttgcagaagctacctgtacgatttgcaatggacagagcagggctggttggagcagatggtcctacacattgtggctctttcgatgtcacatttatggcatgcttaccaaacatggtagtcatggctccttcagatgaagctgagctatttcatatggttgcaactgcagctgctatagacgacagacctagctgctttcgataccctagaggaaatggtaaaggtgtagagctgccacccggaaacaaaggcattccacttgaggttggaaaaggtcggatattaatagagggggagagagtggcactcttgggctatggaacagcagttcaaagctgtttggctgcagctgctttagtagagcctcgtggtttacggttaacagttgcagatgcacgattttgcaagccactggatcatgctctcatacgcagcctggcaaaatctcacgaggttctgatcaccattgaagaaggatcaataggtggttttggatctcatgttgctcagttcatggccctagatggacttcttgatggcaaattgaagtggaggccgttggttcttcccgatagatacattgaccatggatctccagttgaccaactggcagaagctggtctcacaccatctcatattgcagcaactgttttaacatacttggacaaacaagagaggctcttgaggtcatgtcataaatctgaggttctatttctcagaaatctgtacaaatagaatgttgtggtaatttttccttccatctataattgatgtaaaatgtagcgttagccatcatctccatagttgtatcactatatattgctacaagaagcaaaatgatctcaggggctcatgt

SEQ ID NO: 7244 - DNA, 2598 bp, Medicago truncatula
caataatattattataataataaccatactatataaataataattttatattaaccaacacaaacaaaagttgttgttacatacattgcattgcacacttcttcctccattttcagtttgttattatggatctctgttcattagcatgtccttcttttgtcacaccttgtgatcccagaagaacacttcctcttccttcttcttcttcttctcactctcaatggggtcttcatttcttctctcactctcaacaacacaacaaactcaagaaaaagtttggtgttgttcatgcttcactttctgagatgggagaatattattctcaaagacctcctactccactacttgacactattaactacccaatccacatgaaaaatctctccaccaaggagctgaaacagcttgcggatgaactacgttctgatgttattttcagtgtttcaagaactgggggacatttaggttcaagtttaggtgttgttgaactaactattgctcttcactatgtttttaatacacctcaggataagattttgtgggatgttggtcaccagtcataccctcataaaatacttactggtagaagggataagatgcataccatgagacagactaatggattgtctggatttacaaaacgttctgagagtgaatatgattcttttggcactggtcatagttcaactactatttcagctggacttggaatggctgttgggagagatttgaagggaagaaagaatgatgtagttgctgttattggtgatggtgctatgacagcgggtcaagcttacgaagcaatgaacaatgctggatatcttgattctgatatgattgttattttgaatgacaacaaacaagtttctttaccaactgctactcttgatggacctataccacctgtaggagctttgagtagtgcactcagtaggttacaatcaaacaaacctcttagagaattgagagaggttgcaaagggagtaacaaaacgaattggaggtcccatgcatgaattggccgcgaaagttgatgagtatgctcgtggtatgatcagtggtactggatcaactctttttgaagagcttgggctctactatatcggtcctgttgatggtcacaacatagatgatctagttgccattctcaaagaagtcaaaactactaatagtaccggtcctgtattgatccatgttatcaccgaaaaaggccgcggatatccatacgcagagaaagccgctgacaagtatcatggagttgctaagtttgatccaccaactggaaagcaattcaaagtagcagctaaaacacagtcttacacaacatactttgcagaggctttgattgcagaagccaaagctgacaaagacattattgcaatccatgctgcgatgggaggtggaactgggatgaatatcttccatcgccgattcccaacaagatgctttgacgtggggatagcagaacagcatgccgttacatttgctgcaggtctagcttgtgaaggccttaagcctttctgtgcaatttactcctcattcttgcaaagggcctatgaccaggtggtacatgatgtggatttgcagaagcttcctgtaagatttgcaatggacagagctgggttagttggatcagacggtcctacacactctggttcttttgacgtcacttttatggcatgcctacccaacatggtggtgatggctccttctgatgaagcagagctttgccacatggttgccactgcagcggccattgacgatcgaccaagttgtttccgatacccgaggggaaatggcattggtgttgaacttccaaccgagtacaaaggcattcctcttgagattgggaaaggtaggatactaattgaaggggaaagagtagccctattgggctacggatcagccgttcagaactgtttggccgcggcttccttagttgaacaacatggcttgcgcttaaccgttgctgatgcacgtttctgcaagccattggatcgatccttgattcgcagtctggccaaatcacacgaggttctgatcaccgtagaagaaggatcaattggaggatttggttctcatgttgctcagttcatggcccttgatggcctcttagatggaaatttgaagtggaggccggtggttcttcctgaccgatatattgaccatggatcacctgctgaccaattgtgtatggctggtcttacaccctctcacatagcagcaacagtgttcaacatacttggacagacaagagaggcattagaggtcatgtcataagaaaaatacaaaggggttcaatttgtcattcccctcaatatacacgatacaacatttttgtgattaattcatcttgtctaatgtgaagaagtaatgatgtaaattatttaactagataatgcaggttgtcaaatagtggcatgtatggaatcacgatgtgacaaaatcctcaatgacaccgtaatttcgaaatgaagcttttcaaaaatacggtgactcactaagattgtgttacactattgcaaattcatacatgcactataatactaactaattataaatgcgaaaataagtcttaacttttttctgcgagtgcaaa

SEQ ID NO: 7245 - DNA, 2723 bp, Solanum lycopersicum
aaatatatatatgtacatattcatacaagtgtaccttcacattcctccacattggatcaacaccatttgatcctttttatcaaagattcatttttttttcacttaccctccaattacatcttcataaacaacattttagtgacagtagcaccaacacaccccactagaattttcttgaagtaaaccccttttttcaagaatcaagaaaccacttataaaatttgtgggttttcattgaaacaaaggaaaaaaaacagttgaattgactaatcatggctttgtgtgcttatgcatttcctgggattttgaacaggactggtgtggtttcagattcttctaaggcaacccctttgttctctggatggattcatggaacagatctgcagtttttgttccaacacaagcttactcatgaggtcaagaaaaggtcacgtgtggttcaggcttccttatcagaatctggagaatactacacacagagaccgccaacgcctattttggacactgtgaactatcccattcatatgaaaaatctgtctctgaaggaacttaaacaactagcagatgaactaaggtcagatacaattttcaatgtatcaaagactgggggtcaccttggctcaagtcttggtgttgttgagctgactgttgctcttcattatgtcttcaatgcaccgcaagataggattctctgggatgttggtcatcagtcttatcctcacaaaatcttgactggtagaagggacaagatgtcgacattaaggcagacagatggtcttgcaggatttactaagcgatcggagagtgaatatgattgctttggcaccggccacagttccaccaccatctcagcaggcctagggatggctgttggtagagatctaaaaggaagaaacaacaatgttattgccgtaataggtgatggtgccatgacagcaggtcaagcttatgaagccatgaataatgctggttacctggactctgacatgattgttatcttaaacgacaatagacaagtttctttacctactgctactctggatgggccagttgctcctgttggagctctaagtagtgctttgagcaggttacagtctaataggcctctcagagaactaagagaagtcgcaaagggagttactaagcagattggtggtcctatgcatgagcttgctgcaaaagttgatgaatatgctcgtggcatgattagtggttctggatcaacattgtttgaagaacttggactttactatattggtcctgtggatggtcacaacattgatgatctaattgcgattctcaaagaggttagaagtactaaaacaacaggtccagtactgatccatgttgtcactgagaaaggcagaggttatccatatgctgagagagctgcagataagtatcatggagttgccaagtttgatccagcaacaggaaagcaattcaaagccagtgccaagacacagtcctatacaacatattttgccgaggctttaattgcagaagcagaagcagataaagacattgttgcaatccatgctgccatggggggtgggaccggaatgaaccttttccatcgtcgcttcccaacaaggtgttttgatgttggaatagcagaacaacatgcagtaacctttgctgctggattggcttgtgaaggcattaaacctttctgtgcaatctattcgtctttcatgcagagggcttatgaccaggcaagcaaaaatgcctccaattattctcattttgttgaatatagtgcagtagtgcatgacgttgatttgcaaaagctgcccgtgaggtttgcaatggacagagcaggtcttgttggagcagatggtccaacacattgtggtgcatttgatgttacttacatggcatgtcttcctaacatggttgtaatggctccttctgatgaagcggagctatttcacatggtagcaactgctgccgccattgatgacagaccaagttgttttagatacccaagaggaaatgggatcggtgtagagcttccggctggaaacaaaggaattcctcttgaggttggtaaaggtaggatattgattgagggggagagagtggctctattgggatatggctcagcagtgcagaactgtttggatgctgctattgtgctagaatcccgcggcttacaagtaacagttgcagatgcacgtttctgcaaaccactggaccatgccctcataaggagccttgcaaaatcacatgaggtgctaatcactgtcgaagaaggatcaattggaggttttggatctcatgttgttcagttcatggccttagatgggcttcttgatggcaagttgaagtggagaccaatagttcttcctgatcgatacattgaccatggatctcctgttgatcagttggcggaagctggcctaacaccatctcacattgcagcaacagtatttaacatacttggacaaaccagagaggctctagaggtcatgacataagatggaagaagcgtagaaagatatatagtatattgtaaaatatagttttaggtcatgacataagcagattaacatatactttatcctccaaaatatgtttaaagtttccatggctgagttcaagccctcctcttagtctccaccatgacttatgattaactcatatggtttctgattgtgtaaccggttcttgatttttcgagttatgaagatgaatgaaaatgaaagattttacttttagaa

SEQ ID NO: 7246 - DNA, 2283 bp, Elaeis guineensis
cctcctcctctgttattgtggtacctgttgttgcttctaaatcctatggctctctctacattctctttcccttcccagatgccctctcttctgtgtccccactggcttggcggtgctgacctccattcccaccaacatcagtatagacttctcaagactaggaaaaggccatgtgtttgtgcatcactatcagagcatggagagtatcattcacagagaccaccaactcctctcttggacactatcaactatcccatccatatgaagaatctctcaatcaaggagcttaagcagctgggggatgagctccgttcggacatcatcttccatgtctcaaaaaccggaggtcatcttggctcgagccttggtgtggttgagctaacagttgccctccaccatgtcttcaatgctcctcaagataagatactctgggatgttggtcatcagtcatatccacacaagatcttgacagggaggagagacaagatgccaactttgagacagacaaatggcttgtctggtttcactaaacgctcagagagcgagtatgactcctttggtgctggtcacagttccaccagtatctcggcggcccttgggatggctgttgggagagatctaaagggaagaaaaaacaatgtgatcgcagtaataggggatggagccatgactgccggacaggcatatgaggctatgaacaatgctggatatcttgattcagacatgattgtcatactgaatgacaacaagcaggtttctctgcccactgcaaatcttgatgggcctataccaccagttggagctttgagcagtgctctcagtagattgcagtctagccgacctctaagagaactcagggaggtagctaagggagtcacaaagcagattggtggctcaatgcataaactagctgcaaaagttgatgagtatgctcgaggaatgattagtggatctggttcaaccttgttcgaagagcttggtctctactacataggtccagttgatggtcacaacatggatgacctcgtcaccattctcaaagaggttaagagcacaaaaacaacaggcccagttttcatccatgttgtgactgagaaaggaagaggatacccctatgcggagagagctgctgacaagtatcatggtgtcgcaaaatttgatccatcaactggaaagcaattcaaatctagatccaagactcagtcttatacaaactactttgctgaggctttgatatctgaagcagaggtggacaaagatattgttgcaattcatgcagcaatgggagggggaacaggtctcaactactttcttcgccgctttccgacaaggtgttttgatgttggaatagcagaacaacacgcagtcacatttgctgctggtctagcctgtgaaggccttaagcctttttgcgcaatctactcatcattcttgcaacgggcttacgatcaggtggtacatgatgtggatttgcagaaactgccggtaaggtttgcaatggatcgagctggactcgttggggctgatggcccaactcattgtggatcattcgatgtcacatacatggcatgcctgccaaacatggtcgtcatgactccttcagatgaggccgaactatttcacatggttgccactgcagcagccatcgatgaccggccatcttgtttccgatatcctagaggtaatggggttggtgttccactaccagcaggaaacaagggtgtccctcttgaggtgggcaaaggaaggatactgattgagggtgagagggtggcacttctgggatatggagcagctgttcaaggctgcttggctgctgcttccctgctagaggaacatagcctgaaagtaacagttgctgatgcgcgcttctgcaagccattggatcatgccctcattcggagcctagctagatcacatgagctgcttatcacggtcgaagaaggctccatcgggggatttggctctcatgttgctcagttcatggcacttgatgggctccttgatggcaaactgaagtggagaccattggttcttccggacagatacatcgaccatgggtcaccagccgatcagttagcagaggctggcttgacaccatctcatgtagcagccactgtatttaatatgcttggacaagccagagaagctcttgaaatcatgtcatagggggaaaaaacagcaggaaaatgtgttcttcatctagatatagagggtggtctttgtcccattgcttgtacattttgatgttagtgtggtaataaagaacataggtctttgagc

SEQ ID NO: 7247 - DNA, 2410 bp, Flaveria ramosissima
ctcacgctccggtggtgcagcattgcttctttggtaaagatctgcaacacccgcaatcgtcccacaagcccttcaatcagttgagtaaaagggtaggtgtggttcaatcgacaatggctgatagaggtgagtatcactcgcagagacccccgactccactgttggacaccattaattacccaattcacatgaagaatctctcgatcaaggaactgaaacaactagccgatgagctgcggtctgatgtaatctttaatgtttctaagactggtggtcatttgggttcgagcctcggtgtggtggagctcactgtggctcttcattatgtgttcaatacgccgcaagataagatcctttgggatgttggtcatcagtcttacccacataaaatattgacgggaagaagagaccgaatgcataccattagacagacaaacgggttggcgggtttcactaaacgctctgaaagcgagcatgattgttttggcacgggccatagctctaccaccatttctgcaggttaggtatggctgtgggaagggatctgaaaggtggaacaaatgatgtagttgctattataggtgatggtgctatgaccgcgggtcaagcctatgaagccatgaacaacgcgggctatctagattcagatatgatagtcatccttaacgacaataaacaagtctcattaccaactgcaacacttgacgggcctatacctcctgttggcgctttaagcagtgctctcagtaggctacaatctaaccgccctcttagggaactgcgtgaagttgccaaagaagttaccaaacaaattggcaggcccatgcatgaacttgctgctaaagttgatgaatacgcccgtggtatgattagtggttcaggttcaacactgtttgaagaacttggtttgtattacatcgggccagttgatggtcatagcattgatgatcttgttgccattcttaaagaggtcaagagtactaaaacaacgggtccggttttgattcatgttattacagagaaaggtagaggatatccatatgcagagaaagctgctgataagtaccatggtgtggcgaaatttgaccctgcaactgggaaacagttcaagtcaagtgcagcaactcaatcttacactacttactttgcagaggcattgattgctgaagctgaggtggataaaaagattgtgggtatccatgctgcaatgggtggcgggactgggatgaacctatttgaccgccggttcccgaaccggtgttttgatgtcgggatcgctgaacaacacgcggttacttttgctgctggtttggcctgtgaaggccttaagccattttgtgcaatttactcatcattcctgcaaaggggttatgatcaggtggtgcatgatgtggacttgcagaagttgcctgtgaggtttgcaatggaccgagctgggctcgttggtgcagatggcccgacacactcgggctcgtttgatgtgacttacatggcgtgcctcccgaacatggtggtcatggctccttctgatgaggctgagctttttcacatggtggcaaccgctgcagccattgatgacagacctagttgcttccgttatccccgtgggaacgggataggcgcgcccctgccacctggcaacaaaggcgttcctctcgaggttggaaaaggtagaatattgatcgaaggagagcgtgtcgcgctcctaggctatggaaccacggtccagagttgcttggtagcagctcgtttggtacaagaacgaggcttaaacataacagttgcagatgcccgtttttgcaaaccgttggaccataatctcatccgggcccttgcaaagtcacacgaggtcttgataacagttgaagaaggatcaatcggtgggttcggctcacacgtggctcacttcatggctctagatggtcttctagatggaaaactaaagtggagaccactggtgctcccagaccgttacatcgaccatggtgcgcctgatgaccaactagccgaagcgggcctgactccatcgcatatagctgcaaccgtattcaacgtactcgggcaaacaagagaggctctggaggttatgtcatagagtaatcttgtgtgttctgtggtgtacacaaatggatatatgcatagatgtacaacagttgctgttgaacttgtaagagtcaaaatatagagtcaaccctttgtaaaaagtcaactgatatagtcaactgatttgtgttgggtttatatagttacggatagtttggtacatcttcagaaaccaatattccttgatatttataaaacccgacccgagtttagtcgttagattgttgacttttaggtggtatggaaatgggtccgggttaatgatataagacccacattagaacccggttatttaaactggaggccc

SEQ ID NO: 7248 - DNA, 2072 bp, Eutrema parvulum
aatttttgttttgttcagtcaaaggtaaggacaagagtatgtggctcacttgtagagaaaggtgaatatcattccattagaccaccaactcctttattggacacaatcaaccatccaattcacatgaaaaatttgtccatcaaggaactcaaagttctttcagacgagttgaggtctgatgttattttcaatgtttcgaaaaccgggggacatttaggttccaatctcggtgttgttgagcttacagtggcttttcattacatcttcaatactcctcaagataagaacctttgggatgttggtcaccagtcttatcctcacaagattctaacgggtagaagaggaaagatgaaaacaatgagacagaccaatggcttgtccggtttcaccaagcgaggagagagtgagcatgattcttttggcactggacatagctcaaccacaatatctgcaggcttggggatggctgtgggaagagacctgaagggtaggaacaacaacgtggttgctgttataggcgatggcgcaatgacagctggacaggcttatgaggccatgaacaatgctggctatttagactctgacatgattgtgattctcaatgacaacaagcaagtctctttgcctactgctaacttggatggaccaacaccacctgttggagctttgagcagtgctcttagtaggttgcagtctaaccgtcctctcagggagttgagagaagctgcaaaggcaagtaattattctcttacttgtggtgtgacaaagcaaattgggggatcaatgcaccggttagcttcgactgtagatgattatgctcgtggattgattagtggagctggttcaaaattatttgaagaacttggtatgtactatattggtccagttgatggacacaacatagatgatttggtttccattcttaaagaagtaaagagcaccagaaccatagggccggttcttattcatgtcgtgactgagaaaggtcgcggatatccttatgcagagagagctgatgacaagtatcatggagtcttgaaatttgatccagcaactggtaaacagttcaaaaacattgctgagactcagtcttacacgacctattttgcggaggctttgatttcggaagcagaggcagacagagatattgttgctattcatgcagccatgggaggtgggactgggttgaatctcttccaacgccgcttccctactagatgtttcgatgtcggcatagcagaacaacacgcagttactttcgctgctggtcttgcttgcgaaggtttaaagccattttgtgcaatctactcgtctttcatgcaacgagcttatgaccaagttgtacacgacgttgatctacagaaactacctgtgagatttgcgatggacagagcaggacttgtgggagcagatggtccaacgcattgtggagcctttgatgtgacgtttatggcatgtcttccaaacatgatagtaatggctccatctgatgaagctgagctttttaacatggttgcaaccgctgcagctatagatgatcgtccttcttgctttagatatcctagaggaaatggtattggcgtttcacttcctcctggaaacaaaggtgtccctcttcagattggaaaaggtaggatactaagggaaggcgagagagtcgcactcttaggctatggatcagctgttcaaaattgtttggaggcttcttctatactcgataaacgtggaatgaaagtaaccgttgctgatgcgagattttgcaagccgttagatgttgctctcattcgaaacttagctaaatctcacgaggttctagtcacggttgaagaaggttcgattggagggtttggatcgcatgtggtacaatttctagcactcgatggccttcttgatggaaagctcaagtggagaccaatggtactacctgaccggtatatcgagcatggatcaccactggatcaactggctgaagctggcctcacagcttctcacattgcagccaccgcacttaacttaattgggacacccagagaaaccttgttttggaagtaatgggtatgcaacagatggac

SEQ ID NO: 7249 - DNA, 2430 bp, Ambrosia trifida
accaccgcttaattccaccacaccacattctcaattccacaattattataaaaaaaatccaatctttataatctttatcatggccctttgtggtttgcatttcctccacatattaaccacaggtcaatcacttcccacacttctttgatccaacattgcttctatggaaaagatctgcaaaagggtcaatccttttctcacagaccctttaatcagttaggtaaaagatcaggtgtggttgttgaagcaacactgtctgagagaggagagtatcactcacagagacctcctactcctcttttggataccattaattacccaattcatatgaagaatctctcaattaaggaactgaagcagctagctgatgaggttaggtctgatgttatctttaatgtatcgaaaaccggtgggcatttgggttcgagtcttggtgttgtggagcttacggtggcccttcattacgtgttcaatacgccacaagataagatactttgggatgttggtcatcagtcttacccgcataaaatattgactggaagaagggatcggatgcataccattagacagacaaatgggttggcgggtttcaccaaacggtctgaaagcgagcatgattgttttggcacggggcatagctctaccaccatttctgcagggttaggtatggctgtgggaagggatttaaaaggaggaacaaacgacgtagttgccattataggtgacggtgctatgaccgcgggtcaagcttatgaagcaatgaacaatgcgggttatctagattcggatatgatagttattcttaacgacaataaacaagtctcgttaccaactgcaacacttgatgggcctatacctcccgttggagctttaagcagtgctctaagtaggttacagtctaaccgtcctcttagggaactgcgtgaagtagccaaagaagttaccaacaaatgtgggcccatgcatgaacttgcggctaaagttgacgaatatgcccgtggtatgattagtggttcagggtcgactctgtttgaagaacttggtttatattacattgggcctgttgatggtcatagcattgatgatcttgttgccattcttaaagaggttaagagtactaaaacaacgggtccggttttgattcatgttattaccgagaaaggtagaggatatccatatgctgagaaagcggctgataagtaccatggtgtggcgaaatttgacccggcaactgggaaacaattcaaatcaagtgcaccgactcagtcttacacgacttactttgcagaggcgctgattgctgaagccgaggcagatagaaaattgtgggtatccatgctgcgatgggtggtggacggggatgaatctattccaccgccgattcccgagtcggtgttttgatgttgggattgctgaacaacacgcggttacttttgctgcgggcttggcgtgtgaaggccttaagccgttttgtgcgatatactcatcatttctgcaaaggggttatgatcaggtagtgcatgatgtagatttgcagaagctgcctgtgagatttgcaatggacagggctgggcttgttggtgccgatggcccaacacattcgggctcgtttgatgtcacttacatggcatgcctcccgaacatggtggtcatggctccttctgatgaggctgagctttttcatatggtggcaaccgctgctgccattgatgacagacctagctgcttccgttatccacgtggaaacgggataggcgttcccttgccacctggcaacaaaggcattcctctcgaggttggaaaaggtcgaataatgcttgaaggagaacgggttgcgctcctagggtatggaacagcagttcagagttgcttagctgcagccggtttagtaaaaggacgaggtttaaacataacagttgcagatgctcgtttctgcaaaccgttggaccatcatctcatccgggcccttgcaaagtcacacgaggtcttgatcacagttgaagaaggatcaataggtgggttcggttcacacgttgctcatttcatggcactagacggtcttctcgatggaaaactgaagtggagaccactggtgcttccagaccgttacatcgaccatggtgcaccagatgaccagctagccgaagcggggttgactccatcgcatatagccgcaaccgtattcaacgtacttgggcaaacaagagaggctctggaggttatgtcataaagggttgttgtgtggtgagtgatgtgcacaaatagatatatttatctgcatagagggttcttgttgctcaactttttatattgtgaaaatagagttgtaaccatctgtataaagtcaaccgaaatgtattgggtttgttgacttattacgtggcgcgggtcaatactaaaagacccgtcttagagcccgatcgtttaaac

SEQ ID NO: 7250 - DNA, 2498 bp, Salvia sclarea
ggttactgatctgtcctctgtaaatgcgccacccataaagccatatgcacaaaccaatcccaccaacattttgttccttaacaatccctgcatttaatccaagccctcatcattcccatcattttcacacacacacacacagtggctagtgttcttgagagaagttcaaaaacagagcccacctcaagagctggtgcatgaacagatagtaaagttggtatcttttttctgggaaatctgcaatctttgattgtttggagtgaaattttgagctgtctatacacacatacaagatggctttatgcccatttgcattttctgggagtttagtagctgcagatgctcaaaagcacaccaatttctgctctcagtggctacatggtgcagatctaccatttcaccccttctgcaagaacagtcagattaggaaaagctctacaggaatttgtgcaacactgtctgaaagaggggaatacttctcacaaaagcctccaactccccttttagacacaatcaactatccaattcacatgaaaaacctctccactaaggaactgcaacaactcgccgacgaactgcggtccgacgtcatcttcaacgtgtccaagactgggggtcacctgggatcaagccttggtgtgattgagctaaccgtggctcttcattacgtgttcaatgctcctcaagatcgaattctgtgggatgttggccaccaggcttatccacacaagattctgacaggaagaagagacaggatgccgagtttaagacagaccggtggcctctctggtttcacgaagcggtctgagagcgactacgactgctttggcgccggtcacagttccacaactatctctgcaggactaggaatggctgtggggagggatctgaaaggaagaaaggacaacgtcgtggctgtgataggcgacggggctatgacagctggtcaggcctatgaggcaatgaacaatgctggctacctggactcggacatgattgttattctcaatgacaataagcaagtttccttgcctactgccaatctggatgggccaactgctcccgtgggagccttgagcagtgctttgagtaggttgcagtcgaaccggcctctcagagagctaagggaagtcgcgaagggagtcaccaagcagatcggagggcctatgcacgagcttgctgcaaaagtcgatgagtatgctcgtgggctgatcagtggctctggatcaacactctttgaagagctcgggctttactacatcggtccagttgatggtcacaatcttgatgacctgacagcgattcacagagaggtcaagagtactaaaacgacgggtccggtgttgatccatgttgtgactgagaaaggcagaggatatccttatgcagagaaagctgcagataaataccatggagtgaccaagttcgatccagcaacggggaagcagtttaaatcgagtgctccaactcagccttacacaacctactttgctgaggccctgattgcagaagctgaagtagacaaggatatcgtagcaatccatgcagcaatgggaggtgggacgggtttgaacctcttccaacgccgtttcccaacgaggtgtttcgatgttgggatagcagaacagcatgctgtgacttttgctgcaggtttggcctgtgaagggatcaagcccttctgtgcaatctactcatccttcttgcaacgaggctacgaccaggtagtgcacgacgtggatttgcagaagctgccggttaggtttgctatggacagagccggcttggtgggagcggatggcccgacacattgtggagcttttgatgttacattcatggcatgccttcccaacatggtggtgatggctccttcagatgaggctgaattgtttaacatggttgcaactgctgcagctatagacgacagaccaagctgcttccgttatccaagaggcaacggtataggtgtggagttgccgcccggaaacaaaggcaaacccctcgagattggaaagggccgtatactaattgaaggggagagggtggctctcttgggttatggatcagcagttcagagctgtttggctgcagctgccttggtagaaacccgcggtttacagttgacagtagccgatgctcgtttctgtatgccattggatcatgctcttattcggagcttggccaaatcacacgaggtcttgatcactgtggaagaagggtcaattggtggttttggatctcatgtagctcacttcatggccttggatggcctccttgatggcaacctaaagtggagaccattggttcttcctgatcgatacatcgaccatggagccccggtggatcaactgatggaagcaggactcacgccttcacacatcgcggcgactgtctttaatattctaggaaaagctagggaggctctggaaattatgtcatagatcgaagagctgtacaaaaaacaacaaactctgaaatatagtgttagcttcagcttgtct

SEQ ID NO: 7251 - DNA, 2694 bp, Solanum phureja
ttcacattcctccacattggattaacaccatttgatactttttatcaagattcaatttttttacttccattatcaacccttttctcatccctccaattacatcttcataaacaacattttagtgacagtagcaccaacacaccactagaattttcttgaagatatttgaagtaaaccccttttcaagaatcaagaaaccacttataaatttgtgggttttcattgaaacaaagaaaaaaaaacacttgaattgactaatcatggctttgtgtgcttatgcatttcctgggattttgaacaggacagctgtggtttcagattcttcaaagactgcccctttattctctgaatggattcatggaacagatctgcagtttttgttccaacacaagcttactcatgaggtcaagaaaaggtcacgtgtggttcaggcttccttatcagaatctggagaatactacacacagagaccgccaacgcctattttggacactgtcaactatcccattcatatgaaaaatctgtctctgaaggaacttaaacaactagcagatgaacttaggtcagatacaattttcaatgtatcaaagactgggggtcaccttggctcaagtcttggtgttgttgagctgacagttgctcttcattatgtcttcaatgcaccccaagataggattctctgggatgttggtcatcagtcttatcctcacaaaatcttgaccggtagaagggacaagatgtcaacattaagacagacagatggtcttgcaggatttactaagcgatcagagagtgaatatgattgctttggcaccggccacagttccaccaccatctcagcaggcctagggatggctgttggaagagatctaaaaggaagaaacaacaatgttattgccgtaattggcgatggtgccatgacagcaggtcaagcttatgaagctatgaataatgctggttacctggactctgacatgattgttatcttaaacgacaatagacaagtttctttacctactgctactctggatgggccagttgctcctgttggagctctaagtagtgctttgagcaggttacagtctaataggcctctcagagaactaagagaagtcgcaaagggagttactaagcaaattggtggtcctatgcatgagcttgctgcaaaagttgatgaatatgctcgtggcatgattagtggttctggatcaacattgtttgaagaacttggactttattatattggtcctgtggatggtcacaacattgatgatcttattgctattctcaaagaggttagaagtactaaaacaacaggtccagtactgatccatgttgtcactgagaaaggcagaggttatccatatgctgagagagctgcagataagtatcatggagttgccaagtttgatccagcaacaggaaagcaattcaaagccagtgccaagacacaatcctatacaacatattttgccgaggctttaattgcagaagcagaagcagataaagacattgttgcaatccatgctgccatggggggtgggaccggaatgaaccttttccaccgtcgcttcccaacacggtgttttgatgttggaatagcagaacaacatgcagtaacctttgctgctggattggcttgtgaaggcattaaacctttctgtgcaatttattcgtctttcatgcagagggcttatgaccaggcaagcaaaaatgcctccaattattctcattttatagaatatagtgcagtagtgcatgacgttgatttgcaaaagctgcctgtgaggtttgccatggacagagcaggtcttgttggagcagatggtccaacacattgtggtgcatttgacgttacttacatggcatgtcttcctaatatggttgtaatggctccttctgatgaagcagagctatttcacatggtagcaactgctgccgccattgatgacagaccaagttgttttagatacccaagaggaaatgggattggtgtagagcttccggctggaaacaaaggaattcctcttgaggttggtaaaggtaggatattgattgagggggagagagtggctctattgggatatggctcagcagtgcagaactgtttggatgctgctattgtgctagaatcccgcggcttacaagtaacagttgcagatgcacgtttctgcaaaccactggaccatgccctcataaggagcctcgcaaaatcacatggggtgctaatcactgttgaagaaggatcaattggaggttttggatcgcatgttgttcagttcatggccttagatggacttcttgacggcaagttgaagtggagaccaatagttcttcctgatcgatacattgaccatggatctcctgttgatcagttgtcggaagctggcctaacaccatctcacattgcagcaacagtatttaacatacttggacaaaccagagaggctctagaggtcatgacataagatggaagaagcgtagaaagatggtatattgtaaaatatagttttaggtcatgacataagcagattaacatatacttatcctccaaaatatgttttaagtttccatagctgatttcaagccctcctcttagtctcctatatgactcatatggtttctgattgtgtaaccggtgctggatttttcgagttatgaagataaatgaaaatgaaagattttacattagaa

SEQ ID NO: 7252 - DNA, 2310 bp, Glycine max
gtcagcgcctccatggatctctccgctctctcatcataccgcactctcgggaagttacttcctcttccctctcactctcaatggggtctccatttcctcgcccacgctcaccgcctccaccagatgaagaaaaggccatgtggggtatatgcatccctctccgagagtggagagtattattcccaccgaccgccaactcccctactagacaccgtcaactatcctattcatatgaagaatctctctgccaaggagctgaaacaactcgcggatgaactgcgttctgatgttattttcagtgtttctagaactgggggccatttgggctcaagccttggtgtggtggaactcactgttgcacttcactatgtcttcaatgcccctcaggacaagatactgtgggacgttggtcaccagtcttacccgcataagatactcaccggtagaagggaccagatgcataccatgaggcagacaaatggcttatctggcttcaccaaacgttctgagagtgaatttgattgttttggcactggtcacagctccaccaccatttcggcaggacttggaatggctgttgggagggatctgaagggaagaaagaataacgtggttgctgttataggcgatggtgccatgacagcagggcaagcttatgaagccatgaacaatgctggatatcttgattctgacatgattgttattctaaatgacaacaagcaggtttctttaccaactgctactcttgatggacccataccacctgtaggagccttgagtagcgctctcagtagattacaatcaaataggcctcttagagaattgagagaggttgccaagggagttactaaacgaattggaggtcctatgcatgaattggctgcaaaagttgacgagtatgctcgtggcatgatcagtggttctggatcatcactttttgaagagcttggactctactatattggtcctgttgatggtcataacatagatgatcttgttgccatcctcaacgaagttaaaagtactaaaacaaccggtcctgtattgattcatgttatcactgaaaaaggccgtggatacccctatgcagaaaaggcagcagacaaataccatggggttaccaagtttgacccaccaactggaaagcaattcaaatccaaggctaccactcagtcttacacaacatactttgctgaggctttgattgcagaagccgaagctgacaaagacgttgttgcaatccatgctgctatgggaggtggaactggcatgaatctcttccatcgccgtttcccaacaagatgctttgatgtggggatagcagaacagcatgctgttacatttgctgcaggtctggcttgtgaaggtcttaaacctttctgtgcaatttactcatcattcatgcagagggcttatgaccaggtggtgcatgatgtggatttgcagaagctgcctgtaagatttgcaatggacagggctggattagttggagcagatggtcccacacattgtggttcttttgatgtcacatttatggcatgcctgcctaacatggtggtgatggctccttctgatgaagccgaccttttccacatggttgccaccgcagcagccattaatgatcgacctagttgttttcgatacccaaggggaaatggcattggtgttcagctaccaactggaaataaaggaactcctcttgagattgggaaaggtaggatattgattgaaggggaaagagtggctctcttgggctatggatcagctgttcagaactgtttggctgcagcttccttagtggaatgtcatggcttgcgcttaacagttgctgatgcacgtttctgcaaaccactggatcggtccctgattcgcagcctggcaaaatcacatgaggttttaatcacagttgaagaaggatcaattggaggatttggttctcatgttgctcagttcatggcccttgatggccttctagatggcaaattgaagtggcggccaatagttcttccggatcgttatatcgatcatggatcacctgctgaccaattgtctttagccggtcttacaccatctcacatagcagcaacagtgttcaatgtactaggacaaacaagagaggcactagaggtcatgtcatagaaatattaaggggttcaatttttcacttcacacgatgtacaaagtataacatgattcaccatgtgtaatatgaaaaagtaatgtaatattgtgaaattttgaagtgtatgatgtagattgtcatatagtaaaacgactagttataaaagagaaaaatgttaaacttttctt

SEQ ID NO: 7253 - DNA, 2692 bp, Phalaenopsis aphrodite
ctggactggaacgttgtgcgatagagacagctgaggcaaagagacagaagactgtctcagctgattttcttcttgcatagctagttaatctcagccacacacctctatcaggccttctcaaagacaaattttgcagatccattaaactaaaagtcctaattttgtttcatctctctaacttcagccgtccttcctttctcctgttcttcttggccttaatcctctatttatgcaattcctctgaaactcttttattgatgcttcggtacccaatgaatctctccgcactcttttacccatgccagctccccgctggaagcatagtttctggatgcacgagccagtctccactttcttcctcaagattactccgtggttttcattcagaaacttatcagcatcaacatgcgaagaaaatgaaaaaggcgtatgtccatgcagcactgtcagattcaggagaatactactcgcagaagccacccacccccctactggatacaattaactatcccatccatatgaaaaatctttccatgaaggagctcaagcaactatcagatgagctaaggtctgatgtcatcttcaatgtatctaagacaggaggccacctcggttctagtcttggtgtggtggagctgactgtggctctccattatgtcttcaatgctcccatggacaagatagtatgggatgttggccatcagtcctacccacacaaaatcttgacaggtaggagggacaagatgccgactttgaggcagacgaatggattatctggattcactaagcgttcagagagtgaatatgattcctttggcaccggtcatagttctaccagcatttcagcagctcttgggatggctgtaggaagagatctaatggggaggaagaacaatgtgattgcagtgattggggatggagcaatgacggcagggcaagcttatgaagcaatgaacaatgctgggtatcttgactctgacatgattgttatacttaatgacaataagcaggtatcccttcccactgctaatcttgacggaccaataccacccgtaggagctctaagcagtgccctcagtaaactgcaatcaagcagacctcttagagagctgagggaggtagccaagggggtcacaaagcagattggtggatcgatgcatgaatttgcggcaaaagttgatgaatacgctcgaggaatgatcagcggatccaactcatccctgttcgaagagctagggctctactacataggaccagttgatggccataatttggatgatctaatcaccattcttaaggaagtgaaaagcaccaaaacaactggaccagttttaattcatgttgtgaccgagaaaggaagagggtatccttacgctgagagagcagctgataagtatcatggtgtggccaaatttgatccagctacagggaagcaattcaaaggaagtgctaagactcagtcttataccaattactttgctgaggctcttatagcagaagcagaagcggacaagaacattgttgcaatacatgctgctatgggcgggggaacaggactcaactacttcctccgccgctttccaaatcgttgctttgatgtgggaattgcagagcagcatgctgtcacttttgctgctggcttagcttgtgagggattaaagccattttgtgcaatctactcttctttccttcagcgagcttatgatcaggtgatacatgatgtggacttgcagaagctccctgtgaggtttgctttagaccgtgcgggccttgttggggctgatggacctacacattgtggatcatttgatgtaacttacatggcatgtttgccgaatatgatagtgatggctccttctgatgaggcagaactgtttcacatggtggccacagcagcagctattaatgaccgaccatcgtgcttccgatatccaaggggagatggcattggaattcctctgccaccaggaaacaaaggtgtgccgattgaggttggtaaaggtaggattttgagggagggtgaggctgtagctcttctaggatatggaacagcagttcaaagttgtttagctgctgctcgtcttgtggaacaccacggcctaaagctaaccgtagcagatgcccgcttctgcaaaccgctggaccaagctctgattcgcagcctcgcaaaatcacaccaggttttgataacagttgaagaaggatcaattggtggctttggctcacatgttgctcagttcatggctcttgacggccttctggatggcacaacaaagtggagaccattggttcttccggatcgatatatagagcatggatcgcctggtgatcaaatgtgtgaggcaggtctgacaccctcccatattgctgctactgcacttaatgttgctgggaagaaaatggaggctttggaaatcatgtcatatcaattaaataagtcatcttcaaagaacacagcttgagaaagatgtatgtctcaggatttcatatggatagattttggatgccaaagctttgacatttttgttggagtgtggtgagtgattattgacgaattggttatcatctacatgacaatgacaatgacaatcaatgcttggcaatcgttgaattgaatttacctctccttgtagcgatatgaatattttctacatgttttttgctttttaatgttctcaaaattttaaataaa

SEQ ID NO: 7254 - DNA, 2654 bp, Triticum aestivum
cctcgtcactctcccgctccacttcccttccagatccccacccatattccgcatagtgtgtcagcccgccacttgctctcggctctcggacgcgcttgggacgctcatttttggattcacctgcttgctcccaagcagaggataggggggagttgagccgttgcaatcttgagaaggaggagaggaaacaatggcgctctcgtcgaccttctccctcccgcggggcttcctcggcgtgctgcctcaggagcaccatttcgctcccgccgtcgagctccaggccaagccgctcaagacgccgaggaggaggtcgtccggcatttctgcgtcgctgtcggagagggaagcagagtaccactcgcagcggccgccgacgccgctgctggacaccgtgaactaccccatccacatgaagaacctgtccctcaaggagctgcagcagctctccgacgagctgcgctccgacgtcatcttccacgtctccaagaccggcggccacctcgggtccagcctcggcgtcgtcgagctcaccgtcgcgctgcactacgtcttcaacaccccgcaggacaagctcctctgggacgtcggccaccagtcgtacccgcacaagattctgacggggcggcgcgataagatgccgacgatgcggcagaccaacggcctgtccggcttcgtcaagcgctccgagagcgagtacgacagcttcggcaccggccacagctccaccaccatctccgccgccctcgggatggccgtcgggagggacctcaagggcgcgaagaacaacgtggtggcggtgattggggacggggccatgacggccgggcaggcgtacgaggcgatgaacaacgccggctacctcgactcggacatgatcgtgatcctcaacgacaacaagcaggtgtcgctgccgacggcgacgctcgacgggccggcgccgcccgtgggcgcgctcagcggcgccctcagcaagctgcagtccagccggccgctcagggagctgagggaggtggccaagggagtgacgaagcaaatcggcgggtcggtgcacgagatcgcggccaaggtggacgagtacgcccgcggcatgatcagcggctccgggtcgtcgctcttcgaggagctcgggctgtattacatcggccccgtcgacggccacaacattgacgacctcatcaccatccttcgggaggtcaagggcaccaagaccaccgggccggtgctcatccatgtcatcaccgagaaaggccgcggctacccctacgccgagcgagcctccgacaagtaccacggcgtggccaagttcgatccggcgacggggaggcagttcaaggtcccggccaagacgctgtcctacaccaactacttcgcggaggcgctcatagccgaggcggagcaggacagcaagatcgtggcaatccacgcggccatggggggcggcacggggctcaactacttcctccgccgcttccccaaccggtgcttcgacgtcgggatcgctgaacagcacgccgtaaccttcgcggccggcctggcctgcgaggggctcaagcccttctgcgccatctactcctctttcctgcagagaggctacgaccaggtcgtgcacgacgtggacctccagaagctcccggtgaggttcgccatggacagggcggggctggtcggcgccgacgggcccacccactgcggggccttcgacgtggcgttcatggcgtgcctacccaacatggtcgtcatggccccgtccgacgaggccgagctgctgaacatggtggccaccgccgcggccatcgacgaccgcccctcgtgcttccgctatccgaggggcaacggcatcggcgtcccgttgccggaaaactacaaaggcaccgccatcgaggtcggcaaaggcaggatcatgatcgagggcgagagggtggcgctgctggggtacgggtcggcggtgcagtactgcatggccgcctcgtccatcgtggcgcagcacggcctcagggtcaccgtcgccgacgccaggttctgcaagccgttggaccacgccctcatcaggagcctcgccaagtcccacgaggtgatcatcaccgtcgaggaaggctccatcggcggcttcggctcacacgtggctcagttcatggccctggatggccttctcgacggcaaacttaagtggcggccggtggtgctccccgacaagtacatcgaccatggatcaccggccgatcagctggtggaggccgggctgacgccgtcgcacatcgccgcgacggtgttcaacatcctggggcaggcaagagaggccctcgccatcatgacggtgcagaatgcctagagccagtgtgctgcctcctatagagaaccttgtacattttggtcgttaggtgattcagagagattagtcggcgtcagaaaattaaatgatcctcatcaggggaaacgttggtagttttcgttctttggtgcactgacgttgatgtacatggttaattgttcgtggagtggacacatacgttgtctttgtatctgtgaaatgtgtacgtatgttcatagattcttgacgactaggacccgcttatacagggagcacgagtcgctgttgtttggaattatgatgctttctgtatattttttaagaacgggcacttctcttctctaat

SEQ ID NO: 7255 - DNA, 2407 bp, Triphysaria pusilla
cgaaagttagattcaaaataaacccaaatcaaatttgtgtgcacggagccaaaagagaatcaagaatcttattttagtgtaaagttagaatctttatggctctgtgtacatttccttgttccggtaatttgcttaacggactaaatccatatgctcaaaagcagtcaactttatactctcatggggtgggtttacagcgtctctttggctgccaaaataaccaggtaagaaaaaggtcagcagctggtatttgtgcatctttatcagaaaggggagagtatttgtcacagaagcctgaaacccctcttttggatactatcaactatccaattcacatgaaaaatctcaatgtaaaggaattgaaacaactagcagatgaactgcgatccgatgttatcttcaacgtgtcgaaaaccgggggccatctcggctcaaaccttggcgttatcgagctaaccgtggctctgcattacattttcaatgctcctcaagataggatactttgggatgttggccatcagtcttatcctcataagattttaaccggacgaagagaaaaaatgccgactttgagacaaacggagggtctttgtggatttaccaagcggtcggagagtgattatgactgttttggcactggtcatagttctactactatctcagctggattagggatggctgtaggaagagacttaaaaggaagaaataataatgtagtggctgtgataggcgatggtgcaatgacagctggccaagcgtacgaagcaatgaacaacgccggatacttagactcggacatgattgtcatccttaacgacaacaaacaagtttctttgcctaccgctaatttagacggccccacacctcctgtcggagcattaagtagcactctcagcaggctacaatccaatcggcctctcagagaattacgagaagttgccaagggaatgactaagaaaattggagggtctacgcacgagcttgcagctaaagtggacgaatatgctcgtgggctcataagtgcttccgggtcgacattgtttgaagagctcgggctttactatatcggcccggtcgatggccacagtatcgatgacctgacagcgattcttagagaagttaagaatactaaaatcacaggcccggtgttgatccatgtcgtcaccgagaaaggcagaggatacccgtacgccgaaaaagccgacgataagtatcatggagtggccaagtttgatccggcaacgggaaagcaatttaaaacgagcactccaactcagtcgtacacaacctactttgccgaggctttgattgcagaagctgaggtggacaaggatatcgttggtatccatgctgccatgggaggtgggaccggcatgaaccttttccaacgccgttttccgactaggtgttttgacgtcgggatagccgaacagcacgctgtcacttttgctgccggtttagcttgtgaaggcataaaacctttttgtgcaatctactcatccttcatacaaaggggctatgatcagatagtgcatgacgtggatttgcagaagctgccagtgaggttcgcgatggaccgggctggcttagttggatctgatgggcccacacattgtggggcattcgacgtttcttttatggcgtgccttccaaacatggtggtgatggctccttctgacgaggccgaactatttcacatggttgcaatggcctctgctatagacgacaggccaagctgtttccgttatccgagaggcaacggcataggcgtcgagctgccacgaggaaacaaaggcattccacttgaggtcggtaagggccgaatactgattgaaggggaaagggtagccctcttagggtacggatcggctgtacagagctgtttagctgcagctgctctggtcgaacctcatggcttaaatttaacagttgccgatgctcgtttctgcaagccattggatcacgctcttattcgcagcttagccaaatcacatgacgtcttgatcacagttgaagaaggctcgattggtggatttggatctcatgttgctcagtttatggccctggatggacttcttgatggaaaaataaagtggaggccgttggttcttccggatcgatacattgaccatggttcaccggctgatcaactgatgcaagctgggttaacaccttcacatatagccgcaacggtttttaatattctcggaaatgctcgggaagctttaaagattatgtcttagttaatcaacagattgtgtaaaggaacatgttggattatatgtatttttatctccaacattgtaaaatcggggcttttattgagctcgggtttgtgtaatcatagaacaaacatactaattgtataaaaaagtttgcagtttgtgtaacaaaaaaaaaaaaaaaa

SEQ ID NO: 7256 - DNA, 2599 bp, Setaria italica
tcacccccgccgcactactactataggcaccccccctcccagcgcttttccgaatcctccgccattcttgcactcggcacactgttgctgccactgttagcttgcagctcaagctctcgccactagcgtttgggtcagttcttggagaaatcggacacttggttcgcccatcattgggagaagcttgtgctagcttgagcagggagggggagggggagcaatggcgctgtcgacgacgttctctgttccgcggggattcctcggcgtgccggctcaggactcccatttcgctccggcggccgagctccatgcccacaagcagcttcaggccaggcctatcaagcctcggcggaggccggcgtgcgtgtcggcgtcgctgtcggagcgcgaggcggagtactactcccagcggccgcccacgccgctgctggacaccatcaactacccggtacacatgaagaacctgtccgtgaaggagctccggcagctcgccgacgagctccgctccgatgtcatcttccacgtctccaagaccggcggccacctggggtccagcctcggcgtcgtggagctcaccgtcgcgctccactacgtcttcaacgcgccgcaggaccgcatcctctgggacgtcggccaccagtcgtacccgcacaagatcctgacggggcggcgcgacaagatgccgacgatgcggcagaccaacgggctagcggggttcaccaagcgcgccgagagcgagtacgacagctttggcacgggccacagctccaccaccatctccgcggcgctcgggatggcggtggggcgggacctcaagggcagcaagaaccacgtggtcgcggtgatcggcgacggcgccatgacggccgggcaagcgtacgaggccatgaacaacgccgggtacctcgactccgacatgatcgtcatcctcaacgacaacaagcaggtgtccctgccgacggccacgctcgacgggcccgtgccccccgtcggcgcgctcagcagcgccctctccaagctgcagtccagccgcccgctcagggagctccgtgaggtggccaagggcgtgacgaagcagatcggcgggtcggtgcacgagctggcggcgaaggtggacgagtacgcccgcggcatgatcagcggcccgggatcctcgctcttcgaggagctcggcctctactacatcggtcccgtcgacggccacaacatcgacgacctcatcaccatcctcaacgacgtcaagagcaccaagaccaccggccccgtcctcatccacgtcatcaccgagaagggccgcggctacccctacgccgagcgggccgccgacaagtaccacggtgtcgccaagttcgacccggcgacagggaagcagttcaagtccccggccaagacgctgtcctacaccaactacttcgccgaggcgctcatcgcggaggccgagcaggacagcaaaatcgtcgccatccacgcggccatgggcggcggcacggggctcaactacttcctccgccgcttccccaaccgctgcttcgacgtcgggatcgccgagcagcacgccgtcacgttcgccgccggcctggcctgcgagggcctcaagcccttctgcgccatctactcatccttcctgcagcgcggctacgaccaggtggtgcacgacgtggacctgcagaagctcccggtgcggttcgccatggacagggccgggctggtcggcgcggacgggcccacccactgcggcgcgttcgacgtcacgtacatggcgtgcctgcccaacatggtggtcatggccccgtccgacgaggccgagctctgccacatggtcgccaccgccgcggccatcgacgaccgcccatcctgcttccggtacccgagaggcaacggcatcggcgtgccgctgccgcccaactacaagggcactccccttgaggttggcaagggcaggatcctgctggagggcgaccaggtggcgctgctggggtacgggtcggcggtgcagtactgcctggccgccgcgaccctggtggagcgtcacggtctcaaggtcaccgtcgccgacgccaggttctgcaagccgctggaccaagccctgatcaggagcctcgccaagtcccacgaggtgctcatcaccgtcgaggaaggctccatcggagggttcggatcgcacgtcgcacagttcatggccctcgacggccttctcgatggcaaactcaagtggcggccgctggtgcttccggacaggtacatcgaccacggatcgccggccgatcagctggccgaggccgggctgacgccgtcgcacatcgccgcgacggtgttcaacgtcctggggcagaacagggaggcccttgccatcatggcaatgccgaacgcgtaggaaatgtggtgattccggcctatagagatgcttgtacatttgtcgttagatgtcaacagggagattagtctgctttggatgatgaaaatgccgtgggagcaacaacgagcgctttcattatgtattttgacactaaaaaaaatacagatatgttcttacggcaggcaatgtttttgaacaagggtcccaaacatccaaaattccagcgctgcgcaaacccagcat

SEQ ID NO: 7257 - DNA, 2276 bp, Arabidopsis lyrata
attaatactaccactatatatacgttggaatgtcatatcaaacacagattatcaaattctctcaaaatggctctctccgtatttgcctttccttcttacatatatagaaatccttcaattaaatattgcaaacctacttctatgtcttctacaaaaacttcaaaagtaagagcaacaattgcagagaaaggtgaatattattcaagtagaccaccaactcctttactggacacaatcaaccatccaatgcacatgaaaaatctgtccatcaaagaactcaaagttctttcggacgagttgagatctgatgttatcttcaatgtttcaaaaactggaggacacttgggttcgaatctgggtgttgttgagctcactgtggcccttcattacatcttcaatactcctcaagataagatcctttgggatgttggtcatcagtcttatcctcacaagattctaacgggaagaagaggtaagatgaagacaataaggcagaccaatggcctctccggctacaccaatcgaagagagagtgagcatgactcctttggcaccgggcacagttcgaccacaatatctgcaggcttggggatggctgtgggcagggatttgaaggggatgaacaacagcgtggttgcggttataggcgatggtgcgatgacagctggacaagcttatgaagcaatgaacaatgctggctacttagactccgacatgattgtgattctcaacgacaataaacaagtctctttgcctactgctaacttggatggaccaactccacctgttggagctttgagctgtgctctaagtaggttgcagtctaatcacgattatgctcgacgaatgactagtgggactggttcaactctgtttgaagaacttggttttcattatgttggtccagttgatggacacaacatagatgatctggtctccattcttgaaaaagtaaaaagcaccaaacccataggaccggttcttattcatgtcgtgactgagaaaggtcgcggatatccctacgcagagagagctgatgacaagtatcatggagttttaaaattcgatccagcaacaggtaaacagttcaaaaacatttccaagactcagtcttacacttcctgttttgtggaggccttgactgcggaagcagaggcagacaaaaatattgttgccattcatgcagccatgggaggtggaacaatgttgaatctcttcgagagccgctttcctacaaggtgtttcgatgttggaatagcagaacaacatgcagttactttcgctgctggtcttgcttgtgaaggacttaagcccttttgtacaatctactcatctttcatgcaacgggcttatgatcaagttgtacatgatgttgatctacagaaactaccagtgagatttgcaatcgatagagcaggacttatgggagcagatggtccaacacattgtggagcatttgatgtgacgtttatggcatgtcttccaaacatgatagttatggctccatctgatgaagcagagctttttaacatggttgcaaccgctgcagctattgatgaccgtccttcttgctttcgatatcatagaggaaacggtatcggtgtttcacttcctcctggcaacaaaggtgtccctcttcagattgggaaaggtaggatactaagggaaggcgagagggttgcgcttttgggctacggatcagccgttcaaagatgtttagaggctgcttctatgcttagcgaacgtggattaaagataactgtagcggatgcaagattttgcaagccattagatgttgctctcattcgtagcttagttaaatcacacgaggttttgatcacggttgaagaaggttcgattggaggatttggatcgcatgtggtacaatttcttgcacttgatggccttcttgacggaaagctcaagtggagaccaatggtactacctgaccggtatatcgaacatggatcaccaatggatcaactggctgaagctggcctcacagcgtctcacattgcagccacagcacttaacttaatgggaacacctagagaagccttgttttgggagtaatgagatctccaacaggcacagaaacgttcttcaattctataagagagtgtatcgagaaaacccgcttagaagaagtatatattgtagttatttaacatcttgaataaattcattcacattcaagaatgagtttgtgtgtgtagtgcttatatctcgtttcaactaggctaagaaatagaacaaatggcattggcgttttcatc

SEQ ID NO: 7258 - DNA, 2685 bp, Oryza sativa
acacagcccccggcccgttgtcctttctccacctcggtggtcatcagctagacagctatcgcgcgccgtcccaccaccatcttgctccactacgcggaccaccgcgcgcgagcagagcatctcctcactctctagcttgctccagtttcgcgtagctgcgtgacagttcaattgaactctctggattcgttggttacttcgtctgagctgctgcagcgttgaggaggaggaggagcaatggcgctcacgacgttctccatttcgagaggaggcttcgtcggcgcgctgccgcaggaggggcatttcgctccggcggcggcggagctcagtctccacaagctccagagcaggccacacaaggctaggcggaggtcgtcgtcgagcatctcggcgtcgctgtccacggagagggaggcggcggagtaccactcgcagcggccaccgacgccgctgctggacacggtcaactaccccatccacatgaagaacctgtccctcaaggagctccagcagctcgccgacgagctccgctccgacgtcatcttccacgtctccaagaccgggggacatctcgggtccagcctcggcgtcgtcgagctcaccgtcgcgctccactacgtgttcaacacgcctcaggacaagatcctctgggacgtcggccaccagtcgtaccctcacaagattctgaccgggcggcgcgacaagatgccgacgatgcgtcagaccaacggcttgtcgggattcaccaagcggtcggagagcgagtacgactccttcggcaccggccacagctccaccaccatctccgccgccctcgggatggcggtggggagggatctcaagggagggaagaacaacgtggtggcggtgatcggcgacggcgccatgacggccgggcaggcgtacgaggcgatgaataacgcggggtatctcgactccgatatgatcgtgattctcaacgacaacaagcaggtgtcgctgccgacggcgacgctcgacgggccggcgccgccggtgggcgcgctcagcagcgccctcagcaagctgcagtccagccgcccactcagggagctcagggaggtggcaaagggcgtgacgaagcaaatcggagggtcggtgcacgagctggcggcgaaggtggacgagtacgcccgcggcatgatcagcggctccggctcgacgctcttcgaggagctcggcctctactacatcggccccgtcgacggccacaacatcgacgacctcatcaccatcctccgcgaggtcaagagcaccaagaccacaggcccggtgctcatccacgtcgtcaccgagaaaggccgcggctacccctacgccgagcgcgccgccgacaagtaccacggcgtggcgaagttcgatccggcgacggggaagcagttcaagtcgccggcgaagacgctgtcgtacacgaactacttcgcggaggcgctcatcgccgaggcggagcaggacaacagggtcgtggccatccacgcggccatggggggaggcacggggctcaactacttcctccgccgcttcccgaaccggtgcttcgacgtcgggatcgccgagcagcacgccgtcacgttcgccgccggcctcgcctgcgagggcctcaagccgttctgcgccatctactcctccttcctgcagagaggctacgaccaggtggtgcacgacgtggacctccagaagctgccggtgaggttcgccatggacagggccgggctcgtgggcgccgacgggccgacgcactgcggcgcgttcgacgtcacctacatggcgtgcctgccgaacatggtcgtcatggccccgtccgacgaggcggagctctgccacatggtcgccaccgccgcggccatcgacgaccgcccctcctgcttccgctacccaagaggcaacggcatcggcgtcccgctaccacccaactacaaaggcgttcccctcgaggtaggcaaagggagggtactgctggagggcgagagggtggcgctgcttgggtacggttcggcggtgcagtactgcctcgccgcagcgtcgctggtggagcggcacggcctcaaggtgaccgtcgccgacgcgaggttctgcaagccgctggaccaaacgctcatcaggaggctggccagctcccacgaggtgctcctcaccgtcgaggaaggctccatcggcgggttcggctcccacgtcgcgcagttcatggccctcgacggcctcctcgacggcaaactcaagtggcggccgctggtgctacccgacaggtacatcgaccacgggtcaccggcggatcagctggcggaggcagggctgacgccgtcgcacatcgcggcgacggtgttcaacgtgctgggccaggcgagggaggcgctcgccatcatgacggtgcccaacgcgtagcagatgcgtggcgcctctggtagagacaatgctttgtacatgtagagatcagtgaattgtatattagtcggcgtcgggataaatattgattagtgatgctgaggggaacagttacagtttttttgctcttcagttgttcgtggacggagacccggctgctcgatgttcgatcgcttgtatatctaagaaatgttgtaagtggatagatttattgatcatgataaggattagtcgggtattaattgaaagcatcaaaatgcgactcaacggaaagcaaatactcta

SEQ ID NO: 7259 - DNA, 2672 bp, Sorghum bicolor
attcttgaggaaatccgtcgaacagttggtttgccaccattggcaggcagaacctgttgcattcttgagctgttgagcaggaggggggggagaggaagcaatggcgctgtggacgacgttctctgttccaaggggattcctcgccgtgcctgctcaccacgactcccatttcgcttcggcggtggagcagctccatggccacaagctgctccaggccaggccactcaggcctcggcgtcatcatcggccggcatgcgtgtcggcgtcgctgtcgccggagcgcgaggcggagtactactcgcagcggccgcccacgccgctgctggacaccatcaactaccccgtccacatgaagaacctgtccgtgaaggagctgcgtcagctcgccgacgagctccgctccgacgtcatcttccacgtctccaagaccggcggccacctcgggtccagcctcggcgtcgtcgagctcaccgtcgcgctgcactacgtcttcaacgcgccgcaggaccgcatcctctgggacgtcggccaccagtcgtacccgcacaagatcctgacggggcggcgcgacaagatgccgacgatgcggcagacgaacgggctggcggggttcacgaagcgcgcggagagcgagtacgacagcttcgggacgggacacagctcgacgaccatctcggcggcgctggggatggcggtggggagggacctcaagggcggaaagaacaacgtggtggcggtgatcggcgacggcgccatgacggcggggcaggcgtacgaggccatgaacaacgccgggtacctggactccgacatgatcgtcatcctcaacgacaacaagcaggtgtcgctgccgacggccacgctcgacgggcccgtgccgcccgtcggcgcgctcagcagcgccctcagcaagctgcagtccagccgcccgctcagggagctcagggaggtggccaagggagtgacgaagcagatcggcggctcggtgcacgagctggcggcgaaggtggacgagtacgcccgcggcatgatcagcgggcccggctcctctctcttcgaggagctcggcctctactacatcggccccgtcgacggccacaacatcgacgacctcatcaccatcctcaacgacgtcaagagcaccaagaccaccggccccgtcctcatccacgtcgtcaccgagaagggccgcggctacccctacgccgagcgagccgccgacaagtaccacggcgtcgccaagtttgatccggcgacggggaagcagttcaagtccccggccaagacgctgtcctacaccaactacttcgccgagtctctgatcgcggaggcggagcaggacagcaagatcgtggccatccacgccgccatggggggcggcacggggctcaactacttcctccgccgcttcccgagccggtgcttcgacgtcgggatcgcggagcagcacgccgtgacgttcgcggccggcctcgcctgcgagggcctcaagcccttctgcgccatctactcgtcgttcctgcagcgcggctacgaccaggtcgtgcacgacgtcgacctgcagaagctccccgtcaggttcgccatggacagggccgggctcgtcggcgccgacgggcccacccactgcggcgcgttcgacgtcgcctacatggcgtgcctgcccaacatggtcgtcatggcaccgtccgacgaggccgagctctgccacatggtcgccaccgccgccgccatcgacgaccgcccgtcctgcttccggtacccgagaggcaacggcattggcgtcccgttgccgcccaactacaagggcactcccctcgaggtcggcaagggcaggatcctgatggagggcgaccgggtggcgctgctggggtacgggtcggcagtgcagtactgcctggccgcggcgtcgctggtggagcgccacggcctcagggtcaccgtcgccgacgcgaggttctgcaagccgctggaccacgcgctgatcaggagcctggccaggtcccacgaggtgatcatcaccgtcgaggaaggctccatcggaggcttcggctcgcacgtcgcccagttcatggccctggacggcctcctcgacggcaaactcaagtggcggccgctggtgcttcctgacaggtacatcgaccatggatcgccggcagatcagctggccgaggctgggctgacgccgtcgcacatcgccgccacggtcttcaacatcctggggcagaacagggaggctcttgccatcatggcagtgccgaacgcgtagaaatttgtggtgatctgggcctatagagatgcttgtacattttgtcgttaagtagaatggcagcacgatcgacggagattagtcttgtttggatgaaaatgtcgcgggaacaacagtaacggttttcgctatgtattcttctgacattaaaataggaatgagatgttcttgcgtcagtttgcaatgcttgtccattgccatggtgaacgacggtaggtattgcttatccatttcaatgctagggtggaggagagaaaatattagagagagtagaagcggactgtttataggtggtttaggcacaagaatcaaagaagtttgtgagagagataagtgagccatatattagagccaaatgtttgactataagtcaagtgattaaagccaagctagaagtaagttg

SEQ ID NO: 7260 - DNA, 2687 bp, Zea mays
acaggcgaatgaattccagccacacgcgcggccatggccttccccacctacgtggtcatccacactcccctcggcatcccgcatcccctcgtccccggacccgccgcactactgctataggcgcatccccggcgccttcgcacactctctccccggccacttcccaaatccgcccgccattcatgcacccttctgtgcactgtcagcgccaccattagctcgcagctcaagctcgccactaccattttggtcggttcttgaggaaatcgatcgaaccgttggagtgccaccactggcagaggctgttgcattcttgagttgagcaggaagaggagaggaagcaatggctctgtcgacgttctctgtcccaaggggattcctcggtgtgccggctcaggactcccatttcgcttcggcggtcgagctccatgtcaacaagctgctccaggccaggcctatcaatctcaagcctcggcggaggccggcatgcgtgtcggcgtcgctgtcgtcggagcgcgaggcggagtactactcgcagaggccgcccacgccgctgctggacaccatcaactaccccgtccacatgaagaacctgtctgtgaaggagctgcggcagctggccgacgagctccggtccgacgtcatcttccacgtctccaagaccggcggccacctcgggtccagcctcggcgtggtggagctcaccgtcgcgctgcactacgtcttcaacgcgccgcaggaccgcatcctctgggacgtcggccaccagtcgtacccgcacaagatcctgacggggcggcgcgacaagatgccgacgatgcggcagaccaacggcctggcgggcttcaccaagcgcgccgagagcgagtacgacagcttcggcacgggccacagctccaccaccatctccgcggcgctcgggatggcggtgggccgggacctcaagggcggcaagaacaacgtggtcgcggtgatcggcgacggcgccatgacggccgggcaggcgtacgaggccatgaacaacgccgggtacctggactccgacatgatcgtcatcctcaacgacaacaagcaggtgtccttgcccacggcgacgctcgacgggccggtgccgcccgtgggcgcgctcagcagcgccctcagcaagctgcagtcaagcaggccgctcagggagctcagggaggtggccaagggagtgacgaagcagatcggtggctcagtgcacgagctggcggcgaaggtggacgagtacgcccgcggcatgatcagcgggcccggctcctcgctcttcgaggagctcggtctctactacatcggccccgtcgacggccacaacatcgacgacctcatcaccatcctcaacgacgtcaagagcaccaagaccaccggccccgtcctcatccacgtcgtcaccgagaagggccgcggctacccctacgccgagcgagccgccgacaagtaccacggtgtcgccaagtttgatccggcgaccgggaagcagttcaagtcccccgccaagacgctgtcctacaccaactacttcgccgaggcgctcatcgccgaggcggagcaggacagcaagatcgtggccatccacgcggccatgggcggcggcacggggctcaactacttcctccgccgcttcccgagccggtgcttcgacgtcgggatcgcggagcagcacgccgtcacgttcgcggccggcctggcctgcgagggcctcaagcccttctgcgccatctactcgtctttcctgcagcgcggctacgaccaggtcgtgcacgacgtcgatctgcagaagctaccggtgcggttcgccatggacagggccgggctggtcggcgcggacgggccgacccactgcggtgcgttcgacgtcgcgtacatggcctgcctgcccaacatggtcgtcatggccccgtccgacgaggccgagctctgccacatggtcgccaccgccgcggccatcgacgaccgcccgtcctgcttccgctacccgagaggcaacggcgttggcgtcccgttgccgcccaactacaaaggcactcccctcgaggtcggcaaaggcaggatcctgcttgagggcgaccgggtggcgctgctggggtacgggtcggcagtgcagtactgcctgactgccgcgtccctggtgcagcgccacggcctcaaggtcaccgtcgccgacgcgaggttctgcaagccgctggaccacgccctgatcaggagcctggccaagtcccacgaggtgctcatcaccgtggaggaaggctccatcggcgggttcggctcgcacgtcgcccagttcatggccctggacggccttctcgacggcaaactcaagtggcgaccgctggtgcttcctgacaggtacatcgaccatggatcgccggccgatcagctggccgaggctgggctgacgccgtcacacatcgccgcgtcggtgttcaacatcctggggcagaacagggaggctcttgccatcatggcagtgccaaacgcgtagaacttgtgctgatctgggcctatagagatgattgtacattttgtcgttaactagagtgtctgaacttgggagattagtcttctttggatgaaagtgtcgccggaacaacagttaccgtttcttcactatgaaaatgggaaggagatgttcttgtggcaataatgcctgtgaacccgacacatcg

SEQ ID NO: 7261 - DNA, 2567 bp, Phaseolus coccineus
ggccggagactgctgagaagtgtgctgctcttttctcccaccttgttactcacacactctttctcttctaccttcttctctcatggctctctctgcattatcattccctcttcatctcagacaaacaacatctgatccaaaagcatcaacccctttgcctttgccttcttcccactctcatttcagtgtagatctgctcacacaatcctcacgcagacacacccaggtgaggaaaagacgacatggggtatgtgcttcgctatcagagacgggagagtatcattcacagaaaccaccaactcctctgttggacactataaactatcctattcacatgaagaatctctctgccaaggaattgaaccagcttgcggaggagctgcgttctgatgttatttttcatgtttctagaactggtggtcatttgggatcaagtcttggcgttgtagaactcactattgcccttcactatgttttcaattctcccaaagacaaaatcttgtgggatgttggtcatcagtcttatccacacaagatactcactggtagaagggatatgatgcataccatgagacaagcagatggactagccgggtttaccaaacgctctgagagtgagcatgattgttttggcactggtcacagctctacaacaatatctgcagcactgggaatggctattgggagggatctgaagggagagaagaacaacgtggttactgttataggtgatggggccatgacggctggtcaagcttatgaagccatgaacaacgctggatatcttgattctgacatgattgttattctaaatgacaacaagcaggtctccctaccaactgctgatcttgatggtcccataccacctgtaggtgctttgagtagtacgctcagtaagttacagtcaaacagacctctcagagaactgagagaggttgctaagggagtcaccaaacaaattggtggccaaatgcacgagatagctgcaaaagttgatgaatatgcgcgtggcatgatcagcggttctggatcaacactttttgaagagcttggactttactacataggtcctgttgatggtcatagaatagatgatcttgttgccattcttaatgaagttaaaagtactaaaacaactggtccagtgctgatccatgttgtcactgaaaaaggccacggatatccatatgcagaaagagcagtagacaagtaccatggagtagccaagtttgatcctgcaactggaaaacagttcaaagccaaggaaaccacccaatcaataacatcatgctttgcagaggctttgattgcagaagcggaagctgacaaagacattgttggaatccatgctgcaatgggtggtggaactggtatgaatatgttccttcgccgtttcccaaccagatgctttgatgtagggatagcggaacagcatgccgttacatttgctgcgggtctggcttgcgaaggtctgaagccttttgttgcaatttactcatcattcatccagagaggttatgaccaggtggtgcatgatgtagatttgcagaagctgccagtaagatttgcaattgatcgagccggattggttggtgctgatggtccaacacactgtggtgcatttgatgtgacatttatggcatgcctccctaacatggtggttatggctccctctgatgaagcagagcttgttcacatggttgcaactgctgctgccattaatgatcgacccagttgtttccgatatccgaggggaaatggtattggtgttgaactaccaccagggaatagaggcattcctcttgagattgggaaaggtcggatactaattgaaggggaaagagtggccttgttgggctatggatcagctgttcagagctgtgtgactgctgcttccttgttggaacatcatggcttgcgtgtaacagtggcggatgctcgtttctgcaagccattggatcattcccttatcagcagccttgcaaaatcacatgaggttttgatcacagtggaagaaggatctgtaggaggatttggatctcatgttgctcagttcatggcccttgctggccttcttgatggaaaattgaagtggaggccaatggttcttcctgattgttatattgaccatggatcacgggatgaccaattgaaggaagctggtctcacaccatctcacatagcagcaacagtgttcaatttacttggacaaacaagagaggcactagagatcatgacatgaagaagtgcaaaggatttggcaactcaacttttcattttcccagggtaaaaagtagcatgattcacctagtgtaatacaagtatgtttgtataaaaataatgcacatggaagatgcattacgggtgtttattggttaggagtgtgttcagtcgttcgtttgaatgaatctgaccaacttcacaatccaaccaaaccatcaaaaccaaataaattttggtttggatctcactcgaatcatatcatcatggcgaaccaaaccaattacattcaatcatgccattttctttattatcaattattgttgccaatgaagttttatattagc

SEQ ID NO: 7262 - DNA, 2391 bp, Brachypodium distachyon
gacaggatttctgggcgtgctccctcaggaacaccatttcgctcccgcgttggagctccagactaggtctctcaagccgaggaagaggtcctgcatttctgcgtcgctgtcggcggagagagaagcagagtaccactcgcagcggccgcccacgccgctgctggacaccgtcaactaccccatccacatgaagaacctgtctctcaaggagctccagcagctgtccgacgagctccggtcggacgtgatcttccacgtctccaagaccggcggccacctcgggtccagcctgggcgtcgtggagctcaccgtggccctgcactacgtcttcaacacgccccaggacaagattctctgggacgtcggccaccagtcgtatccgcacaagatcctgaccgggcggcgcgacaagatgccgacgatgcggcagaccaacgggctctcgggcttcgtcaagcgctccgagagcgagtacgacagtttcggcaccggccacagctctaccaccatctccgccgcactcgggatggccgtggggagggacctcaagggcgccaagaacaacgtggtggcggtgatcggggacggggccatgacggccgggcaggcgtacgaggccatgaacaacgctgggtatctggactccgacatgatcgtcatactcaacgacaacaagcaggtgtcgctgcccacggccacgctcgacgggccggcgccgcctgtgggcgcgctcagcggcgccctcagcaagctgcagtccagcaggccgctcagggagctcagggaggtggcaaagggagtgacgaagcaaatcggcgggtcggtgcacgagctggcggccaaggtggacgaatacgcccgtggcatgatcagcggctccggttcttccctcttcgaggagctgggcctctactacatcggccccgtcgacggccacaacatcgacgacctcatcaccatcctccgggaggtcaaaggcaccaagaccaccggcccggttctcatccacgtcgtcaccgagaaaggccgcggctacccttacgccgagcgagcctccgacaagtaccacggcgtggccaagttcgacccggccacggggaagcagttcaagtccccggccaagacgctgtcctacaccaactacttcgccgaggcgctgatcgcggaggcggagcaggacagcaagatcgtggccatccacgcggccatggggggaggaaccgggctcaactacttcctccgccgcttcccgaaccggtgcttcgacgtggggatcgccgagcagcacgccgtcacattcgccgcggggctcgcctgcgagggcctcaagcccttctgtgccatctactcgtcgttcctgcagagggggtatgaccaggtcgtgcacgacgtggacctccagaagcttcccgtgaggttcgccatggacagggctgggctggtgggcgccgacgggccgacacactgcggggcgttcgatgtgacgttcatggcgtgcttgcccaacatggtcgtcatggccccgtccgacgaggctgagcttctgaacatggtcgccaccgctgctgccatcgacgaccgcccctcctgcttccgctatcccagaggcaacggcattggcgtcccgttgccccccaactacaaaggcattcccctcgaggtggggaaaggcaggatccttatggagggtgagagggtggcgctgctggggtacgggtcggcggtgcagtactgcgtggccgcgtcgtccatcgttgaggagcacggcctcagggtgaccgtcgccgacgccaggttctgcaagccgttggaccacgccctcatcaggagcctcgccaagtcccacgaggtgatcatcaccgtagaggaaggctccattggtggattcggctctcacgtggctcagttcatggccctggacggccttcttgacggcaaacttaagtggcggccggtggtgcttcctgacaagtacatagaccatggatcaccggctgatcagttggtggaggctgggctgacaccgtcgcacatcgccgccacggtgttcaatatcctggggcaggcaagggaggccctcgccatcatgacggtgccgaatgcctagagccagcgtgctgcctgctatagagattcttgtacattttggcattagatgattcagagagattagccggcgtcttaaaattaaagataatgatcctggtcaggggaggggggaatgacagttttcgttctttatttttgatgttggctgccttgaggtacgtggttgttcacggattggaacacagctgtggtctttgtatctatgtaatgatgtatgttgatagattttggaggacaaagatactctgtatatacatggagaatgagtcgatgttgtttgaa

SEQ ID NO: 7263 - DNA, 2024 bp, Flaveria ramosissima
ggtaggtgtggtcaagcgacatggctgatagaggtgagtatcactcgcagacgacccccgactccactgttggacaccattaattacccaattcacatgaagaatctctcgatcaaggaactgaagcaactagctgatgagctgcggtctgatgtaatctttaatgtttctaagactggtggtcatttgggttcgagcctcggtgtggtggagctcacagtggctcttcattatgtgttcaatacgccgcaagataagatcctttgggatgttggtcatcagtcttacccgcataaaatattgacgggaagaagagaccgaatgcataccattagacagacaaacgggttggcgggtttcactaaacgctctgaaagcgagcatgattgttttggcacaggccatagctctaccaccatttctgcagggttaggtatggctgtgggaagggatctaaaaggtggaacaaacgatgtagttgctattataggtgatggtgcgatgaccgcgggtcaagcctatgaagccatgaacaacgcgggctatctagattcagatatgatagtcatccttaacgataataaacaagtctcattaccaactgcaacacttgacgggcctatacctcctgttggagctttaagcagtgctctcagtaggctacaatctaaccgccctcttagggaactgcgtgaagttgccaaagaagttaccaaacagattggcgggcccatgcatgaacttgcagctaaagttgatgagtacgcccgtggtatgatcagtggttcagggtcaacactgtttgaagaacttggtttgtattacatcgggccagttgatggtcatagcattgatgatcttgttgccattcttaaagaagtcaagagtactaaaacaacgggtccggttttgattcatgttattacagagaaaggtagaggatatccatatgcagagaaagctgctgataagtaccatggtgtggcgaaatttgaccctgcaacagggaaacaattcaagtcaagtgcagcaactcaatcttacactacttactttgcagaggcattgattgctgaagctgaggtggataaaaagattgtgggtatccatgctgcaatgggtggtgggaccgggatgaacctatttcaccgccggttcccgaaccggtgttttgatgtcgggatcgctgaacaacacgcggttacttttgctgctggtttggcctgtgaaggccttaagccattttgtgcaatttactcatcattcctgcaaaggggttatgatcaggtggtgcatgatgtggacctgcagaagttgcctgtgagatttgcaatggaccgggctgggctcgttggcgcagatggcccgacacattcgggctcgtttgatgtgacttacatggcgtgccttccgaacatggtggtcatggctccttctgacgaggctgagctttttcacatggtggcaaccgctgcagccattgatgacagacctagttgcttccgttatccccgtggaaacgggataggcgcacccttgccacctggcaacaaaggcgttcctctcgaggttggaaaaggtagaatattgattgaaggagagcgtgtcgcgctcctaggttatggaaccgcggtccagagttgcttggtagcagcccgtttggtacaagaacgaggcttaaacataactgttgcagatgcccgtttctgcaaaccgttggaccataatctcatccgggccctcgcaaagtcacacgaggtcttgatcacagttgaagaaggttccatcggtgggttcggctcacacgtggctcacttcatggcactagatggtcttctagatggaaaactaaagtggagaccaatagtgcttccggaccgttacatcgaccatggtgcgcctgatgatcaactagctgaagccggcctgactccatcacatatagctgcaaccgtattcaacgtactcgggcaaacaagagaggctctggaggttatgtcatagaataatcttgtgtgttctgt

SEQ ID NO: 7264 - DNA, 2684 bp, Brassica rapa
  misc_feature (355)..(355): n is a, c, g, or t
  misc_feature (358)..(358): n is a, c, g, or t
  misc_feature (394)..(394): n is a, c, g, or t
  misc_feature (397)..(397): n is a, c, g, or t
  misc_feature (415)..(415): n is a, c, g, or t
  misc_feature (439)..(439): n is a, c, g, or t
  misc_feature (463)..(463): n is a, c, g, or t
  misc_feature (475)..(475): n is a, c, g, or t
  misc_feature (493)..(493): n is a, c, g, or t
  misc_feature (505)..(505): n is a, c, g, or t
  misc_feature (508)..(508): n is a, c, g, or t
  misc_feature (851)..(851): n is a, c, g, or t
  misc_feature (955)..(955): n is a, c, g, or t
  misc_feature (1063)..(1063): n is a, c, g, or t
  misc_feature (1075)..(1075): n is a, c, g, or t
  misc_feature (1114)..(1114): n is a, c, g, or t
  misc_feature (1129)..(1129): n is a, c, g, or t
  misc_feature (1132)..(1132): n is a, c, g, or t
  misc_feature (1135)..(1135): n is a, c, g, or t
  misc_feature (1144)..(1144): n is a, c, g, or t
  misc_feature (1147)..(1147): n is a, c, g, or t
  misc_feature (1174)..(1174): n is a, c, g, or t
  misc_feature (1186)..(1186): n is a, c, g, or t
  misc_feature (1189)..(1189): n is a, c, g, or t
  misc_feature (1192)..(1192): n is a, c, g, or t
ggtagagtccatataactcactgcgaagatctctcttctctttcagatcccattctcacaaaacccatctctcaaataacccccaaagctctcaactttcgctaatctcgattcaattatgtcgaacccagctgaatcttcagactcgaaatcgaagaaggattttagtactgctattctggagaggaagaagtctcccaacagacttgtcgtcgatgaggccatcaacgatgataactccgtcgtgtctctccaccctgctaccatggagaagctccagctcttccgtggtgataccattctcatcaagggtaagaaaaggaaggacactatctgcatagctcttgctgatgantcntgtgaggagccaaagatcaggatgaacaaagtggtnagntctaacttgagggttagncttggtgatgttatctctgttcancaatgccctgatgtcaagtacggncagcgtgtgcanatcttgcctgttgatganaccgttgaaggngtnactggaaacctctttgatgcttacctcaaaccttatttccttgaggcgtaccgtccggtgaggaagggagatctcttcctagtgagaggaggaatgaggagtgtggagttcaaggttattgagacggatcctgctgagtactgtgttgttgctccggacactgagattttctgtgagggtgagccagtcaagagagaggatgaagaaaggcttgatgaagtgggttatgatgatgttggtggagtcaggaagcagatggctcagatcagggagcttgttgagcttcccttgaggcatccacagctgttcaagtcgattggtgttaagccaccgaagggaattntgctttacggaccacctgggtctggaaagactttgatcgctcgtgctgttgctaacgaaactggtgcctttttcttctgtatcaatgggcctgagatcatgtcnaagctggctggtgagagtgagagcaacctcaggaaagcgtttgaggaggctgagaagaacgctccttcgatcatattcattgatgagattgactctattgcaccgaanagagagaagacnaatggagaggttgagaggaggattgtgtctcagctcctnacgctaatggatggnctnaantctcgtgcncangttattgtcatgggagcaaccaatcgncccaacagtatnganccngctttgagaaggtttggaagatttgatagggagattgatattggtgttcctgatgagattggacgtcttgaagttctcaggatccacactaagaacatgaagcttgctgaagatgtggatcttgagaggatctcaaaggacacacacggctatgttggtgctgatcttgcagctctgtgcacagaagctgccctgcagtgcatcagggagaagatggatgtgattgatttggaagatgactccatagatgctgaaatcctcaactccatggcagtgaccaatgagcacttccacactgctctcggcaacagcaacccatctgctcttcgtgaaactgttgtggaggttcctaatgtttcttgggatgacattggaggtcttgagaatgtcaagagagagctccaggagactgtccaatacccagtggagcacccagagaagtttgagaagttcggtatgtctccatcaaagggagtcctcttctacggtcctcctggatgtggtaaaacgctattagccaaagctatagccaacgagtgccaagcaaacttcatcagtgtcaaaggtcctgagcttctcaccatgtggtttggtgagagtgaagccaacgtccgtgaaatctttgacaaggcacgtcagtctgctccctgtgtgctcttctttgacgagctagactccattgccactcagagaggaggtggaggcggaggtgatgcaggcggcgcagcggacagagtcctcaaccagcttttgaccgagatggatggaatgaacgccaagaagactgtcttcatcatcggagcaaccaacagacccgacattattgattctgctcttctccgtccaggaaggctcgaccagctcatttacattccgctcccagacgaggattcacgtctcaacatcttcaaggcctgcttgaggaaatcacctgttgctaaagatgttgacatcaacgctctggctaagtacacgcaggggttcagtggtgctgatatcactgagatttgccagagggcttgcaagtacgccatcagagaaaacatcgagaaggacattgaaaaggagaagaggaggagcgagaaccctgaggcgatggaggaagatggagtggatgaagtgtctgagatcaaagctgcacactttgaggagtcgatgaagtatgcgcgcaggagtgtgagtgatgcagacatcaggaagtaccaagcgtttgctcagacgctgcagcagtctagagggtttggttctgagttcaggttcgagactaatgctgctggttcaggtgcaaccactggagtcgccgatccttttgccacctcggcagctgctgctgcggacgatgatgatctctacaattagtgtgatcaaatttattatcctttttatttaagttttcaatcggattctctcaactttcaaccttatgtttccttaaaaagttatcggaattatgttcattgcttttaatcaatgtacctgcttcactcttgtt

SEQ ID NO: 7265 - DNA, 2706 bp, Brassica napus
gagagagatattaatctgcgacgatctctcttctactctttcagatcccattctcataatccccaaatccatctctctcagagataaccctaaagctctcaactttccgagaaaactctctctcaatcgctaatctcgattcaatcatgtcgaacccagctgaatcttcagactcgaaatcgaagaaagacttcagtactgctattctggagaggaagaagtctccgaacagactcgtcgtcgacgaggccatcaacgatgataactccgtcgtgtctctccaccctgacaccatggagaagctccagctcttccgtggcgacaccattctcatcaagggaaagaaaaggaaggatactatttgcattgctcttgctgatgagtcatgtgaggagccaaagatcaggatgaacaaagtggttagatctaacttgagggttaggcttggagatgtcatctctgttcaccagtgccctgatgtcaagtacggacagcgtgtgcacatcttgcctgttgatgataccgttgaaggagtcactggaaacctctttgatgcttacctcaaaccttatttcttggaggcataccgccccgtgaggaagggagatctcttcctagtcagaggaggaatgaggagtgtggagttcaaggttattgagacagatcctgctgagtactgtgtggtggctccggacactgagattttctgtgagggtgagccagtcaagagagaggacgaagaaaggctagatgaagtgggttatgatgatgttggtggcgtcaggaagcagatggctcagatcagggagcttgttgagcttcccttgaggcatccacagctgttcaagtcgattggtgtgaagccaccgaagggaattcttctttacggaccacctgggtctggaaagactctgattgctcgtgccgtggctaacgaaactggtgcctttttcttctgtatcaatggtcctgagattatgtctaagctggctggtgagagtgagagcaacctcaggaaagcgtttgaggaggctgagaagaacgcgccttcgattatatttattgatgagattgactctattgcaccgaaaagagagaagactaatggagaggttgagaggaggattgtgtctcagctccttacgctgatggatgggcttaaatctcgtgctcatgttattgtcatgggagcaaccaatcgccccaacagtattgatccagctttgagaaggtttggaagatttgatagggagattgatattggtgttcctgacgagattggacgtcttgaagttctcaggatccacacaaagaacatgaagcttgctgaagatgtggatcttgagaggatctcaaaggacacacacggttatgttggtgctgatcttgcagctctgtgcacagaagctgccctgcaatgtatcagggagaagatggatgtgattgatctggaagatgactccatagatgctgaaatcctcaactccatggcagtgaccaatgaacacttccacactgctctcggaaacagcaacccatctgcacttcgtgaaactgttgtggaggttccaaatgtttcttgggatgacattggaggtcttgagaatgtcaagagagagctccaggagactgtccaataccctgtggagcacccagagaagtttgagaagttcggtatgtctccgtcaaagggagtccttttctacggtcctcctggatgcggtaaaacccttttggccaaagctatagccaacgagtgccaagccaacttcatcagcgtcaaaggtcctgagcttctcaccatgtggtttggtgagagtgaagccaacgtccgtgaaatctttgacaaggctcgtcagtctgctccatgtgttctcttctttgacgagctcgactccattgccactcagagaggaggtggaggcggaggtgatgccggcggcgcagcggacagagtcctgaaccagcttttgaccgagatggatgggatgaacgctaagaagaccgtcttcatcatcggagcgaccaacagacccgacattatcgactctgctcttcttcgaccaggaaggctcgaccagctcatttacattccgctcccggacgaggactcgcgtctcaatatcttcaaggcctgcttgaggaaatcacccgttgctaaagatgttgacatcaacgctctggctaagtacacgcaggggttcagtggtgctgatatcactgagatttgccagagggcttgcaaatacgccattagagaaaacatcgagaaggacattgaaaaggagaagaggaggagcgagaaccctgaggccatggaagaagatggagtggatgaagtgtctgagatcaaagctgcacactttgaggagtcgatgaagtatgcgcgcaggagtgtgagtgatgcagacatcaggaagtaccaagcgtttgctcagacgctgcagcagtctagagggtttggttctgagttcaggttcgagactaatgctgctggttcaggtgcaaccactggagtcgctgatccttttgccacctcggcagctgctgctgcggacgatgatgatctctacaattagtgtgatcaaatttattatcctttttatttaagttttcaatcggattctctctctactttcaaccttatgtttcttaaaaaagttatcggaattatgttcattgcttttaattaatgtactctcttca

SEQ ID NO: 7266 - DNA, 2755 bp, Raphanus sativus
  misc_feature (12)..(12): n is a, c, g, or t
  misc_feature (29)..(29): n is a, c, g, or t
  misc_feature (47)..(47): n is a, c, g, or t
  misc_feature (80)..(80): n is a, c, g, or t
  misc_feature (88)..(88): n is a, c, g, or t
  misc_feature (234)..(234): n is a, c, g, or t
  misc_feature (351)..(351): n is a, c, g, or t
  misc_feature (405)..(405): n is a, c, g, or t
  misc_feature (408)..(408): n is a, c, g, or t
  misc_feature (474)..(474): n is a, c, g, or t
  misc_feature (588)..(588): n is a, c, g, or t
  misc_feature (738)..(738): n is a, c, g, or t
  misc_feature (819)..(819): n is a, c, g, or t
  misc_feature (834)..(834): n is a, c, g, or t
  misc_feature (852)..(852): n is a, c, g, or t
  misc_feature (930)..(930): n is a, c, g, or t
  misc_feature (1035)..(1035): n is a, c, g, or t
  misc_feature (1086)..(1086): n is a, c, g, or t
  misc_feature (1092)..(1092): n is a, c, g, or t
  misc_feature (1098)..(1098): n is a, c, g, or t
  misc_feature (1113)..(1113): n is a, c, g, or t
  misc_feature (1125)..(1125): n is a, c, g, or t
  misc_feature (1131)..(1131): n is a, c, g, or t
  misc_feature (1143)..(1143): n is a, c, g, or t
  misc_feature (1149)..(1149): n is a, c, g, or t
  misc_feature (1185)..(1185): n is a, c, g, or t
  misc_feature (1197)..(1197): n is a, c, g, or t
  misc_feature (1203)..(1203): n is a, c, g, or t
  misc_feature (1218)..(1218): n is a, c, g, or t
  misc_feature (1245)..(1245): n is a, c, g, or t
  misc_feature (1260)..(1260): n is a, c, g, or t
  misc_feature (1299)..(1299): n is a, c, g, or t
  misc_feature (1308)..(1308): n is a, c, g, or t
  misc_feature (1326)..(1326): n is a, c, g, or t
  misc_feature (1329)..(1329): n is a, c, g, or t
  misc_feature (1337)..(1338): n is a, c, g, or t
  misc_feature (1359)..(1359): n is a, c, g, or t
  misc_feature (1377)..(1377): n is a, c, g, or t
  misc_feature (1389)..(1389): n is a, c, g, or t
  misc_feature (1401)..(1401): n is a, c, g, or t
  misc_feature (1716)..(1716): n is a, c, g, or t
  misc_feature (1749)..(1749): n is a, c, g, or t
  misc_feature (1761)..(1761): n is a, c, g, or t
  misc_feature (1803)..(1803): n is a, c, g, or t
  misc_feature (1851)..(1851): n is a, c, g, or t
gggaaacgtcgngacgatataacttactncgaagatctctctgctcnctcagatcccattctcacaaatccatctctcanataactcnaaagctctcaactttctctaatcgctaatctcgattcaatcatgtcgaacccagctgaatcttcagactcgaaatcgaagaaagatttcagtactgctattctggagaggaagaagtctccgaacagacttgtcgtcgatgaggcnatcaacgatgataactccgtcgtgtctctccaccctgccaccatggagaagctccagctcttccgtggtgataccattctcatcaagggtaagaaaaggaaggacactgtctgcatngctcttgctgatgaatcatgtgaggagccaaagatcaggatgaacaaagtggtnagntctaacttgagggttagacttggagatgttatctctgttcaccaatgccctgatgtcaagtacggnaagcgtgtgcacatcttgcctgttgatgataccgttgaaggagtcactggaaacctctttgatgcttacctcaaaccttatttcttggaggcataccgcccggtgaggaagggngatctcttcctagtcagaggaggaatgaggagtgtggagttcaaagttattgagacagatcctgctgagtactgtgtggttgctccggacactgagattttctgtgagggtgagccggtcaagagggaggatgaagaaaggctagatgangtgggttatgatgatgttggtggtgtcaggaagcagatggctcagatcagggagcttgttgagcttcccttgaggcatccncagctgttcaagtcnattggtgttaagccaccnaaggggattctgctttacggaccacctgggtccggaaagactttgattgctcgtgctgtggctaacgaaactggtgcntttttcttctgtatcaatggacctgagatcatgtccaagctggctggtgagagtgagagcaacctcaggaaagcgtttgaggaggctgagaagaacgctccttcnatcatatttattgatgagattgactctattgcacccaaaagagagaagacnaatggngaggtngagaggaggattgtntctcagctcctnacgctnatggatggactnaagtcncgtgctcatgttattgtcatgggagcaaccaatcgncccaacagtatngatccngctttgagaaggttnggaagatttgatagggagattgatatnggtgttcctgatganattggacgtcttgaagttctcaggatccacacaaagaanatgaagctngctgaagatgtggatctnganaggatctnnaaggacacacacggttatgtnggtgctgatcttgcagcnctgtgcacagangctgccctgcantgcatcagggagaagatggatgtgattgatttggaagatgactccatagatgctgaaatcctcaactccatggcagtgaccaatgaacacttccacactgctctcggcaacagcaacccatctgcacttcgtgaaactgttgtggaggttcctaatgtttcttgggatgacattggaggtcttgagaatgtcaagagagagctccaggagactgttcaataccctgtggagcacccagagaagtttgagaagttcggtatgtctccatcaaagggagtcctattctacggtcctcctggatgtggtaaaaccctnttggccaaagctatagccaacgagtgccaagcnaacttcatcagngtcaaaggtcctgagcttctcaccatgtggtttggagagagngaagccaacgtccgtgaaatctttgacaaggcacgccagtctgctccntgtgttctcttcttcgatgagctcgactccattgccactcagagaggaggtggaggcggaggtgatgctggaggtgcagcggatagagtcctgaaccagcttttgactgagatggatgggatgaacgccaagaagactgtcttcatcatcggagcgaccaacagacccgacattattgactctgctctcctccgtccagggaggctcgaccagctcatttacattccactgccggacgaggattcacgtctcaacatcttcaaggccgccttgaggaagtctcctattgctaaagatgttgacatcaacgctctggctaagtacacgcagggattcagtggtgctgatatcactgagatttgccagagggcttgcaaatacgccatcagagaaaacatcgagaaggacattgagaaggagaagaggaggagcgagaatccagaggccatggaggaagatggagtggatgaagtgtcagagatcaaggctgcacattttgaggagtcgatgaagtatgcgcgcaggagtgtgagtgatgcagacatcaggaagtaccaagcctttgctcagacgctgcagcagtctagagggtttggttctgagttcaggttcgagactaatgctgctggttcaggtgcaaccactggagtcgctgatccttttgccacctcggcagctgctgctgcggacgatgatgatctctacaactaaaagatccatcctttttaatattttaagttgtcaatcgaattcagactgggaaagtgatactctcatcttttcatagtgttttttaagtttatcagaaactttgtttgacatttcaatcaatgctctttgttaatgtttgggcggcagttaaaagtagtacatgccccaataaaagctcaaatttacatcgacc

SEQ ID NO: 7267 - DNA, 2704 bp, Brassica napus
tcagaatctcttctgctctttcagatctctcagataactcccaaaagctctcaactttctcatcgatctcaaatccaattatgtcaaacccagctgaatcttccgactcgaaatcgaagaaagatttcagcactgctattctcgagaggaagaagtctcctaacagacttgtcgtcgatgaggccatcaacgatgataactccgtcgtctctctccaccccgacaccatggagaagctccagctcttccgcggcgataccattctcatcaagggtaagaagaggaaggacactgtctgcattgctcttgctgatgaatcatgtgaggagccaaagatcaggatgaacaaagttgtcagatctaacttgagggttagacttggagatgtcatctctgttcaccagtgccctgatgtcaagtacgggaagcgtgtgcacatcttgcctgttgatgataccgttgaaggagtcaccggaaacctctttgatgcttacctcaaaccttatttcctggaagcgtaccgcccggtgaggaagggcgatctcttcctagtcagaggaggaatgaggagtgtggagttcaaggttatagagacggatcctgctgagtactgtgtggttgctccagacactgagattttctgtgagggtgagcctgtgaagagagaggatgaggaaaggctagatgaagtgggttatgatgatgttggtggtgtgaggaagcagatggctcagatcagggagcttgttgagcttcccttgaggcatccacagctcttcaagtcgattggtgttaagccaccgaaggggattctgctttacggaccacctgggtccggaaagactttgattgctcgcgccgtggctaacgaaaccggtgcgtttttcttctgtatcaatgggcctgagatcatgtctaagttggctggtgagagtgagagcaacctcaggaaagcgtttgaggaggctgagaagaacgctccttcgatcatattcattgatgagattgactctattgcacccaaaagagagaagacgaatggagaggttgagaggaggattgtgtctcagctcctcacgctgatggatggtctgaagtcacgtgctcatgtcattgtcatgggagcaaccaatcgccccaacagtattgatccggctttgagaaggtttggaagatttgatagggagattgatatcggcgttcctgatgaaattggacgtcttgaagttctcaggatccacaccaagaacatgaagctcgctgaagatgttgatcttgagaggatctcaaaggacacacacggttatgtaggtgctgatcttgcagctctctgcacagaagctgccctgcaatgcatcagggagaagatggatgtgattgatctggaagatgactctattgatgctgagatcctcaattccatggcagtgactaatgaacacttccacaccgctcttggaaacagcaacccatctgcacttcgtgaaactgttgtggaggttcctaatgtttcttgggatgacattggaggtcttgagaatgtcaagagagagctccaggagactgttcaataccctgtggagcacccagagaagttcgagaaattcggtatgtctccttcaaagggagtcctattctacggtcctcctggatgtggtaaaacccttctggccaaagctatagccaacgagtgccaagcaaatttcataagtgtcaaaggtcctgagcttctcactatgtggtttggagagagtgaagccaatgtccgtgaaatcttcgacaaggctcgtcagtccgccccgtgtgttctcttctttgacgagctcgactccattgctactcagagaggaggtggaggcggaggtgatgctggcggtgcggctgatagagtcctcaaccagcttttgacagagatggatggaatgaacgccaagaagactgtcttcatcatcggagcgaccaacaggcccgacattattgattctgctcttctccgaccaggaaggctcgaccagctcatttacattccactaccggatgaggactcacgtctcaatatcttcaaggcatgcttgaggaaatctcctgttgctaaagatgtggacatcaatgctctcgctaagtacacgcaggggttcagtggtgctgatatcactgagatttgccagagggcttgcaaatacgccataagagagaacattgagaaggacattgagagggagaagaggaggagcttgaacccagaggcgatggaggaagatggagtggatgaagtgtcagagatcaaagctgcacactttgaggagtcgatgaagtatgcacgcaggagtgtgagtgatgcagacatcaggaagtaccaagcctttgctcagacgctgcagcagtctagagggtttggttctgagttcaggtttgagactaatgctggttcaggtgcaaccactggagtcgctgatccttttgccacctctgcagctgctgctgcagatgatgacgatctctacaattagtgatccttatttaccatccttttttataaagttctcaatcgaattctcttcttttggatgactgagggcaagtgatactgatacttttccttgtgttttaagttaatcagaatcgtttatgtttaatactccagatcctaagcaacctctagatattgaagagaaggaaaaataattatacagaagatcaatac

SEQ ID NO: 7268 - DNA, 2743 bp, Eutrema parvulum
aagaaacatagagatataatctgcgaaaatctttgctctttcagatcccattatcacaatcgatctctcagagaagcgaagggaaaacaaaaagctctcaactttcttcgatttctgagggaactctctcgctaactcaaatccatcatgtcaaacccagctgaatcttcagactcgaaatcgaagaaagatttcagtactgctattctggagaggaagaagtctccgaacagacttgtcgtcgatgaggccatcaacgatgataactccgtcgtatctctccaccctgcaaccatggagaagcttcagctcttccgtggtgataccattctcattaagggtaagaaaaggaaggacactgtctgcattgctcttgctgatgagtcatgtgaggagccaaagattaggatgaacaaagtagtcagatctaacttgagggttcgattgggagatgttatctctgttcaccaatgcccggatgtcaagtacggaaagcgtgttcacatcttgccagttgatgataccgttgaaggagtgactggaaacctctttgatgcttacctgaaaccttatttcctggaggcataccgccctgtgaggaagggcgatctcttcctcgtcagaggaggaatgaggagtgtggagttcaaagttatagagacagatcctgctgagtactgtgtggttgctccagacactgaaattttctgtgagggtgagccagtcaagagagaggatgaagaaaggctagatgaagtaggttatgatgatgttggtggtgtcaggaagcagatggctcagatcagggaacttgttgagcttcccttgaggcatccacaactattcaagtcaattggtgttaagccaccgaagggaattctgctttatggacctcctggttctggaaaaactttgattgctcgtgctgtggctaatgaaaccggagcctttttcttctgtatcaacggacccgagatcatgtccaaactggctggtgagagtgagagcaacctcaggaaagcatttgaggaggctgagaaaaacgctccttcaatcatattcattgatgaaattgactctattgcaccaaaaagagagaagacaaacggagaggttgagagaaggattgtgtctcagctccttacactaatggatggactgaagtcgcgtgctcatgttattgtcatgggagcaaccaatcgccccaacagtatcgatccagctttaagaaggttcggaagatttgatagggagattgatattggggttcctgacgagattggacgtcttgaagtgctcaggatccacacaaagaacatgaagcttgctgaagatgtggatctcgaaagaatctcaaaggacacacacggttatgtcggtgctgatcttgcagctctgtgcacagaagctgccctgcaatgcatcagggagaagatggatgtgattgatttagaagatgactccatagatgccgaaatcctcaattccatggcagtgaccaatgaacacttccacactgctcttgggaacagcaacccatctgcacttcgtgaaactgttgtggaggttcccaatgtttcttgggatgacatcggaggtcttgagaatgtcaagagagagctccaagagactgtccagtacccggttgagcacccagaaaagtttgagaaatttggtatgtctccttccaagggagtccttttctacggtccacctggatgtggtaaaacccttttggccaaagctatagccaacgagtgccaagcaaacttcatcagcgtcaaaggtcctgagcttctcactatgtggtttggagagagtgaagcgaatgtccgtgaaatctttgacaaggcccgtcagtccgctccatgtgttctcttctttgacgagctcgactccattgccacgcagagaggaagcggaagtggaggcgatggtggcggtgcagcggatagagtcctgaaccagcttttgactgagatggatggcatgaacgccaagaaaaccgtcttcatcattggagcaaccaacagacccgacattattgatgcggcccttctccgtccaggcaggctcgaccagctcatttacattccactaccagacgaggattcccgtctcaatatcttcaaggcatgcttgaggaagtcacctattgctaaagatgtagacatcaacgccctcgctaagtacacccagggattcagtggtgctgatatcactgagatttgccagagggcttgcaaatatgccatcagagaaaacatcgagaaggacattgaaaaggagaagaggaggagcgagaatccagaagccatggaggaagatggagtggatgaagtatcagagatcaaagctgcccactttgaggaatcgatgaagtatgcgcgcaggagtgtgagcgatgcagacataaggaaataccaagcctttgctcagacgctgcagcagtctagagggttcggttctgagttcaggttcgagacttctgctggttcaggtgcaaccactggagtcgctgatccttttgcgacgtctgcagctgctgctgcggacgatgatgatctctacaattagtgatcaaatttatcatactttttattaagttttcaatcgaattctctacttttggataccttgtgtttcttcaagttatcagaattatgtttattacttttaatcaatgttcaagcttaactcctcttgttcattcgttaccactaacttttgagggaaatcaagg

SEQ ID NO: 7269 - DNA, 2631 bp, Brassica napus
tccatctctcaaataacctctcaactctctgaggaaactctttcatcgctaatctcgcttccattatgtcgaacccagctgaatcttcagactcgaaaccgaagaaggatttcagtactgctattcttgagaggaagaagtctccgaacagactcgtcgtcgatgaggccatcaacgatgataactccgtcgtgtctctccaccctgctactatggagaagctccagctcttccgtggtgataccattctcatcaagggtaagaaaaggaaggacaccatctgcatcgctcttgctgatgaatcgtgtgaggagccaaagatcaggatgaacaaagtggtcaggtcgaacttgagggttagacttggtgatgttatctctgttcaccaatgccctgatgtcaagtacggaaagcgtgtgcacatcttgcctgttgatgacaccgttgaaggagtcactggaaacctctttgatgcttacctcaaaccttacttccttgaggcataccgtccggtgaggaagggcgatctcttcctagtgagaggaggaatgaggagtgtggagttcaaggttattgagacggatcctgctgagtactgtgtggttgctccggacactgagattttctgtgagggtgagccagtcaagagagaggatgaagaaaggcttgatgaagtgggttatgatgatgttggtggagtcaggaagcagatggctcagatcagggaacttgttgagcttcccttgaggcatccacagctgttcaagtcaattggtgttaagccgccgaagggaattctgctttacggaccacctgggtccggaaagactttgatcgctcgtgctgttgctaacgagactggtgcatttttcttctgtatcaatggacctgagatcatgtccaagctggctggtgagagtgagagcaacctcaggaaagcgtttgaggaggctgagaagaacgctccttcgatcatattcattgatgagattgactctattgcaccgaaaagggagaagacgaatggagaggttgagaggaggattgtgtctcagctccttacgcttatggatgggctgaaatctcgtgctcatgttattgtcatgggagcaaccaatcgccccaacagtatcgacccggctttgagaaggtttggaagatttgatagggagattgatattggtgttcctgatgagattggacgtcttgaagttctcaggatccacacaaagaacatgaagcttgctgaagatgtggatctagaaaggatctcaaaggacacacacggttatgtgggtgctgatcttgcagctctgtgtacagaagctgccctgcaatgcatcagggagaagatggatgtgattgatttggaagatgactccatagatgctgaaatcctcaattccatggcagtgaccaatgaacatttccacactgctctcggcaacagcaacccatctgcacttcgtgaaactgttgtggaggttcctaatgtttcttgggatgacattggaggtcttgagaatgtcaagagagagctccaggagactgttcaatacccggtcgagcacccagagaagtttgagaagttcggtatgtctccatcaaagggagtccttttctacggtcctcctggatgtggtaaaacccttttggccaaagctatagccaacgagtgccaagcaaacttcatcagtgtcaaaggtcccgagcttctcaccatgtggtttggagagagtgaagcaaatgtccgtgaaatctttgacaaggcccgtcagtctgctccatgtgttctattctttgacgagctcgactccattgcgactcagagaggaggtggaagcggaggtgatggtggcggtgcagcggatagagtcctgaaccagcttttgactgagatggatggaatgaacgccaagaagaccgtcttcatcatcggagcaaccaacagacccgacattattgattctgctcttctccgtccaggaaggctcgaccagctcatttacattccactgccagacgaggattcccgtctcaatatcttcaaggcctgcttgaggaagtcacctatcgctaaagatgtggacatcaacgctctcgctaagtacacacagggattcagtggtgctgatatcactgagatttgccagagggcttgcaagtacgccatcagagaaaacatcgagaaggacattgaaaaggaaaagaggaggagcgagaacccagaagccatggaggaagatatggatgaagtatcagagataaaagctgcacactttgaggagtcgatgaagtatgcacgcaggagtgtgagtgatgcagacatcaggaagtaccaagcctttgctcagacgctccagcagtctagagggtttggttccgagttcaggttcgagactaatgctggttcaggtgcaaccactggagtcgctgatccttttgccacgtctgcagctgctgctgcggacgatgatgatctctacaattaagttatcaagtttatcatactttgttatttaaggtttcagtcggattctctctactacttctggataccttgtgtttcttttaagttatcagaattaagttctcaattgacttgttaacttgaggtcaaaaaaaaaaaaa

SEQ ID NO: 7270 - DNA, 2690 bp, Brassica napus
gaagatctctcttctctttcagatcccattctctcaataacctctcaactctctgaggaaactctcttctcttccgctaatctcgattcaattatgtcgaacccagctgaatcttcagactcgaaatcgaagaaggattttagtactgctattctggagaggaagaagtctcccaacagacttgtcgtcgatgaggccatcaacgatgataactccgttgtatctctccaccctgctaccatggagaagctccagctcttccgtggtgataccattctcatcaagggtaagaaaaggaaggacactatctgcatcgctcttgctgatgaatcatgtgaggagccgaagatcaggatgaacaaagtggtcaggtctaacttgagggttaggcttggtgatgttatctctgttcatcaatgccctgatgtcaagtacggacagcgtgtgcacatcttgcctgttgatgacaccgttgaaggagtcactggaaacctctttgatgcttacctcaaaccttatttcctggaggcataccgtccggtgcggaagggcgatctcttcctagtgagaggaggaatgaggagtgtggagttcaaggttattgagacggatcctgctgagtactgtgttgttgctccggacactgagattttctgtgagggtgagccagtcaagagagaggacgaagagaggcttgatgaagtgggttatgatgatgttggtggtgtcaggaagcagatggctcagattagggagcttgttgagcttcccttgaggcatccacagctgttcaagtcaattggtgttaagccaccgaagggaattttgctttatggaccacctgggtctggaaagactttgatcgctcgtgctgttgctaatgaaactggtgcctttttcttctgtatcaatgggcctgagatcatgtccaagctggctggtgagagtgagagcaacctcaggaaagcgtttgaggaggctgagaagaacgctccttcgatcatattcattgatgagattgactctattgcaccgaaaagagagaagactaatggagaggttgagaggaggattgtgtctcagctccttacgctaatggatggacttaaatctcgtgctcatgttattgtcatgggagcaaccaatcgtcccaacagtatcgacccggctttgagaaggtttggaagatttgatagggagattgatattggtgttcctgatgagattggtcgtcttgaagttctcaggatccacacaaagaacatgaagcttgctgaagatgtggatctagaaaggatctcaaaggacactcacggttatgtcggtgctgatcttgcagctctgtgcactgaagctgccctgcaatgcatcagggagaagatggatgtgattgatttggaagatgactccatagatgctgaaatcctcaattccatggcagtgaccaatgaacacttccacactgctctagggaacagcaacccatctgcacttcgtgaaactgttgtggaggtacccaatgtttcttgggatgacattggaggtcttgagaatgtcaagagagagctccaggagactgttcaatacccggtcgagcacccagagaagtttgagaaattcggtatgtctccgtcaaagggagtccttttctacggtcctcctggatgtggtaaaactcttctggccaaagctatagccaacgagtgccaagcaaacttcatcagtgtcaaaggtcccgagcttctcaccatgtggtttggagagagtgaagctaatgtccgtgaaatctttgacaaggcccgtcagtctgctccatgtgttctcttctttgacgagctcgactccattgcgactcagagaggaggtggaagcggaggtgatggtggcggcgcagcagatagagtcctgaaccagcttttgactgagatggatggaatgaacgccaagaaaaccgtcttcatcatcggggcaaccaacaggcccgacattattgattctgctcttctccgtccaggaaggctcgaccagctcatttacattccactgccagacgaggactcacgtctcaacatcttcaaggcctgcttgaggaagtcacctatcgctaaagatgtggacatcaacgctctcgctaagtacacacagggattcagtggtgctgatatcactgagatttgccagagggcttgcaagtacgccatcagagaaaacatcgagaaggacattgaaaaggagaagaggaggagcgagaacccagaagccatggaggaagatatggatgaagtatcagagatcaaagctgcacacttcgaggagtcgatgaagtatgcacggaggagtgtgagcgatgcagacatcaggaagtaccaagcctttgctcagaccctgcagcagtctagagggtttggttccgagttcaggttcgagactaatgctggttcaggtgcaaccactggagtcgctgatccttttgccacgtctgcagctgctgctgcggacgatgatgatctctacaattagtgatcaagtttatcatactttgttatttaagttttcaatcggattctctctacttctggataccttgtgtttctttaagttattggatttgatacttaataatcttgcttcactcttgttctttggtactaactactaaggtaatctaaaggacaatcttgattctccaa

SEQ ID NO: 7271 - DNA, 2803 bp, Eutrema halophilum
aagaaacatagagatattattaatatgtgaaaatctctgctctttcagatcccattatcacaatcgatctctcagagaacctaagggaaaactaaaagctctcaactttcttagattttctgagggaaatttctcgctaatctcaaatccattatgtcaaccccagctgaatcttcagactcgaaaccgaagaaagatttcagtactgctattctggagaggaagaagtcaccgaacagactcgttgtcgatgaggccatcaacgatgataactccgtcgtatctctgcaccctgccacaatggaaaagctccagctcttccgtggtgataccattctcatcaagggtaagaagcggaaggacactgtttgcattgctcttgctgacgaatcatgtgaggagccaaagatcagaatgaacaaagtcgtcagatctaacttgagggttagattgggagatgtcatttcggttcaccaatgcccagatgttaagtacggaaagcgtgtgcacatcttgccagtcgatgataccgttgaaggcgtgactggaaacctctttgatgcttacctgaaaccttattttctggaggcataccgccccgtgaggaagggtgatctcttcctagtcagaggaggaatgaggagtgtggagttcaaagttatagagacagatcctgctgagtactgtgttgttgctccagacacggagattttctgtgagggtgagccagtgaagagagaggatgaagaaagactagatgaagtaggttatgatgatgttggtggtgtcaggaaacagatggctcagattagggaacttgttgagcttcccttgaggcatccgcaactattcaagtccattggtgttaagccaccaaagggaattctgctctatggacctcctgggtctggaaagactttgattgctcgtgctgtggcaaatgaaaccggtgcctttttcttctgtattaatggacctgagatcatgtccaaactggctggtgagagtgagagcaacctcaggaaagcatttgaggaggctgagaaaaacgctccttcgatcatattcatcgatgagattgactctatcgcacccaaaagggagaagacaaacggagaggttgagcggaggattgtgtctcaactccttacactaatggatgggcttaaatcgcgtgctcatgttattgtcatgggagcaaccaatcgccctaacagtattgacccagctttgagacggtttggaagatttgatagggagattgatatcggggttcctgacgaaattggacgtcttgaagtactcaggatccacacaaagaacatgaagcttgctgaagatgtggatcttgagaggatctcaaaggacacacacggttatgtcggtgctgatcttgcagccctgtgcacagaagccgccctgcaatgcatcagggagaagatggatgtgattgatttggaagatgactccatagatgccgaaattctgaattctatggcagtgaccaatgaacacttccacactgctcttgggaacagcaacccatctgcacttcgtgaaactgttgtggaggttcccaatgtctcttgggatgatattggaggtcttgagaatgtcaagagagagctccaggagactgtccaatacccggttgagcacccagagaagtttgaaaaattcgggatgtctccatcaaagggagtccttttctacggtcctcctggatgtggtaaaacccttttggccaaagctatagccaacgagtgccaagcaaacttcatcagtgtcaaaggtcctgagcttcttactatgtggtttggagagagtgaagcgaatgtccgtgaaatctttgacaaggcccgtcagtccgctccatgtgttctcttctttgatgagcttgactccattgcgactcagagaggaagcggaagcggtggcgatggtggcggtgcagcagatagagtcctgaaccagcttttgactgagatggatggcatgaacgctaagaaaaccgtcttcatcattggagcaaccaacagacccgacattatcgatgcggctcttctccgtccaggaaggctcgaccagctcatttacattccactaccagacgaggattcgcgtctcaatatcttcaaggcctgcttgaggaaatctcctgttgccaaagatgtagacatcaatgcactcgctaagtacacacagggattcagtggtgctgatatcactgagatttgccagagagcttgcaagtacgccatcagagaaaacatcgagaaggacattgaaaaggagaagaggaggagcgagaacccagaggcgatggaggaagatggagaggatgaagtgtcagagatcaaagctgcacactttgaggagtcgatgaagtatgcgcgcaggagtgtgagtgatgcagacatcaggaaataccaagcctttgctcagacgctgcagcagtctcgagggttcggttctgagttcaggttcgagaatactgctggttcgggcgcaaccactggagtcgctgatccttttgccacatctgcagctgctgccgcggacgatgatgatctctacaactgatgatcaaatttatcacatcctttttttttttttttcaaatttaagaagttttaaatcgaattctctactgttggatgactaggaaagtgatactgatcctttccttgtggttttatcgttttataaagtattcggaatcagtcatgttggtaacttttaatcaatgttcttcactcctcttgttcattcattactaaagggctagaagctatcctattct

SEQ ID NO: 7272 - DNA, 2815 bp, Arabidopsis thaliana
aagaaacgtagagagatataattagagaaaatctgtgctctttcagatcccattatcacaaatccatctctctctctctctcagagaagaaaccaaagaagaagaaaaagctctcaactttcttcgatttctcagggaactctttcgttaatctcaaactcaatcatgtctaccccagctgaatcttcagactcgaaatcgaagaaagatttcagtactgctattctcgagaggaagaagtctccgaaccgtctcgtcgtcgatgaggctatcaacgatgataactccgtcgtctctcttcaccctgcaaccatggagaagcttcagctcttccgtggtgataccattctcatcaagggtaagaagaggaaggacactgtctgcattgctcttgctgatgagacatgtgaggagccaaagatcagaatgaataaagtagtcagatctaacttgagggttagactgggagatgttatatctgttcaccaatgcccagacgtcaagtacggaaagcgtgttcacatcctgcctgttgatgatactgttgaaggagtgactggaaacctatttgatgcttacctgaaaccttatttccttgaggcataccgtccagtgaggaagggtgatctcttcctagtcagaggaggaatgaggagtgtggagttcaaagttatagagacagatcctgctgagtactgcgtggttgctccagacacagagattttctgtgagggtgagcctgtgaagagagaggatgaagaaaggctagatgatgtaggttatgatgatgttggtggtgtcaggaaacagatggctcagattagggaacttgttgaacttcccttgaggcatccacagctattcaagtcgattggtgttaagccaccgaagggaattcttctttatggaccacctgggtctggaaagactttgatcgctcgtgctgtggctaatgaaacgggtgcctttttcttctgtatcaacggacctgagatcatgtccaaattggctggtgagagtgagagcaacctcaggaaagcattcgaggaggctgagaaaaatgcgccttcaatcatattcattgatgagatcgactctattgcaccgaaaagagagaagactaatggagaggttgagaggaggattgtctctcagctccttacgctaatggatggactgaaatctcgtgctcatgttatcgtcatgggagcaaccaatcgccccaacagtatcgacccagctttgagaaggtttggaagatttgacagggagatcgatattggagttcctgacgaaattggacgtcttgaagttctgaggatccatacaaagaacatgaagctggctgaagatgtggatctcgaaaggatctcaaaggacacacacggttacgtcggtgctgatcttgcagctttgtgcacagaggccgccctgcaatgcatcagggagaagatggatgtgattgatctggaagatgactccatagacgctgaaatcctcaattccatggcagtcactaatgaacatttccacactgctctcgggaacagcaacccatctgcacttcgtgaaactgttgtggaggttcccaacgtctcttggaatgatattggaggtcttgagaatgtcaagagagagctccaggagactgttcaatacccagtcgagcacccagagaagtttgagaaattcgggatgtctccatcaaagggagtccttttctacggtcctcctggatgtgggaaaacccttttggccaaagctattgccaacgagtgccaagctaatttcatcagtgtcaagggtcccgagcttctgacaatgtggtttggagagagtgaagcaaatgttcgtgaaatcttcgacaaggcccgtcaatccgctccatgtgttcttttctttgatgagctcgactccattgcaactcagagaggaggtggaagtggtggcgatggaggtggtgctgcggacagagtcttgaaccagcttttgactgagatggacggaatgaatgccaagaaaaccgtcttcatcatcggagctaccaacagacctgacattatcgattcagctcttctccgtcctggaaggcttgaccagctcatttacattccactaccagatgaggattcccgtctcaatatcttcaaggccgccttgaggaaatctcctattgctaaagatgtagacatcggtgcacttgctaaatacactcagggtttcagtggtgctgatatcactgagatttgccagagagcttgcaagtacgccatcagagaaaacattgagaaggacattgaaaaggagaagaggaggagcgagaacccagaggcaatggaggaagatggagtggatgaagtatcagagatcaaagctgcacactttgaggagtcgatgaagtatgcgcgtaggagtgtgagtgatgcagacatcaggaagtaccaagcctttgctcagacgttgcagcagtctagagggttcggttctgagttcaggttcgagaattctgctggttcaggtgccaccactggagtcgcagatccgtttgccacgtctgcagccgctgctggggacgatgatgatctctacaattagtgataacttctttatcctttttttttttaagttttaaaactcgaattctctacttttggattactggggaaagtgatactgattctttcctcgtgtttttaagttatccgaatctcttgtgtttgggttttaatcaatgttcttaattttcgtttcaatacttgtttggtcgttcattacaaatggaaaaaataaaggattataaagtaagttaaaaaga

SEQ ID NO: 7273 - DNA, 2782 bp, Arabidopsis lyrata
agagatataattagcgaactccttcagatcccattatcacaaatcgatctctctctcagaaaccaaaaagctctcaactttcttcgatttctgagggaactctttcgttaatctcaaactcaatcatgtctaccccagctgaatcttcagactcgaaatcgaagaaagatttcagtactgctattctcgagaggaagaagtctccgaaccgtcttgtcgtcgatgaggctatcaacgatgataactccgtcgtctctcttcaccctgcaaccatggagaagcttcagctcttccgtggtgataccattctcatcaagggtaagaaaaggaaggacactgtctgcattgctctcgctgatgagtcatgtgaggagccaaagatcagaatgaacaaagtagtcagatctaacttgagggttagactcggagatgttatttctgttcaccaatgcccagacgtcaagtacggaaagcgtgtgcacatcttgcctgttgatgatactgttgaaggagtgactggaaacctctttgatgcttacctgaaaccttatttcctggaggcataccgtccagtgaggaagggtgatctcttcctagtcagaggaggcatgaggagtgtggagttcaaagtcatagagacagatcctgctgagtactgcgtggttgctccagacacagagattttctgtgagggtgagcctgtgaagagagaggatgaagaaaggctagatgatgtaggttatgatgatgttggcggtgtcaggaaacagatggctcagatcagagaacttgttgaacttcccttgaggcatccacagctattcaagtcaattggtgtcaagccaccaaagggaattcttctttatggaccacctgggtccggaaagactttgattgctcgtgctgtggctaatgaaactggtgcctttttcttctgtatcaacggacctgagatcatgtccaaactggctggtgagagtgagagcaacctcaggaaagcatttgaggaggctgagaaaaatgccccttcaatcatattcattgatgagattgactctattgcacccaaaagagagaagacgaatggcgaggttgagaggaggattgtgtctcagctgcttacgcttatggatggactgaaatcgcgtgctcatgttattgtcatgggagcaaccaatcgccccaacagtatcgacccagctttgagaaggtttggaagatttgacagggagatcgatattggggttcctgacgaaattggacgtcttgaagttctgaggatccatacaaagaacatgaagcttgctgaagatgtggatctcgaaaggatctcaaaggatacacacggttacgtcggcgctgatcttgcagctttgtgcacagaggccgccctgcaatgcatcagggagaagatggatgtgattgatttggaagatgactccatagatgctgaaatcctcaattccatggcagtgactaatgaacatttccacactgctctcgggaacagcaacccatctgcacttcgtgaaactgttgtggaagttcccaacgtctcttggaatgatattggaggtcttgagaatgtcaagagagagcttcaggagactgttcaatacccagtcgaacacccggagaagtttgagaaattcgggatgtctccatcaaagggagtacttttctacggtcctcctggatgtgggaaaactcttttggccaaagctattgccaacgagtgccaagctaatttcatcagtgtcaagggtcccgagcttctgacgatgtggtttggagagagtgaagcgaatgtccgtgaaatcttcgacaaggcccgtcaatccgctccatgtgttcttttcttcgatgagcttgactccattgcgactcagagaggaggcggaagtggaggcgatggaggcggcgctgcggatagagtgttgaaccagcttttgactgagatggatggaatgaacgccaagaaaactgtcttcatcattggagcaaccaacagacctgacattatcgattcggctcttctccgtcctggaaggcttgaccagctcatttacattccactaccagacgaggattcccgtctcaatatcttcaaggccgccttgaggaaatctcctattgctaaagatgttgacatcgctgcactcgctaaatacactcagggattcagtggtgctgatatcactgagatttgtcagagagcttgcaagtacgccatcagagaaaacattgagaaggacattgaaaaggagaagaggaggaacgagaacccagaggcaatggaggaagatggagtggatgaagtatcagagatcaaagctgcacactttgaggagtcgatgaagtatgcacgtaggagtgtgagtgatgcagacatcaggaagtaccaagcttttgctcagacgttgcagcagtctagaggattcggttctgaattcaggttcgagaattctactggttcaggtgccaccactggagtcgcagatccgtttgccacgtctgcagctgctgctggggacgatgatgatctctacaattagtgataacttctttatcctttttttttatattaagtttaaaactcgaattctctacttttggattactggggaaagtgatactgattctttcctcgtgtttttaagttatccgaatttcttgtgtttgggttttaatcaatgttcttaattttcgtttcactcctttttttttttgtttcattccttacaaatggaaaacaaaaggatcacaaagtaagttacaaaga

SEQ ID NO: 7274 - DNA, 2751 bp, Arabidopsis thaliana
ggaaatcacagagcgtataaaatcccgagttcagctcccttgagatcccattcatcatcatcatcatcatcaccaatcgatctctctagaaacaaatttcccaacttccttcttagagctctcttgtcagtttaagctatcattatgtcaaacgaaccggaatcctccgactcgaaaactaagaaggatttcagtactgcgattctagagaggaagaagtctccaaaccgacttgttgtcgatgaagctattaacgatgacaactctgttgtctctctccatcctactaccatggaaaaactccagcttttccgaggcgatacaattctcatcaagggtaagaagaggaaggacactgtatgcattgccctcgctgatgaaacatgtgaggaacccaagatcagaatgaataaggttgtaaggtctaacttgagggttaggctgggagatgttatttctgttcaccaatgcccagatgtcaagtatggaaagcgtgttcacatcttgcctgttgatgatacagttgaaggcgttactggaaacctctttgatgcttacctgaaaccttactttctggaggcgtaccgtccagtgaggaagggagatcttttcctagtgagaggaggaatgaggagtgtggagttcaaagtgatcgagactgatcctgctgagtactgtgtggtggctccagatacagagattttctgtgagggtgaaccagttaagagggaggacgaagaaaggcttgatgaggttggttatgacgatgttggtggtgtcaggaaacagatggctcagattagggaattggttgaacttcccttgaggcatccacaactctttaaatcaattggtgtgaagccaccaaagggaattctgctttacggacctcctggatccgggaagactcttattgctcgtgctgtggctaatgaaaccggagcattcttcttctgtatcaatggaccggaaatcatgtcgaaactagctggtgagagtgagagcaacctcaggaaagcatttgaggaggctgagaagaatgccccgtctatcatattcattgatgagattgactctattgcaccaaaaagagagaagacgaatggtgaggttgagaggaggattgtctctcagctccttacgcttatggatggactaaaatcacgtgcccatgttattgttatgggagcaacaaatcgtcccaacagtattgatccggctttgagaaggtttggaagattcgacagggaaattgatatcggtgttcctgatgaaattggacgtcttgaagttcttaggatccacacgaagaacatgaagctagctgaagatgttgatctagaaagaatctccaaggacacgcatggatatgttggagctgatcttgcagctctatgcactgaagctgcccttcaatgtatcagagagaagatggatgtgattgacttggaagatgactcaattgacgccgaaatcctcaattccatggctgtgtctaatgaacacttccacactgctcttggaaacagcaacccatccgcccttcgtgaaactgttgtggaggttccaaatgtctcctgggaggatattggaggtctcgagaatgttaagagagagcttcaggagactgttcaataccctgtggagcatccagagaaattcgagaagtttggtatgtctccatcaaagggagttcttttctacggtcctcctggatgtggtaaaaccctgttagccaaagctatagcaaacgagtgccaagcaaacttcatcagtgtcaagggacccgagcttctcacaatgtggtttggagaaagtgaagccaacgtccgagaaatctttgacaaggctcgtcaatctgctccttgtgttctgtttttcgatgagctagactccattgctactcagagagggaacagcgcgggtgatgccggcggtgcagctgacagagtgttgaatcagcttttgacagaaatggatggaatgaatgcaaagaagacggtattcattattggagcaactaacagaccggatatcatagattcagctcttcttcgacctggaagactcgaccagcttatctacattcctctacctgatgaagattcccgtctcaatatctttaaggcctgcttgagaaaatctcccgtcgctaaagatgtagatgttactgcactcgcaaagtacactcagggattcagtggtgctgatatcaccgagatctgccagagagcttgcaagtacgccatcagagaaaacatcgaaaaggatattgagaacgagcgtagaaggagccagaatccagaggccatggaggaagatatggtggatgatgaagtttcagagattagagctgctcatttcgaagagtcgatgaaatatgcaaggagaagtgtgagtgatgctgatattcgcaagtaccaagcttttgctcagacgctgcagcaatccagagggtttggatctgagttcaggtttgactcaaccgctggtgtcggacgcaccactggtgttgcagccgccgatccctttgccacttctgcagctgcagctgatgacgacgatctctacagttagattttgatttcttagtgatcgtttttcttctttctttaacttaaattaggttcttttggatgatgtcgagattgatacagtttaaaatcatctgggtttgccagcttataatcacttgagcaaattatttctatgtttatttcattcacaatgcctttgatcggttacttaacg

SEQ ID NO: 7275 - DNA, 2556 bp, Arabidopsis lyrata
gttcaatctcagctatcactatgtcaaaccaacctgaatcttccgactcgaaacctaagaaggatttcagtactgcgattctcgagaggaagaagtctccaaaccgacttgttgtcgatgaagccattaacgatgacaactctgttgtctctctccatcctgctaccatggaaaagctccagctttttcgaggcgatacaatcctcatcaagggtaagaagagaaaggacactgtgtgcattgcccttgctgatgaaacatgtgaggaacccaggatcagaatgaataaggttgtaaggtctaacttgagggttagactgggagatgttatttctgttcaccagtgcccagatgtcaagtatggaaagcgtgtgcacatcttgccagttgatgatacagttgaaggcgttactggaaacctttttgatgcttaccttaaaccttacttcctggaggcgtaccgcccagtgaggaagggagatcttttcctagtgagaggaggaatgaggagtgtggagttcaaagtgatcgagactgatcctgctgagtactgtgtggtggctccagatacagagattttctgtgagggtgaaccagtcaagagggaagacgaagaaaggcttgatgatgtcggttatgacgatgttggtggtgtcaggaaacagatggctcagattagggaattggttgaacttcccttgaggcatccacaactctttaaatcaattggtgtgaagccaccaaagggaattctgctttatggacctcctggatccgggaagactcttattgctcgtgctgtggctaatgaaaccggggcatttttcttctgtatcaatggaccggaaatcatgtcgaaactggctggtgagagtgagagcaacctcaggaaagcatttgaggaggctgagaagaatgccccttctatcatattcattgatgagattgactctattgcaccaaaaagagagaagacgaatggtgaggttgagaggaggattgtctctcagctccttacgcttatggatggactaaaatcacgtgcccatgttattgttatgggagcaacaaatcgccccaacagtattgatccggctttgagaaggtttggaagattcgacagggaaattgatatcggtgttcctgatgaaattggacgtcttgaagttcttaggatccacacgaagaacatgaagctagctgaagatgtggatctagaaagaatctccaaggacacgcatggatatgttggagctgatcttgcagctctatgcactgaagctgcccttcaatgtatcagagagaagatggatgtgattgacttggaagatgactcaattgacgccgaaatcctcaattccatggcggtgtctaatgaacacttccacaccgctcttggaaacagcaacccatccgcacttcgtgaaactgttgtggaggttccaaatgtctcctgggaggatattggaggtcttgagaatgttaagagagagcttcaggagactgttcaataccctgttgagcatccagagaaattcgaaaagtttggtatgtctccatcaaagggagttcttttctacggtcctcctggatgtgggaaaacccttttagccaaagctatagcaaacgagtgccaagcaaacttcatcagtgtcaagggacccgagcttctcacaatgtggtttggagaaagtgaagccaacgtccgtgaaatctttgacaaggctcgtcaatctgctccttgtgttctgtttttcgatgagcttgactccattgctactcagagaggaaacagcgtgggtgatgccggcggtgcagctgatagagtgttgaatcagcttctgacagaaatggatggaatgaatgcaaagaagactgtattcattattggagcaactaacagaccagatatcatagatccagctcttcttcgacctggaagactcgaccagcttatctacattcctctacctgatgaagattcccgtctcaatatcttcaaggcctgcttgagaaaatctcctgtcgctaaagatgtagatgtgactgcactcgctaagtacactcagggattcagtggtgctgatatcactgagatctgccagagagcttgcaagtacgccatcagagaaaacatcgaaaaggatattgagaaagagcgtagaaggagcgagaatccagaggcgatggaggaagatatggtggatgatgaagtttcagagattcgagctgctcatttcgaagagtcgatgaaatatgcaaggagaagtgtaagtgatgctgatattcgcaagtaccaagcttttgctcagacactgcagcaatctagagggtttggatctgagttcaggtttgactcaaccgcttctgcgggacgcaccattggtggtgcagccgctgatccctttgccacttctgcagctgcagctgatgacgacgatctctacagttagattatgatttctctcgttttcttttctctttaacttaaagttatgatcttttggatgatgtcaagagtgatacagttataactcctccgggtttgtcaggtta

SEQ ID NO: 7276 - DNA, 2705 bp, Eutrema halophilum
aattccgcttctttgtccaacaagaaacacagatataaatcccgaaatctactcccttgagatcccattatctcaacactcatcaatcgatctctctagaaacaaatttcgcaactttctgagaaaaactcttttctcaatttcagcaatcaccatgtcaaaccaacctgaatcttccgactcgaaatcgaagaaggatttcagtactgctattcttgagaggaagaagtctccaaaccgacttgttgtagacgaagccatcaacgatgacaactctgtcgtctctatccatcctgccaccatggaaaagctccagcttttccgtggcgatacgattctcatcaagggtaagaaaaggaaggacacagtctgcattgctcttgctgatgagtcatgtgaggaacctaagatcagaatgaacaaggtcgtaaggtccaacttgagggttagacttggagatgttgtttctgttcaccaatgcccagacgtcaagtatggtaagcgtgtgcacatcttgccagttgatgataccgttgaaggagttactggaaacctcttcgatgcttacttgaaaccttacttcctggaggcgtaccgcccagtgaggaagggtgatctattcctagtgagaggaggaatgaggagtgtggagttcaaagtaatcgagactgagcctgcagagtactgtgtggtcgctccagatacagagattttctgtgagggtgaaccaataaagagggaggacgaagaaaggctggatgaagtcggttatgatgatgttggtggcgtcaggaaacagatggctcagattagggaacttgttgaacttcctttgaggcatccgcaactgttcaagtcaattggtgtaaagccaccaaagggtattctgctttatggacctcctgggtccggaaagactctgattgctcgcgccgtggccaacgaaaccggagcttttttcttctgtattaatggaccggagatcatgtcgaaactggctggtgagagcgagagcaacctcaggaaagcatttgaggaggctgagaagaatgctccttctatcatatttattgatgaaatcgactctattgcaccaaaaagagagaagactaatggagaggttgagagaaggattgtctctcagctccttacgcttatggatggactgaaatcgcgtgcccatgttattgtcatgggagcaacaaatcgccccaacagtatcgacccggctttgagaaggtttggaagattcgacagggaaattgatatcggtgttcctgatgaaatcggacgtcttgaagttcttaggatccacacgaagaacatgaagctatctgaagatgtggatctagaaagaatctccaaggacacacatggatatgttggtgctgatcttgcagctctatgcactgaagctgcccttcaatgtatcagagagaagatggatgtgattgacttggaagatgactctattgacgccgaaatcctcaattccatggctgtgtctaatgaacatttccagaccgctcttggaaacagcaacccatctgcacttcgtgaaaccgttgtggaggttccaaatgtctcctgggaggatattggaggtcttgagaatgttaagagagagctacaggagactgttcaataccctgtggagcatccagagaaattcgagaaatttgggatgtctccatcaaagggagttcttttctacggtcctcctggatgtggaaaaacccttctagccaaagcgatagcaaacgagtgccaagcaaacttcatcagcgtcaagggacctgagcttctcactatgtggtttggagaaagtgaggccaacgtccgagaaatctttgataaggctcgtcagtctgctccttgcgttctgttctttgatgagctcgactccattgctactcagagaggaagcagcgtgggtgatgcaggcggtgcagctgatagagttttgaatcagcttttgacagaaatggatggaatgaatgcgaagaagacggtcttcattattggagcaactaacagacctgacattattgatccagctcttcttcgacctggaagactcgaccagcttatctacattcctctacccgatgaggattcccgtctcaacatcttcaaggcgtgcttgaggaaatctcctgttgctaaagatgtcgatgtgactgcactcgccaagtacactcagggattcagtggtgctgatatcactgagatttgccagagagcttgcaagtacgccatcagagagaatatcgaaaaggatatcgagagggagcgtagaaggagcgagaatccagaggccatggaggaagatttggtggacgatgaagttgcagagattagagctgctcatttcgaagagtcgatgaagtatgcaaggaggagtgtgagtgatgctgatattcgcaagtaccaagcttttgctcagacgctgcagcagtcgagaggatttggaactgagttcagatttgacccaaccgccgctgctggacgcaccactggtggtgctgccgccgatccctttgccacttctgcagctgctgccgatgacgacgatctttacagttagattatggattcgtcaatgtagttttttttttttttttctaagtgtttttaagttaagttgtgaacttttgaatgatgtcgagagagattatgtcgatgttattttcacctttttttac

SEQ ID NO: 7277 - DNA, 2819 bp, Eutrema parvulum
aattccgcttcttttccaacaagaaacacagatataaatcccgaaacctgctctcttcagatcccatacgagactcatctcaatcgatctctctagaaacaaatttcgaaactttcttcggtttctttgagaactctctctgctcaatttcagcaatcaccatgtcaaaccaacctgaatcttccgactcgaaatcgaagaaggatttcagtactgctatccttgagaggaagaagtctcctaaccgacttgtcgtcgacgaagccattaacgatgacaactctgtcgtctctctccatcccgccaccatggaaaagctccaacttttccgtggcgatacaattctcatcaagggtaagaaaaggaaggacactgtctgcattgcccttgctgatgagtcatgtgaggaacctaagatcagaatgaacaaggtcgtgaggtccaacttgagggttagactgggagatgttatttctgttcaccaatgcccagatgtcaagtatggaaagcgggtgcacatcttgccagttgatgataccgttgaaggggttactggaaacctatttgatgcgtacctgaaaccttacttcctggaggcgtaccgcccagtgaggaagggtgatctattcctagtgagaggaggaatgcggagtgtggagttcaaagttatcgagactgatcctgctgagtactgtgtggtcgctccagatacagagatcttctgtgagggtgaaccagttaagagggaggatgaagaaaggctggatgatgttggttatgatgatgttggtggtgtcaggaaacagatggctcaaattagggagcttgttgaacttcctttgaggcatccacaactgttcaagtcaattggtgtgaagccgccaaaaggtattctgctttatggaccgcctggatccggaaagactctgattgcccgcgccgtagctaacgaaaccggagcgtttttcttttgtattaatggaccggagatcatgtcgaaactggctggtgagagtgagagcaacctcaggaaagcatttgaggaggctgagaagaacgctccttctatcatattcattgatgagattgactctattgcaccaaaaagagagaagactaatggagaggttgagaggaggattgtctctcagctccttacgcttatggatggactgaaatcacgtgcccatgttattgtcatgggagcaacaaatcgccccaacagcattgacccagctttgagaaggtttggaagatttgacagggaaattgatatcggcgttcctgatgaaatcggacgtcttgaagttcttaggatccacacgaagaacatgaagttagctgaagatgtggatctagaaagaatctgcaaggacacacatggatatgttggtgctgatcttgcagctctatgcactgaagctgcccttcaatgtatcagggagaagatggatgtgattgacttggaagatgattctattgacgccgaaatcctcaactccatggctgtttctaatgaacacttccatactgctcttggaaacagcaacccatctgcacttcgtgaaaccgttgtggaggttccaaatgtctcgtgggaagatattggaggtcttgagaatgttaagagagagctacaggagactgttcaataccctgtggagcatccagagaaattcgaaaaatttgggatgtctccatcaaagggagttcttttctacggtcctcctggatgtgggaaaacccttttagccaaagccatagcgaacgagtgccaagcaaacttcatcagcatcaagggacctgagcttctcacaatgtggtttggagaaagtgaagccaacgttcgtgaaatctttgacaaggctcgtcaatctgctccttgtgttctgttttttgatgagctcgactccattgctactcagagaggaagcagcgtgggtgatgcaggtggtgcagctgatagagttttgaatcagcttttgacagaaatggatggaatgaatgcaaagaagacggtcttcattattggagcaactaacagacctgacattattgatccagcccttcttcgacctggaagactcgaccagcttatctacattcctctacccgatgaagattcccgtctcaacatctttaaggcgtgcttgaggaaatctcctgttgctaaagatgtcgatgtgactgcacttgccaagtacacgcagggattcagcggtgctgatatcactgagatttgccagagatcttgcaagtacgcaattagagaaaacattgaaaaggatattgagagggagcgtagaaggagcgagaatcccgaggccatggaggaagatttggtggatgatgaagttgcggagattagagctgctcatttcgaagagtcgatgaagtatgcaaggaggagtgtgagtgatgctgatattcgcaagtaccaagcttttgctcagacgctgcagcagtcaagagggtttggaactgagttcaggtttgacccaaccacggctgctggacccaccactggtggtgccgccgctgatcccttcgccacttctacagctgcggccgatgacgatgatctctacagttagattatggttttttttctttcttctaagttaaaaggttgtgaacccgaatgatgtcgagagagatacggaaacttttctcatgttattattaacttgggctcattatttccgatgttattttcattcacaaaactttttataagtttcctttgtttcttaaggtttatttcttaaaagtaaccatctaacgagagagtcggaaaagtcgtgaagtaggataatttt

SEQ ID NO: 7278 - DNA, 2519 bp, Brassica napus
cggcacgaggacaaaagctcgcaactttcttcgacaactctctgctcaatttcagcaatcatcaccctgtcgaaccaacctgaatcttccgactcgaaatcgaagaaggacttcagcacagctatcctcgagaggaagaagtctcctaatcgtcttgttgtcgacgaagccatcaacgatgacaactccgtagtctctctccaccccaacgccatggagaagctccaactcttccgtggcgacacaattctcatcaagggcaagaagaggaaggacactgtctgcatcgctcttgctgatgactcctgcgaggagcctaagatcaggatgaacaaagtcgtgaggtccaacttgagggttagactcggcgacgtcgtctccgttcaccaatgccctgacgtcaaatacggaacacgtgtccacatcttacccgttgatgacaccgttgaaggagtcaccgggaacctcttcgacgcttacctcaaaccttacttcttggaggcgtaccgtccagtgaggaagggcgatctattccttgtgagaggaggaatgaggagtgtggagttcaaagttattgagactgatcctgctgagtactgtgtggttgctccagacactgagattttctgtgaaggggaaccgatcaagagagaggacgaagagaggctggatgaagtcggttatgatgatgttggtggcgtcagaaaacagatggctcagattagagaacttgttgagcttcctttgaggcatccgcagctcttcaagtccatcggtgtgaagccgccgaagggtatcttgctctatggacctcctggttccggaaagacactgatcgctcgcgccgtggctaacgaaacgggagcgtttttcttctgtatcaatggaccggagatcatgtcgaaaatggccggtgagagtgagagcaacctcaggaaagcgtttgaagaggctgagaagaacgctccttccattatctttattgatgagattgactctattgcaccaaagagagataagactaatggtgaggttgagaggaggattgtctctcagctcctcacgcttatggatggtttaaagtcacgtgcgcatgttatcgtcatgggagcgacgaaccgtcccaatagtattgacccggctttgagaaggtttgggaggttcgacagggagattgacatcggtgttcccgatgagattggacgtcttgaggttcttaggatccacaccaagaacatgaagctagctgaagatgttgatctcgaaagaatctccaaggacacgcacggatacgttggtgctgatcttgcggctctatgcaccgaagctgctcttcagtgcatcagagagaagatggatgtgattgacttggaagatgagtctatcgacgctgagattctcaactccatggcggtgtctaacgaacacttccacaccgctcttgggaacagcaacccgtctgcactccgtgagaccgttgtggaggtaccaaacgtctcctggaaggatatcggagggcttgagaatgttaaaagagagctgcaggagactgttcagtaccctgtggagcatccagagaagttcgagaagtttgggatgtctccatcgaagggagttctcttctacggtcctcccggatgcgggaaaacgcttctagccaaagccatagcgaacgagtgtcaagcaaacttcatcagcgtcaagggacctgagcttctcaccatgtggtttggagagagtgaggcaaacgtccgcgagatctttgacaaggcgcgtcagtccgcgccttgcgttctcttcttcgacgagctggactccatcgctactcagagaggaagcagcgtgggggacgcaggaggcgcggcggatagagttttgaaccagcttttgacggagatggatgggatgaacgcaagaagactgtcttcatcatcggagcgactaacagacccgacattatagatccagctcttctccgacctgggagattggatcagctcatctacattcctctgccagatgaggagtcccgtctcagcatcttcaaggcgtgtttgaggaagtctcccgttgctaaagacgttgacgtgagggccctggctaagtacactcaggggttcagcggcgctgacatcactgagatttgccagagggcgtgcaagtacgctattagagagaacatcgagaaggatattgagagggagcgtaggaggggggagaatccggaggctatggaggaagatttggtggatgatgaggtggcggagattagagctgctcatttcgaggagtcgatgaagtatgcgaggaggagtgtgagtgatgctgatattcgcaagtaccaggcctttgctcagacgctgcagcagtctagagggattgggagtgagttcaggtttgatccgaccgcgtctgctggacggaccactggtggtgcatctgctgatccctttgctacttcagctgctgctgcagatgatgatgatctctacagttaagattatggtttctcaaagtta

SEQ ID NO: 7279 - DNA, 2813 bp, Vinca minor
gaattttttccatccctatttaatacccctcaaatcacagatctcctttacccaacctcaacaaacccttcttctaatcgaagaattccaattcaatcgtcgatttcattcagtgccatgagtaaccaagctgaatcctccgattcgaaggggactaagagggattttagtactgcgattttggaaaggaagaaatctcctaatcgcctcgttgtagatgaagctatcaacgatgataactccgttgttgctctacaccccgatactatggaaaagctccagcttttccgcggtgatactattttgattaagggaaagaaaaggaaggatacaatttgcattgcccttgctgatgaaacttgtgatgaaccaaagattaggatgaacaaggtggtcaggtcaaacctgagggttaggcttggagatgttgtttccgttcatcaatgtcctgatgtgaaatatgggaagcgtgttcacatcctccctgttgatgacactgttgaaggagttactggaaatctgtttgatgcttatttgaaaccttatttcttggaagcataccgaccggtcagaaagggcgacctcttcctcgtaaggggtggaatgagaagtgtagaatttaaggttatagaaactgacccttctgagtattgtgttgttgcccccgatactgagatcttttgtgagggagagccagttcgaagggaagatgaagagcgcttggatgaggttggttatgatgatgttggaggagttcgtaagcagatggctcagattcgtgagcttgtggaattgcccttgagacatcctcagctcttcaaatcaattggtgttaagcctccgaaaggaattcttctttatgggcctccagggtctggaaaaaccttgatagccagagctgtggccaatgaaactggtgccttcttcttctgtatcaatggaccagaaattatgtcaaaactggcaggagagagtgaaagcaatctcagaaaagcatttgaggaagccgagaagaatgctccatctatcatatttattgatgagattgattccattgctcctaagcgagagaagacaaatggagaagttgaaagaagaattgtttctcagctcttgacgcttatggatgggctgaagtctcgtgcccatgttattgttatgggtgctacaaaccgtcccaatagcattgatccagcactgagaaggtttggaagatttgatagggaaatagatattggtgtaccagatgaagttgggcgtcttgaggttcttcgtatccacacaaagaacatgaagctcgccgaagatgttgatctggaaaaaatttctaaggacacccatggttatgttggtgccgacttagctgctttgtgtactgaggctgctctacaatgtatcagggagaagatggatgtgatcgacttggaagatgattctattgatgcagagatcctcaactccatggctgtcaccaatgagcatttctcgactgctcttgggacaagcaatccatctgccctgcgtgaaactgtggttgaagtgccaaatgtttcctgggaggatattggtggcctggaaaacgtcaaaagagaacttcaagagacggttcaatatccagtggagcaccccgagaagttcgagaagtttggcatgtcaccctcaaagggtgttcttttctatggtccacctggttgtggtaagactttgctggccaaggctattgccaacgagtgccaagcaaacttcatcagtatcaagggtcctgaattgcttaccatgtggtttggagagagcgaggccaatgtcagagaaatatttgacaaggcgcgccaatctgctccttgtgttctcttctttgacgaattagattcaattgcgactcagagaggaagcagcgttggagatgctggaggtgctgctgatagagttttgaatcagcttctcacagaaatggacggaatgaacgcaaagaaaactgttttcatcattggagccaccaacagacctgacattattgatcctgcgcttttaaggcctggccgtcttgatcaactaatttatatccctcttcctgatgaggattctcgacaccagatattcaaggcatgcctgaggaaatctcccatctcaaaagatgtagacttgagagctcttgccaaatatacacaaggcttcagcggtgctgatatcacagagatatgccaacgtgcatgcaaatatgctattagagagaacattgagaaagatatcgagagggagaagaggagaagggacaatcccgaggctatggaggaggatgtagatgacgaggtggctgagatcacggctgctcactttgaggaatccatgaagtacgccaggaggagtgtcagcgatgccgatatccgcaaatatcaagcttttgctcagactttgcagcaatctaggggattcggtactgaattccgattctcggagaccagtgccagtggtgccacaggaacggacccttttgcagctcctgctggtggagctgatgaagatgacctttatagttagttcatctatttggtgctctactcttttatattgaaatactataatgcttttgtaagttattgactgtcccttgtagaatgaggttaaggttttatgttggatggattatgaagctgaaaaccctctttggtttggcttggtgaatacttgtattttccaacaggtctcattagccttttgcttttggaaaggttataatgatgaatcttttagaccatctagccaattttatgcacacttatgtgttctggatattatcatcatctttttatgag

SEQ ID NO: 7280 - DNA, 2746 bp, Tabernaemontana elegans
cttccaatctcagatctccattacccaagacaatcaaatcctgaccaaaccctcctctgaaattcaattcaattgtgcattcattcagctttctatctgcctgccatgagtaaccaagctgaatcctccgattcgaaggggacgaagagggattttagtaccgcgattttggaaagaaagaaggcccctaatcgcctcgtagttgatgaagctatcaacgatgataactccgtcgttgctctacacccggagactatggagaagctccagcttttccgcggcgacactatcttgattaagggaaagaaaaggagggatacaatttgcatagcccttgccgatgatagttgtgaggaacctaagattaggatgaataaggtggtcaggtcaaacctcagggttaggcttggagatgttgtttctgttcatcaatgtcctgatgtcaaatacgggaaacgtgtccacatcctccctattgatgacacagttgaaggagttactggaaatctttttgatgcttatttgaaaccttatttcttggaagcataccgaccagtcagaaagggcgacctcttcctcgtaaggggagggatgagaagtgtagaattcaaggttatagaaactgaacctgctgagtattgtgttgttgcccctgacaccgagattttttgtgagggagagcctgtgcgaagggaggatgaagagcgcttggatgaggttggttatgatgatgttggaggagttcgtaagcagatggctcagattcgtgaactagtggagttgcccttgagacatcctcagctctttaaatcaattggtgttaagcctccaaaaggaattctactttatggacctccaggatctggaaagaccttgatagcccgagctgtggctaatgaaactggtgccttcttcttctgtatcaatggaccagagattatgtcaaaactggcaggagagagcgaaagcaatctcaggaaagcatttgaggaagcggagaagaatgccccatccatcatatttattgatgagattgactccatcgctccaaagcgagagaagacacatggagaagttgaaagaagaattgtttcccagctcttgacacttatggatgggctgaagtctcgtgcccatgttattgttattggtgcgacaaatcgtcctaatagcattgatccagcactgagaaggtttgggagatttgatagggaaatagacattggagtgccagatgaagttgggcgtctggaggttcttcgtatacacacgaagaacatgaagctttctgaagatgttgatctggagagaattgctaaggacacccatggttatgttggtgctgacttagcagctctgtgtactgaggctgctctgcaatgtatcagggagaagatggatgtgattgacttggaagatgattctattgatgcagagattctcaactccatggctgtcactaatgagcatttccagactgcccttggtacaagcaatccatctgctttgcgtgaaactgtggtggaagtgccaaatgtcacttgggaggatattggaggcctggagaacgtcaagagagagcttcaagagactgttcaatatccagtggagcatcctgagaagtttgaaaagtttggcatgtcaccctcaaagggtgttcttttctatggtccacctggttgtggcaaaacattgctggccaaggctattgctaacgagtgccaggcaaacttcatcagtgtcaagggtcctgaattgcttacaatgtggtttggagagagtgaggccaatgtcagagaaatatttgacaaggcgcgccaatctgctccctgtgttctcttctttgatgaattagattcaattgctactcagagaggaagcagtgtaggagatgctgggggtgctgccgatagagttttgaatcagcttctcacagaaatggatggaatgaatgcgaagaaaactgttttcatcattggtgcgaccaacaggcctgacataattgatcctgcgcttttaaggcctggccgtcttgatcaattaatttatatcccccttcctgatgaggattcacgacaccagatattcaaggcatgcctgagaaaatctccagtctcaaaagatgtggacttgagagcccttgccaagtatacgcaaggcttcagtggtgctgatattacagagatatgccaacgtgcgtgcaaatatgcaattagagagaacattgagaaagatattgagagggagaggaggaggagagacaatcctgaggctatggaggaggatgtggaggatgaggtggctgagatcaaggctgctcattttgaggaatcaatgaagtatgccaggaggagtgttagtgatgctgatatacgcaaatatcaggcttttgctcagacattgcagcaatctagaggatttggtagtgaattccgatttccggagactggtgctggggctacaggagctgacccttttgcaacttctgctggtggagctgatgaagatgacctgtatagttaggttgtctatttgtggtgctattttattttgaaatgttttaatgcttttgtaagttgttgactatccctgtagcatgggttaaaagggcacatgttggatgattattgagctgaagaacctcttggacggcttcttgaagacttgtatctctcttactctcaatgtctgggaagtgcttgcttttagaaaggtcacaatgaatatttagaccctataatttaag

SEQ ID NO: 7281 - DNA, 2665 bp, Euphorbia peplus
atcttcagctatatttttcacatctgtgctttgctttcctcttcctctcgaccatgtctagccaagccgaatcatctgactctaaaggaacgaagagggattttagtactgcgattttggaacgcaagaaatcgcctaatcggcttgttgttgatgaagctatcaatgatgacaactctgttgtctctctgcatcctgaaaccatggagaagcttcagttgtttcgtggtgacacgatcctgattaagggtaagaaaaggaaagataccatctgcattgctcttgccgatgacacttgtgatgagcccaagatcaggatgaacaaggttgtgaggtcaaacctgagggttaggcttggagatgttgtctctgtgcatcaatgtcctgatgtcaaatacggaaagcgtgtgcacatactgcctatagatgacacgattgagggagttactggaaatttgttcgatgcatacttgaaaccgtatttcctggaggcatatcgcccagtcaggaagggggatctcttcctcgtgagaggagggatgagaagtgtggagttcaaggttattgagacggatccaactgagtactgtgtggttgctccagacacagagatcttctgtgagggagagccagtgaggagagaagacgaaaacagattggatgaagtcggttatgatgatgttggtggtgtcagaaaacagatggctcagattagggagttggtggagcttccactgcgacacccgcagctcttcaaatcaattggtgtaaagcccccaaaaggaatcttgctatatggacctcctggttctggcaagactctgattgcccgtgctgttgccaacgaaactggtgctttcttcttctgcatcaacggacctgaaatcatgtctaaattggctggtgagagtgaaagtaatctcaggaaagctttcgaagaagcagagaaaaatgctccatcaattatatttattgatgagattgattcaattgcccccaagagagagaaaacacatggagaagttgagagaaggattgtttctcagctcttgacacttatggacggactcaagtcccgtgcacatgttattgttatgggagccactaaccgtcctaacagcattgatcctgctctgaggcggtttggtagatttgatagggaaattgatattggtgttcctgatgaagttgggcgtctcgaggttcttcgtatccatacaaagaatatgaagctttctgaagaagttgatttggaaagaattgctaaagatacccatggttatgttggtgctgacttggcagctctttgtaccgaggctgcgcttcagtgcattagggagaagatggacgtgattgacttggaagatgagtccattgatgctgagatactaaactcgatggcagtgactaacgaacacttccatactgctcttggaaatagcaacccatccgctttgcgtgaaacagtggttgaagtgcctaactgcagttgggaagatattggtggtcttgaaaatgtcaagcgggaacttcaagagactgttcaatacccagtggagcaccctgagaaattcgaaaagttcggaatgtcaccctccaagggtgttcttttctatggacctcctggatgtgggaaaacccttctggctaaagctattgccaacgaatgtcaggcgaatttcatcagtgtcaagggtccagaattgcttactatgtggtttggtgagagtgaagccaatgtgcgagaaatttttgataaggctcgccaatctgctccttgtgttctcttctttgatgaactcgattcaattgctactcagagaggaagcagtgttggggatgctgggggtgcagctgatagggttttgaaccagcttttaacagaaatggatggcatgtccgcaaagaaaaccgtcttcattattggggccaccaataggcctgatatcattgaccctgcacttctgcgtcctggtcgtctcgatcagttgatctacattcctcttccagatgaggattctcgccatcaaattttcaaggcttgtttgaggaaatcacccatttctaaagatgtcgacattagagcacttgccaagtacactcagggcttcagtggtgctgatattactgaaatttgccagcgtgcttgcaaatatgctatcagagagaatatcgaaaaggatattgagagggagaggagacggagagacaacccagaagctatggaggaagatgttgaggatgaggttgcagagatcaaggcagcacattttgaggagtcgatgaagtttgctcgcaggagtgtgagtgatgctgacatccgcaagtaccaggcctttgcccaaactctgcaacaatcaagaggcttcggaagcgaattcaggttttccgaagctagcggcgcaactactggagcagatccttttacatcaactgctgctgcagccgacgatgacgacctctacagttaaattatcatcttcaaacaggcgcgtgtttttaagttagtcctacatgatgtgtatttgtttatttccgtccttgttgtagttttaaggataattttatgatgtccctcttggcccgacttatccttggcttttccttgcaagttggatagaacagattccgcttctctttactggttatataatggatgacattt

SEQ ID NO: 7282 - DNA, 2659 bp, Vinca minor
aacaaacccttccttcttctatcggaatcctcaatttaatcgacgattcattgcctgttatgagtaatcaagctgaatcctccgattcgaagggtactaagagggattttagtactgcgattttggaaaggaagaaatctcctaatcgactcgtggtagatgaggctatcaatgatgataactccgttgttgctctacaccctgatactatggaaaagctccagcttttccgcggcgacactattttgattaagggtaagaaaaggaaggatacaatttgcatagcccttgctgatgaaacttgtgatgaaccaaagattaggatgaacaaggtgatcaggtcaaacctgagggttaggcttggagatgttgtttccgttcatcagtgccctgatgtgaaatatgggaagcgtgttcacatcctccctgtggatgacactgttgaaggagttactggaaatctgtttgatgcttatttgaaaccgtatttcttggaagcataccgaccggtcagaaagggtgacctcttcctcgtaaggggaggaatgagaagcgtagaatttaaggttatagaaactgaccctgctgagtattgtgttgttgcgcccgatactgagatcttttgtgagggagagccagttcgtagggaagatgaagagcgcttggatgaggttggttatgatgatgttggaggagtccgtaagcagatggctcaaattcgtgagcttgtggaattgcccttgagacatcctcagctcttcaaatcgattggtgttaagcctccaaaaggaattctgctttatgggcctccaggatctggaaaaactttgatagccagagctgtggctaatgaaactggtgccttcttcttctgtatcaatggaccagaaattatgtcaaaactggcaggagagagtgaaagcaatctcagaaaagcattcgaggaagcagagaagaatgctccatctatcatatttattgatgagattgactccattgctcctaagcgagagaagacacatggagaggttgaaagaagaattgtttctcagctcttgacacttatggatgggctgaagtctcgtgcccatgttattgttatgggtgctacaaaccgtcccaatagcattgacccagcactgagaaggtttggaagatttgatagggaaatagacattggtgtaccagatgaagttgggcgtcttgaggttcttcgtatccacacaaagaacatgaagctcgctgaagatgttgatctggaaagaatttctaaggacacccatggctatgttggtgccgacttagcagctttgtgtactgaggctgctctacaatgtatcagggagaagatggatgtgatcgacttggaagatgattctattgatgcagagatcctcaattccatggccgtcaccaatgagcatttctcgactgctcttgggacaagcaacccatctgccctgcgtgaaactgtggttgaagtgccgaatgtttcctgggaggatattggtggcctggagaatgtcaaaagagaacttcaagagacggttcaatatccagtggagcatcctgagaagttcgagaagtttggcatgtcaccctcaaagggtgttcttttctatggtccacctggttgcggcaaaactttgctggccaaggctattgccaatgagtgccaagcaaacttcatcagtgtcaagggtcctgaattgcttaccatgtggtttggagagagtgaggccaatgtcagagaaatatttgacaaggcgcgccaatctgctccttgtgttctctttttcgatgaattagattcaattgcaactcagagaggaagcagtggcggagatgctggaggagctgctgatagagttctgaatcagcttctcacagaaatggatggaatgaacgcaaagaaaactgttttcatcattggagccaccaacagacctgacattattgatcctgcgcttttaaggcctggccgtcttgatcagctaatttatatccctcttcctgatgaggattctcgacaccagatattcaaggcatgcctgaggaaatctcccatctcaaagaatgtagacttgagagcccttgccaaatatacgcaaggcttcagcggtgctgatatcacagagatatgccaacgtgcatgcaaatatgccattagagagaacattgagaaagatatcgagagggaaaggaggagaagggataatcctgaggctatggaggaggatgttgaggacgaagtggctgaaatcacggctggtcactttgaggaatccatgaagtatgccaggaggagtgtcagcgatgctgatatccgcaaatatcaggcttttgctcagacattgcagcaatctaggggatttggtactgaattccgattctcagagaccagtgctggtgggactacaggatccgacccttttgcagctcctgctggtggagctgatgaagatgacctttatagttagatcatccctttaatgttgaaatattataatgctttgtaagttattgactattccttgtagaattgaggttaagggcacgttggatggattataaaaagccgaataacctcttggttggcgcagtaaagacttgtatttcccaacaagtcctcaggtcccataagcctttgcttttggac

SEQ ID NO: 7283 - DNA, 2612 bp, Aquilegia formosa
atgagcaatcaagctgaatcatccgattcgaaaggaacgaagagagatttcagtactgctatattagaacgtaagaaagctgctaaccgtcttgttgttgatgaagcaatcaatgatgacaattctgttgtttcaatgcatcctgatactatggagaagcttcagctttttcgtggtgatacaatccttatcaagggaaagaaaagaaaggatacaatctgcattgctcttgctgatgatacctgtgacgagcctaaaattaggatgaacaaggttgtgaggtccaatctcagggttaggcttggtgatgttgtttctgtgcatcaatgtcctgatgttaaatatggcaagcgtgtacacattcttcctgttgatgataccattgaaggtgttactgggaacctgtttgacgcctatttgaaaccttatttcttggaggcttatcgcccggtaagaaaaggtgatctcttccttgttagaggtgggatgagaagtgtagaatttaaggtcatagagaccgaccctttggaatactgtgtagttgctccagacacagagatcttttgtgaaggtgagccagttaaaagggaggacgaagatagattagatgaagtgggatatgatgatgttggtggtgtgagaaaacagatggctcagatcagggagttggtggagctacctcttaggcatcctcagctttttaaatcaattggtgttaagccaccaaagggaattttactttatggacctccaggttctgggaagacattgattgccagagcggttgcaaatgagactggcgccttctttttctgtattaatggtcctgaaattatgtccaagttggcaggagaaagtgagagtaatctgagaaaggcatttgaggaagccgagaagaatgcaccatcaataattttcattgatgaaatagattcgatcgcaccaaaaagagaaaaaacaaatggagaagttgagaggcgaattgtatctcagctattaactctaatggacggattaaagtcccgtgcacatgttattgttatgggtgcgacaaatcggccaaatagcatagatcctgctttgaggaggtttggaaggttcgatagggaaattgatattggtgttcccgatgagattggacgtctagaggtccttcgcatccatacaaagaacatgaagctctctgatgatgttgatttagagagaatttcaaaggatacccatgggtatgttggtgctgatcttgctgctctatgcactgaagctgcacttcagtgcatcagagaaaagatggatgttattgacttggaagacgagtctatagatgctgagatacttaactccatggctgttacaaatgaacatttcaaaactgcccttgggacaagcaatccatctgctttgcgtgaaacagttgttgaggtacccaatgtcaactgggaagacatcggtgggcttgaaaatgttaagagggaactccaagagactgtacaatatccagtggagcatcctgaaaagttcgagaagtttggtatgtcgccttcgaaaggagttcttttctacggaccccctggttgtggtaaaacccttttggctaaggctattgcaaatgaatgccaagctaattttattagtatcaagggtcctgagctacttactatgtggtttggagagagcgaggctaatgtcagagaaatttttgacaaagctcgtggatctgcaccctgtgttcttttctttgatgaacttgattccattgctactcagagaggaagcagtgttggtgatgcaggtggtgctgctgatagagttctgaaccagcttcttactgaaatggatggaatgtctgcaaagaaaactgtattcataattggtgctaccaacaggccagacattattgatcctgctttacttagacctggtcgtcttgatcagctgatatatatcccattgccagacgaggcatctcgctattcaattttcaaggctgccctcaggaagtctcctgtatctaaagatgtggacctgaatgccctggccaagtatactcaaggctttagtggagctgatatcacagagatatgccagcgcgcttgcaagtatgccattagggagaacattgaaaaggatattgaaagggagaagaggagaagcgagaatccggaggcaatggaagaggatgtcgaggacgaagtggctgaaatcaaggctgcccactttgaggagtccatgaaatatgctcgtaggagtgttagtgatgctgacattcgcaaatatcaggcctttgcacagactttgcaacaatctaggggctttggaagcgagtttaggtttgcagatacagcaggagcagggaccactacttctgacccatttgcagctgctgcaggagcggatgatgatgacctgtatagttgataatcctgtttgttaacattatctgtaatttatgattcctttaatcatggaagcaagacaacaaccgagccttaagctttatgtgcttggcttgggacatcccaaggaagataaactgcttttatagacttaaaattgtttattttgcaatacattagggatactcgtcaggatcctgcctccctcttgactta

SEQ ID NO: 7284 - DNA, 2714 bp, Catharanthus roseus
ttcaatcgattcattcacctctctctctttctctgcctgtcatgagtaaccaagctgaatcctccgattcgaaggggactaagagggattttagtaccgcgattttggagaggaagaagtctcccaaccgtctcgtagtcgatgaagctatcaacgatgataactccgtggttgctctgcacccggacactatggaaaagcttcagctattccgcggcgatactatcttgattaagggaaagaagcgaaaggatacaatttgcatagcgcttgctgatgatacttgtgatgaaccaaagattaggatgaacaaggtggtcaggtcaaacttgagggttaggcttggggatgttgtttctgttcatcaatgtcctgacgtcaagtatgggaaacgtgttcacatcctccctattgatgacacgattgaaggagttactggaaatctttttgatgcttatttgaaaccttatttcttggaagcttaccgaccagtcagaaagggtgacctcttccttgtaaggggaggaatgagaagtgtagaattcaaggttatagaaactgaccctcctgagtattgtgttgtcgcccctgatactgagatcttttgtgagggagagcctgttcgaagggaagatgaagagcgcttggatgaggttggttatgatgatgttggaggagtccgtaagcagatggctcagattcgtgagctggtggaattgcccttaagacatcctcagctctttaaatcaattggtgttaagcctccaaaaggaattttgctctatgggcctccagggtctggaaaaaccttgatagcccgtgctgtggctaatgaaaccggtgcctttttcttctgtatcaatggaccagaaattatgtcaaaactggcaggagagagtgaaagcaatctcagaaaagcatttgaagaagcagagaagaatgctccatctatcatattcattgatgagattgactccattgctcccaagcgagagaagacacatggagaagttgagagaagaattgtttcccagctcttgacacttatggatgggttgaagtctcgtgcccatgttattgttattggtgcaacaaaccgtcccaatagcattgatccagcattgagaaggtttggaagatttgatagggaaatagacattggtgtaccagatgaggtcgggcgtcttgaggttcttcgtatccacacaaagaacatgaagctcgctgaagatgttgatctggagagaatttccaaggacacccatggttatgttggtgctgacttagcagctctgtgcactgaggctgccctacaatgtatcagggagaagatggatgtgattgacttggaagatgattctattgatgctgagattcttaactccatggctgtcaccaatgagcatttccagactgctcttggaacaagcaacccatctgccctgcgtgaaactgtggttgaagtgccaaatgtcagctgggaggatattggtggcctggagaatgtcaaaagagagcttcaggagacggttcaatatccagtggagcatcctgagaagtttgagaagtttggcatgtcaccttctaagggagttcttttctatggtccgcctggttgtggtaaaactctgctggccaaggctattgccaatgagtgccaagcaaacttcatcagtgtgaagggtcctgaattgcttaccatgtggtttggtgagagtgaggccaatgtcagagaaatatttgacaaggcgcgacaatctgctccttgtgttctcttctttgatgagttagattcaatagctactcagagaggaagcagcgttggagatgctggaggtgctgctgatagagttttgaatcagcttctcacagaaatggatgggatgaatgcaaagaaaactgtttttatcattggtgctaccaacaggccagacattattgatcctgcacttttgaggcctggtcgtctcgatcaactaatatatatccctcttcctgatgaggattctcgacaccagatattcaaggcatgcttgaggaaatctcctgtctctaaagatgtagacttgagagcccttgccaagtatacacaaggcttcagtggtgctgatattacagagatatgccaacgcgcatgcaaatatgcaattagagagaacattgaaaaagatattgagagggagaggaggagaagagacaatccagaggctatggaagaggatgtggaggatgaggtagctgagatcaaggctgctcattttgaggaatcaatgaaatttgccaggaggagtgttagtgatgctgatattcgcaaatatcaggcttttgctcagacattgcagcaatctagaggattcggtgctgacttccgattttctgagacaagagctgcgactactggatctgacccttttacaacttctgctggtggagcggatgaagatgacctgtatagttaggttgtccatctgtgctctctctttaatgttgaattgttaaagtttcttttgtgtatgttaattgactgtccccttatagaatgtggttcatgctggatgattattaagctgaaacacctctttggttggttggttggcttcttgaagagaggatttgttatgcctttaactcaggtcccaaaaagtgttttgcttttggaaaggctataatgaatattcagaccatccttatgttaatgcacttgtatgtgtttc

SEQ ID NO: 7285 - DNA, 2742 bp, Silene vulgaris
ttcacatctacttctcttccaataacttattatctcaattaattattccttagatttcttactcatcaagcaacaatggcggaccatgctgaatcctcagattcgaagggtactaagaaagactttagtactgcgattctagagcgtaagaaggcggcgaatcgccttgttgttgatgaggctgttaatgacgataattctgtagtttcaatgcaccctgataccatggaaaagcttcagattttccgtggtgataccatcttgcttaagggaaagaaaaggaaagatacaatctgcatcgcccttgctgatgagacctgtgaagaacctaaaattaggatgaacaaagttgtaaggtctaatttaagggttagacttggcgatgttgtatctgtacaccagtgtcctgatgtcaaatatggaaagcgtgttcacattcttcctattgatgatacaatcgagggggtgactggaaatttgtttgatgcctacttgaaaccgtacttcctagaggcttaccgtcctgtacgaaaaggtgacttcttccttgttagagggggtatgaggagtgttgagttcaaagtcattgagaccgaccctgccgagtattgtgtggttgcccctgacacagagatcttttgtgagggggaacccgtgaaaagggaagatgaaaacagattagatgaggtcggttacgatgatgttggtggagttcgtaagcagatggcccaaattagggagttggttgaactgcctcttagacacccacaactatttaagtcaattggtgtgaaaccaccaaagggtatcttgctttacgggcctccgggttctggtaagactttaatagcccgtgccgttgctaatgaaactggggctttcttcttctgtattaatgggcctgagatcatgtcgaaattggctggagaaagtgaaagcaatctgagaaaagcatttgaggaggctgaaaagaatgctccctccattatctttattgatgaaattgattcaattgctcctaaaagagaaaagaccaatggagaggtcgagagacgaattgtttcacagttacttactcttatggatggacttaagtcacgggctcatgttattgtcatgggggctactaatcgtcctaatagcattgaccctgcattgagaaggtttggtaggtttgacagggaaatagatattggtgtgcctgatgaggttggacgacttgaagttctccggattcacacaaagaacatgaagcttgctgaagatgtggatctggaaaaaatctccaaggaaacacatggttacgttggtgccgacttggctgctctatgcactgaagctgctcttcaatgtattagagagaagatggatgtaattgatctggaggatgacacaattgatgcagagattctcaattcaatggctgttacaaatgaacactaccagactgctcttggacagagcaacccatctgctttgcgtgaaacagtggttgaagttcctaatgttagttgggaagatattggtggccttgaaaatgtcaaaagagagctccaagagactgttcaatatccagtggagcatccagagaaatttgaaaagtttggaatgtcaccttctaagggtgtcctgttttacggtcctcctggttgtggaaagactttgctagccaaggctattgcaaatgaatgtcaggccaacttcatcagtgtgaaaggtcctgaattgctgaccatgtggttcggggagagtgaggctaatgttcgcgagatttttgacaaggcccggcaagcggctccttgtgttctgttctttgacgagcttgattcaattgccacacagagaggaggaggtggtggagatgctgggggtgctgctgacagagttctgaaccagcttttgaccgagatggatggcatgtctgccaaaaagacagttttcattatcggggccactaacaggcctgatattatcgattcagctcttctgcgaccgggtcgtcttgaccagcttatttatatccctcttccagatgatgagtcccgcctccaaattttcaaggcagccttgaggaaatcccctattgctaaggatgttgatattaatgcccttgcgaagtatactcagggctttagtggtgcggatatcacggagatctgccagcgtgcttgcaagtacgccattcgtgaaaacattgaaaaggatattgaaaaggagagaaggagaaacgagaatcccgaggcaatggaggaggacctcgacgacgaagtgtccgaaattaaggcagcccacttcgaagagtcaatgaagtatgctcgcaggagtgtgagcgatgccgatatccgcaaataccaggcatttgctcagactttgcagcagtctcgagggtttgggtctgagttccgtttcaacacaagcacaactaccccttcagcaactgatgcgtttgccgcctctgctggtgccgctgatgaagacgacctctacaattaaactccgtcagctatgtttcccattttgcattgtactataaattatgaaaaggtctttcaggcagatttagacttgttgaatcctttgatacagttcaaaggtttttattctatgttattgttgaatttatagaccgtctttcctggcaaataccactacttgaaactagtgaagctattttcttccattatttccacatgcatccttcaagttacttgtaccattcagatccaaactttcattgaatta

SEQ ID NO: 7286 - DNA, 2636 bp, Vinca minor
tcgattcaaaatcacttctctctgagcctaccatgagtaatcaagctgaatcctccgattcgaaggggactaagagggatttcagtactgcaattttggaaaggaagaaatcgcctaatcgtctcgtagtagatgaagctatcaacgatgataactccgttgttgctcttcaccctgatactatggaaaaactacagcttttccgcggtgacactattttgattaagggaaagaaaaggaaggatacaatttgcatagcccttgccgatgaaacttgtgatgaaccaaagattaggatgaacaaggtgatcaggtcaaacctgagggttaggcttggagacgttgtttccgttcatcaatgtcctgatgtgaaatatgggaagcgtgttcacatcctccctgttgatgacactgttgaaggagttactggaaatttgtttgatgcttatttaaaaccttatttcttggaagcataccgaccggtcagaaaaggtgacctcttccttgtaaggggaggaatgaggagtgtagaatttaaggttatagaaactgaacctgctgagtattgtgttgttgcccccgatactgagatcttttgtgagggagagccagttcgaagggaagatgaagagcgcttggatgaggttggttatgatgatgttggaggagttcgtaagcagatggctcagattcgtgagcttgtggaattgcctttgagacatcctcagctcttcaaatcgattggtgttaagcctccaaaaggaattctgctttatgggcctccagggtctggaaaaaccttgatagccagagctgtggccaatgaaactggtgccttcttcttctgtatcaatggaccagaaattatgtcaaaactggcaggagagagtgaaagcaatctcagaaaagcatttgaggaagctgagaagaatgctccatctatcatatttattgatgagctcgactccattgctcctaagcgagagaagacacatggagaagttgaacgaagaattgtttctcagctcttgacgcttatggatgggctgaaatctcgtgcccatgttattgttatgggtgctacaaaccgccccaatagcattgatccagcactgagaaggtttggaagatttgatagggaaatagacattggtgtaccagatgaagttgggcgtcttgaggttcttcgtatccacacaaagaacatgaagctttccgaagatgttgatctggagagaatttctaaggacacccatgggtatgttggtgccgacttggcagcattgtgtaccgaggctgctctacaatgtatcagggagaagatggatgtgatcgacttggaagatgattctattgatgcagagatcctcaactccatggctgtcaccaatgagcatttctcgactgctcttgggacaagcaatccttctgccctgcgtgaaactgtggttgaagtgccaaatgtttcttgggaggatattggaggcctggggaacgtcaaaagagaacttcaagagacggttcaatatccagtggagcatcccgagaagttcgagaagtttggcatgtcaccctcaaagggtgttcttttctatggtccacctggttgtggtaaaactttgctggccaaggctattgccaacgagtgccaagcaaactttatcagtgtcaagggtcctgaattgcttacaatgtggtttggagagagcgaggccaatgtcagagaaatatttgacaaggcccgccaatctgctccttgtgttctcttcttcgatgaattagattcaattgcgactcagagaggaagcagtgtcggagatgctggaggtgctgctgatagagttctgaatcagcttctcacagaaatggacggaatgaacgcaaagaaaactgttttcatcattggagccaccaatagacctgacattattgatcctgcgcttttaaggcctggccgtcttgatcaactaatttatatccctcttcctgatgaggattctcgacaccagatattcaaggcatgcctgaggaaatctcccatctcaaaggatgtagacttgagagcccttgccaaatatacgcaaggcttcagcggtgctgatatcacagagatatgccaacgtgcatgcaaatatgctattagagagaacattgagaaagatatcgagagggagaggaggagaaaggacaaccctgaggccatggaggaggatgttgaggacgaagtggctgagatcaaggctgctcactttgaggaatccatgaagtatgccaggaggagtgttagcgatgctgatatccgcaaatatcaagctttcgcccagacattgcagcaatctaggggctttggtactgaattccgattttcagagaccagtgccggtggtggggctacaggatctgacccatttgcagctcctgctggtggagctgatgaagatgacctttatagttaggtcatctatttgtgcctctatcctttaaaatattataatgctttgtacgttgttgaccgtcccttgtacaatgaggctcgagggctcatgttggatggattataaaaagctgaacaacctcctggttggcgcggtgaacacttgtatttcccaaccaagtcctcaagtcgaatatgcctt

SEQ ID NO: 7287 - DNA, 2709 bp, Castanea mollissima
tctcttcgcttcgctttgctttctccgatcctaaacccaatggcgcaccagggcgaatcgtccgacccgaaattggggaagaaggacttctcgacggcgattctggagaggaagaagtcgccgaatcggcttgtcgttgacgaggcggtcaacgacgacaactccgttgtcgctttgcaccctgacaccatggaaaagctccagcttttccgtggcgacacgattcttatcaagggcaagaaacgaaaggatacagtctgcattgctcttgctgatgaaacttgtgaggagccaaagattaggatgaacaaggttgttagatcaaatctgagggttcggcttggggatgttgtatctgtacaccagtgccctgatgttaagtatgggaagcgtgtccacatactgcctgttgatgatactatagaaggtgttactggcaatctatttgacgcatacttgaaaccttatttcttggaggcttatcgccctgtaaggaagggagatctattccttgtcagaggagggatgagaagtgtagagttcaaggttattgaaactgacccaggggagtattgtgtggttgccccagacacagaaatcttctgtgagggtgaacctgtcagaagggaggatgaggataggttggatgaagttggttatgatgatgtgggtggtgttagaaagcagatggctcagattcgtgagttagtggagctgcctctaaggcaccctcagctttttaaatcaattggtgtgaaaccacctaagggcattttgctttatgggcccccaggttctggaaagacattgatagctagagctgtggctaatgaaactggagctttctttttctgtattaatgggccagagattatgtccaaattggctggggagagtgaaagtaatctccggaaggcatttgaagaagctgaaaagaatgctccatccatcatttttattgatgagctcgattctattgctcctaagagggagaagactcatggtgaagttgaaaggaggattgtttcacagcttttgactcttatggatgggctgaaatctcgggcccatgtcattgtcatgggggctacgaatcgtccaaacagcattgacccagctttgagaagatttggtcgttttgatagggaaatagacattggtgttccagatgagattgggcgccttgaagttcttcgcatccataccaagaacatgaagctctctgaagaggttgatttggaaagaatttcaaaagatacccatggttatgttggtgctgatcttgctgctctctgcactgaggctgcactgcaatgcattagggagaagatggatgtgattgacttggaagatgattctattgatgctgagatacttagttccatggctgttaccaatgagcacttccagactgctcttggaaccagcaacccatctgctttacgtgaaactgttgttgaagtgcccaatgtcggctgggaagacattggaggccttgagaatgttaagcgggaacttcaagagactgtacagtatcctgtggagcacccagagaagtttgagaaattcggaatgtcaccttcaaaaggggtccttttctatggtccccctggatgtgggaagactctattggccaaggcaattgcaaatgaatgtcaagcgaacttcatcagtgtcaagggccctgagctgcttacaatgtggtttggtgagagtgaagccaatgttcgagaaatttttgacaaggctcgacaatctgccccatgtgtccttttctttgatgagcttgactccattgctacccagagaggaagcagtgttggggatgcaggtggtgctgctgatcgggttctgaaccagcttcttactgaaatggatggcatgtctgcaaagaagaccgtgttcataattggggctaccaacagacctgacataattgacccagcacttctgaggcccggtcgtcttgatcaattgatttatattcctctccctgatgaggagtcacgttttcaaatctttaaatcctgcttgagaaaatcacctgtctcaaaagatgtcgatttgagagcactggccaaatatactcaaggcttcagtggagctgacatcacagaaatttgccagcgagcatgcaagtatgctataagagagaacatagaaaaggacatagagaaggagaggaggagaagcgagaatcctgaggctatggacgaggacgaaaacgatgaagtggcagagattagggctgctcattttgaggagtccatgaagtttgcccgtaggagtgttagtgatgctgatatacgcaaataccaggcatttgctcagaccttgcagcagtctaggggttttggaagtgaatttaggttctctgagacacgtgctggggccaccactggatctgatccatttgcaacttctgctggtggtgctgctgatgaagatgatttgtatagttaggttttatatttatcaaatcttcagtgacacgtctgttgaacttaatgtatgcctttttgggtcacaatggggcagggcttttgtgtccgccattactgcttttgccattcggtacttaccaggcctgggttactgggttaaacttaaacatcctgttttcagttctcaaactttgttatttatggtatgaaaacttaaagtgatgaattggaaaacaaaagaaatctatgggcctaattggctacg

SEQ ID NO: 7288 - DNA, 2886 bp, Ricinus communis
gatcccaatttcatcgaaacattttcttttgctgtttttcaatttctttctatctctcgaccatgtctaaccaagccgaatcatctgactccaaagggacaaaaagggattttagtactgcgattttagagcgaaagaagtcaccaaatcggcttgttgttgatgaagctattaatgatgataactccgttgtttctcttcatcctgaaactatggagaagctccagctctttcgtggtgacacgatcttgattaagggaaagaaaaggaaggatactatctgcattgctcttgctgatgactcttgtgacgagccaaagatcaggatgaacaaggttgtgaggtcaaacctgagagttaggcttggagatgttgtctctgttcaccagtgtcctgatgtcaaatatggaaagcgtgtgcacatactccctattgatgatacaattgaaggagtcactggaaatctatttgatgcatacttgaaaccttatttcctggaggcatatcgcccagtcaggaagggtgatctcttccttgtgaggggaggaatgagaagtgtggaattcaaagttattgagactgaccctgcggagtactgtgtggtcgcccctgacactgagattttctgtgagggtgagcctgtgaggagagaagatgagaatagattggatgaagttggctatgatgatgttggtggtgttagaaaacagatggctcagattagggagctggtggagcttccactaagacatccacagctattcaaatcaattggtgttaagccaccaaaaggaattttgctatatgggcctcctggttctgggaagactcttattgcccgggctgttgccaatgaaactggtgctttcttcttctgtattaatggacctgagatcatgtcaaaattggctggggagagtgaaagcaaccttcgaaaagctttcgaggaagcagagaaaaatgcaccatctatcatttttattgatgagattgattcaattgcccccaagagggagaagacacatggagaggtggagaggaggatagtctcacagcttttaacacttatggatggacttaaatctcgtgcgcatgttattgtcattggggccacaaatcgccccaacagcattgaccctgctttgagaaggtttggcagatttgatagggaaattgatattggtgtaccagacgaagttgggcgacttgaagttctcagaatccatacgaagaacatgaagcttgcagaagatgttgatttggaaagaatttccaaagacacgcatggttatgttggtgctgatttggcagctctgtgcactgaggctgcacttcaatgcatcagggagaagatggatgtgatcgacttagaagatgaaacaatagatgctgagatacttaactctatggcagtgagtaatgaacacttccaaactgcacttggaacaagtaacccatctgctctgcgcgaaacagttgttgaagtgcctaatgtgagttgggaagatattggaggccttgagaatgttaagagggagcttcaagagactgttcaatatccagtggagcaccctgagaaattcgagaaattcggaatgtcaccttctaagggagttcttttctatggccctcctggatgtgggaaaactcttctggctaaagctattgccaacgagtgccaggcaaatttcatcagtgtgaagggtcctgaattgctgacaatgtggttcggtgagagtgaagccaacgtccgagaaatttttgacaaggctcggcaatctgctccttgtgttctcttctttgatgaacttgactcaattgctactcagagaggaagcagtgtgggagatgctggcggtgctgctgatagggttttgaaccagcttcttacagagatggatggcatgtctgcaaagaaaactgtttttataatcggggccactaatagacctgatatcatagaccctgcacttttgcgtcctggccgtcttgatcagttgatttacatccctcttcctgatgaggactcgcgacaccaaattttcaaggcttgcttaaggaaatcaccagtctccaaagatgttgacctcagagcacttgccaagtatactcagggcttcagtggtgctgatatcactgaaatatgccagcgcgcatgcaaatatgctataagagagaatattgaaaaggacattgaaagggagaggaggcgaagggataatccagaagctatggaggaagatgttgaggatgatgtggcagagatcaaggcggcacacttcgaggagtccatgaagtatgcccgcaggagtgtgagtgatgcagacattcgcaaataccaggcatttgctcagactttgcaacaatcaagaggctttggatcagaattcaggttttctgaagctactggtgcagctgctggagctgatccatttgcagcttcggcaggtggggaggcggatgatgacgatctatacagttagacaattagtttcaaacacgtgcatttgttatttatgttggccctgtatgtgtatttcttaacttccatacatgtagttttaagaatgcatggcaattttatttctgccgaagttagcctttccaccagtactacgtggtacatgggttgtgtttgctggtctactatttgcttgtcttgggtgttttcccttttaaatttggatcaaattagccctgataggtattttcaaagtactggtaaaaagggatgtgagaagtggaagcatgggattgggaggtcttctatgaagtagatcaatttgttttgtggtggagcaaacaactaaggaccaaattctttattctacaaataaggtatggattatattataaagctaaagttcaataccaatggtacttttg

SEQ ID NO: 7289 - DNA, 3087 bp, Ricinus communis
ttttttttttttttttttgattcagaagaacatgttataatgaaaagtaaatagaggatttaaagtaaaaaagaatcaaaatttcctttttctaaaaaaaaaagtggagaattaaaacatttctttacaaacaagaaaagaagaaaaatcagcttttgcctctcatttaaataccccaaaactgcttcagtaacttcagatcccaatttcatcgaaacattttcttttgctgtttttcaatttctttctatctctcgaccatgtctaaccaagccgaatcatctgactccaaagggacaaaaagggattttagtactgcgattttagagcgaaagaagtcaccaaatcggcttgttgttgatgaagctattaatgatgataactccgttgtttctcttcatcctgaaactatggagaagctccagctctttcgtggtgacacgatcttgattaagggaaagaaaaggaaggatactatctgcattgctcttgctgatgactcttgtgacgagccaaagatcaggatgaacaaggttgtgaggtcaaacctgagagttaggcttggagatgttgtctctgttcaccagtgtcctgatgtcaaatatggaaagcgtgtgcacatactccctattgatgatacaattgaaggagtcactggaaatctatttgatgcatacttgaaaccttatttcctggaggcatatcgcccagtcaggaagggtgatctcttccttgtgaggggaggaatgagaagtgtggaattcaaagttattgagactgaccctgcggagtactgtgtggtcgcccctgacactgagattttctgtgagggtgagcctgtgaggagagaagatgagaatagattggatgaagttggctatgatgatgttggtggtgttagaaaacagatggctcagattagggagctggtggagcttccactaagacatccacagctattcaaatcaattggtgttaagccaccaaaaggaattttgctatatgggcctcctggttctgggaagactcttattgcccgggctgttgccaatgaaactggtgctttcttcttctgtattaatggacctgagatcatgtcaaaattggctggggagagtgaaagcaaccttcgaaaagctttcgaggaagcagagaaaaatgcaccatctatcatttttattgatgagattgattcaattgcccccaagagggagaagacacatggagaggtggagaggaggatagtctcacagcttttaacacttatggatggacttaaatctcgtgcgcatgttattgtcattggggccacaaatcgccccaacagcattgaccctgctttgagaaggtttggcagatttgatagggaaattgatattggtgtaccagacgaagttgggcgacttgaagttctcagaatccatacgaagaacatgaagcttgcagaagatgttgatttggaaagaatttccaaagacacgcatggttatgttggtgctgatttggcagctctgtgcactgaggctgcacttcaatgcatcagggagaagatggatgtgatcgacttagaagatgaaacaatagatgctgagatacttaactctatggcagtgagtaatgaacacttccaaactgcacttggaacaagtaacccatctgctctgcgcgaaacagttgttgaagtgcctaatgtgagttgggaagatattggaggccttgagaatgttaagagggagcttcaagagactgttcaatatccagtggagcaccctgagaaattcgagaaattcggaatgtcaccttctaagggagttcttttctatggccctcctggatgtgggaaaactcttctggctaaagctattgccaacgagtgccaggcaaatttcatcagtgtgaagggtcctgaattgctgacaatgtggttcggtgagagtgaagccaacgtccgagaaatttttgacaaggctcggcaatctgctccttgtgttctcttctttgatgaacttgactcaattgctactcagagaggaagcagtgtgggagatgctggcggtgctgctgatagggttttgaaccagcttcttacagagatggatggcatgtctgcaaagaaaactgtttttataatcggggccactaatagacctgatatcatagaccctgcacttttgcgtcctggccgtcttgatcagttgatttacatccctcttcctgatgaggactcgcgacaccaaattttcaaggcttgcttaaggaaatcaccagtctccaaagatgttgacctcagagcacttgccaagtatactcagggcttcagtggtgctgatatcactgaaatatgccagcgcgcatgcaaatatgctataagagagaatattgaaaaggacattgaaagggagaggaggcgaagggataatccagaagctatggaggaagatgttgaggatgatgtggcagagatcaaggcggcacacttcgaggagtccatgaagtatgcccgcaggagtgtgagtgatgcagacattcgcaaataccaggcatttgctcagactttgcaacaatcaagaggctttggatcagaattcaggttttctgaagctactggtgcagctgctggagctgatccatttgcagcttcggcaggtggggaggcggatgatgacgatctatacagttagacaattagtttcaaacacgtgcatttgttatttatgttggccctgtatgtgtatttcttaacttccatacatgtagttttaagaatgcatggcaattttatttctgccgaagttagcctttccaccagtactacgtggtacatgggttgtgtttgctggtctactatttgcttgtcttgggtgttttcccttttaaatttggatcaaattagccctgataggtattttcaaagtactggtaaaaagggatgtgagaagtggaagcatgggattgggaggtcttctatgaagtagatcaatttgttttgtggtggagcaaacaactaaggaccaaattctttattctacaaataaggtatggattatattataaagctaaagttcaataccaatggtacttttgtaa

SEQ ID NO: 7290 - DNA, 2812 bp, Ricinus communis
tttctttccgaacaagaaaagaaggaaaattagctttgcctctcatataaagacccagaaactgcttcaataatttcagatcccaatttaatcgaaacattttcttttgctgtttatcaaattctctctatctctcgaccatgtctaaccaacccgaatcatccgactcgaagggaacaaaaagggattttagtactgcgattttagagcgaaagaagtcaccaaatcggcttgttgttgatgaagctattaatgatgataactctgttgtttctcttcatcctgaaactatggagaagctccagctctttcgtggtgacacgatcttgattaagggaaagaaaaggaaggatactatctgcattgcccttgccgatggctcttgtgacgagccaaagatcaggatgaacaaggttgtgaggtcaaacctgagagttaggcttggagatgttgtctctgtgcaccaatgtcctgatgtcaaatatggaaagcgtgtgcacatactccctattgatgacacaattgaaggagtcactggaaatctgttcgatgcatacttgaaaccttatttcctcgaggcgtatcgcccagtcaggaagggtgatctcttcctcgtgaggggaggaatgagaagcgtggaattcaaggttattgagaccgaccctgcagagtactgtgtggtcgcccctgacactgagattttctgtgagggtgagcctgtgaggagagaagatgagaatagattagatgaagttggctatgatgatgttggtggtgttagaaaacagatggctcagattagggagctggtggagcttccactgaggcatccacagctattcaaatcaattggtgttaagccaccaaaaggaattttgctttatggacctcctggttctgggaagactcttattgcccgggctgttgccaatgaaactggtgctttcttcttctgtattaatggacctgagatcatgtcaaaattggctggggagagtgaaagcaatcttagaaaagcttttgaggaagcagagaaaaatgcaccatccatcatttttattgatgagattgattcaattgctcccaagagagagaagacacatggagaggtggagaggaggatagtctcccagctattaacacttatggatggacttaaatcccgtgcgcatgttattgtcattggggccacaaatcgccccaacagcattgaccctgctttgagaaggtttggcagatttgatagggaaattgacattggtgtaccagacgaagttgggcgacttgaagttctcagaatccatacgaagaacatgaagcttgcagaagatgttgatttggaaagaatttccaaagacacacatggttatgttggtgctgatttggcagctctgtgcactgaggctgcacttcaatgcatcagggagaagatggatgtgatcgacttagaagatgaatcaatagatgctgagatacttaactctatggcagtgagtaatgaacacttccaaactgcacttggaacaagtaacccatctgctctgcgcgaaacagttgttgaagtgcccaatgtgagttgggaagatattggaggccttgagaatgttaagagggagcttcaagagactgttcaatatccagtggagcaccctgagaaattcgagaaattcggaatgtcaccctctaagggagttcttttctatggccctcctggatgtgggaaaactcttctggctaaagctattgccaatgagtgccaggcaaatttcatcagtgtgaagggtcctgaattgcttacaatgtggttcggtgagagtgaagccaacgtccgagaaatttttgacaaggctcgacaatctgctccttgtgttctcttctttgatgaacttgactcaattgccactcagagagggagcagtgtaggagacgctgggggtgctgctgatagggttttgaaccagcttttgacagaaatggacggcatgtctgcaaaaaaaactgttttcataatcggtgccactaatagacctgatatcatagatcctgcactcctgcgtcctggccgtctggatcagttgatttacatccctcttcctgatgaggattcacgccaccaaattttcaaggcttgcttgaggaaatcaccagtctccaaagatgttgacctcagagcacttgccaagtacactcagggctttagtggtgctgatatcactgaaatatgccagcgtgcttgcaagtatgctataagagagaacattgaaaaggacattgagagggagaggaggcaaagggataatccagaagctatggaagaagatgttgaggatgatgtggcagagatcaaggcagcacatttcgaggagtcgatgaagtatgcccgcaggagtgtgagtgatgcggacattcgcaaataccaggcatttgctcagactttgcaacaatcaagaggctttggatcagaattcaggttttctgaatctactggcggagctgctggagctgatccttttgcagcttcggcaggtggggctgatgacgacgatctatacaattagacagttattttcaaacacgtgcatatgtcatttatgttggccctgtatgtgtatttttttacatccatacatgtagttttaagaatgcatggttaattttatttctgcccaagttagtcttgggtttttgcctgtggaagacactggctatccttaaaagttgatagaacagattcagctattggttagtatggatgacctttgaaattcagaacattcctctttttaaagtagtgtggatttttataactgca

SEQ ID NO: 7291 - DNA, 2725 bp, Solanum lycopersicum
gttttcccaattcgctgtaacttcggccgattttttctctcttataaatattacgcaaacaaatcaaaactcttcaatttctgcaaaatcatgactaacaaagctgaatcttccgattctaaagggacaaagagggattttagtacagcgattttggagaggaagaagtcgccgaatcgacttgtggtggatgaagcaaccaatgatgataactctgttgttgctattcatcctgatactatggagaagcttcagctttttcgtggtgacactatattgatcaagggtaagaagagaaaagatacaatctgcatcgcccttgctgatgacacctgtgacgtgccaaagattaggatgaacaaggttgtcagaaataacctgagggttcgacttggtgatgttgtctctgtgcatcagtgtcctgatgtcaaatatggcaaacgcgtacacattcttcccattgatgacaccattgaaggagtcactgggaacctttttgatgcttacttgaagccctattttcttgaagcatacagaccagttaggaagggtgatctttttctggtaaggggaggcatgagaagtgttgagttcaaggttatcgagactgatcccgctgaatactgtgttgttgcccctgatactgaaatattttgtgagggtgaacctgtgattagggaagatgagaatagactagatgaggttggttatgacgatgttggtggtgtgcgtaaacaaatggctcagataagggagcttgttgagctgccactaaggcacccacaactcttcaaatctattggtgtcaagcctcccaaaggaattttgttgtatggacctcctggatcaggaaagactttaatagcccgagctgttgcaaatgagactggtgcgttctttttctgcattaatggtccagagatcatgtctaagttggcgggagaaagtgaaagtaatctcagaaaagcatttgaagaagctgagaagaatgcaccatcaattattttcatcgacgaaattgattcaattgctcctaaacgtgagaagacaaatggagaggtggagcggaggattgtctcccagcttttgacacttatggatggacttaagtcacgtgcccatgtaattgttatgggtgccactaatcgccccaatagcattgaccctgccttaagaaggtttggtagatttgacagggaaatagacattggtgttccggatgaagtggggcgtcttgaggtgcttcgtatccatacaaagaacatgaagcttgctgaagaagttgatttagaaagaatttgcaaagacactcatggttatgttggagccgatttagcagctttgtgtaccgaggctgcacttcaatgcatcagagagaagatggacgtgatagatttggaggatgagaccattgatgcagagattcttaactcaatggctgtgacaaatgagcacttccaaactgctcttgggacgagcaatccttctgccttgcgtgaaaccgttgttgaagttcccaatgtttcatgggaggatattggaggacttgagaatgtcaagcgtgagctccaagagactgttcaatatccagtggagcatcctgagaaatttgagaagtttggtatgtctccctcgaagggagtccttttctatggcccacctggatgtggtaaaactttgctcgcaaaggccattgcaaatgaatgccaggctaacttcatcagtatcaagggtccagagctgcttaccatgtggtttggagagagtgaagccaacgttagagaaatatttgacaaggcccgccaatctgctccgtgtgtcctgttttttgatgaactagactcaatcgccacacagagaggaagtagttcgggagacgctgggggagctgctgacagagttctgaatcaactcctcactgaaatggatggcatgaacgctaagaaaactgtgttcattattggtgcaaccaataggccagacattattgatcctgcacttttgcgtcctggtcgtcttgaccaattgatttatattcctctccctgatgaagattctcgtcaccaaattttcaaggcatgcctaaggaaatcacctctttctaaggatatcgatctaagagctcttgcaaagtatacacagggctttagtggagctgacattacagagatctgtcaacgtgcttgcaaatacgccatcagagaaaacattgagaaagatatcgagagggagaaaaggagaagtgagaatcctgaagccatggaggaagacgttgaagacgaggtacctgagatcaaggctgctcactttgaggaatcaatgaagtacgccaggaggagtgtcagtgacgctgatatccgcaagtaccaagctttcgctcagacgttgcaacagtccagaggattcggttctgaattccgattttcggagacgagcactgcagggaccactgggactgctgctgacccctttgcaacttcagctggtggagcagatgaagatgacctgtatagttaaggttgtccaagtttttactttcatattttacatacatttgaaactctgtattaattcagtttaaaaacttgtgagtagcaaattgaaatctctcctttgctgctctcagttcataattttatgttttggatctttttgctcagtttaatttatatttggatcttccattatatttctttattttcttaatatgtgactttggtgccaa

SEQ ID NO: 7292 - DNA, 2697 bp, Solanum phureja
gttttctcaattccctgtaacttcggccgattttttttctcttataaatattactcaaacaaatcaaaactcttcggaaacaaatcaatttctgcaaaatcatgactaacaaagctgaatcttccgattctaaagggacaaagagggattttagtacagcgattttggagaggaagaagtcgccgaatcgacttgtggtggatgaagcaaccaatgatgacaactctgttgttgctattcatcctgatactatggagaagcttcagctttttcgtggtgacactatcttgatcaagggtaagaagagaaaagatacaatctgcattgcccttgctgatgacacctgtgacgtgccaaagattaggatgaacaaggttgtcagaaataacctaagggttcgacttggtgatgttgtctctgttcatcagtgtcctgatgtcaaatatggcaaacgcgtacacattcttcccattgatgacaccattgaaggagtcactgggaacctctttgatgcttacttgaagccctattttcttgaagcatacagaccagtgaggaagggtgatctttttctggtaaggggaggcatgagaagtgttgagttcaaggttatcgagactgatcctgctgaatactgtgtcgttgcccctgatactgaaatattttgtgagggtgaacctgtgattagggaagacgaggatagattagatgaggttggttatgacgatgttggtggtgtgcgtaaacaaatggctcagataagggagcttgttgagctgccactaaggcacccacaactcttcaaatctattggtgtcaagcctcctaaaggaattttgttgtatggacctcctggatcaggaaagactttaatagcccgagctgttgcaaatgagactggtgcattctttttctgcattaatggtccagagatcatgtctaaattggcgggagaaagtgaaagtaatctcaggaaagcatttgaagaagctgagaagaatgcaccatcaattattttcattgatgaaattgattcaatagctcctaaacgtgagaagacaaatggagaggtggagaggaggattgtctcccagcttttgacacttatggatggacttaagtcacgtgcccatgtaattgttatgggtgctactaatcgccccaacagcattgaccctgccttgagaaggtttggtagatttgaccgggaaatagacattggtgttccggatgaagtggggcgtcttgaggtgcttcgtatccatacaaagaacatgaagctcgctgaagaagttgatttagaaagaatttgcaaagacactcatggttatgttggagctgatttagcagctttgtgtaccgaggctgcactccaatgcatcagagagaagatggacgtgatagatttggaggatgagaccattgatgcagagattctgaactctatggctgtgacaaatgagcacttccaaactgctcttgggacgagcaatccttctgccttgcgtgaaaccgttgttgaagttcccaatgtttcatgggaggatattggaggactagagaatgttaagcgtgagctccaagagactgttcaatatccagtggaacatcctgagaaattcgagaagtttggtatgtctccctcaaagggagtccttttctatggcccacctggatgtggaaaaactttgctcgcaaaggccattgcaaatgaatgccaggctaacttcatcagtatcaagggtccagagctgcttaccatgtggtttggagagagtgaagccaacgttagagaaatatttgacaaggcccgccaatctgctccgtgtgtcctattttttgatgaactggactcgatcgccacacagagaggaagtagttcgggagacgctgggggagctgctgacagagttttgaatcaactccttactgaaatggatgggatgaacgctaagaagactgtgttcattattggtgcaaccaataggccagacattattgatcctgcacttctgcgtcctggtcgtcttgaccaattgatttatattcctctccctgatgaagattctcgtcaccaaattttcaaggcatgcctgaggaaatcaccgctttctaaggacatcgatctaagagcacttgcaaagtatacacagggcttcagtggagctgacattacagagatctgtcaacgtgcttgcaaatacgctatcagagaaaacattgagaaagatatcgaaagggagaaaaggagaagtgagaatcctgaagccatggaggaagacgttgaagacgaggtacctgagatcaaggctgctcattttgaggaatcaatgaagtatgctaggaggagtgtcagtgatgctgatatccgcaagtaccaggctttcgctcagacgttgcaacagtccagaggtttcggttctgaattccgattttccgagaccagcactgcagggacaactggaactgctgctgacccctttgcaacttcagctggtggagcagatgaagatgacctgtatagttaggttgtccaagttttacttacatattttacatacatttggaattctgtattaattcagtttaaaaacttgtgagtagcaaattgaaatctctcctttgctgctctcagtttataattcatgtttggatctttttgctcagtttataatttatatttggatcttccatagc

SEQ ID NO: 7293 - DNA, 2722 bp, Solanum lycopersicum
gttttcccaattcgctgtaacttcggccgattttttctctcttataaatattacgcaaacaaatcaaaactcttcaatttctgcaaaatcatgactaacaaagctgaatcttccgattctaaagggacaaagagggattttagtacagcgattttggagaggaagaagtcgccgaatcgacttgtggtggatgaagcaaccaatgatgataactctgttgttgctattcatcctgatactatggagaagcttcagctttttcgtggtgacactatattgatcaagggtaagaagagaaaagatacaatctgcatcgcccttgctgatgacacctgtgacgtgccaaagattaggatgaacaaggttgtcagaaataacctgagggttcgacttggtgatgttgtctctgtgcatcagtgtcctgatgtcaaatatggcaaacgcgtacacattcttcccattgatgacaccattgaaggagtcactgggaacctttttgatgcttacttgaagccctattttcttgaagcatacagaccagttaggaagggtgatctttttctggtaaggggaggcatgagaagtgttgagttcaaggttatcgagactgatcccgctgaatactgtgttgttgcccctgatactgaaatattttgtgagggtgaacctgtgattagggaagatgagaatagactagatgaggttggttatgacgatgttggtggtgtgcgtaaacaaatggctcagataagggagcttgttgagctgccactaaggcacccacaactcttcaaatctattggtgtcaagcctcccaaaggaattttgttgtatggacctcctggatcaggaaagactttaatagcccgagctgttgcaaatgagactggtgcgttctttttctgcattaatggtccagagatcatgtctaagttggcgggagaaagtgaaagtaatctcagaaaagcatttgaagaagctgagaagaatgcaccatcaattattttcatcgacgaaattgattcaattgctcctaaacgtgagaagacaaatggagaggtggagcggaggattgtctcccagcttttgacacttatggatggacttaagtcacgtgcccatgtaattgttatgggtgccactaatcgccccaatagcattgaccctgccttaagaaggtttggtagatttgacagggaaatagacattggtgttccggatgaagtggggcgtcttgaggtgcttcgtatccatacaaagaacatgaagcttgctgaagaagttgatttagaaagaatttgcaaagacactcatggttatgttggagccgatttagcagctttgtgtaccgaggctgcacttcaatgcatcagagagaagatggacgtgatagatttggaggatgagaccattgatgcagagattcttaactcaatggctgtgacaaatgagcacttccaaactgctcttgggacgagcaatccttctgccttgcgtgaaaccgttgttgaagttcccaatgtttcatgggaggatattggaggacttgagaatgtcaagcgtgagctccaagagactgttcaatatccagtggagcatcctgagaaatttgagaagtttggtatgtctccctcgaagggagtccttttctatggcccacctggatgtggtaaaactttgctcgcaaaggccattgcaaatgaatgccaggctaacttcatcagtatcaagggtccagagctgcttaccatgtggtttggagagagtgaagccaacgttagagaaatatttgacaaggcccgccaatctgctccgtgtgtcctgttttttgatgaactagactcaatcgccacacagagaggaagtagttcgggagacgctgggggagctgctgacagagttctgaatcaactcctcactgaaatggatggcatgaacgctaagaaaactgtgttcattattggtgcaaccaataggccagacattattgatcctgcacttttgcgtcctggtcgtcttgaccaattgatttatattcctctccctgatgaagattctcgtcaccaaattttcaaggcatgcctaaggaaatcacctctttctaaggatatcgatctaagagctcttgcaaagtatacacagggctttagtggagctgacattacagagatctgtcaacgtgcttgcaaatacgccatcagagaaaacattgagaaagatatcgagagggagaaaaggagaagtgagaatcctgaagccatggaggaagacgttgaagacgaggtacctgagatcaaggctgctcactttgaggaatcaatgaagtacgccaggaggagtgtcagtgacgctgatatccgcaagtaccaagctttcgctcagacgttgcaacagtccagaggattcggttctgaattccgattttcggagacgagcactgcagggaccactgggactgctgctgacccctttgcaacttcagctggtggagcagatgaagatgacctgtatagttaaggttgtcccaagtttttactttcatattttacatacatttgaaactctgtattaattcagtttaaaaacttgtgagtagcaaattgaaatctctcctttgctgctctcagttcataattttatgttttggatctttttgctcagtttaatttatatttggatcttccattatatttctttattttcttaatatgtgactttggtg

SEQ ID NO: 7294 - DNA, 2435 bp, Manihot esculenta
ctctccatctctcgaccatgtctaaccaagccgaatcctctgactctaagggaacgaagagggattttagtactgcgattttggagcgcaagaaggcgccgaatcggctcgttgttgatgaggctaccaatgatgataactcggttgtctcgctccaccccgacaccatggagaagctccagctttttcggggtgacacgatcttaattaagggtaagaaaaggaaagatacaatctgcattgcacttgctgatgacacatgtgatgagccaaagatcaggatgaataaggttgtgaggtcaaaccttagggttaggcttggagatgttgtctctgtgcaccaatgtcccgatgtcaaatatggaaagcgtgttcacatactgcctatagatgacacaattgaaggggtcactggaaatctctttgatgcatacttgaagccttacttcctggaggcatatcgcccagtcaggaagggtgatctcttccttgtgagagggggaatgagaagtgtcgagttcaaggttattgagacggaccctgcagagtactgtgtggttgccccagacactgagattttctgtgagggagagccagtaaggcgggaagatgaaaatagattggatgaagttggctatgatgatgttggtggtgttagaaaacagatggctcagattcgggagttggtggagcttccacttagacatccacagctattcaaatcaattggtgtgaagccaccaaaaggaattttgctttatggacctcctggttctgggaagacactaattgcccgggctgttgccaacgaaactggtgctttcttcttctgtattaatggacctgagattatgtccaaattggctggtgagagtgaaagcaatctcagaaaagcttttgaggaagcagagaagaatgcaccatccattatttttattgatgagattgattcaattgctcccaagcgggagaagacacatggagaagttgagaggaggatagtctctcagctattgacacttatggatggacttaaatcccgtgcacatgttattgttattggggccacaaaccgtcccaacagcatagacccagctttgagaaggtttggtagatttgatagggaaattgatattggtgttcctgatgaagttggacgtcttgaggttcttcgaatccatactaagaatatgaagcttgctgaagatgttgatttagaaagaattgccaaagacacacatggttatgttggtgctgatttagctgctctttgcactgaggctgcacttcagtgcatcagggagaagatggatgtgatcgacttggaagatgagtcaatagatgctgagatacttaactctatggcagttagtaatgaacacttccaaactgcacttggaacaagcaacccatctgccctgcgtgaaacagttgttgaagtacctaatgtgagctgggaagatattggaggtctggagaatgttaagcgagaacttcaagagactgtccaatatccagtggagcatcctgagaaatttgagaagtttggaatgtcaccctctaagggggttcttttctacggccctcctggatgtgggaaaactcttctggcaaaagctattgccaatgagtgccaggcaaatttcatcagtgtcaagggtcctgagttgcttacaatgtggtttggtgagagtgaagccaatgtgagagagatttttgataaggctcgccaatctgctccttgtgtcctcttctttgatgaacttgactcaattgctactcagagaggaagtagtgtaggggatgccggaggtgctgctgatagggttttgaaccagcttctgacggagatggatggtatgtctgcaaagaaaactgtttttataattggagccactaatagaccagacatcatagatcctgcacttctgcgtcctggccgtcttgatcagctgatttacatccctcttcctgatgaggattctcgtcatcaaattttcaaagcttgcttgaggaaatcgccagtttccaaagatgttgacctcagagctcttgccaagtatactcagggcttcagtggtgccgatattactgagatttgccagcgtgcttgcaaatatgctattagagagaacattgaaaaggatattgagagggagaggaagcgtagagagaacccagaagcaatggaggaagatgttgaggatgatgtggcagagattaaagcagcacattttgaggagtcaatgaagtatgcccgcaggagtgtgagcgacgctgacatccgcaaataccaggcatttgctcaaactttgcaacagtcgagaggctttggaactgaattcaggttttctgaagccagtggtgcagctactggaagtgatccttttgcggcttctgcagggggggctgatgatgatgacctttacaattaa

SEQ ID NO: 7295 - DNA, 2790 bp, Citrullus lanatus
cgcaaatcgtcggaagattttacccaaattctcagtatcgcaagttggacggaaaatttctccttttgattctctttgcctctcccgtcaatttctgctgattatggctaatcaacctgaatcctctgactccaagggtacgaagagggactttagcaccgccattttggagcggaagaaggccccaaatcgtcttgttgtcgatgaagctatcaacgatgataactccgtggtcgctcttcatcctgataccatggagaagcttcaactcttccgtggggatacgatcctcattaagggtaagaagaggaaagacacgatatgcattgctcttgctgatgatacttgtgatgagcctaaaataaggatgaacaaggtcgtgaggagcaatcttagggttaggcttggtgatgttgtctctgtgcaccaatgtgccgatgttaaatatggaaagcgtgtacacattcttccagtggatgatactattgaaggggttactggaaatctttttgacgcttatttgaaaccctatttcttggaggcatatcgccctttgaggaagggtgatctcttccttgtgagggggggaatgaggagtgtagagttcaaggttattgagactgatccagctgaatactgtgtggtagccccagacactgagatcttttgtgatggggagcctgtgaaaagggaggatgaggatagattagatgaagttggttatgatgacgtcggtggtgtcaggaaacaaatggctcagattcgtgaattggttgagttgccactgaggcatccacagctgtttaaatcgatcggtgtgaagccacccaagggaattttgctgtatggaccccctgggtctgggaagactctgattgcacgtgctgttgcaaatgaaactggtgcatttttcttctgtatcaatggaccagagatcatgtcaaagttggctggtgaaagtgaaagtaacctcagaaaagcttttgaggaagcggagaaaaatgcaccatctattatttttattgatgaaattgattcaattgctcccaagcgagagaagaccaatggagaagttgagcgaaggattgtctcacagctactgaccctcatggatggactgaagtctcgtgctcatgtcattgtgattggggctacaaatcggccaaacagcatcgacccagctctgagaaggtttggaagatttgatagggaaatagatattggtgttcctgatgaagttggccgtctagaagttctacgaattcatactaaaaacatgaagctcgcagaagaagttgatttggagaggattgctaaagatacgcatggctatgttggtgctgatctggctgctctctgtactgaggctgcacttcaatgcatcagagagaagatggatgtaattgacttggaagatgactctatagatgctgagatactcaattcaatggcagttacaaatgagcattttcagacagctcttggaaccagcaacccatcagctcttcgtgaaacagttgttgaagtacctaatgtttcatgggaggatattggaggtcttgagaatgttaagagagagcttcaagagacggttcaatatccagttgaacatcctgagaagtttgagaaatttgggatgtcgccctcaaaaggagttcttttctatggccctcctggatgtggaaagactcttcttgcaaaggccattgcaaatgagtgtcaagcaaactttattagcgtcaagggcccagagttgctcacgatgtggtttggagagagtgaggccaatgttcgtgaaatctttgacaaggcccgccagtctgctccttgtgtcttgttctttgatgaacttgactcaattgccacccaaagaggtagtagtgttggggatgctggaggtgctgctgatcgtgtactgaaccaacttcttacagaaatggatggaatgtcagcaaagaaaactgttttcatcattggtgccaccaacagaccagacattatagatcctgctcttttacgtcctggacgtctcgaccagttgatttatattcctcttcctgacgaagaatctcgtcttcaaatcttcaaggcttgcttgaggaaatctccaatctcaaaagatgtggaactcagagcccttgctaagtacactcaaggcttcagtggtgctgatattacagaaatctgtcagcgtgcctgcaaatatgcaatcagagagaacatcgagaaggacattgagaaggagaggaggaaaagcgagaaccccgaggccatggaggaggatgctgatgatgaagtggccgagatcaaggctgcacactttgaggaatctatgaagtatgcccgaaggagtgtcagtgatgctgacatccgcaaataccaggcatttgcgcaaacacttcagcagtcaagaggattcggagccgagttcaggttcgagcagagctcggcaccaactgcatccgacccatttgcaacttctgctggtggggctgatgaagatgatctctataactagtatggcatgtaggttccaaccccatttatgcttagacttggtagtatgatataacttgataaaagcttcatatggatcgctttttgattggacagaatcctgaatccaaacagttggagaaagtcattttgttaacccagaatttctttatgggttgcacaaaacactgaacagattttatttgaatgtgattatcatttacatcattcttgacacgaaaaggttgcttttccccttaattgcttataataatgtatcatctttgttgggtt

SEQ ID NO: 7296 - DNA, 2953 bp, Citrullus lanatus
gatctctccagatacattctatcgccatttccctttgattttgttgtctctctctacaacaactcagtcgtcttttgttttctgctcggccatcgccatggcgaatcaagctgaatcctccgactctaagggtccgaagagggattttagtaccgcgattctagagcgcaagaaagccgcgaaccggcttattgtcgatgaggcaatcaatgatgacaactctgtggttgcgcttcaccctgacactatggagaagcttcaacttttccgtggcgacacgatcttgatcaaggggaagaaaaggaaggatacaatatgcattgctcttgctgatgacacatgtgatgaaccaaaaataagaatgaacaaggttgtgagaagcaaccttcgtgtcaggcttggagatgttgtatccgtgcatcaatgtgctgatgttaaatatggaaagcgagtacacattcttccagtagatgacactattgaaggtgtcaccggaaatctttttgatgcatatttgaaaccgtacttcttggaagcctatcgcccagtgaggaagggtgatctctttcttgtgaggggaggaatgagaagtgtggagttcaaggtcattgaaactgatcctcctgaatattgtgtggttgcccctgatactgaaatcttctgtgatggggagcctgtgaaaagagaggacgaagatagattagatgaggttggttatgatgacgttggtggtgttagaaaacaaatggcacaaattcgtgaattggtggaacttcctctgagacatccacaactttttaaatccattggagtaaagccaccaaagggaattctgctttatggacctcctgggtctggaaagactttgattgccagagctgtagctaatgaaactggggctttctttttctgtatcaacggaccagaaattatgtcgaagttagctggagagagtgaaagtaacctcaggaaagcttttgaggaggcagaaaagaatgctccatctatcatctttattgatgagattgattcaattgctcctaaacgagaaaaaactcatggagaagttgagagaaggattgtttctcagctcttgacactaatggatgggttaaaatctcgtgcccatgtcattgttattggagctacaaatcgtccaaacagcattgatccagctttgagacgatttggaagatttgacagggaaatagatattggggttcctgatgaagttgggcgtcttgaggttcttcgtatccataccaagaacatgaagcttgctgaagatgttgacttggaaagaattgccaaggatacacatgggtatgttggagctgacttggcagctctttgtaccgaggctgcacttcaatgcattagagagaaaatggatgttattgatttggaagatgaaacaattgatgcggagattcttaactcaatggcagtcacaaatgagcacttccaaactgcccttggaaccagtaatccatctgctctacgtgaaaccgttgttgaagtgcctaatgtcagctgggaagacattggaggtcttgagaatgtcaagagagaacttcaagagactgtacaatatccagtggaacatcctgagaagtttgagaaatttgggatgtcaccctcaaagggagttcttttctatggccctcctggatgtggaaaaactcttctggccaaagctattgcaaatgagtgccaggcgaacttcatcagtgtcaagggtcctgaattgcttacaatgtggtttggagaaagtgaggccaatgttcgtgaaatttttgacaaggcacgccagtctgcaccttgtgttctgttctttgatgagcttgactctatcgccactcagagaggcagcagcgtgggagatgctggaggtgctgctgatcgagttttgaaccaacttctgacggaaatggacggaatgtcagcaaagaaaactgtcttcataattggggcgaccaacagaccagatattatagatccagcacttcttcgtccaggacgtcttgatcaattgatttatattcctcttcctgatgaggattctcgtcaccaaattttcaaggcttgcttgaggaagtcaccagtatcgaaagatgtagaccttagggcccttgctaagtacactcaaggttttagtggtgctgatattacagaaatctgccagcgtgcttgcaaatatgctatcagggagaatattgagaaagatattgagagggagaggaggagaagagataatcctgaggccatggaagaggatgtagaggacgaggtggcggagattaaagctgctcattttgaggagtcgatgaagtttgctcgcagaagtgtgagtgacgccgatattcgtaaataccaggcatttgctcaaacactgcagcagtcgagagggtttggttctgaattcaggttctcagacaacactgcttctggaactgcggctgccgacccgtttgcaacttctgctggcggcggggctgatgatgatgatctttacaactaggttcgaatgtgtcatgtatgtttagaacatttcttcttctaatactgcaaatttgtgtccttttctcatataatgatctgtgggggagaaggagcctacagttggagggctgtttggtcccaaagatggcttcagggtgcccccttggttagtgatacttacctataatgtagacttgattagttggttattcctgttactactctaaaaatgaatactactttagaagactataaggttgctgtttggctcactattgaattcctcctctccatttgcttcttaggagttgtgaatatgaattatgaatcgtattattctctctgagatgctgcccaagttggtttgcaaagagaggccttttctcccgaactcttcaaaaagttagaaatattgctgtcttgtaataatctattgaaatctcattctcaa

SEQ ID NO: 7297 - DNA, 2545 bp, Nicotiana tabacum
atgactaacaaagctgaatcctccgattcgaaagggacaaagcgggactatagtacggcgatattggagaggaagaagtcgccgaatcggcttgttgttgatgaggcaatcaacgatgacaactctgttgttgctcttcaccctgatactatggagaagcttcagctttttcgtggtgacactatcttgatcaagggtaagaagagaaaagatacaatctgcatagctcttgctgatgacacctgtgatgagccgaagatcaggatgaacaaggttgtcagaaataacctaagggttcgacttggtgatgttgtctctgtgcatcagtgtcctgatgtcaagtatggcaaacgtgtacacattcttcccattgatgataccattgaaggggtcactgggaatctctttgatgcttacttaaaaccctatttccttgaagcatacagaccggtgaggaagggtgatcttttcttggtaaggggagggatgagaagtgtagagttcaaggttattgaaactgatcctcctgaatactgtgttgtagcccctgatacggagatattttgtgagggtgaacctgtgagtagggaagacgagaataggctagatgaaatcggttatgatgatgttgggggcgtgcgtaaacaaatggctcaaatacgggagcttgttgagcttccactaaggcacccacaactcttcaaatctattggtgtcaaacctcctaaaggaattctgttgtatggacctcctggatcaggaaagactttaatagcccgagcagttgcaaatgagactggtgcgttcttcttctgtattaatggtccagagatcatgtcaaaattggctggagaaagtgaaagcaatcttaggaaggcatttgaggaagctgaaaagaatgcaccatcaatcatttttatcgatgaaattgactcaatagctcctaaacgtgagaagacacatggagaggttgagaggaggattgtctcccagcttttgacattgatggatggactcaaatcacgtgcccatgtaattgttatgggtgccactaatcgccccaacagcattgaccctgccctaagaaggtttggtagatttgatagggaaatagacattggtgttccagatgaagtggggcgtctcgaggtgcttcgtatccatacgaagaacatgaagcttgctgaagaagttgatttagaaagaattggcaaggacacacatggttatgtcggtgctgatttagcagctttgtgtaccgaggctgctcttcaatgcatcagagagaagatggacgtgattgatttggaggatgagaccattgatgcagagatactgaactctatggctgtgacaaatgagcacttccaaactgctcttggaacgagcaatccctctgccttgcgtgaaactgttgttgaagttcccaatgtttcctgggaggatattggaggccttgagaatgtcaagcgtgagctccaagagactgttcaatatccagtggaacatcctgagaaattcgagaagtttggtatgtctccgtcaaagggagtcctgttctacggcccacctggatgtgggaaaactttgctcgcgaaggccattgcaaatgaatgccaggccaacttcatcagtgttaagggtccagaattgctcaccatgtggtttggagagagtgaagccaatgttagagaaatatttgacaaggctcgacagtctgctccatgtgtcctattctttgatgaactggattccatcgccacacagagaggaagtagtgtgggagatgctgggggagctgctgatagggtattgaatcaactccttactgaaatggatggaatgaatgctaagaagacagtattcattattggcgcaaccaacaggcccgacattattgatcctgcacttctacggcctggtcgtcttgatcagttgatttatattcctctccccgatgaagactctcgtcaccaaattttcaaggcgtgcctaagaaagtcacccctttctaaggatatcgatctaagagctctagcgaagtacacacagggcttcagtggagctgacataacagaaatctgtcaacgcgcttgcaaatacgctatcagagaaaacattgagaaagacattgagagggagaaaaggagaagcgagaatcctgaggccatggaggaagacgttgatgatgaggtagcagagatcaagcctgctcattttgaggaatcaatgaagtatgctaggaggagtgttagtgacgcagatattcgcaagtaccaggcttttgctcagacgttgcagcagtctagaggttttggtactgaattccgattctcagagacaagcacggcaggagggacaactggaactgctgaccccttcgcaacttcagctggtggagcagatgaagatgacctgtatagttagcttgtcagagattaattttcttgtcttacattgcaaccctgtaaaatggactaattactcgactcgaaatccctcctttgctgtcagtttataatttatatttggatcttctatagct

SEQ ID NO: 7298 - DNA, 2828 bp, Quercus alba
gtttcatcgaaaatgcttttatatgcaatttgcatctccggatgcgaatgctttaccttcgtctctctctctctctctctctctctctctcttcgcttcgctttgctttgctctctccgatcccaaacacaatggcgcaccagggcgaatcgtccgaaccgaaaccggcgaagaaggacttttcgacggcgattctggagaggaagaagtcgccgaatcggcttgtcgttgacgaggcggtcaacgacgacaactccgttgtcgctttgcaccctgacaccatggaaaagctccagcttttccgtggcgacacgattcttatcaagggcaagaaacgaaaggatacagtctgcattgctcttgctgatgaaacatgtgaggagccaaagattaggatgaacaaggttgttagatcaaatctgagggttcggcttggggatgtagtatctgtacaccagtgccctgatgttaagtatgggaagcgtgtccacatactgcctgttgatgatactatagaaggtgttactggcaacctatttgatgcatatttgaaaccttatttcttggaggcttatcgccctgtaaggaagggagatctattccttgtcaggggagggatgagaagtgtagagttcaaggttattgaaactgacccaggggagtattgtgtggttgccccagacacagaaatcttctgtgagggagaaccggtcagaagggaggatgaggataggttggatgaaattggttatgatgatgtgggtggtgttagaaagcagatggctcagattcgtgagttagtggagctgcctctaaggcaccctcagctttttaaatcaattggtgtgaaaccaccaaagggcattttgctttatggacccccaggttctggaaagacattgatagctagagctgtggctaatgaaactggagctttctttttctgtattaatgggccagagattatgtccaaattggctggggagagtgaaagcaatctccggaaggcatttgaagaagctgaaaagaatgctccatccatcattttcattgatgagctcgattctattgctcctaagagggagaagactcatggtgaagttgaaaggaggattgtttcacagcttttgactcttatggatgggctgaaatctcgggcccatgttattgtcatgggggctacgaatcgtccaaacagcattgacccagctttgagaagatttggtcgttttgatagggaaatagacattggtgttccagatgagattgggcgccttgaagttcttcgcatccataccaagaacatgaagctctctgaagaagttgatttggaaagaatttcaaaagatacccatggttatgttggtgccgatcttgctgctctctgcactgaggctgcactgcaatgcattagggagaagatggatgtgattgacttggaagatgactctattgatgctgagatacttaattccatggctgttaccaatgagcacttccagactgctcttggaaccagcaacccatctgctttacgtgaaactgttgttgaagtgcccaatgtcggctgggaagacattggaggccttgagaatgttaagcgggaacttcaagagactgtacagtatcctgtggagcacccagagaagtttgagaaattcggaatgtcaccttcaaaaggggtccttttttatggtcccccaggatgtgggaagactctattggccaaggcaattgcaaatgaatgtcaagcgaacttcatcagtgtcaagggccctgagctgcttacaatgtggtttggtgagagcgaagccaatgttcgagaaatttttgacaaggctcgacaatctgccccatgtgtccttttctttgatgagcttgactccattgctacccagagaggaagcagtgttggggatgctggtggtgctgctgatcgggttctgaaccagcttcttactgaaatggatggcatgtctgcaaagaagaccgtgttcataattggggctaccaaccgacctgacataattgacccagcacttctgaggcctggtcgtcttgaccaattgatttatattcctctccctgatgaggagtcacgttttcaaatctttaaatcctgcttgagaaaatcacctgtctcaaaagatgtcgatttgagagcactggccaaatatactcaaggcttcagtggagctgacatcacagaaatttgccagcgagcatgcaagtatgctataagagagaacatagagaaggacatagagaaggagaggaggagaagtgagaatcctgaggctatggacgaggacgaaaacgatgaagtggcagagattagggctgctcattttgaggagtccatgaagtttgcccgtaggagtgttagtgatgctgatatacgcaaataccaggcatttgctcagaccttgcagcagtctaggggttttggaagtgaatttaggttctctgagacacgtactggggccacctctggatctgatccatttgcaacttctgctggtggtgctgctgatgaagatgatttgtatagttaggttttatatttatcaaatcttcagtgacacgtctgttgaacttaatgcatgtctttttgggtcacaatggggcagggccttcgtgtccgccgttactgcttttgccatttggtacttaaccaggcctggtgggttactaggttaaacttaaacatccggttttccgttctcaaacattgttatttatggatgaaaacttaagtgatgaattggaaaaacaaaagaaatctatgggcctaattggccaagaatattcaaatttatgcatggtta

SEQ ID NO: 7299 - DNA, 2753 bp, Populus trichocarpa
agaattagatcccactattaatattaattttcgaaaagaaaacagatattttctatccctctgagttctgcctctctgtctctcgaccatgtctaaccaagctgaatcctctgactctaaaggaacaaagagggattttagtaccgcgattttggagagaaagaagtctccgaatcgtcttgttgttgatgaggctattaatgatgataactctgtcgtttcccttcatcctgagactatggagaagctccagctctttcggggtgacaccatcttaatcaagggaaagaaaaggaaagatactatttgcattgcccttgctgatgactcatgcgatgaaccaaagatcaggatgaacaaggttgtgaggtcaaacctgagggttaggcttggagacgtggtatctgtacaccagtgtcctgatgtcaagtatggaaaacgcgtgcacatcttgcccattgatgacacaattgaaggggtcactggaaatctctttgatgcatacttgaagccttatttcttggaagcatatcgcccagtgaggaagggtgacctcttccttgtacgagggggaatgagaagtgtggaattcaaagttattgaaactgaccctccggagtactgcgtggttgctccagacactgagatcttctgtgagggagagcccgtgagaagagaggatgaggatagattggatgaagttggttatgatgatgttggtggtgttagaaaacaaatggctcagattcgggagttggtggagcttcctttgagacacccacaactattcaaatcaattggtgttaaaccaccaaaaggaattctgctgtatggacctcctggttctgggaagactctaattgcccgagctgttgcaaatgaaactggtgcttttttcttctgtattaatggacctgaaattatgtcaaagttggctggagagagtgaaagtaatctcagaaaagcatttgaggaagcagagaaaaatgcaccttcaattatatttattgacgaaatagattcaattgcccccaagcgagagaaaacaaatggagaggttgagaggagaattgtttcccaacttttgacactcatggatggactaaaatcccgtgcacatgttattgtcatgggggctacaaatcggcccaatagcattgaccctgctctgaggaggtttgggagatttgatagggaaattgatattggtgttccagatgaagttgggcgcctagaggttcttcgtattcatactaagaacatgaagcttgctgaggatgttgatttggaaagaatagccaaggatacccatggttatgttggtgctgacttagcagctctttgcaccgaggctgcgcttcaatgcatcagagaaaagatggacgtgattgacttggaagatgagacaatagatgctgaaatactcaactcaatggcagtgactgacgaacacttcaagactgctcttggaataagcaacccatctgcattgcgtgaaacagttgttgaagttcctaatgttagttgggaagatattggtggtcttgaaaatgttaagagggagctccaggagactgttcaatatccagtggagcaccctgagaaatttgagaagtttggaatgtcaccatcaaagggagttctgttctatggccctccaggatgtgggaaaacccttctggctaaagctattgccaatgaatgccaggcaaacttcattagtgtcaagggtcctgaattgcttacaatgtggtttggtgagagtgaggccaatgtacgagaaatttttgacaaagctcgccaatctgctccttgtgtcttgttctttgatgaacttgactcaattgcaactcagagaggaagcagcgtaggagatgctgggggtgctgctgatagagttttgaaccagcttctgacggagatggatggcatgactgcaaagaaaactgttttcataattggggccacaaacagacccgacatcatagaccctgccctattgcgtcctgggcgtcttgatcagttgatctatatccctcttcctgatgaggagtcacgctttcaaatattcaaatcttgcttgaggaaatcaccagtctccaaagatgttgacctcagagcacttgccaagtacacacagggtttcagtggtgctgatattacagaaatatgccagcgtgcttgcaaatatgccataagagagaacattgagaaagatattgagaaggagaggaggcaaaaagagaaccctgaggctatggaggaagatgttgaggatgaggtggcagagatcaaggcagcacattttgaggaatccatgaaatatgcccgtcggagtgttagtgatgctgacatccggaagtatcaggcatttgctcaaacactgcaacagtcaagagggtttggaactgaattcaggtttgctgaagctagtgctgggtccgatccgtttgcagcttctgctggcggagctgatgaagatgacctttacagttaagttatcgtaaaatgtctaggcttatagatttgggccctaatatgtgtctctggttaaatccatgcatgtttactgaaagttccttgggattttattattgtgaccaaattggccttgcgtttttcaaaattgaacacttcctttgactcctttcaagtcaaaattgaacatgttatcttattttgaaagattattaatgatactatctgaaactaagtttccttctaaattgccaatgacttgcgaattaattacc

SEQ ID NO: 7300 - DNA, 2733 bp, Triphysaria pusilla
aaacacagccctcttctctatatatttttctacttctcatccccaattcacagatccctcatttatattcttcaaccaatcccaaaaccctaaaacaacaattgtttctcacaatcacacgccatgactgataaagccgaatcatctgaccctaagggcacgaagagggattttagcacggccatcttggagaggaaaaaggctccgaatcggctcgtagtggatgaagctataaatgatgataattctgtggtaactattcaccccagtactatggaaaagcttgagcttttccgtggcgacacgatcttaatcaagggtaagaaaagaaaggacacgatttgcatcgcccttgctgatgattgttgtgaggaacccaagattcgtatgaacaaggttgtccgaagcaacctcagggttaggcttggtgatgttatttccgtgcatcagtgtgctgatgtcaagtatggtaaacgtgtccacattctacccgtcgatgacacaatcgaaggtgtcaccggaaatctcttcgatgctttcctgaagccttatttctctgaagcataccggcctgtaaggaagggcgacatgtttcttgtcaggggaggaatgagaagtgttgagttcaaggtcattgagacggacccagctgaatactgtgtagttgcccccgacactgagattttctgtgagggcgagcccattaaaagggaggatgaggatcgtttggacgaggtgggctacgatgatgtcggtggagttcgtaagcagatggcccagattcgtgagcttgttgagctcccgctcaggcacccacagcttttcaagtcgattggggtcaagcccccgaagggaattctactttatgggcctccgggttctggaaagaccctcattgcccgggctgtggctaatgagactggtgctttctttttctgcatcaatgggcctgaaatcatgtcaaaactggcgggagagagcgagagtaatctgagaaaggcgtttgaggaggctgaaaagaatgcgccttcgattatctttattgatgagattgattcgattgcgcccaagagagagaaaacgaacggcgaggtcgagaggaggatcgtttctcagctcttgacattgatggatgggctgaaggcccgcgcccatattatcgtgatgggtgctacgaaccggcccaatagcattgaccctgctttgagaaggtttggtaggttcgacagggagatagacattggtgttcctgatgaagttgggcgtcttgaggttttccgtattcatacgaagaacatgaagcttgcagaagatgttgatttggaaagaattgctaaggagacacatggctttgttggtgccgatttagctgctctttgcactgaggctgctcttcaatgcatcagggagaagatggatgtgattgacttggaagatgatacgattgatgcggagatactaaactccatggctgtgaccaatgaacatttccagactgctcttggaataagcaatccctcagctctgcgtgaaactgttgttgaagtgcccaatgttagctgggaagatattggcggccttgagaatgtcaaacgggaactccaagagactgttcaatatccagtggagcatcccgagaagtttgaaaagtttggcatgtcgccttccaagggtgtccttttctacgggcccccggggtgtggaaagactttactggcaaaggctattgccaacgaatgtcaggcaaatttcatcagtgtcaagggtcctgagttgctcactatgtggttcggagagagtgaggccaatgttagggagattttcgacaaggcccgccagtctgcaccatgtgttctgtttttcgatgagttggactcgatcgcaactcagagagggagcagctcaggagatggtggtggtgcagccgatcgtgtgctgaatcagcttctgactgaaatggatggcatgaatgctaagaagactgttttcatcatcggtgccaccaacaggccagacattatcgactctgcgcttttacgtcccggtcgtctcgatcagctgatttacatccctctccctgatgaggactcacgccataatatcttcaaggcgtgcctgcgaaagtcacctatttccaaggatgtcgacattaaagcacttgctaagtacactcagggctttagcggtgctgacattaccgagatatgccaacgtgcttgcaaatacgccatcagagagaatattgaaaaagatatcgagagggagaagagaagaagcgagaacccagaggctatggaggaagatgaggatgaggtgcctgagattaaggctgctcactttgaggagtcgatgaagtacgctcgccggagtgtgagtgatgccgacattcgcaagtatcagtcgtttgcccagacattgcagcaggccaggggatttggttccgagtttcgatttgctgataatagcagcggtggtggtgctactactggaacagctgatgcttttgcagcaccagctggcgcagctgatgatgatgacctgtatagttagaaaatgcggagcagaacggtttaattcaagttctgattacttggctcccagaacggattatgatgaaacatttagacaatgttttgcttttgtattctgatggatatttattttactatttgtttctcaactttatttgagatatttatttgggattcagacttaatacacttgttttaccag

SEQ ID NO: 7301 - DNA, 2876 bp, Cucumis melo
gttttatcgccattgattttgttgtctctttcactctcactctcctcacccatcgccatggcgaatcaacctgaatcctccgactccaagggtcccaagagggattttagtaccgcgattctagaacgcaagaaagctgccaaccggcttgttgtcgatgaggccattaatgatgataactcggtggttgcgcttcaccctgatactatggagaagcttcaactcttccgtggcgacacgatcttgatcaaggggaagaaaaggaaggatacaatctgcattgctcttgctgatgacacatgtgatgagccaaaaataagaatgaacaaggttgtgagaagcaaccttcgcgtcaggcttggagatgttgtttccgtgcatcaatgtgctgatgttaagtatggaaagcgggtacacattcttccagtagatgatactattgaaggtgtcaccgggaatctttttgatgcatacttgaaaccatatttcttggaagcctatcgcccagtgaggaagggtgatctcttccttgtgaggggaggaatgagaagtgttgagttcaaggtcattgaaactgatcctcctgaatattgtgtggttgcccctgatactgaaattttctgtgatggggagcctgttaaaagagaggatgaagatagattagatgaggttggttatgatgacgttggtggtgttagaaaacaaatggcacaaattcgtgaattggtagaacttcctctgagacatccacagctttttaaatccattggagtaaagccaccaaagggaattctgctttatggaccccctggatctggaaagactttgattgccagagccgtagctaatgaaactggggctttctttttctgtatcaatggaccagaaattatgtcaaagttggctggagagagtgaaagcaaccttaggaaagcttttgaggaggcagaaaagaatgctccatctatcatctttattgatgagattgattccattgctcctaagcgtgaaaaaactcatggagaagttgagagaaggattgtgtctcagctcttgacactaatggatgggttaaaatctcgtgcccatgtcattgttattggagctacgaatcgtccaaacagcattgatccagctttgagacgatttggaaggtttgatagggaaatagatattggggttcctgatgaagttgggcgtcttgaggttcttcgtatccataccaagaacatgaagcttgctgaagatgttgacttggaaagaattgccaaggatacgcatgggtatgttggagctgacttggcagctctttgtaccgaggctgcacttcaatgcattagagagaaaatggatgttattgatttggaagatgaaacaatcgatgcagagattctgaactcaatggcagtcacaaatgagcacttccaaactgctcttgggactagtaatccgtctgctctacgtgaaactgttgttgaagtgcctaacgtcagctgggaagacattggaggtcttgagaatgtcaagagagaacttcaagagactgtacaatatccagtggagcatcctgagaagttcgagaaatttggaatgtcaccctcaaagggagttcttttctatggccctcctggatgtggaaaaactcttctggccaaagctattgcaaatgagtgccaggcaaacttcatcagtgtcaagggtcctgaattgcttacaatgtggtttggagaaagtgaagccaatgttcgtgaaatttttgacaaggctcgccagtctgcaccttgtgttctgttctttgacgagcttgactctattgccactcagagaggcagcagcgtgggagatgctggaggtgctgctgatcgagttttgaaccaacttctgacggaaatggatggaatgtcagcaaagaaaactgtctttataattggggcgaccaacagaccagatattatagatcctgcacttcttcgtccaggacgtttagatcaattgatttatattcctcttcctgacgaggattctcgtcaccaaattttcaaggcttgcttgaggaagtccccagtatcaaaagatgtagaccttagagcccttgccaagtacactcaaggttttagtggtgctgatattacagagatctgtcagcgtgcttgcaaatatgctataagagagaatattgagaaagatattgagagggagaggaggagaagagacaatcctgaggctatggaagaggatgtagaggacgaggtggcagagattaaggctgctcattttgaggagtcaatgaagtttgctcgcagaagtgtgagcgacgccgatattcgtaaataccaggcatttgctcaaacactgcagcagtcgagagggtttggttcggaattcaggttctcagacaacccttcttctggaactgcagcggctgacccgtttgcaacatcagctggtggtggggctgatgatgatgatctttacaactaggtttccatgtgtcatgtatgtttagaacacttctaatactgcaaatttgtgtctttttctcgtatatgaagatctctgtgggggagaagaagcctacagttggagggctgtttggtgccaaagatggcttcagcttgtccccttggttagtgatacttgcctataatgtagacttgatcaaatggttatttcctgttactgctttaaaaacaaatactacttttagaacaccataagattgctgtttaactcaccactgagtttcttctctccatctgcttcttaagagttgtgaatatgaattaagaattctattattctctctaaagatgctgtccgaattggtttgccgaatgaggcttttctcccgaacttaagaaaccaatgttgtgttt

SEQ ID NO: 7302 - DNA, 2639 bp, Solanum phureja
aataattcaataaaaaaatcatgagtaacaaagctgaatcctctgattcgaaggggcctaagaaggattttagtacagcaattttggagaggaagaaatcacctaatcgtcttgttgttgatgaagcaatcaatgatgataattctgttgtttcacttcatcctgatactatggaaaagctccagtttttccgtggtgacacaatcttgataaagggaaagaaaagaaaagatactatctgcattgcccttgttgatgaaacatgtgatgagccaaagattaggatgaacaaggttgtcagaaataaccttagggttcgtcttggtgatgttgtctctgttcatcaatgtcctgatgtcaaatatggtaaacgtgtgcacattcttcccattgatgacagcattgagggggtttcgggaaatctatttgacgcttacttgaaaccctatttccttgaagcatatcgaccagtgagaaagggtgatctatttcttgtaagaggagggatgagaagtgtagaattcaaggttattgagactgaccctcctgaatactgtgttgtcgccccagatactgagatattctgtgagggtgaacctgtgaacagagaagatgagaatcggctagatgagattggctatgatgatgttggtggcgtgcgtaaacaaatggctcagatccgcgagcttgttgagcttccgttgaggcatccacaactgttcaaatctattggtgtgaaacctcccaaaggaattctcttgtatggacctcctggatcagggaagacattgatagctcgagcagttgctaatgagactggcgcattcttcttttgtattaatgggccagagatcatgtccaaattggcgggagaaagtgaaagtaatctcaggaaagcatttgaggaagctgagaagaatgcgccttcaattatttttattgatgaaattgattcaatagctcctaaacgtgagaagactcatggagaggttgagaggaggattgtttctcagctcttgactctcatggatggtctcaaatcacgtgcccacgtaattgtcatgggtgccactaatcgccctaatagtattgaccccgccctaagaaggtttggcagatttgatagggagatagatattggtgtcccggatgaagttgggcgtcttgaggtgcttcgtatccacacaaagaacatgaagctcgccgaagatgttgatttggaaagaattggcaaagaaacacacggttatgttggtgcggatttggcagctttgtgtaccgaggctgcacttcagtgcatcagagagaagatggatgtgattgatttggaagatgaatctattgatgcagagatattaaactccatggctgtgactaatgagcacttctcaactgcccttgggacaagcaatccatctgccctgcgcgaaactgttgttgaagttcctaatgtttcctgggaggacattggaggccttgagaatgtcaagcgtgagctccaagagactgttcaatatcctgtggaacatcccgagaagttcgagaagtttggtatgtctccttctaagggtgttctcttctatgggccacctggatgtgggaaaactttgttggcgaaggctattgcaaatgaatgccaggccaattttattagtatcaagggtccggaattgcttaccatgtggtttggagagagcgaagccaatgttagagaaatattcgacaaggctcgagggtctgctccttgtgtcctgttttttgatgagttggactcgattgctactcagagaggtggtagcagtggagatgccgggggagctgctgatagagttttgaatcaactcctcactgaaatggatggtatgaatgccaagaagacggttttcatcatcggtgccaccaacaggcctgacattattgatcctgcacttctacgtcctggtcgtcttgaccaattgatttacattcctcttcctgacgaggattcccgccatcaaattttcaaggcatgcctgcggaaatcacccctttctaaggatatcgatctcagagctcttgcaaaatatacgcaagggttcagcggagctgacattacagagatctgccaacgtgcatgcaaatacgctatccgagagaacattgagaaagatattgagagggagagaaggagaagggataatcctgaagccatggaggaagacgttgacgatgaggtatccgagatcaagcctgctcactttgaggaatcaatgaagtatgctaggagaagtgtcagtgatgctgatatccgcaagtaccaggcgtttgctcagacgttgcagcagtcccgagggtttggttctgagttccggtttgcagaggccaccaccggtcccaccaccggaactgctgatccctttgcaacttctgctggtggtgcagatgaagatgacctgtatagctagagtgtctttaacttattttttactagttacaactttgctaatatgagtaattattttgaagaaactttgaaagttagaaaaattcagtatttccattcattgtctagagtttgtaattttattttgatttttctcagctttacataaaaatattctgtagctattattttatctacttgaaaagttatagattct

SEQ ID NO: 7303 - DNA, 2562 bp, Euphorbia peplus
ctcacatattcgatttacaatgtctcaacctgcagaatcctccgatccgaaatctgccaagaaggatttctccaccgcgattttggaacggaaaaagtctcccaatagattagtcgtcgatgaggccgttaacgacgataattccgttgtctctatgcatcctgaaaccatggaaaagctccagcttttccgcggcgatactattctcatcaagggaaagaaaaggaaggatacagtttgcattgctcttgctgatgacacgtgcgagcctgcaaagattaggatgaacaaggttgttagatcaaacctgagggttcgtcttggagatgttgtgtcggtgcaccaatgccccgatgttaagtatggaaagcgagttcatattctgccaattgatgataccatagaaggtgttaccgggagtctgtttgatgcatacttgaaaccttatttcttggaggcttacagacctgtaaggaaaggggattttttcctggtgcgaggaggaatgagaagtgtagagttcaaggtgattgaaactgatccaggagagtactgtgttgttgccccggacactgagattttctgtgagggagaacctgtgagaagggaggatgaggagaaattgaatgaagtaggatatgatgatgttggtggtgttaggaagcagatggcccagattcgggagttagtggagctgcctctgaggcatcctcaactatttaaatcaattggtgttaaaccaccaaagggaattttactctatggacccccgggttctggaaagactttgatagcccgagctgttgctaatgaaactggtgcctttttcttttgcattaatggaccagagataatgtctaaattggctggagagagtgaaagcaatcttaggaaggcatttgaagaagctgagaagaatgctccttccatcatctttattgatgagattgattcaattgctcctaagcgggagaagacacatggtgaagttgaaagaaggatagtatcacagcttcttactctcatggatgggctcaaatctcgagcacatgttattgttatgggtgctacaaaccggcccaacagtattgacccagcgttgaggaggtttggaaggtttgatagggagatagacattggtgttccagatgaaattggtcgtcttgaagttctaagaattcataccaaaaatatgaagctctctgaggaagttaatctagaaaggatttcaaaggatacccatggttatgtcggtgctgaccttgctgccctatgtactgaagctgcacttcagtgcattagagagaaaatggatgtgattgacttggaggatgataccattgatgcagagatacttaattccatggctgtaacaaatgagcacttccaaactgctcttggaacaagcaacccgtctgctttacgcgaaacagttgttgaagttcccaattgcagctgggaagacattggtggtcttgaaaatgttaagagggagcttcaggagactgttcaataccctgtggagcatcctgagaagttcgaaaaatttggcatgtcaccttcgaaaggggttcttttctatggccctcctggatgtggcaaaactctactggctaaggcgatcgctaatgaatgtcaagcaaacttcataagcgtgaaaggtcctgagctattgaccatgtggttcggtgagagtgaagctaatgtcagggaaatttttgacaaggctcgacaatctgcgccatgtgtacttttctttgatgagcttgactcaattgctacgcagaggggaagcagccaaggggatgctggaggtgcagcagatagggtgttgaaccaacttcttactgaaatggatggcatgtccgctaagaagactgtttttataattggagccaccaacagacccgacattattgatccagcattgttgcgacctggtcgtctggaccaactgatttatattccccttccagacgaagactcgcgtcatcagatctttaaggcctgtttaaggaaatcacctgttgcaaaagatgttgatttgagggcactgaccaagtatactcaaggattcagtggagctgatattaccgagatatgccagcgggcatgtaaatatgccataagggagaatatagagaaggatattgaaaaggagaagaggagagcagagaatccagaggcaatggatgaggatgttgaggaagtggcggagatcaaggctgctcatttcgaggagtcgatgaaatatgctcgtaggagtgttagtgatgcagatatacgcaaataccaagcatttgcgcagacattgcaacagtccagggggttcggctcagagtttaggttcgcggattcaaggactgatggtgctgctggtgcatcggatccttttgcgactgcagctggtggggttgatgaagatgacttgtatagttaaacttattaactttttatttgaagaatgtttaaatttatctgaagtgttacggatgtaggggtagatggtggaaattcagcaactcttttcttttatttaaatgtaattttggaatttagtaa

SEQ ID NO: 7304 - DNA, 2649 bp, Manihot esculenta
ctttcttcctctcgaccatgtctaaccaagcagaatcctctgaatctaagggaaccaagagggattttagtactgcgattttggaaagaaagaaggcgccaaatcgtcttgttgttgatgaggctaccaatgatgataactcggttgtctctctccatcccgataccatggagaagctacagctctttcgtggagatacgatcttaattaaggggaagaaaaggaaagatacagtctgcattgctcttgctgatgacacgtgtgatgagccaaagatcaggatgaacaaggttgtgagatcgaacctgagggttaggctcggagatgttgtctctgtgcaccagtgtcctgatgtcaagtatggaaagcgtgttcacatactgcctatagatgacacgattgaaggggtcactggaaatatatttgatgcatacttgaagccttatttcctggaggcatatcgccccgtcaggaagggtgatctcttccttgtgagaggtggaatgagaagcgtggagttcaaagttattgagactgacccctcagaatactgtgtggttgccccagacactgaaattttctgtgagggagagcctgtaaggagagaagatgaaaatagattggatgaagttggctatgatgatgttggcggtgttagaaaacagatggctcagattcgggagttggtggagcttccactgagacatccacaattattcaaatcgattggtgtgaagcccccaaaaggaattctgctttatggacctcctggttctgggaagactctaattgcacgggctgttgcaaatgaaactggtgctttcttcttctgtattaatggacctgagatcatgtccaaattggctggggaaagtgaaagcaatcttagaaaagcttttgaggaagcagaaaagaatgcaccatctattatctttattgatgagattgactcaattgctcccaagcgggaaaagacacatggagaagttgagaggaggatagtctcccagctcttgacacttatggatggactaaaatcccgtgcacatgttattgttattggggccacaaatcgtcccaacagcattgacccagctttgagaaggtttggtagatttgatagggaaattgatattggtgttccggatgaagttgggcgtcttgaggttcttcgtatccacacaaagaatatgaagcttgctgaagatgttgatttggaaagaattgcgaaagacacacatggttatgttggtgctgatttagctgctctttgcaccgaggctgcacttcaatgcattcgggagaaaatggatgtaatcgacttggaagatgagacaatagatgctgagatacttaactccatggcagtgtctaatgaacacttccaaactgcacttggaacaagcaatccatctgctctgcgtgaaactgttgttgaagtacctaatgtgagctgggaagatattggaggccttgagaatgttaagcgagagcttcaagagactgttcaatatccagtggagcatcctgagaaatttgagaagtttggaatgtcaccatctaagggggttcttttctatggccctcctggatgcgggaaaactcttctggctaaagctattgccaacgagtgccaggcaaatttcatcagtgtcaagggtcctgaattgcttacaatgtggtttggtgagagtgaagccaacgtgcgagaaatttttgacaaggctcgccaatctgctccttgtgtcctcttctttgatgaactggactcaattgctactcagagaggaagcagtgtaggagatgctgggggtgctgctgatagggttttgaaccagcttctgacggagatggatggcatgtctgcaaagaaaactgtttttataattggagccactaatagacctgacatcattgatcctgcacttctgcgtcctggccgtcttgatcagttgatttacatccctcttcccgatgaggaatctcgtcatcaaattttcaaggcttgcttgaggaaatcgccagtctccaaagatgttgacctcagagcacttgccaaatatactcagggcttcagtggtgctgatattactgagatttgccagcgtgcttgcaaatatgctattagggagaacattgaaaaggatattgagagggagaggagacgtagagataacccagaagcaatggaggaagatgtcgaggatgatgtggcagagatcaaggcagcacattttgaggagtctatgaagtatgcacgtaggagtgtgagcgatgccgacatccgcaaataccaggcattcgctcaaactttgcaacaatcaagaggctttggaagtgaattcaggttttctgaagctagtggtgcagctactggatctgatccttttgcagcttctgcaggcggggctgatgatgatgacctttacaattaaattgtcattttcaaatgtgcgtgttgtttatgctggccttacatgtgtatctgtttatttccatatatgttgtagtgttaagaatccatgggattattcattttgcccaagtcaagccttgggttttggccaatggaagacacaatggctactcttccaagttgatagaacagattctgctactttattggttataatggatgacttctgaatc

SEQ ID NO: 7305 - DNA, 2980 bp, Amsonia hubrichtii
tttcccattcctatttattaagaccccaaatcccagatctccagtacataactcaaccaaacccttctctcaaattcaattcaatcgtcgatcattcagctttctgcctgccatgagtaaccaagctgaatcctccgattcgaaggggacaaagagggattttagtaccgcgattttggagaggaagaaggccgctaatcgcctcatagtagatgaagctgtcaacgatgataactccgtggttgctctacacccggatactatggagaagctccagcttttccgcggcgacacaattttgattaagggaaagaaaaggagggatacaatttgcatagcccttgctgatgatacttgtgatgaaccaaagataaggatgaacaaggttgtcaggtcaaacctcagggttaggcttggggatgttgtttccgtccatcaatgccctgacgtcaaatatgggaaacgtgtgcacatcctccctattgatgacactgttgaaggagttactggaaatctttttgatgcttatttgaaaccttatttcttggaagcttaccgaccagtcagaaagggtgaccttttccttgtaaggggaggaatgagaagtgtagaattcaaggttatagaaactgaccctgctgagtattgtgttgttgcccccgacactgagatcttttgtgagggagagccagtgcgaagggaggatgaagagcgtttggatgaggttggttatgatgatgttggaggagttcgtaagcagatggctcagattcgtgagctagtggaattgcccttaagacatcctcagctctttaaatcaattggtgttaagcctccaaaaggaattctgctttatggaccaccaggatctggaaagaccttgatagccagagctgtggctaatgaaactggtgctttcttcttctgtatcaatggaccagagattatgtctaaactggcaggagagagtgaaagcaatctcaggaaagcatttgaggaagcagagaagaatgccccatctatcatatttattgatgagatcgactctatcgctcctaagcgagagaagacacatggagaagttgaaagaagaattgtttcccagctcttgacacttatggatggactgaaatctcgtgcccatgtcatcgttattggtgctacaaaccgtcccaatagcattgatccagcactgagaaggtttgggcgatttgatagggaaatagacattggtgtaccagatgaagttggccgtcttgaggttcttcgtatccacaccaagaacatgaagcttgctgaagatgttgatctggagagaattgctaaggacacccatggttatgtcggtgctgacttagcagctctgtgtactgaagctgctctacaatgtattagggagaagatggacgtgattgacttggaagatgattctattgatgcagagattctaaactccatggccgtctccaatgaacatttccagactgctcttgggacaagcaacccatctgctctgcgtgaaactgtggttgaagtgccaaatgtcacctgggaggatattggaggcctggagaacgtcaagagagagcttcaagagactgtgcaatatccagtggagcatcctgagaagtttgagaagtttggcatgtcaccttcaaagggtgttcttttctatggtccacctggttgtggtaaaactttactggccaaggctattgccaatgagtgccaggcaaacttcatcagtgttaagggtcctgaattgcttaccatgtggtttggggagagtgaggccaatgtcagagaaattttcgataaggctcgccaatctgctccttgtgttctcttctttgatgaattagattcaattgcaactcagagaggaagcagtgtaggagatgcagggggtgctgccgatagagttttgaaccagcttctcacagaaatggatggaatgaatgcaaagaaaactgttttcatcattggcgccaccaacaggcctgacataattgatcctgcgcttttaaggcctggccgtcttgatcaactaatttatatccctcttcctgatgaggaatctcgataccagatattcaagtcatgcctgaggaaatcgccaatctcaaaagatgtagacttgagagccctcgccaagtatacacagggctttagtggtgctgatattacagagatatgccaacgtgcatgcaaatacgcaattagagagaatattgagaaagatatcgagagagagaggaggaggagagacaatccggaggcaatggaggaggacgtggaagatgaggtggctgagatcaaggctgctcattttgaggaatcaatgaagtatgccaggaggagtgtcagtgatgctgatatacgcaaatatcaggcttttgctcagacattgcagcagtccagaggatttggttccgaatttcgattttcagactccactgctggggctacaggatctgacccttttgcaacttctgctggtggagctgatgaagatgacctgtatagttaggttgtctatttgtgcctcttttatgttgaaatgttttagtgcttttgtaagttattgcccctcccttgtagaatgggttaacagagctcattttggatgattgttaagctgaaaaacctcttggttggcttcttgaagacttgtatctcaatcctcaaggtctcataaggtttgcttttggaaaggttataatgaatacttggaccatataatttaattatatcaattgtgctggatccataagttggatgggagagttttgggtttcatcactgatctttctcttccaggtttaatatagggctgcttgctttgctctttctttgggaatactatagcccttaaattttgtggctttgcttgggttgtcctgagaatttgtcttgaatggaatgtaatatattaggctggataggctgtcttgtacgaagccaggttgctttgggttta

SEQ ID NO: 7306 - DNA, 2817 bp, Citrus clementina
aaaactgaaaaggaaaagaaaaagcttaaaaacaaaaggactttctttcctaacaagaaacggagccacccttctctataaaacacctcaagccatcttctcagatcccattcatcacacaaaattctgttttctcaattcctctaatcactttcgttatctcattctcttcaatcaactaattatgtctaatcaagctgaatcctctgatgctaaggggacgaagagggactttagtacggccattttggagcgaaagaaggcaccgaatcgtctcgttgttgatgaagctattaacgatgataactctgtcgttgttcttcatcccgataccatggagaagctccaattcttccgcggtgacacgatcctcatcaagggaaagaaaaggaaagataccgtttgtattgcccttgccgacgatacatgtgaggaaccgaagataagaatgaataaggtcgtgaggtcgaacttgagggttagactcggagatgttgtttctgtgcaccagtgcgctgatgtcaaatacggaaagcgtgtgcacatattacctgtggatgacacaattgaaggggttactggaaatctctttgatgcatacttgaaaccttatttcacggaagcttatcgaccagtgaggaagggtgatctattccttgttagaggtggaatgagaagtgtagagttcaaggttattgagactgaccctcctgaatactgtgtggttgcccctgatactgagatcttctgtgagggagagccagtgagaagggaagatgagaatcgattagatgaggttggctatgatgatgttggtggggttagaaagcagatggctcagattcgagaattagtagaacttccattaaggcacccgcagctctttaagtcaattggtgtgaagccaccgaaaggaattttgctttatggacctcctggatctgggaagacactgattgcccgtgccgttgcaaatgaaaccggtgctttcttcttttgtataaatggacctgagatcatgtcaaaattggctggtgagagtgaaagcaatcttaggaaagcatttgaggaagcagagaaaaatgcaccatcaattatttttattgatgagatagattcaattgctcctaaacgtgagaagactcatggagaagttgagaggagaattgtttcccagcttttgacactcatggatgggctgaaatcacgtgctcatgtgattgttattggggctacaaatcgtcccaacagcattgacccagctttgagaaggtttggtagatttgatagggaaattgacataggtgtgccagatgaagtcgggcgtcttgaggttctccgtattcacacaaagaatatgaagctttctgatgatgttgacttggaaagaattgcaaaagacacacatggttatgttggtgctgatctagcagctctgtgtactgaggctgcacttcagtgcatcagggagaagatggatgtgattgacttagaagatgaaaccatagatgctgagatactcaattctatggcagtgacagatgaacattttaagactgctcttggaacaagcaatccatctgctctgcgtgaaactgttgttgaagttcccaatgtcaactgggaggatatcggtggccttgagaatgttaagagagagcttcaagagactgttcaatatccagtggagcatcctgagaaatttgagaagtttggcatgtccccatcaaagggagtgcttttctatggtcctcctggatgtgggaaaacccttctggccaaagctattgccaatgagtgtcaggcaaatttcattagtgtcaagggtcctgaattgcttacaatgtggtttggagagagtgaagccaatgtacgagaaattttcgacaaggcccgtcaatcagctccctgcgttctattttttgatgaacttgattcgattgctacccagagaggaagcagtgttggagatgctggaggtgctgctgatagggttttgaaccagcttctgacagagatggatggcatgtccgcaaagaaaactgtcttcattattggagccaccaaccgaccagatatcatagatccggcccttctccgtccaggccgtcttgaccagttgatttatatccctctccctgatgaggaatctcgccttcaaattttcaaggcttgcttgaggaaatcaccggtgtccaaagatgttgacctcagagctcttgctaagtacacccaaggctttagtggtgcagatattactgaaatatgccagcgggcttgcaaatatgccatccgagagaatatcgagaaagatattgagagggagaggaggagaagtgagaacccagaggcaatggaggaggatgtagaggatgaagtggctgagattaaagctgtgcatttcgaggaatcaatgaagtatgctcgtagaagtgtcagtgatgctgacatacgcaaataccaagcatttgctcaaacattgcagcagtcaagagggtttggaagtgaatttaggtttcctgatgctgctccccctggtgctgatggcggatcagatccttttgcgtcttctgcaggtggcgcagatgacgacgatctttacagttagattatctccatgtttaaagtctatcagtttgctgtctaatttatgctaatgttggtttacctatgtatttgacgattcgccatatgatttgtcaaaagcttcaatgtttctgccataaagccgaaaaggttaaatgagtttaggctgctggaacgcaattctctattttgattataatggatgaaatgaaactctgcaagatttaagtt

SEQ ID NO: 7307 - DNA, 2875 bp, Vitis vinifera
aaaaccctttctttttatacaagaaacggagctgcgctccctataaatacccaatatccccttccccaattcttcagatcccatttcacggatttttcccttcttccggtgaacgttgtcgttgcagggaatcctacaccatgagcaaccaagccgaatcctccgattccaagggaacgaagagagatttcagtactgcgattttggagcgcaagaaggctgcgaatcgtcttgtcgttgatgaagctgttaacgatgacaactcggtcgttgcgcttcaccccgacactatggagaaactgcaactctttcgcggcgacacaatcctgatcaagggaaagaaaaggaaagatactatctgcattgctcttgctgatgatacctgtgatgaaccaaagattagaatgaacaaggttgtgagatcaaacctgagggtcaggctaggagacgtggtttctgtgcaccaatgtcctgatgtcaaatatggaaagagagtgcacatcctccctgtggatgacactattgaaggtgtcacagggaatctatttgatgcatatttgaaaccttatttccttgaggcataccgcccagtgaggaagggtgatctgtttcttgtcagaggaggaatgagaagtgtagaattcaaggtaattgagactgaccctgctgagtactgtgtggtggccccagacacagagatcttttgtgaaggagagcctgtgagaagggaggatgaggaccgattagatgaggttggttatgatgatgttggtggagtccgaaaacagatggctcagatccgggagctggtggagctgccgcttcgtcatccccagttatttaaatcaattggcgtgaagccaccaaaagggattctgctatatggacctcctggatctggaaaaactttaatagcccgagctgttgctaatgaaaccggtgctttcttcttctgtattaatggaccggagatcatgtcaaaattggctggggagagtgaaagcaatctcaggaaagcatttgaggaagcggagaaaaatgccccatccattatctttattgatgagattgattcaattgctccaaagcgagagaagacacatggagaagttgagaggcgtattgtttctcagctcttgacacttatggatggacttaaatcccgtgcacatgttattgttattggtgcgaccaatcgtcccaacagcatagatccagctttgagaaggtttgggagatttgatagggaaatagatattggtgttccagacgaagttgggcgtcttgaggttcttcgcatccatacgaagaacatgaagctctccgaagatgttgatttagaaagaattgccaaggacactcatgggtatgtgggtgctgaccttgctgctctatgtaccgaggctgcacttcagtgcatcagagagaagatggatgtgattgacttggaagacgaaagtatagatgcagagatacttaactccatggccgttactgatgagcactttaagactgctcttgggacaagcaatccatctgctctccgtgaaacagttgttgaagtgcctaatgttagctgggaagatattggtggccttgagaatgttaagagggaacttcaggagactgttcaatatcctgtggagcatcctgagaaatttgagaagtttggcatgtctccttccaagggagttcttttctatggtccacctggatgtggtaaaactctgcttgctaaggccatcgccaatgaatgtcaggcaaacttcatcagtgtcaagggtccagaattgcttacaatgtggtttggagaaagcgaggccaatgtgcgagaaatttttgacaaggctcgccaatctgccccttgtgtcctattctttgatgaactcgattccattgctactcagagaggaagcagtgtaggtgatgctgggggtgctgctgatagagttctgaaccaacttctgactgaaatggatggaatgtccgcaaagaaaactgtttttattattggggctaccaacagacctgatataattgacccggcacttctacgtccaggtcgtcttgatcagttgatttacattcctttacctgatgaggattctcggcatcaaattttcaaggcctgcctgaggaaatctcctgtttcaaaagatgtagaccttagagcccttgccaagtatactcaaggcttcagtggtgctgatattactgaaatatgccagcgtgcatgcaaatatgccataagagagaatattgagaaggacagtgagagggagaggaggagaagggagaaccctgaggctatggaagaggatgttgatgaagaagtggcagagatcaaggctgctcattttgaagaatcaatgaagtatgctaggaggagtgtcagtgatgctgacattcgtaaataccaggcatttgcacagacattgcagcaatccagaggctttggaactgaatttcgattttcagaaaccggcacaggagctgctggatcggacccttttgcagcttctgctggtggggctgctgatgaagatgacctttatagttaggcctactccaagtgtgttgttcactgtttaatttctacaatactttatatttccatttatatatgtatttgttggtgccctgtaacatgggttaaaatattccatgggattattattgcccatatctttgggttttggcaggtgccctgactcctgtttgaattttaaaacagtggttcccatcctggatgttataattcctgattgaagaagctccacaaaatttaagttaaactcaagttattaggattttatatttcttgatttaagattattaggttgcatgtagtcattcatccaaacttctatggcaa

SEQ ID NO: 7308 - DNA, 2817 bp, Citrus sinensis
aaaactgaaaaggaaaagaaaaagcttaaaaacaaaaggactttctttcctaacaagaaacggagctacccttctctataaaacacctcaagccatcttctcagatcccattcatcacacaaaattctgttttctcaattcctctaatcactttcgttatctcattctcttcaatcaactaattatgtctaatcaagctgaatcctctgatgctaaggggacgaagagggactttagtacggccattttggagcgaaagaaggcaccgaatcgtctcgttgttgatgaagctattaacgatgataactctgtcgttgttcttcatcccgataccatggagaagctccaattcttccgcggtgacacgatcctcatcaagggaaagaaaaggaaagataccgtttgtattgcccttgccgacgatacatgtgaggaaccaaagataagaatgaataaggtcgtgaggtcgaacttgagggttagactcggagatgttgtttctgtgcaccagtgcgctgatgtcaaatacggaaagcgtgtgcacatattacctgtggatgacacaattgaaggggttactggaaatctctttgatgcatacttgaaaccttatttcacggaagcttatcgaccagtgaggaagggtgatctattccttgttagaggtggaatgagaagtgtagagttcaaggttattgagactgaccctcctgaatactgtgtggttgcccctgatactgagatcttctgtgagggagagccagtgagaagggaagatgagaatcgattagatgaggttggctatgatgatgttggtggggttagaaagcagatggctcagattcgagaattagtagaacttccattaaggcacccgcagctctttaagtcaattggtgtgaagccaccgaaaggaattttgctttatggacctcctggatctgggaagacactgattgcccgtgctgttgcaaatgaaaccggtgctttcttcttttgtataaatggacctgagatcatgtcaaaattggccggtgagagtgaaagcaatcttaggaaagcatttgaggaagcagagaaaaatgcaccatcaattatttttattgatgagatagattcaattgctcctaaacgtgagaagactcatggagaagttgagaggagaattgtttcccagctcttgacactcatggatgggctgaaatcacgtgctcatgtgattgttattggggctacaaatcgtcccaacagcattgacccagctttgagaaggtttggtagatttgatagggaaattgacataggtgtgccagatgaagttgggcgtcttgaggttctccgtattcacacaaagaatatgaagctttctgatgatgttgacttggaaagaattgcaaaagacacacatggttatgttggtgctgatctagcagctctgtgtactgaggctgcacttcagtgcatcagggagaagatggatgtgattgacttagaagatgaaaccatagatgctgagatactcaattctatggcagtgacagatgaacattttaagactgctcttggaacaagcaatccatctgctctgcgtgaaactgttgttgaagttcccaatgtcaactgggaggatatcggtggccttgagaatgttaagagagagcttcaagagactgttcaatatccagtggagcatcctgagaaatttgagaagtttggcatgtccccatcaaagggagtgcttttctatggtcctcctggatgtgggaaaacccttctggccaaagctattgccaatgagtgtcaggcaaatttcattagtgtcaagggtcctgagttgcttacaatgtggtttggagagagtgaagccaatgtacgagaaattttcgacaaggcccgtcaatcagctccctgcgttctattttttgatgaacttgattcgattgctacccagagaggaagcagtgttggagatgctggaggtgctgctgatagggttttgaaccagcttctgacagagatggatggcatgtccgcaaagaaaactgtcttcattattggagccaccaaccgaccagatatcatagatcctgcccttctccgtccaggccgtcttgaccagttgatttatatccctctccctgatgaggaatctcgccttcaaattttcaaggcttgcttgaggaaatcaccggtgtccaaagatgttgacctcagagctcttgctaagtacacccaaggctttagtggtgcagatattactgaaatatgccagcgggcttgcaaatatgccatccgagagaatatcgagaaagatattgagagggagaggaggagaagtgagaacccagaggcaatggaggaggatgtagaggatgaagtggctgagattaaagctgtgcatttcgaggaatcaatgaagtatgctcgtagaagtgtcagtgatgctgacatacgcaaataccaagcatttgctcaaacattgcagcagtcaagagggtttggaagtgaatttaggtttcctgatgctgctccccctggtgctgatggcggatcagatccttttgcgtcttctgcaggtggcgcagatgacgatgatctttacagttagattatctccatgtttaaagtctatcagtttgctgtctaatttatgctgatgttggtttacatatgtatttgacgattcgccatatgatttgtcaaaagcttcaatgtttctgccataaagccgaaaaggttaaatgagtttaggctgctggaacgcaattctctattttgattataatggatgaaatgaaactctgcaagatttaagtt

SEQ ID NO: 7309 - DNA, 2757 bp, Solanum lycopersicum
gataattcacttcttccatatccctttcttgcactcattgttctcttcttgagcaaaactccagtttctctcggctgctctaccctaatctagatctccgaagatgactaaccaggccgagtcatctgactcaaaaggtgcgaagaaggatttctctaccgcgattttggagaggaagaagtctcctaatcggcttgttgttgatgaggcggtcaacgatgataactctgttgttgcactgcaccctgctactatggagaagctacagctcttccgtggagatacaattctcatcaagggaaagaaaaggaaggatacagttgtcattgctcttgctgatgaaacatgtgatgagccaaagattaggatgaacaaggttgtccgttcaaatttgagggtccgtcttggagatgttgtgtctgtgcaccaatgcccagatgttaagtatgggaagcgtgtccacatacttcctatagatgatacaatagaaggtctcaccggggatttgtttgatgcgttcctgaaaccgtactttttggaagcatatcgtcctttgaggaaaggagacaattttcttgttagaggggggatgagaagtgtggaattcaaagtcattgagactgacccaggggagtattgtgttgttgccccagacactgaaatcttttgtgagggggagcctgttaaaagggaggatgaggagagactggacgaagttggctatgatgatgttggtggtgtgagaaaacagatggctcaaattcgtgaactggtggaactaccattgaggcatcctcaacttttcaaatccattggtgtgaaaccaccaaaggggattttactttatgggccccctggttctgggaagaccctgatagccagagcagtggctaacgaaacaggtgcatttttcttttgcattaatggaccagaaatcatgtccaaattggctggtgagagtgaaagcaatctcaggaaggcattcgaagaggcagagaaaaatgctccatctattatattcattgatgagattgattcaattgctcccaagcgagagaagacacatggtgaagttgagagaaggattgtttcacagctcctgactctgatggatggactgaaatctcgtgctcatgtcatagttatgggagctaccaatcgtcctaatagcattgatcccgctctcagaaggtttggtaggtttgatcgggaaattgacattggtgttcctgatgaagttggacgtcttgaagttcttcgtattcataccaagaatatgaagcttgcagaagaagttgatttggaaagaatatcaaaagatacacatggttatgtcggtgcagatcttgctgctctttgcactgaagctgcacttcagtgcattagagagaaaatggatgtcattgatctggaagatgattccattgatgctgaaatattgaattcaatggctgtcacaaatgagcacttccaaactgctctaggaacaagcaatccatctgcattgcgtgaaacagttgttgaagtgcctaatgtctcatgggaagacattggaggccttgaaaatgtcaaaagagagcttcaagagactgttcaataccctgtggagcatccagagaagttcgagaaatttggtatgtcaccttcaaaaggtgttcttttctatggtcctccgggatgtgggaaaactcttcttgccaaggcaattgcaaatgagtgtcaagccaatttcattagtgtcaaaggacctgagctgcttaccatgtggtttggagagagtgaggccaatgtccgtgaaatttttgacaaggctagacaatctgcaccctgtgtcctcttctttgatgagcttgactctattgccactcagaggggaagcagtagtggtgatgctggtggagcagctgatcgggttctcaaccaacttctgactgaaatggatggcatgaatgcaaagaaaactgtttttattattggggccacaaacaggcctgatattattgaccctgcacttctgcgacccggtcgacttgaccagttaatttatatcccactgccagacgaagactcgcgccatcagattttcaaggcatgtcttagaaaatctcccctatcaaaagatattgatttgagagctcttgccaaatatactcagggatttagtggagccgatatcactgagatctgtcaacgggcctgcaaatatgccataagggagaatattgagaaagatatagaaaaggaaaagaggcgagcagagaatcctgattctatggatgaggatgctgatgatgagatatcagagatcaagcctgctcattttgaggagtccatgaagtatgcacgacgaagtgtgagtgatgccgatattcgtaaataccaggcatttgctcagaccttacagcaatctcgaggttttggaacggaatttcggttttctgagaccagtggtggagctgctgcatctgatcccttcacaacttctaatgctggagccgatgatgatgacctgtatagctaaagttatggactatcctgttattttgctgcgacttctttcttttccgttgttgctagcgctatatagagtttcctaaacaatttacttctttgtttctggaagctgtaatgctactcgtccaactgttggtttattttgctcgctctttaatgttgttatcttgaggtgttctatgacattttaaagaaacctcaatagctttgctaatatagtggaccttggtaatttattctctt

SEQ ID NO: 7310 - DNA, 2794 bp, Citrus sinensis
aacaagaaacggagccacccttctctataaaacacctcaagccatcttctcagatcccattcatcacacaaaattctgttttctcaattcctctaatcactttcgttatctcattctcttcaatcaactaattatgtctaatcaagctgaatcctctgatgctaaggggacgaagagggactttagtacggccattttggagcgaaagaaggcaccgaatcgtctcgttgttgatgaagctattaacgatgataactctgtcgttgttcttcatcccgataccatggagaagctccaattcttccgcggtgacacgatcctcatcaagggaaagaaaaggaaagataccgtttgtattgcccttgccgacgatacatgtgaggaaccgaagataagaatgaataaggtcgtgaggtcgaacttgagggttagactcggagatgttgtttctgtgcaccagtgcgctgatgtcaaatacggaaagcgtgtgcacatattacctgtggatgacacaattgaaggggttactggaaatctctttgatgcatacttgaaaccttatttcacggaagcttatcgaccagtgaggaagggtgatctattccttgttagaggtggaatgagaagtgtagagttcaaggttattgagactgaccctcctgaatactgtgtggttgcccctgatactgagatcttctgtgagggagagccagtgagaagggaagatgagaatcgattagatgaggttggctatgatgatgttggtggggttagaaagcagatggctcagattcgagaattagtagaacttccattaaggcacccgcagctctttaagtcaattggtgtgaagccaccgaaaggaattttgctttatggacctcctggatctgggaagacactgattgcccgtgctgttgcaaatgaaaccggtgctttcttcttttgtataaatggacctgagatcatgtcaaaattggctggtgagagtgaaagcaatcttaggaaagcatttgaggaagcagagaaaaatgcaccatcaattatttttattgatgagatagattcaattgctcctaaacgtgagaagactcatggagaagttgagaggagaattgtttcccagctcttgacactcatggatgggctgaaatcacgtgctcatgtgattgttattggggctacaaatcgtcccaacagcattgacccagctttgagaaggtttggtagatttgatagggaaattgacataggtgtgccagatgaagttgggcgtcttgaggttctccgtattcacacaaagaatatgaagctttctgatgatgttgacttggaaagaattgcaaaagacacacatggttatgttggtgctgatctagcagctctgtgtactgaggctgcacttcagtgcatcagggagaagatggatgtgattgacttagaagatgaaaccatagatgctgagatactcaattctatggcagtgacagatgaacattttaagactgctcttggaacaagcaatccatctgctctgcgtgaaactgttgttgaagttcccaatgtcaactgggaggatatcggtggccttgagaatgttaagagagagcttcaagagactgttcaatatccagtggagcatcctgagaaatttgagaagtttggcatgtccccatcaaagggagtgcttttctatggtcctcctggatgtgggaaaacccttctggccaaagctattgccaatgagtgtcaggcaaatttcattagtgtcaagggtcctgagttgcttacaatgtggtttggagagagtgaagccaatgtacgagaaattttcgacaaggcccgtcaatcagctccctgcgttctattttttgatgaacttgattcgattgctacccagagaggaagcagtgttggagatgctggaggtgctgctgatagggttttgaaccagcttctgacagagatggatggcatgtccgcaaagaaaactgtcttcattattggagccaccaaccgaccagatatcatagatcctgcccttctccgtccaggccgtcttgaccagttgatttatatccctctccctgatgaggaatctcgccttcaaattttcaaggcttgcttgaggaaatcaccggtgtccaaagatgttgacctcagagctcttgctaagtacacccaaggctttagtggtgcagatattactgaaatatgccagcgggcttgcaaatatgccatccgagagaatatcgagaaagatattgagagggagaggaggagaagtgagaacccagaggcaatggaggaggatgtagaggatgaagtggctgagattaaagctgtgcatttcgaggaatcaatgaagtatgctcgtagaagtgtcagtgatgctgacatacgcaaataccaagcatttgctcaaacattgcagcagtcaagagggtttggaagtgaatttaggtttcctgatgctgctccccctggtgctgatggcggatcagatccttttgcgtcttctgcaggtggcgcagatgacgatgatctttacagttagattatctccatgtttaaagtctatcagtttgctgtctaatttatgctgatgttggtttacatatgtatttgacgattcgccatatgatttgtcaaaagcttcaatgtttctgccataaagccgaaaaggttaaatgagtttaggctgctggaacgcaattctctattttgattataatggatgaaatgaaactctgcaagatttaagttaaatgctagtattgtttggactttttct

SEQ ID NO: 7311 - DNA, 2757 bp, Solanum phureja
aattcacttcttccatatccctttcttgcactcattgttctcttctccagcaaaactccagtttctctcggctgctctaccctaatctagatctctgaagatgactaaccaggccgagtcatctgactcaaaaggtgcgaagaaggatttctctaccgcgattttggagaggaagaagtctcctaatcggcttgttgttgatgaggcggtcaacgatgataactctgttgttgcactgcaccctgctactatggagaagctacagctcttccgtggagatacaattctcatcaagggaaagaaaaggaaggatacagttgtcattgcacttgccgatgaaacatgcgatgagccgaagattaggatgaacaaggttgtccgttcaaatttgagggtccgtcttggagatgttgtgtctgtgcaccaatgcccagatgttaagtatgggaagcgtgtccacatacttcctatagatgatacaatagaaggtctcactggggatttgtttgatgcgtttctgaaaccttactttttggaagcatatcgtcctttgagaaaaggagacaatttccttgttagaggagggatgagaagtgtggaattcaaagtcattgagactgacccaggggagtattgtgttgttgctccagacactgaaatcttttgtgagggggagcctgttaaaagggaggacgaggagagactggacgaagttggctatgatgacgttggtggtgtgagaaaacagatggctcagattcgtgaactggtggaattaccattgaggcatcctcaacttttcaaatccattggtgtgaaaccaccaaaggggattttactttatggaccccctggttctgggaagaccctgatagccagagcagtggctaatgaaacaggtgcatttttcttttgcattaatggaccagaaatcatgtccaaattggctggtgagagtgaaagcaatctcaggaaggcattcgaagaggctgagaaaaatgctccatctattatattcattgatgagattgattcaattgctcccaagcgagagaagacacatggtgaagttgagagaaggattgtttcacagctcctgactctgatggatggactgaaatctcgtgctcatgtcatagttatgggagctaccaatcgtcctaacagcattgatcctgctctcagaaggtttggtaggtttgatagggaaattgacattggtgttcctgatgaaattggacgtcttgaagttcttcgtattcataccaagaatatgaagcttgcagaagaagttgatttggaaagaatatcaaaagatacacatggttatgtcggtgcagatcttgctgctctttgcactgaagctgcacttcagtgcattagagagaaaatggatgtcattgatctggaagatgattccattgatgctgaaatattgaattcaatggctgtcacaaatgagcacttccaaactgctctaggaacaagcaatccatctgcattgcgtgaaacagttgttgaagtgcctaatgtctcatgggaagatattggaggtcttgaaaatgtcaaaagagagcttcaagagactgttcaatacccagtggagcatccggagaagttcgagaaatttggtatgtcaccttcaaaaggtgttcttttctatggtcctccaggatgtgggaaaactcttcttgccaaggcaattgcaaatgagtgtcaagccaatttcattagtatcaaaggacctgagctgcttaccatgtggtttggagagagtgaggccaatgtccgtgaaatttttgacaaggctagacaatctgcaccctgtgtcctcttctttgatgagctcgactctattgccactcagaggggaagcagtagtggtgatgctggtggagcagctgatcgggttctgaaccaacttctgactgaaatggatggcatgaatgcaaagaaaacagtttttattattggggccacaaacaggcctgatattattgaccctgcacttctgcgacctggtcgacttgaccagttaatttatatcccactgcccgatgaagactcacgccatcagattttcaaggcatgtcttagaaaatctcccctatcaaaagatattgatttgagagctcttgccaagtatactcagggatttagtggagctgatatcactgagatctgtcaacgggcatgcaaatatgccataagagagaacattgagaaagatatagaaaaggaaaagaggcgagcagagaatcctgattctatggatgaggatgctgatgatgagatatcagagattaagcctgctcattttgaggagtccatgaagtatgcacgacgaagtgtgagtgatgccgatattcgtaaataccaggcatttgctcagaccttacagcaatctcgaggttttggaactgaatttcggttttctgagaccagtggtggggctgctgcatctgaccccttcacaacttctaatgctggagctgatgatgatgacttgtatagctaaagttatggactatcctgttattttgctgcgacatttttcttttccgttgttgctatagagtttcctaaacaaaaatgtctttgaactattactttgattctggaagctgttggtttattttgcgcactctttaatgttgttatcttgaggtgttttgcgacattttaaagaaacctcaatagcttcgctaatacagtggaccttggttatttattctcttcttcacctttccccttttg

SEQ ID NO: 7312 - DNA, 2757 bp, Solanum lycopersicum
gataattcacttcttccatatccctttcttgcactcattgttctcttctcgagcaaaactccagtttctctcggctgctctaccctaatctagatctccgaagatgactaaccaggccgagtcatctgactcaaaaggtgcgaagaaggatttctctaccgcgattttggagaggaagaagtctcctaatcggcttgttgttgatgaggcggtcaacgatgataactctgttgttgcactgcaccctgctactatggagaagctacagctcttccgtggagatacaattctcatcaagggaaagaaaaggaaggatacagttgtcattgctcttgctgatgaaacatgtgatgagccaaagattaggatgaacaaggttgtccgttcaaatttgagggtccgtcttggagatgttgtgtctgtgcaccaatgcccagatgttaagtatgggaagcgtgtccacatacttcctatagatgatacaatagaaggtctcaccggggatttgtttgatgcgttcctgaaaccgtactttttggaagcatatcgtcctttgaggaaaggagacaattttcttgttagaggggggatgagaagtgtggaattcaaagtcattgagactgacccaggggagtattgtgttgttgccccagacactgaaatcttttgtgagggggagcctgttaaaagggaggatgaggagagactggacgaagttggctatgatgatgttggtggtgtgagaaaacagatggctcaaattcgtgaactggtggaactaccattgaggcatcctcaacttttcaaatccattggtgtgaaaccaccaaaggggattttactttatgggccccctggttctgggaagaccctgatagcaagagcagtggctaacgaaacaggtgcatttttcttttgcattaatggaccagaaatcatgtccaaattggctggtgagagtgaaagcaatctcaggaaggcattcgaagaggctgagaaaaatgctccatctattatattcattgatgagattgattcaattgctcccaagcgagagaagacacatggtgaagttgagagaaggattgtttcacagctcctgactctgatggatggactgaaatctcgtgctcatgtcatagttatgggagctaccaatcgtcctaatagcattgatcccgctctcagaaggtttggtaggtttgatcgggaaattgacattggtgttcctgatgaagttggacgtcttgaagttcttcgtattcataccaagaatatgaagcttgcagaagaagttgatttggaaagaatatcaaaagatacacatggttatgtcggtgcagatcttgctgctctttgcactgaagctgcacttcagtgcattagagagaaaatggatgtcattgatctggaagatgattccattgatgctgaaatattgaattcaatggctgtcacaaatgagcacttccaaactgctctaggaacaagcaatccatctgcattgcgtgaaacagttgttgaagtgcctaatgtatcatgggaagacattggaggccttgaaaatgtcaaaagagagcttcaagagactgttcaataccccgtggagcatccagagaagttcgagaaatttggtatgtcaccttcaaaaggtgttcttttctatggtcctccgggatgtgggaaaactcttcttgccaaggcaattgcaaatgagtgtcaagccaatttcattagtgtcaaaggacctgagctgcttaccatgtggtttggagagagtgaggccaatgtccgtgaaatttttgacaaggctagacaatctgcaccctgtgtcctcttctttgatgagcttgactctattgccactcagaggggaagcagtagtggtgatgctggtggagcagctgatcgggttctcaaccaacttctgactgaaatggatggcatgaatgcaaagaaaactgtttttattattggggccacaaacaggcctgatattattgaccctgcacttctgcgacccggtcgacttgaccagttaatttatatcccactgccagacgaagactcgcgccatcagattttcaaggcatgtcttagaaaatctcccctatcaaaagatattgatttgagagctcttgccaaatatactcagggatttagtggagccgatatcactgagatctgtcaacgggcctgcaaatatgccataagggagaatattgagaaagatatagaaaaggaaaagaggcgagcagagaatcctgattctatggatgaggatgctgatgatgagatatcagagatcaagcctgctcattttgaggagtccatgaagtatgcacgacgaagtgtgagtgatgccgatattcgtaaataccaggcatttgctcagaccttacagcaatctcgaggttttggaacggaatttcggttttctgagaccagtggtggagctgctgcatctgatcccttcacaacttctaatgctggagccgatgatgatgacctgtatagctaaagttatggactatcctgttattttgctgcgacttctttcttttccgttgttgctagcgctatatagagtttcctaaacaatttacttatttgtttctggaagctgtaatgctactcgtccaactgttggtttattttgctcgctctttaatgttgttatcttgaggtgttctatgacattttaaagaaacctcaatagctttgctaatatagtggaccttggtaatttattctctt

SEQ ID NO: 7313 - DNA, 2959 bp, Gossypium hirsutum
aggccgaagttcgaaaaatcgaaaagcaaagaaggagagttgcaatctgactaaaacaaccttatctttccaaacaagaaaacggagcagccttttaattctccttataataacccaccgcttttcttcacatccacatacatattccaccaaaccccaaagcttattcttatttttcggttctttaatcgacccaaattcaccatgtctaaccaagcagaatcatctgactcgaaggggactaagaaggattttagtactgcgatcttggaaagaaagaaggcaccgaaccgacttgttgttgatgaggcaatcaacgatgataactctgttgttgctcttcatcctgataccatggaaaagcttcagctttttcgcggtgacactatcctgatcaaggggaaaaagaggaaagataccatttgcattgctcttgctgatgacgcatgcgatgagccaaagatcaggatgaataaggttgtgaggtcaaacttgagggttaggctaggtgatgttgtctctgtgcatcagtgtcctgatgtcaagtatggaaaacgtgtgcacatcttgcccgtggatgacacaattgaaggggttactggaaatctctttgatgcttacctgaaaccttactttctggaagcataccgtccagtgaggaagggtgacctcttccttgtgagaggtggaatgagaagtgtggaattcaaggttattgagactgaccctcctgagtactgtgtggttgcaccagatactgagatattctgcgagggagagcctgtaaggagagaagatgagaatagattagatgaggtaggttatgatgatgttggtggagtgagaaaacagatggctcagattcgggaattagtggaacttccactgaggcatccacagctctttaaatcaattggtgtgaagccacccaaaggaattttgctttatggacctcccggatctggaaagactttgattgcacgtgctgttgcaaatgaaactggtgctttctttttttgcatcaatggtcctgagatcatgtcaaaattggctggagagagtgaaagcaatctcagaaaagcatttgaagaagcagagaagaatgcaccgtctattatattcattgatgaaatcgattcaattgctcccaagcgagagaagacccatggtgaagttgagaggagaatagtctctcagcttttgacattgatggatgggcttaaatcccgtgcacatgtcattgttattggggccacaaatcgtcccaatagcattgatccagctctccgaaggtttggaaggtttgatagggagattgatattggcgtacctgatgaagttggccgtcttgaggtgcttcgcatccacacaaagaacatgaagctgtctgacgatgttgatttagaaagaattgccaaggacacacatggttatgttggtgctgatcttgcagctctttgtactgaggcagcattacagtgcatcagggaaaagatggatgtgattgacttggaagatgagtcaatagatgcggagatactcaactctatggcagttagcaatgagcacttccagactgctcttggaacaagcaatccatcagcattacgtgaaactgttgttgaagtgcctaatgtaagttgggaagatattggaggcctggagaatgttaaaagagagcttcaagagactgttcaatatccagtggagcatcctgagaagtttgagaagtttggtatgtcaccctcaaagggagtattgttctatggccctccaggatgtggtaaaacacttctggccaaagctattgccaatgaatgtcaggcaaacttcattagtgtcaagggtccagaattactcacaatgtggtttggagagagtgaagctaatgtacgtgaaatttttgacaaggctcgccagtctgctccttgtgtcctcttctttgatgaacttgattcaattgcaacccagagaggaagcagtgtaggtgatgcagggggtgctgctgatagggttctgaatcaacttcttactgagatggatggcatgtctgccaagaaaacagtttttataattggagctaccaaccgacctgacattattgatcctgcccttttgcgaccaggtcgtcttgatcagttgatttacattcccctccctgatgaggattctcgccatcagatctttaaggcttgcttgaggaaatcaccagttgcgaaagaggttgacctcagagctcttgccaagtatactcaaggttttagtggggctgatattactgaaatttgtcagcgcgcatgtaaatatgccatcagagagaacattgaaaaggatattgagagagaaaggaggagagcggagaaccctgaagctatggaggaagatgtggaggatgaagtggcagaaatcaagcctgctcattttgaggaatcaatgaagtttgctcgtaggagtgtgagtgatgccgacatccgcaaataccaggcatttgctcaaacgctgcagcagtcaaggggatttggaagtgagtttaggttcgctgaaactggtgcaaggcctgcagcatctgacccttttgcagcttctgctggaggagccgatgaagatgacctctacagttaagatcatctctgtctgtgtcttaagttatggtgacaaaagcagaccctttttttttttaatatagtgtagtattaaatttgactggatggatgtagaagctccttggcacaacctttcagcaggagaaaggggggggggggctgcccctgggagttcataaaatactgtgtttttcctttattttgggatttaaagattttacaagattaaatttctgtgtcccttttggattatttttatgtttgtgcgtgtggtatatgaaatatgaatgacaaccaaataagtccttgccttgagcttcaccaccaaaaaaaaaaacaaaatagagacacgacaa

SEQ ID NO: 7314 - DNA, 5128 bp, Gossypium hirsutum
aggtgtatgacaaagtggttgaaaaggtcttcagatggttcagctaaattaagggtatttttgttttcggcttcggagctcgatccttctggtttggttcaatttggggatttaaatgacaatgggcagaaatatgttgaggcagtgaatggaattgtggaaggagcttcttgtggcttcacacggaaggagagcatggcaagtcttgcttcaacacggaattctgatgttagtgggactgaggctgttgatagcattggtgctggtcaggttgatgctggggggccgccaccgtcaaacatcttgtcaccaggagggaattcagctacttctcatgatactggtccaaaaatgatggctccggatcctaatcctgttgctgcttatccagatgcttctgctgttcatttaggaattccagtggttaaatctgttcctccacaaacattgtcttctcaacctgaggttgagttagagaggtcgatgcccctcacttcggcaccgcagcaagtgagatatgattcaccgctacactatgcatctacatatattgatcctcgccatgatgttatgaaccgttctgattatgtgcatcttgcacctcaaatggggtactcaagtccccagttggtgggcaatactgattctgtattcaaccaacagcatttttgtgacaatgctaccgctcatcagttcattcctgctttgcacatgacaatgactccctccgcttcccatgctggtattagaccagcagtggttcagccactgttgcaacccaacaaattccattggagagtcatcctggtgaaagtgcttttggtacaaagatagttcagcttcctgttgaacggaaccagaatgtttatcaagcccagattccatctgcaatggttggaggaggttatgcctggcatcgtattccacaaactgagcatgttctcttgtcagatggatccttgcctcagcaccaagcaagtactcctgagaagatctcaaggcttgaagactgctgtatgtgtcagaaggcattgcctcatgcacattctgatcctttggtaaaggatacaagaaatagcagtggaacacttctggttaatacgaattcaacttatcatagtctgcgtcctgaagatggtatgaaaatttcaccagtaaacagggttgtggtatctggagcattaggggatggcattgctgaacaaggagctgggtttcgacagcttggtcatgttgatcatcaagttggaggacttcattcagaggcagttggattctctcaaggtcttgatgcacaaaatgaatgtagaactgataattccgatcatcctagaattccagcaagtcagggtttaatgggtatggcaggtgaattacaatcacagtatgttttgccgactcaataccagcttaaacaggatgttccacaacctggggcaattggcattcaagcttctgaacagcaagtgcctgaagcctccagagaatatcatggcaatattcctgctgtctccaaaatggatattgtagaccctaaccgtctgatcccaattaatgggatgatggatgctcttcggataagcaatgagcagggtaattcacctgtttacaaaaccagaaaagatgtcttggatgagagatctccacaaatagcagggagagagttgcctttggataatatctttaacaaaccaatagactccagtgagatggttattttggataatgtagtgacacattcacaacccaaagttggagctcaaaacttggattcccttgaagttcaatatgggaaccctccattttctggtcttcaatcggcacataaattggatgacgtttcatggactcagcagaagattgtactaaatgacactgaagctgctcctttgaatgctaatacccgatcttctttttcaccatctaatagaggtggtgatgtcttggattcctcagattcactctttagcaatcaagatccttggaatttacggcaagatgctcaatttcctcctcctagacctaacaaaattcaaacacagagagaagggttacctaccagagacccttttggagagaaccaggcagtgattagtggggaatctaaagcccaattggaagatgatgtttaccagccattaaaccatttaaacaaggatttcatttcagaccaaaaacagtccacaaaagctgaggaactcatcaagaaagaattacaagctgtagctgagggagtagctgcttctgttttccagtcatctaccccttccactcctgacataccagcagcaactgatgcatctggttttgagggcaatcaagagatagatggttcaactagaaacatggaaatgcaacataaagctaagtttgaggaaatcaagaccaaacaaccaaacgaatttgttcttgtttcgtgactatttcatcaaccataagccatgtctaaccaagctgagtcctctgactcgaagggggctaagaaggattttagtacggcgatcttggaaagaaagaaggcagcaaatcgactcgttgttgatgaggcaatcaacgatgataactctgttgtttctcttcatcctgataccatggaaaagcttcagctgtttcgcggtgacactattctcatcaagggaaagaagaggaaagatactatctgcattgctctggcagatgacacatgtgatgaacctaagatcaggatgaataaggttgttaggtcaaacttgagagttaggcttggtgatgttgtctctgtgcatcagtgtccagatgttaagtatggaaaacgtgtgcacatcttgcctgtggatgacacaattgaaggggttactggaaatctctttgatgcttacctgaaaccttactttctggaagcataccgcccagtgaggaagggtgatctcttccttgtgagagggggaatgagaagtgtagaattcaaggttattgagactgaccctccagagtattgtgtggtcgcaccagacactgagatattctgtgaaggagagcctgttaagagggaggatgagaatagattagatgaggtgggttatgatgatgttggcggagtgagaaaacagatggctcagattcgggaactagtggagcttccattgaggcatccacagttatttaaatcaattggcgtgaagccacctaaaggaatcttgctttatggacctcctggatctggaaagactttgattgcccgtgcagttgcaaatgaaactggtgctttctttttttgcatcaacggtcctgagatcatgtcaaaattggccggggagagtgaaagcaatcttagaaaagcttttgaggaagcagagaagaatgcaccatctattatattcattgatgaaattgattcaattgctccgaagagagagaagacacatggtgaagttgagaggagaattgtctctcagctgttgacattgatggatggtcttaaatcccgtgcacatgttattgttattggggccacaaatcgtcccaatagcattgatcctgctcttagaaggtttggaagatttgatagggagattgatattggtgtccctgatgaagttggccgtcttgaggtgctccgtatccacaccaagaacacgaagctggctgaagatgttgatttagaaagaatttccaaggagacacatggctatgttggtgctgatctcgcagctctctgtacggaggcagcattacagtgcatcagggaaaagatggatgtgattgacttggaagatgagacaatagatgctgagatactcaactctatggcagtctcaaatgagcacttccagactgctcttggaacaagcaatccatcagccctgcgtgaaactgttgttgaagtacctaatgtcagttgggaagatattggaggcctcgagaatgttaaaagggagcttcaagagactgttcaatatcctgtggagcatcctgaaaagtttgagaagttcgggatgtcaccctcaaagggagtactattctatggccctccaggatgtgggaaaacccttctggccaaagctattgccaatgagtgtcaggcaaacttcatcagtgtcaagggtccagaattactaacaatgtggttcggagagagtgaggccaatgtgcgggaaatttttgacaaggctcgccagtctgctccttgtgtcctgttctttgatgaacttgattcaattgctacccagagaggaagcagcgtgggtgatgcagggggtgctgctgatagggttttgaaccaacttcttactgagatggatggcatgtctgcgaagaaaactgttttcatcattggagccaccaaccgacctgatattatagatccagcacttctgcgtccaggtcgtcttgatcagttgatctatattcctctccctgacgaggattctcgccatcagatttttaaggcttgcttgaggaaatcaccaattgcaaaagaggttgacctcagagctcttgccagatatactcaagggtttagtggggctgatatcacagaaatttgccaacgagcatgtaaatatgccataagagaaaacattgaaaaggatattgagagagaaaggagaagaagtgagaaccctgaagctatggaggaagatgttgaggatgaagtggcagaaatcaagcctgcacattttgaggaatcaatgaagtttgctcgtaggagtgtgagcgatgctgacatccgcaaatatcaagcatttgctcaaacattgcagcagtcgaggggatttggaagtgaatttaggttcgctgaaactggttccaggactgcagcctctgatccttttgctgctgctgctggaggagctgatgaagatgacctttacagttaaattacccgtcatctatgttttccctaattcatggttgacaatttatcttctatctatatacgtagtaggtaattaagttgactgtatgatttaaaacagtaaaaggcacaagtgtttatcctggttgcccccctttggagttcaaggaaacactttttgttatccatttgatttacaacagtggagggaatgggaatggggaaatcggccccatttataaattatattataaattgcaaaaaaaaaaagaaaagaagtaaccgactgcg

SEQ ID NO: 7315 - DNA, 2634 bp, Manihot esculenta
tacgatgtctcaccaagcggaatcttctgattcgaaatcggcgaagaaagacttctcgacggccattttggagcggaagaagtctcctaatcggctgatcgttgatgaggctgttaacgatgacaattccgtcgtttcgatgcattcggagaccatggagaagctccagcttttccgcggtgataccattcttatcaagggaaagaaacggaaggatacaatctgcattgctcttgctgatgacacctgtgagccgcccaaaatcaggatgaataaggtcgttagatctaacctgagggttcgacttggagatgttgtatctgtgcaccaatgcccagatgttaagtatggaaagcgtgtccacatactgcccattgatgataccatagaaggtgtcactgggaatctgtttgatgcatacctgaaaccttatttcttggaggcatatcgcccagtgaggaaaggggatcttttccttgttagaggagggatgagaagtgtagagttcaaggtcatagaaactgatccaggagaatattgtgtggtcgcgccagatactgagattttctgcgagggggaacctgtgagaagggaggatgaggacaggctagatgaagtgggatatgatgatgttggtggtgttaggaagcagatggctcagatacgtgagttagtggagctgccgttgaggcatcctcaacttttcaaatcaattggtgtgaagccaccaaaaggaattttgctatatgggcccccaggttcaggaaagacattgatagctcgagctgttgctaatgaaactggtgcatttttcttctgtatcaatggtcctgagataatgtccaagttggctggagagagtgaaagcaatctgaggaaggcatttgaagaagctgaaaagaatgctccatccatcatctttattgatgagcttgattcaattgctcccaagcgtgagaagactcatggtgaagttgaaagacggattgtctcacagcttttaactcttatggatgggctcaaatctagggcacatgtcattgtgattggtgccactaatcgtccaaacagtattgacccagctttgagaaggtttggaaggtttgatagggaaatagacattggtgtccctgatgaaattgggcgccttgaagttctacgaatccatacaaagaatatgaaactctctgacgaggcgagttgatctggaaaggattgcaaaagatacccatggctatgttggcgctgaccttgctgccctatgtactgaagctgcactccaatgcatcagagagaagatggatgtgattgacttagaagatgattctattgatgctgagatacttaattccatggcagttacaaatgagcacttccaaactgcccttggaacgagcaacccatctgctttacgcgaaactgttgtcgaagtgcccaatgttagctgggaggacattggtggtcttgagaacgttaaacgggagcttcaggagactgttcaatatcctgttgagcatccagagaagtttgagaagtttggcatgtcaccttcaaaaggtgtcctcttctatggcccacctggatgtggaaaaaccctactggctaaagcaattgcgaatgaatgtcaggcaaacttcataagcgtcaagggtcctgaattactaaccatgtggtttggtgagagcgaagccaatgttagagaaatttttgacaaggcccgacaatctgcaccatgtgtccttttctttgatgagcttgactctattgctactcagaggggaagcagcgttggtgatgctggtggtgcagctgatcgagtactgaaccaacttctcactgaaatggatggcatgtcggcaaagaagactgttttcataataggggccaccaacagacccgacattattgacccagcactcttgcgtcctggccgacttgatcagttgatttatattcctcttccagatgaagattcacgccatcaaatcttcaaagcctgtctgaggaaatcacctgtctcgaaagatgttgatttgagggccttggccaagtatactcaaggattcagtggagctgatattactgaaatttgtcagcgggcatgcaaatatgccataagggagaatatagagaaggatattgagaaagagaagaggagaagtgagaatccagaggcaatggatgaggatgttgaggatgaggtggctgagatcaaagccgctcattttgaggagtcgatgaaatttgctcgcaggagtgtaagtgatgctgacattcgtaaatatcaagcatttgcgcagacattgcagcaatctaggggatttgggacagaatttaggttttcagaaacaaggagcagtggtgcaacatctgatcctttcacaacaccagctggtggggctgatgatgatgatctctatggttaggttttctatctactcaaacacttttcctttgccagaatacatgacatttgtagcttttggttaaagaccggcaattagttactgggtagaagagtagcagctgttaaaaattttgctttcttgtaatatggaatttagtgtttcactgttcacgctcatgtctcttttaattttctctctcttttttttaaatgtttggaaaggtagg

SEQ ID NO: 7316 - DNA, 2658 bp, Valeriana officinalis
aagttcatcgtattcgattcttcaaacatgagtaatcctccagcaccggcaacacagcctgaatcttcagactctaagggaacgaagagagacttcagtactgctattctggagcggaaaaaggctgcgaatcggcttgttgttgatgaagcgattaatgatgataattctgttgtttcgcttcatcctgagacgatggagaagcttcagctgtttcgtggtgatacgatcttgatcaagggaaagaagagaaaggatactatctgcattgcacttgctgatgatacttgtgatgaaccgaaaattaggatgaacaaggttgtaaggtctaacctgagggtcagacttggagatgtgatctctgttcatcaatgtcctgatgtcaaatacggcaaacgtgttcacattcttcctattgacgattcagtggagggagtttctggaaatatctttgatgcgtatttgaaaccttattttgttgaggcttaccgtccattgagaaagggagatcttttcctcgtaaggggaggaatgaggagtgtagagtttaaagttattgaaactgatccagctgagtactgtgttgttgctccggatactgaaattttctgtgaaggagaacctgtaagacgtgaggacgaagatagattggacgaagttggttacgatgatgttggtggtgtccgcaagcagatggctcaaatccgtgagcttgtcgaactaccgctaagacacccacagcttttcaaatctatcggtgtgaagccaccaaaggggatcttgctttacgggccacctggttctggaaaaaccctaatcgcccgtgctgttgctaatgaaactggagctttctttttctgcataaatgggcctgaaattatgtcgaagttggctggagagagtgaaagtaatctgaggaaagctttcgaggaggcagagaagaatgcaccatcaatcatttttatcgatgagatcgattcgattgccccaaaaagagagaaaactaacggtgaagttgagaggagaattgtttcacagcttttgactctcatggacggtcttaaatcgcgtgcacacgttatcgtaatgggtgctactaatagacctaatagcattgaccctgctcttaggaggtttggcaggtttgatagggaaattgatatcggtgttcctgatgagattggccgtcttgaggttcttcgtattcatacaaagaacatgaagctcgccgaggatgttgacttggagaaaatttcaaaggagacacatggatacgttggtgccgacttagcagctttgtgcactgaagctgcacttcagtgtattagagagaaaatggatgtgatcgacttggaagatgactccattgatgcagagatcttaaactccatggctgtttcaaacgaacacttctcaactgctctcggaaccagcaatccttcagctcttcgtgaaacagttgttgaagttcctaatgtcagctgggaagacattggaggtcttgagaatgtcaagagagagcttcaagagacggtacaataccctgttgagcatccagagaagtttgagaaattcggtatgtctccgtcaaagggagttcttttctatggcccacctggatgtggtaaaaccctacttgcaaaagcaatcgcaaatgaatgtcaagccaatttcatcagcatcaagggtcctgaattgctcacgatgtggttcggagaaagtgaagccaatgtccgagaaattttcgacaaagctagaggctcagctccttgtgtcctcttttttgatgaactcgattctattgctactcagagaggaagcagtcacggagatgcaggtggtgctgccgatagggttttgaaccagcttttgaccgaaatggacggaatgtcggcgaagaagactgttttcattattggagctacgaacaggcctgacatcatcgatcctgctctattgcgtcctggtcgtctagatcagttgatctatattcctctcccagacgaagagtcgagattaaacatcttcaaatcttgcttgaggaaatcccctgtttctaaagatgtcgacctaaaagcgctagccaagtacactcaaggattcagtggtgcagatattaccgagatctgtcagcgtgcctgcaagtacgccattagagagaacatcgagaaagatatcgagaaagagaagaggagaagcgagaatccggaagcgatggaggaagataatatcgatgacgaggtgtcagaaatcaaggctgcacatttcgaggagtcgatgaagtacgcaaggaggagtgtgagtgatgctgacatcagaaagtatcaggcttttgcgcagactctgcagcagtctagaggattcgggtcggagttcagattcccagagacaagtggcggtgcaggtggtggtgcagctgatactgccgatccttttgccgcttctgctggcggtgctgcagatgaagatgacctgtatagttaggttatctatttatatgttgtcttttgctctatttgatgggttttattattatgatcatgtacaatttcaaagtggtggtggtgaatgttgtggaactccacaggatttaattttaattttagttttgtgtacgactttcttaaatatttatcttaaataacttttgaggaaaaa

SEQ ID NO: 7317 - DNA, 2793 bp, Populus trichocarpa
aagaaacgaagactctctataaataccgaaacacccatctctttagatcccaaaattaattttcgaaaaaagaggtatctgagttctgattagtctctcaacaaaaactctgggccatgtctaaccaagctgaagctgaatcctccgactctaagggaacaaagagggattttagtactgcgattctggagagaaagaaggctccgaatcggcttgttgttgatgaggctgtaaacgatgataactctgtcgtttcgcttcatcccgagaccatggagaagctccagctctttcggggtgacaccatcttaatcaagggaaagaaaaggaaagatactatttgtattgccctcgctgatgactcatgcgatgaaccaaagatcaggatgaacaaggttgtgaggtcgaacctgagggttaggcttggagatgtggtgtctgtgcaccagtgtcctgatgtcaagtatggaaaacgtgtgcacatcctgcccatagatgacacaattgaaggggtcactggaaatctctttgatgcctacttgaagccttatttcctggaggcatatcgcccagtgaggaagggtgatctcttccttgtaagagggggaatgagaagtgtggagttcaaagttattgaaactgatccaccggagtactgtgtggttgctccagacactgagatcttctgtgagggagagcctgtgttaagggaggatgagaatagattagatgaagttggttatgatgatgttggtggtgttagaaaacaaatggctcagattcgggagttagtggagcttccattgagacacccacaactattcaaatcaattggtgtgaaaccaccgaaaggtattctgctgtatggacctcctggttctgggaagactcttattgcccgagcagttgctaatgaaactggtgctttcttcttctgtattaatggacctgaaatcatgtcaaaattggctggagagagtgagagcaatctcagaaaagcgtttgaggaagcagagaagaatgcaccttcgattatatttatcgatgaaattgattcgattgctccaaagcgagagaagacaaacggagaggttgagaggaggattgtatcccagctcttgacactcatggatggactaaaatcccgggcacatgttattgtcatgggggctacaaatcgacccaatagcattgaccctgctctgaggaggtttgggagattcgatagggaaatcgatatcggtgttccagatgaagttgggcgccttgaggttcttcgtattcatactaagaacatgaggcttgctgaagatgttgatttggaaagaattgccaaggatacccatggttatgttggtgctgatttagcagcactttgcactgaggctgcacttcaatgcatcagagaaaagatggatgtgattgatttggaagatgagacaatagatgctgagatactcaactccatggcagtgactgacgaacacttcaagactgctcttggaacaagcaacccatctgctttgcgtgaaacagttgtcgaagttcctaatgttagttgggaagatattggtggtctcgagactgttaagagagagctgcaggagactgttcaatatccagtggagcacccagagaaatttgagaagtttggaatgtcaccatcaaagggagttctgttctacggtcctcctggatgtgggaaaactcttctggctaaagctattgccaatgaatgccaggcaaacttcatcagtatcaagggtcctgaattgcttacaatgtggtttggtgagagtgaggccaatgtacgagaaatttttgacaaagctcgccaatctgctccttgtgtcttgttctttgatgaacttgactcaattgcaactcagagaggaagcagtgtgggagatgcggggggtgctgctgatagagttttgaaccagcttctgacagagatggatggcatgtctgcaaagaaaactgttttcataattggggcaactaacagacctgacatcatagaccctgccttattgcgtccagggcgtcttgatcagttaatctatatccctcttcctgacgaggagtctcgctttcaaattttcaaatcttgcttgaggaaatcaccagtctctaaagatgttgacctcacagcacttgccaagtatacacagggtttcagtggtgctgatattacagaaatatgccagcgtgcctgcaaatatgccataagagagaacattgagaaagatatcgagagggagaggaggcgaagcgagaaccctgaggctatggaggaagatgttgaggatgaggtgtctgagatcaaggcatcacattttgaggaatccatgaaatatgcccgtcggagtgttagtgatgctgacatccgcaagtatcaggcgtttgctcaaacactgcaacagtcaagagggtttggatctgaattcaggtttgctgaagctagcgccggggcaactggatccgatccgtttgcagcttctgctggcggggctgatgaagatgacctttatagctaagttatcttaaaattgcatgtcttgtagatttgggccctaatatgtgtattaggttaaatcgatgtatgtttacttaaagttccttcggatttttttattgggtccaagttggccttgtgcctcggtcaattgaagatttcttttcggccctttcaagtcaaatgaactttttatcttgttttgtaagattataattggcaaccatctgaaattaaagttacatctcaatggcaaattgattttccaatttatc

SEQ ID NO: 7318 - DNA, 2694 bp, Flaveria ramosissima
ctcacaaaccacccaaaatcctcaattcttcgatctaaactcaagaatccatcaacctttttcagcatcatgagcaatcaacccgaatcttccgattctaagggcactaagcgcgactacagtacggcgattctggaacgaaagaaggctgcgaacagactcgttgttgatgaagctattaacgatgataactctgttgtggccctacatccggagacgatggagaagcttcagctcttcagaggagacactattttgattaagggaaagaaacgaaaagacactatttgtatagcacttgctgatgacacgtgtgaagagcccaaaattagaatgaacaaggttgtgagggctaacctgcgggtcaggcttggtgatgtggtctctgttcatcaatgccctgatgtcaaatatggcaaaagggttcatatccttccagttgatgatacaattgaaggcgttactggcaatctctttgatgcatatttaaaaccatattttctggaagcatatcgtcctgtaaggaaaggcgactttttcctcgtgaggggagggatgcggtctgttgaatttaaagttattgaaactgatcctgctgaatattgtgtagttgcacccgatactgagatcttctgtgaaggtgagcctgttagaagggaggatgaagatcgattagatgaaatcggttatgatgatgtgggtggagtccgcaaacagatggcacaaatccgtgagctggtagagttgccattaagacatccacagcttttcaagtcaatcggggtcaaaccacctaaaggaattcttctttacgggcctcctggttcaggaaagactttgatagcccgggctgttgcaaatgaaacaggtgcttttttttttgtataaacgggccagaaatcatgtcaaagttggctggagaaagtgagagtaatcttagaaaagcttttgaggaagccgagaaaaatgctccatcgattattttcatcgatgaaatcgattcgattgctcccaaacgagaaaaaacaaatggagaagttgaaagaagaattgtctcacagctgctgactctaatggatgggctgaaatcacgggcccatgttattgttatgggtgcaaccaaccgtcccaacagcattgacccagcccttaggaggtttggcaggtttgacagggaaattgatatcggtgttcctgatgaagtgggcaggcttgaggtgctccgcattcataccaagaatatgaagctggctgatgatgtggacttggaaaagatttccaaggagacacatggatatgtaggggctgacctggcggctttgtgtactgagtctgcactacaatgtattcgtgagaagatggatgtgattgatttggaagacgagtcaattgatgttgagattcttaattcaatggcagttacaaacgagcatttccaaactgcccttggtacaagtaacccatctgctcttcgtgaaactgttgttgaagttcctaatgtcagctgggaagatattggtgggcttgaaaatgttaaaagagagctccaagagactgtccaatatccagtcgaacatcctgaaaaattcgagaaattcggcatgtcaccatctaaaggagttctgttttacggcccacctgggtgtggcaaaacacttctagctaaggctatagccaatgaatgccaagctaacttcatcagcatcaagggtcctgaattgctaaccatgtggtttggtgaaagtgaagctaatgttcgtgagatctttgataaggcccgtggatccgccccttgtgtcttattttttgatgagctggactccattgctactcagagagggagtagtcaaggagatgcaggaggtgcagctgatagggttttgaatcagcttttgactgaaatggacgggatgtcagctaaaaagacggttttcataatcggtgcaactaaccggcctgatatcatagatccagcccttttgaggcctggtcgtcttgatcagctgatttacattcctctccctgatgaggagtcgcgctatcagattttcaaatcagctttaaggaagtcacctgttgcaaaagacgttgaccttcacgcacttgctaaatacactcagggattcagtggtgctgacatcactgaaatctgccagcgtgcatgtaaatacgccattcgtgagaacattgaaaaggatattgagagggagaagagaagaagtgagaacccggaggctatggaggaggacgtggaagatgaggtggcggagattaaggcggcacactttgaagaatcaatgaagtttgcacgaagaagtgttagtgatgctgacatacgcaaataccaggcgtttgctcagacccttcagcagtctagagggtttgggtctgagtttaggttctctgagactagcggtgcagccgctggtgctggtggctcagacccttttgctgcttctgctggtgcagcggatgatgatgatttgtataactagtctttttttttataaacatatgcagatcacgcattctcagttgttaaaacactgctgtcttgaactttttgaattctatgtaaacgtcattacttttttgatttacagtaccttgttccctcttgtttgtgtccttgatacttgattaggacgggtaattatttctagtaaattggttagaaattagtaggataggaaa

SEQ ID NO: 7319 - DNA, 2733 bp, Ambrosia trifida
taacaagaaaggattcatatggtttcactatatatcctcacaacccccttaccctaaccctcacaaatcaatccccaaattaatctctcaaacaattcttcgatccaacactcaatcgtcttcttcaaaccatgagtaatcaacccgaatcatctgactctaagggtacaaagcgtgactttagtacagcgattcttgaaagaaagaaggctgcaaacagacttgttgttgatgaggctattaatgatgataactctgttgtcgctctgcatcctgagaccatggaaaagcttcagctttttagaggagatactattctcatcaagggaaagaaacggaaagacactatttgtatcgctcttgctgatgatacttgtgaagagccaaagattagaatgaacaaggttgtcagggctaacctacgggtcaggctcggtgatgtggtctctgttcatcaatgccctgatgtcaagtatggcaaaagggtgcatatccttccagttgatgatacaattgaaggcgttactggcaatctctttgatgcgtatttaaaaccatactttttggaagcatacaggcccgtgaggaaaggcgacttcttcctcgtgaggggaggaatgcggtctgttgagtttaaagttattgaaactgatcctgcagaatactgtgtagttgcccccgatactgagatcttctgtgagggcgagcccattagaagggaggatgaagaccgtttggatgaaatcggttatgatgatgtcggtggggtccgcaaacagatggcacagatccgtgagttggtggagttgcctttaagacatccacagcttttcaagtcaattggggtcaagccaccaaagggaattcttctttacgggcctcctgggtcaggtaagactttgatagccagggctgttgcaaatgaaacgggtgctttcttcttctgtataaacgggcctgagatcatgtcaaagatggctggagaaagtgagagtaatctcaggaaagcttttgaggaagctgagaagaacgctccatcgattattttcatcgatgaaattgattcgattgctcccaaaagagataaaacaaatggagaagttgaaagaagaattgtctcgcagcttttgactctaatggacgggctgaaatcacgggctcatgttattgtcatgggtgctaccaaccgtcccaacagcattgaccctgccctgaggaggttcggcaggtttgaccgggaaattgatatcggtgttcctgatgaagtgggccggcttgaggtgctccgcattcataccaagaacatgaagctggctgaggatgtggacttggaaaagatttcaaaagagacacatggctatgtcggggctgatcttgctgctttgtgtactgagtcagcactccagtgtattcgtgagaagatggatgtgatcgatttggaagatgagtcgattgatgctgagattctcaactccatggcggttacaaatgagcactttcaaactgcccttggtacaagtaacccgtctgctcttcgtgaaactgttgttgaagttcctaatgttagttgggaagatattggtgggctcgaaaatgtcaaaagagagctccaagagactgtacaatatccagtcgaacaccctgaaaagttcgagaagtttggcatgtctccatctaaaggagttctgttttacgggccacctgggtgcggtaaaactcttctagccaaggctatagccaatgaatgccaagctaacttcatcagcatcaagggtccagaattgctaaccatgtggtttggtgaaagtgaagcaaatgttcgtgagattttcgacaaggcccgtggctccgccccttgtgtcttgttttttgatgagctggactccattgctacccagagagggagcagccaaggagatgcaggaggtgcagctgatagggttctcaatcaacttttgactgaaatggacgggatgtctgctaaaaagactgttttcattatcggtgcaaccaaccgtcctgacatcattgatccagctcttttgaggcctggtcgtcttgatcagttaatttacattcctctccctgatgaagagtcacgttattcgattttcaaatcagctttaaggaagtcacctgttgctaaggacgtcgatcttcatgcacttgctaaatacactcagggattcagcggtgctgacatcactgaaatctgccagcgtgcgtgtaaatacgcaatccgtgagaacattgagaaggatatcgagagggagaagagaaggagcgagaacccggaggctatggaggaggatgtggaagatgatgtgccggagatcaaggcggcacactttgaagaatcgatgaagtttgcacgaagaagtgttagtgatgctgacatccgcaagtaccaggcgtttgcacagaccctgcagcagtctagagggtttggttctgagtttaggttctctgagacgagcagtgcagctgctggtgctggtgggtcagacccttttgctgcttctgctggtgcagcggatgacgacgatttatacaactagctttaaagcacactactatcttttacgtttgtaatttatgtaaacttgatgcttttgttttacaagacttaatccccttgtttattgcgttggttattactctggatgaggtggagaacgcttccaaaatgtttcttgaatttatggattaacttcgtaaatttgtctttaaaaa

SEQ ID NO: 7320 - DNA, 2738 bp, Ambrosia trifida
taacaagaaaggattcatatggtttcactatatatcctcacaacccccttaccctaaccctcacaaatcaatccccaaattaatctctcaaacaattcttcgatccaacactcaatcgtcttcttcaaaccatgagtaatcaacccgaatcatctgactctaagggtacaaagcgtgactttagtacagcgattcttgaaagaaagaaggctgcaaacaggcttgttgttgatgaggctattaatgatgataactctgttgtcgctctgcatcctgagaccatggaaaagcttcagctttttagaggagatactattctcatcaagggaaagaaacggaaggacactatttgcatcgctcttgctgatgacacctgtgaagagccaaaaatcagaatgaacaaggttgtcagggctaacctgcgtgtccgtctaggtgatgtggtctctgttcatcaatgtcctgatgtcaagtatggcaaaagggtgcatatccttccagttgatgatacaattgaaggtgttactggcaatctctttgatgcgtatttaaaaccatactttttagaagcatacaggcccgtgaggaaaggtgacttcttcctcgtgaggggaggaatgcggtctgttgagtttaaagttattgaaactgatcctgcagaatactgtgtagttgcccctgatactgagatcttctgtgagggcgagcccattagaagggaggatgaagaccgtttggatgaaatcggttatgatgatgtcggtggagtccgcaaacagatggcacaaatccgtgagctggtggagttgcctttaagacatccacagcttttcaagtcaattggggtcaaaccaccgaagggaattcttctttacgggcctcctgggtcaggtaagactttgatagccagggctgttgcaaatgaaactggtgccttcttcttctgtataaacgggcctgaaatcatgtcaaagatggctggagaaagtgagagtaatctcaggaaagcttttgaggaagctgagaagaacgctccatcgattattttcatcgatgaaattgattcgattgctcccaaaagagataaaacaaatggagaagttgaaagaagaattgtctcgcagcttttgactctaatggacgggctgaaatcacgggctcatgttattgtcatgggtgcaaccaaccgtcccaacagcattgaccctgccctgaggagattcggcaggtttgaccgggaaattgatatcggtgttcctgatgaagtgggccggcttgaggtgctccgcattcataccaagaacatgaagctggctgaggatgtggacttggaaaagatttccaaagagacacatggatatgtcggggctgatctggctgctttgtgtactgagtcagcactccagtgtattcgtgagaagatggatgttatcgatttggaagatgagtcgattgatgctgagattcttaactccatggcggttacaaatgagcacttccaaactgcccttggtacaagtaacccgtctgctcttcgtgaaactgttgttgaagttcctaatgttagttgggaagatattggtgggcttgaaaatgttaaaagagagctccaagagaccgtacaatatccagtcgaacaccctgaaaagttcgagaagtttggcatgtcaccatctaaaggagttctgttttacgggccacctgggtgcggtaaaactcttctagctaaggctatagccaatgaatgccaagctaacttcatcagcatcaagggtccagaattgctaaccatgtggtttggtgaaagtgaagctaatgttcgtgagatcttcgacaaggcccgtggctccgccccttgtgtcttgttttttgatgagctggactccattgctacccagagagggagcagccaaggagatgcaggaggtgcagctgatagggttctcaatcaacttttgactgaaatggacggaatgtctgctaaaaagactgttttcattatcggtgcaactaaccgtcctgacatcattgatccagctcttttgaggcctggtcgtcttgatcagttaatttacattcctctccctgatgaagagtcacgttattcgattttcaaatcagctttaaggaagtcacctgttgctaaggacgtcgatcttcacgcacttgctaaatacactcagggattcagcggtgctgacatcactgaaatctgccagcgtgcgtgtaaatacgcaatccgtgagaacattgagaaggatatcgagagggagaagagaaggagcgagaacccggaggctatggaggaggatgtggaagatgatgtgccggagatcaaggcggcacactttgaagaatcgatgaagtttgcacgaagaagtgttagtgatgctgacatccgcaagtaccaggcgtttgcacagaccctgcaacagtctagagggtttggttctgagtttaggttctctgagacgagcagtgcagctgctggtgccggtgggtcagacccttttgctgcttctgctggtgcagccgatgacgacgatttatacaactagctttaaagcacactactatcttttacgtttgtaatttatgtaaacttgatgcttttgttttacaagacttaatctccttgtttattgcgttggttattactctggatgaggtggaggacgcttccaaactgtttcttgaatttatggattaacttagtaaatttgtctttaaaaaagaaa

SEQ ID NO: 7321 - DNA, 2845 bp, Theobroma cacao
ttattcagatcccacatatcaaccaacccaagctaaccaaaccccgaaagcacttctctctttcgagtcttccgtcaaccaaacaccatgtctaaccaagcagaatcctccgactcgaaggggacaaagagagattttagtacggcgatcttggaaagaaagaaggcacccaatcgcctcgtcgttgatgaggcaatcaacgacgataactctgttgtttctctccatcctgataccatggaaaagctccagctgtttcgcggtgacactatcttgatcaagggaaagaagaggaaagatactatttgcattgctcttgcagacgacacatgtgatgaaccaaagatcagaatgaataaggttgtcaggtcaaacttgagggttaggcttggtgatgttgtctctgtgcatcagtgtccagatgttaagtatggcaaacgtgtccacatcttgcccgtggatgacacaattgaaggggttactggaaatctcttcgatgcttacctgaaaccttactttctggaagcataccgcccagtgaggaagggtgatctcttccttgtgagaggtggaatgagaagtgtagaattcaaggttattgagactgatcctcccgagtactgtgtggttgcaccagacactgagatattctgcgagggagaacctgtcaggagggaggatgaaaatagattagatgaggtaggttatgatgatgttggtggagtgagaaaacagatggctcagattcgggaattggtggagcttccattgaggcatccacagctctttaaatcaattggtgtgaagccgcctaaaggaattttgctttatgggcctcctggatctggaaagactttgattgcccgtgctgttgcaaatgaaactggtgctttctttttttgcatcaatggaccagagatcatgtctaaattggctggagagagtgaaagcaatctcagaaaagcatttgaggaagcagagaaaaatgcaccatctattatattcattgatgaaattgattcaattgctcccaagcgagagaagacccatggtgaagttgagaggaggattgtctctcagctgttgacattgatggatggacttaaatcccgtgcacatgttattgtcattggggccacaaatcgtcccaacagcattgatccggctctcagaaggtttgggagatttgatagggaaattgatattggcgtccctgatgaagttggccggcttgaggtgcttcgtatccacacaaagaacatgaagctggccgaagatgttgatttagaaaggattgctaaggacacccatggttatgttggtgctgaccttgcagctctctgtactgaggctgcattacagtgcattagggaaaagatggatgtgattgacttggaagatgagtcaatagatgcagagattctcaactctatggcagtctcaaatgagcacttccagactgctcttgggacaagcaatccatcagcactgcgggaaactgttgttgaagtgcccaatgtcagttgggaagatattggtggcctcgagaatgttaaaagggagcttcaagagactgttcaatatccagtggagcatcctgagaagtttgagaagtttgggatgtcaccctcaaagggagtactcttctatggccctccaggatgtgggaaaactcttctggccaaagctattgccaatgagtgtcaggcaaacttcattagtgtcaagggtccagaattacttaccatgtggtttggagaaagtgaggccaatgtacgtgaaatttttgacaaggctcgccaatctgctccttgtgtcctgttctttgatgaacttgattcaattgctacccagagaggaagcagtgtaggtgatgcagggggtgctgctgatagggttttgaaccaacttcttactgagatggatggcatgtctgccaaaaaaactgttttcatcattggagccaccaaccgacctgacattatagatcctgcacttctgcgaccaggtcgtcttgatcagttgatctatattcctctacctgatgaggattcccgccatcagatctttaaggcttgcttgaggaaatcaccagtagcaaaagaggtcgacctccgagctcttgccaaatatactcaaggctttagtggggcagatattacagaaatttgtcagcgtgcatgtaaatatgccataagggaaaacattgagaaggatatcgagagggaaaggagaagaagggataaccctgaagctatggaggaagatgttgaggatgatgtggcagaaatcaagcctgctcattttgaggaatcaatgaagtttgctcgcaggagtgtgagtgatgctgacatccgcaaatatcaagcttttgcgcaaacattgcagcagtcaaggggatttggaagtgaatttaggtttgctgaaactggttccagggctgctgcatctgatcctttcgcagcttcagctggaggagctgatgaggatgacctttacagttaaattaccatcatttgtggttgcctaatttatggtgactatttatctttatgtagtatctgttaaattgactgtatgatgtaaaagctccgtggcacaaccctttagccgaagggagcctggaggatgactcctggctacccattggagttgaagaaagagttttttgttattttggagttactatagacaaattgaaagcttttacaagatttaagctcaattcaggcatttggttcgttttatggttgtgtggcatgtctctatggtttttactttttcttttcctctaccctctataattagaatagcctgaggaaaatggtatttagtttttgaggtg

SEQ ID NO: 7322 - DNA, 2870 bp, Chelidonium majus
cctctttcttcttctccgtcgatcgggttacttcttctatatatcagctcctctgtttctcttatttattttctctctctagtttctctctcatcatctaagatgagtaaccaagctgaatcctcagactcaaaaggaacgaagagggatttcagcactgcaatattggaacgtaagaaggctgcaaatcggcttgttgttgatgaagcgatcaatgatgacaactcggtggtgtcgatgaaccctgagactatggaaaagctacagctcttccgtggggatacgatcctcatcaagggcaagaaaagaaaagacaccatctgcattgcgcttgctgatgacacatgtgatgagccaaagatcaggatgaataaagttgttcgatcgaacttgagggtcaggcttggtgacgttgtttctgtgcaccaatgtcctgatgtcaaatatgggaagagagtacacatactgcctgtagatgataccattgaaggtgttagtgggaatctgtttgatgcgtacttgaagccttacttcctggaggcatatcgtccagtgaggaaaggggacctgttccttgttagaggtggaatgagaagtgtggaatttaaagtcattgagaccgacccagcagagtactgtgtggttgccccagatactgaaatcttttgcgagggggagcctgtgagacgggaggatgaagataggttagatgaagtgggttatgatgatgtgggtggtgtccgaaagcagatggctcagattcgtgagttagtggaattgccacttagacatccacagctctttaaatcaattggtgtgaagccaccaaaaggaattttactctatggacctccaggttcagggaagacactgattgcccgtgctgttgccaatgaaactggtgctttctttttttgcattaatggaccagagatcatgtctaaattagcaggggagagtgaaagcaatcttcgaaaggcattcgaggaagctgagaagaatgcaccatcaataatctttatcgatgagatcgactcaattgctcccaaaagagagaagacaaatggtgaagttgagcgaaggattgtttcccagctcttgacacttatggatggtctaaaatctcgtgcccatgttattgttatgggcgctacaaacagaccaaacagcattgacccagctctgaggaggtttggtaggtttgaccgggaaattgacattggtgttccagatgaaattggacgtcttgaggttcttcggatccatactaagaacatgaagctctctgatgatgttgatttggaaagaattgcaaaggatactcatggttatgttggtgccgatcttgcggccctgtgtactgaagctgcattgcagtgcatcagagaaaaaatggatgtgatcgacttggaagatgaagaaattgatgctgagattctgaactccatggctgttacagatgagcacttcaagactgctctagggacaagcaacccctctgcactgcgtgaaacagttgttgaagtgcctaattgcagctgggaggacattgggggtcttgaaaatgtcaagagggagcttcaagagactgttcaatatccagtcgagcatcctgagaagttcgagaagtttggcatgtctccttcaaagggagttcttttctatggtccccctggatgtgggaaaaccctattggctaaggcaattgcaaatgaatgccaagcaaacttcatcagtatcaagggtcctgagctgctcacaatgtggtttggagagagtgaggctaatgtgcgagaaatttttgacaaggccaggggatctgcaccttgtgtcctcttctttgacgaacttgattccattgcaacacagagaggaagcagtgtaggtgatgcaggtggtgctgccgatagggtacttaaccagctcttgactgaaatggatggaatgtctgctaaaaagacggtcttcattattggtgctaccaacaggcctgatattattgatcctgcacttctgaggccaggacgtcttgatcagttgatctatattccattgcccgatgaggcttctcgccatcagattttcaaggcatgcctaaggaagtcacctatttcaaaagatgttgacttggcagccctcgccaagtatacccaaggatttagtggagcagatatcacagagatatgccagcgtgcttgcaagtatgccattagagagaatattgagaaagatattgaaagggagaggagaagaagtgagaatcccgaggcaatggaagaggatgttgaggatgaagtagctgagatcaaggctgctcattttgaggagtcaatgaagtatgccaggaggagtgtgagtgatgctgacatccgcaagtatcaggcctttgctcagactttgcagcagtcgaggggatttgggtctgagttcagattctctgaagcatcaacaggagcaggcaccactggtggctcagatccatttgcggcttctgctggcggtgccgatgaagacgacttgtacagttagttcttcaactcgcacctgttacctgttatgtcttttttacttcaccttttgtgtatttgttattatccctggacgtggagtgggacagtgggaagaggctatgggatgggattaattacaaaaagatcagtggggtcttccttctgattggtggttggtcttggctgacctagtaaaaaacttcattgtttattggctagaaccttgagaggattctgtttcaagaacctttgaaatccattggggtcatgccttgtttagaaagaaatacatgatgctccagtcattgaacttattttcggttcttgtgatggtaatatttatactcttctttactgctc

SEQ ID NO: 7323 - DNA, 2865 bp, Trigonella foenum-graecum
actctcagatctattaaccttcttctttctcttctctcaactttcacaaaatccgattactcaaccaaccactttcttcttcttccgctatggcgaatcaacctgaatcctccgatgctaagggaacgaaaagagatttcagcactgcgattctcgaacgcaaaaaagcgccgaatcgtttggttgttgacgaagccgttaacgatgacaactccgtcgtcgctcttcatcctgagaccatggaaaagcttcaactcttccgcggtgacactatcttaatcaagggtaagaaaagaaaagatactatctgtattgcacttgctgatgaaacatgtgaggaaccaaaaattagaatgaacaaggttgtgaggaacaatcttagggttaggcttggagatgttgtttcagtgcatcaatgtgctgatgtcaaatatggaaagcgagttcacattcttcctgtggatgatactattgaaggagttacagggaatctctttgatgcgtacttaaagccttatttcttggaggcatatcgaccagtgaggaagggtgatttcttccttgtgagaggtgggatgagaagtgtagaattcaaggttattgaaactgacccacatgagtactgtgttgtcgcccctgataccgagatcttctgtgaaggagaacctattaaaagggaagatgagaatcgcttagatgaggttggatatgatgacgttggtggtgtgagaaagcagatggcacagattagggaactggtggaactgcccttgaggcacccacaattgttcaagtctattggtgtcaagccaccaaaagggattctgttgtatggaccccctggatctggaaagactttaattgctcgagcagttgcaaatgaaacaggtgccttctttttctgcattaatggcccggagataatgtcgaaacttgccggtgagagtgaaagcaatctaaggaaggcatttgaggaagctgagaagaatgcaccatccatcatctttattgatgagatagattccatagctcctaagcgagagaaaactcatggtgaagtagagaggaggatcgtctcccaactcttgaccctcatggatggtcttaaatcacgtgcacatgtaattgttatgggagccacaaataggcccaatagcattgaccctgcacttaggaggtttggaaggtttgacagggagattgatatcggtgttccagatgaagttgggcgtcttgaggttcttcgaattcatacgaagaatatgaaacttgctgaagatgttgatttagaaaagatttctaaggacacacatggctatgttggtgctgatctagctgctttgtgtaccgaagcagcacttcaatgtatcagagaaaaaatggatgtgattgacttagaagatgagactattgatgctgaaatattgaactccatggcagtgtcaaacgagcattttgcaactgctcttggatcaagcaatccttctgctctccgtgaaacagttgttgaagtgcccaattgcagctgggaagatattggcggtcttgaaaatgttaagagggaactccaagagactgttcaatatccagtggaacaccctgaaaagtttgagaagtttggaatgtcgccttcaaagggagttcttttctatggtcctcctggctgtggtaaaacacttttggcaaaagctattgccaatgaatgccaggcaaacttcatcagtatcaaaggtcccgagctactaactatgtggtttggagaaagtgaggcaaacgtgagagaaatttttgacaaggctcgtggttctgctccatgtgtcctgttctttgatgaacttgactccatcgctactcagagaggtagtagtgtaggagatgctgggggtgctgctgacagggttttgaaccagctgctaacagaaatggatgggatgtcagccaagaaaactgtgttcatcattggcgccactaatcgaccagacattatagacccagctcttctgcgtccaggccgtctagaccagttgatttatatccccctcccagatgaagattcccgtcatcagatatttaaagcttgcttgagaaaatcccccatctcaaaagatgttgatattagagctcttgcgaagtacacccaaggctttagtggtgctgatattactgagatttgccagcgtgcttgcaagtatgccattcgagagaacattgagaaggatattgagaaagaaagaaggagaagcgagaaccctgaggctatggaagaggatgttgaagatgaagtagccgaaatcaaggcagctcattttgaggaatcaatgaagtatgcacgaaggagtgtaagtgatgccgacattcgcaagtaccaggccttcgcccaaacattgcagcaatccagagggtttggatctgagtttaggtttgcagattccagcaccagtggtgccgctgctgcaggtgcatctgatccatttacatctgctgctggagctgatgatgatgatctttacaattaggtcaaacttgtatgttcgtagttcatttaagaatgcccgtactgtcttatttatgtacctgtcattatggcttcctttggattatctcattgcttcttaaaagcatttgtttatatggcaagcataggtgcgagcctcttcaaaagttgggaaaaaaatatgttttcagttttttgtataacccgacagcttttgaagctttgctgctcgattctgaagcgctacatttcacatgaacaagattttacacagataacacatttgtttaaaaaaaattggatgttgaagtttttcctcttgcagttggtgccaagcgcgaaagatttctttctatgaaaaacaatttgct

SEQ ID NO: 7324 - DNA, 2709 bp, Gossypium hirsutum
atgtctaaccaagccgaatcctccgactcgaaggggactaagagggattttagtacggcaatcttggaaagaaagaaggctccgaatcgactcgttgtcgatgaggcaatcaacgatgataactccgttgtttctcttcattctgataccatggaaaaactccagctgtttcgcggtgacactatcctgatcaaggggaagaagaggaaggatactatctgcattgctcttgcagacgatacatgtgatgaaccaaagatcaggatgaacaaggttgtcaggtcaaacttgagggttaggcttggtgatgttgtctccgtgcaccagtgtcctgatgttaagtatggaaaacgtgtacacatattgcctgtggatgacacaattgaaggggttactggaaatctctttgatgcatacctgaaaccttactttcttgaagcataccggccggtgaggaagggtgatctcttccttgttagaggtggaatgagaagtgtagaattcaaagttatcgaaactgatcctccagagtactgtgttgtcgcaccagacactgagatattctgtgagggagagcctgtcaggagagaggatgagaatagattagatgaggtaggttatgatgatgttggtggagtgagaaaacagatggctcagatccgggaactagtggagcttccattgaggcatccacagctcttcaaatcgattggtgtgaagccacctaaaggaattttgctttatggacctcctgggtctggaaagactttgattgctcgtgctgttgcaaatgaaactggtgctttctttttctgcatcaatggtccggagataatgtcaaaattggctggagagagtgagagcaatctcaggaaagcatttgaggaagcagaaaagaatgcaccatctattatatttattgatgaaattgactcaattgcacccaagcgtgagaagacccatggtgaagttgaaaggaggattgtttctcagctattaacattaatggatgggcttaaatcccgtgcacatgttattgttattggagccacaaatcgtcccaatagcattgatccagctctcagaaggtttggaagatttgatagggagattgatattggcgttcctgatgaagtcggccgtcttgaggttcttcgtatccacacgaagaatatgaagttggctgaagaggttgatttagaaagaattgccaaggacacccatggttatgttggtgctgatcttgcagcactttgtactgaggcagcattacagtgcatcagggaaaagatggatgtgattgacttggaagatgagtcgatagatgcagagatactcaactctatggcagtctcaaatgaccacttccagactgctcttggaacaagcaatccgtcagcgctgcgcgaaactgttgttgaagtgcctaatgtcagttgggaagatattggtggccttgagaatgttaaaagagagcttcaagagactgttcaatatcctgtggagcatcctgagaagtttgagaagtttgggatgtcaccttcaaagggagtactattttatggccctccaggatgtggtaaaacacttttggctaaagctattgccaatgaatgtcaggcaaacttcattagtgtcaagggacctgaattgcttacaatgtggtttggtgagagtgaggctaatgtacgtgaaatttttgacaaggcacgccagtccgcaccttgtgtcctcttctttgatgaacttgattccattgctacccagagaggaagcagtgtaggtgatgcagggggggcagctgatagagttttgaaccaacttcttaccgagatggatggcatgtctgccaagaaaacagttttcatcattggagctaccaaccgacctgacattatagatccagcacttcttcgtccaggtcgtcttgatcagttgatctatattcctctccctgatgaggagtcacgccatcaaatcttcaaggcctgtttgaggaagtcaccgattgcaaaagatgttgatgtcagagctcttgccaaatatactcaaggctttagtggggcagacattacggaaatttgtcaacgtgcatgcaaatatgctataagagaaaacattgaaaaggatatcgagagagaaaggaggaggagtgagaatcctgaagccatggaagaagatgttgaagatgaagttgcagaaatcaagcctgcacattttgaagaatcgatgaagtttgctcgtaggagtgtgagtgatgcggatatccgcaagtaccaggcatttgcacaaacattgcagcaatcaaggggatttggaagtgaatttaggtttgctgaaactggttcaaggactgcagcatctgatccttttgcagcttctgctggtggagctgatgaagatgacctttacagttaaattacctttcatctgtgtttgcttatgggtctttcatataatatttacatataaacgtagtgttaattgaactgtatgatattaagaacacattggcacagatcttgagcctgtgggtgctcaatggagtttagaaaacaggttttgttattttggaattccaagtttttattttctactagagttaaattcaaattttacccttttcatcatataaatagaatttacaatatttagtgttcgaattcggattttggatattttaatacattattttaattcattttacgg

SEQ ID NO: 7325 - DNA, 2719 bp, Cucumis sativus
atcgctaagttcgacggaaaaattctctcctttttgattctctttgcctctccctccatttctgctgctgattatggccaatcaacctgaatcctctgactccaagggtaccaagagggactttagcaccgccattttggagcggaagaaggcccctaatcgtcttgttgtcgacgaagctatcaacgatgataactccgtcgtcgctcttcatcctgataccatggagaagcttcaactcttccgtggagatacgatcctcattaagggtaaaaagaggaaggacacaatatgcattgctcttgctgatgatacatgtgatgagcctaaaataaggatgaacaaggtcgtgagaagcaatcttagggttaggcttggtgatgttgtctctgtgcaccaatgtgctgatgttaagtatgggaagcgtgtacacattcttcctgtggatgataccattgaaggagttactgggaatctttttgatgcttatttgaaaccctatttcttggaggcatatcgtcctttgaggaagggtgacctcttccttgtgagggggggaatgaggagtgtagagttcaaggttattgagacagatccagctgaatactgtgtggttgccccagacactgagatcttttgtgatggagagcctgtgaaaagggaggatgaggatagattggatgaagttggttatgatgacgttggtggtgttaggaaacaaatggctcagattcgtgaattggttgaactgccactgaggcatccgcagctgtttaaatcaattggtgtgaagcctcctaagggaattttgctgtatggaccccctgggtctgggaagactttgattgcacgtgctgttgcaaatgaaactggtgcatttttcttctgtatcaatggaccagagatcatgtcaaagttggctggtgaaagtgaaagtaacctcagaaaagcttttgaggaagcagagaaaaatgcaccgtccataatttttatcgatgaaattgattcaattgctcccaagcgtgagaaaaccaatggggaagttgaacgaaggattgtctctcaactactgaccctcatggatggactgaagtctcgtgctcatgtcattgtgattggggctacaaatcgacccaacagcattgacccagctctgagaagatttggaagatttgatagggaaatagacattggtgttcctgatgaagttgggcgtctggaagttctacgaattcataccaaaaacatgaaactcgctgaagaagtcgatttggagaggattgctaaagatacgcatgggtatgttggtgctgatctggcagctctctgtactgaggctgctcttcaatgtatcagagagaagatggatgtaattgatttggaagatgactctatagatgctgagatactcaattcaatggcagttacaaatgagcatttccagacagctcttggaaccagcaacccatcagctcttcgtgaaacagttgttgaagttccaaatgtttcatgggaggatattggaggtcttgagaatgttaagagagagctccaagagacggttcaatatccagttgaacatcctgagaagtttgagaaatttgggatgtcgccctcaaaaggagttcttttctacggccctcctggatgtggaaagactcttctggcaaaggctattgcaaatgaatgtcaagctaactttattagcgtcaagggcccagagttgctcacgatgtggtttggagagagtgaggccaatgttcgtgaaatctttgacaaggcccggcagtctgctccttgtgtcttgttctttgacgaacttgactcaattgctacacaaagaggtagtagtgttggggatgctggaggtgctgctgatcgtgtactgaaccaacttcttacggaaatggatggaatgtctgcgaagaaaactgttttcattattggtgccaccaacagaccagacattatagatcctgctcttttacgacctggtcgtctcgatcagttgatttatattcctcttcctgacgaagaatctcgacttcagattttcaaggcttgcttgaggaaatctccaatctcaaaagatgtggaactcagagcccttgccaagtatactcaaggcttcagtggtgctgatattacagaaatttgtcagcgtgcctgcaaatatgcaattagagagaacattgagaaggacattgagaaggagaggaggaaaagcgagaaccccgaggcgatggaggaggatgctgatgatgaagtggccgagatcagggctgctcactttgaggaatctatgaagtatgcccgaaggagtgtcagtgatgctgacatccgcaaataccaggcatttgcacaaacacttcagcagtcaagagggtttggagccgagttcaggtttgagcagagctcagcaccagctgcatccgacccatttgcaacttctgctggtgggggtgatgaagatgatctctataactagtatggcatttagactccaatcccatttatgctttagacttggtagtatgatataacttcatcatatggatcgatttttttattggacagaatcctgaatccaaacagttggattgaaagaatggagttcgggaaatcattttgttaactcataatttctttatgggttgcataaaaaaactgaacagattttatttgaatgtgattatcatttacaatcattcttgacaca

SEQ ID NO: 7326 - DNA, 2679 bp, Capsicum annuum
ctctttgcaatttctctctatttaccggctgctaccctagatctccccaatatgactaaccaggccgagtcatctgactcaaaaggtgcgaagaaggatttctctacggcgattttggagaggaagaaagcagcgaataggcttgttgtagatgaggcggtcaacgatgataactccgttgttgcactacatccggctaccatggaaaaactccagcttttccgtggagatacaattctcatcaagggaaagaaaagaaaggatacagttgtgatcgcccttgctgacgaaacatgcgatgagccaaagattaggatgaacaaggtggtccgttcaaatttgagggttcgtctaggagatgttgtatctgtccaccagtgtccagatgtcaagtatgggaagcgtgtgcacatacttcctatagatgatacaatagaaggtctcacaggggatctgtttgatgcattcctgaaaccttactttttggaggcatatcgtccattgaggaaaggggacaattttcttgttagaggagggatgagaagtgtggaattcaaggtcatagaaaccgaccctggggagtattgtgttgttgctccagacactgaaatcttttgtgagggtgagcctgtgaaaagagaggatgaggagagacttgatgaggtaggctatgatgatgtgggtggtgtgagaaagcagatggctcagattcgtgaactggtggaattaccgttgaggcatcctcaacttttcaaatctattggtgtgaaaccaccaaaggggattttactttatggcccccctggttctggaaagactttgatagccagagctgttgctaatgaaacaggtgcatttttcttttgcattaatggacctgaaatcatgtccaaattagctggagagagtgaaagtaatctcagaaaggcatttgaagaggctgaaaagaatgctccttctatcatatttattgatgaaattgattcaattgctcccaagcgagagaaaacacatggtgaagttgaaaggaggatcgtctcacaactcttgactctgatggatggactgaaatctcgcgctcatgtaatagtgatgggagctaccaaccgtccaaacagcattgaccctgctctgagaaggtttggtaggtttgatagagaaatagacattggtgttccagacgaagttggacgccttgaggttcttcgtattcataccaagaatatgaagcttgcggaagaagtcgatttggaaagaatttcaaaagatacacatggatacgttggtgcagatcttgccgctctctgcacggaagctgcacttcagtgcattagggagaaaatggatgtcattgatctggaagatgacactattgatgctgaggtgttgaactcaatggctgtaacaaatgagcacttccaaactgctctcggtacaagcaatccgtctgcattgcgtgaaacagtggttgaagtgcctaatgtttcatgggaagacattggaggccttgaaaatgtcaaacgagagcttcaagagactgttcaatatccagtggaacacccagagaagtttgagaagtttggtatgtcaccttcgaaaggtgtacttttctatggtcccccaggatgtgggaaaactctacttgccaaggcaattgcaaatgaatgtcaagccaatttcatcagtgtcaaaggacctgaactgctcaccatgtggtttggagagagtgaggcgaatgttcgtgaaattttcgataaagcgagacaatccgctccctgcgtcctcttctttgatgagctcgactctattgctactcagagaggaagcagcagtggagatgctggaggagcagctgatcgggttctgaaccaacttttgactgaaatggatggcatgaatgcaaagaagactgtttttattattggggccacaaacagacctgatataattgaccctgcacttctgcgtcctggccgtcttgatcagttaatttatattcctctaccagatgaggattcacgccatcagattttcaaggcatgcctcagaaaatcccccttatcaaaggatattgatttgagagctctcgccaaacatactcagggatttagtggggctgatgtcactgagatttgtcaacgagcctgcaaatatgccattagggagaacatagagaaagacatagaaagggagaagagaagacaggaaaaccctgattcaatggatgaagatgtcgatgaagtaccagagatcaagcccgctcatttcgaggaatctatgaagtatgcacgacgtagtgtcagtgatgctgatatacgcaaataccaggcatttgctcagacattacagcagtccagaggtttcggaacagaatttcggtttgcagatactagtggcggtgcgactgctgcagctgacccatttgcaacttctaatgctgcagccgatgacgatgacctatatagctgaagtcctagattctccttgttattttgctgcaagtctccagttttgtcgggtcaaactcgaatatccggaaccaactggtttaacttctggtttcttctgttaacctttaacaatttacccttaaaaatgtctggggtttgctactggttatgacactttttagaaccttaagataatttaattttacagttcacacttatttcctcgtgc

SEQ ID NO: 7327 - DNA, 2770 bp, Arachis hypogaea
gagttttgcttctgctgtttgttcttctgcaactctcaactctcatctcttttctctgcacttttctgatcttccgattccaccaaattgccaatgtctcaccagggcgaatcatccgactcgaaatcggggaagaaggacttctccaccgcgattctcgaacgcaagaagtcgccgaacagattggtcgtcgatgaagccgtcaacgacgataattctgtcgtggccatgcacccacagacaatggaaaagctccaacttttccgcggcgacactattctcatcaagggaaagaaaaggaaggacactatttgcatcgcacttgctgacgacaattgcgaggagcccaaaatcaggatgaacaaggttgtgaggtccaatttgagggttcgtctcggtgatgttgtgtctgtgcatcagtgccctgatgttaagtatgggaaacgagtccacattctgcctatcgatgatactgtcgaaggtgtcactggaaatctgtttgatgcttacttgaaaccttatttcttggaggcttatcgtcctgtcagaaaaggagatctattccttgtccgaggagggatgagaagtgtagagttcaaggtcattgaaactgatcctggggagtattgtgtggttgctccagacactgaaatcttctgtgaaggtgaacccgtgaaacgggaggatgaagaaaggctggatgaagttggatacgatgatgtgggtggtgttaggaagcaaatggcacagatccgtgagcttgtagagcttccactgagacatcctcagcttttttaagtcgattggtgtgaagccacccaagggaattttgctctatggaccccctggctctggaaagacactaattgcaagagctgttgctaatgaaaccggagctttcttcttttgtattaatggtccagagattatgtccaaattggccggagagagtgaaagcaatctcaggaaagcatttgaagaagcagaaagaatgctccgtccatcatatttattgatgagattgattcgattgcacccaagcgggagaagacaaatggtgaagttgaaaggaggattgtttcacaacttttgactcttatggacggattgaagtctcgtgcacatgttattgttattggtgcaacaaatcgtccaaatagcattgacccagcattaagaaggtttggtagatttgatagagaaattgacattggtgttcctgatgaagtcggtcgacttgaagtccttcgcatacataccaagaacatgaagctttctgatgaggttgatctggagagaatttcaaaagatactcatgggtatgttggtgccgaccttgctgctctttgcactgaagctgctctgcagtgcattagggaaaaaatggatgtcatcgacttggaagatgagactattgatgctgaagtgttgaattcaatggcagttacaaatgagcatttccagactgccctaggaacaagcaatccatctgccttacgtgaaactgttgttgaggtgcctaatgtcagttgggatgatattggaggccttgagaacgtcaagcgggagctgcaagagactgttcaatatccagtagagcacccagaaaagttcgagaaatttggtatgtcaccatctaaaggagtcctcttctatggtcctccaggatgtggaaaaactttgttggccaaagcaattgctaatgaatgtcaagctaactttataagtgtgaaaggcccggaattgcttactatgtggtttggtgaaagcgaagccaatgttcgagaaattttcgacaaggctagacaatcagctccgtgtgttctcttctttgatgagctcgactccatcgccactcagagaggaagtagtgtcggggatgctggtggtgctgccgatagagttttgaatcaacttctgacagaaatggatggcatgtctgccaagaagactgtattcataattggggctactaacaggccagacatcattgatccagcacttcttcggccaggccgtcttgatcaactgatctacatccctcttcccgacgaggagtctcgttatcagatcttcaaggcgtgcatgaggaagtcacctgtctcaaaagatgtcgatttgagtgcacttgccaagtatactcaaggcttcagtggtgctgatataacagagatatgccagcgagcatgcaaatatgccataagagaaaacatagaaaaggacttggagcgagagaggaagaggagagataatccagaggccatggatgaggatgtggatgatgaagttgcggagatcaaagcaggccatttcgaagagtcgatgaagtatgcacgtaggagtgtgagtgacgctgatatccgcaaataccaggcattcgctcagaccttgcagcaatcccgcgggtttggaacggagtttaggtttccagagactggaagtaggaccactggatctgcagacccgtttgcaacttctgctggtggtgctgatgaagatgatctttatagttaggttctctaataatagaatgatgtatttgagtctcacatgtttaggtcaaaagatgcgtttgtaaacttctgaaacctgttgcatatttagcatttcacatacttatagattaaccctgcattgttaccagttttaatagaattcagatacaggtccttttgttatgttagaaaatttctgatcatgttaaaagataatcatgccttcgattgctacttaaccatgaaattcagtctttatacatggctacttaatt

SEQ ID NO: 7328 - DNA, 2816 bp, Gossypium hirsutum
caagaaacggaggtgcccttcattgatgataactctccccttagattaatacccccccaacgccccttttcttcgttcaattcttcagatcccacacattaagcaatcaattttaaacaaagccaacaccgaaaggcaagctcttcattgtttcttatttttggttctttaatcgaccaaaaactatgtcgaaccaagctgaatcttctgattcgaaagggactaagagggattttagtacggcgatcttggaaagaaagaaggctcccaatcggctcgttgttgatgaggcgatcaacgatgataactccgttgtttccatgcatcctgacaccatggaaaagctccagttgtttcgcggtgacactatcctcatcaagggaaagaagaggaaagatactatctgcattgctctcgcagacgacacatgtgatgaaccgaagatcaggatgaataaagttgtcagatcgaacttgagggttaggcttggtgatgtcgtctctgtgcaccagtgtcctgatgttaagtacggaaaacgtgtgcacatcttgcccgtggatgacaccatcgaaggggttactggaagtctttttgacgcctaccttaaaccttactttcttgaagcgtaccgcccagtgaggaagggtgatttcttccttgctagaggtggaatgagaagcgtagaattcaaggttattgagaccgaccctcccgagtactgtgtggttgcaccggacaccgagatattctgtgagggagagcctgtaaagagggaagatgaaaatagattagacgaggtcggttatgatgatgttggtggagtacgaaaacagatggctcaaattcgggaattagtggagcttccgttaaggcatccgcaactctttaaatcaattggtgtgaagccacctaaaggaattctgctttacggacctcctggatcaggaaagactttgatcgcccgtgctgttgcaaatgaaactggtgctttctttttctgcatcaacggtccggaaatcatgtcgaagttggccggagagagtgaaagtaatctccgaaaagcatttgaagaagcagagaagaatgctccgtccattatatttatcgatgaaatcgattcgattgctcctaagcgagaaaaaacaaatggtgaagttgagaggaggattgtttctcagcttttgacactaatggatgggcttaaatcccgggctcatgttattgttatcggggccacaaaccgtcctaatagcatcgatccagctcttagaaggttcggaagatttgatcgggagattgatattggtgtccccgatgaagttggtcgccttgaggtgcttcgtatccacacaaagaacatgaagctggctgaagatgttgatttagaaaaaatttcgaaggaaacccacggttatgttggtgcagatcttgcagctctttgtaccgaggcagcattacaatgcatccgagaaaagatggatgtgattgacctggaagatgattcgatagatgctgagatattaaactctatggcagtcacaaacgaacacttcgcgactgctcttggaacaagcaatccatcagctctgcgtgaaactgttgttgaagtgcccaatgtcagttgggaagatattggaggccttgagaatgttaagagagagcttcaagagacggttcaatatccagtggagcatcccgagaagtttgagaagtttgggatgtcaccgtcgaagggagtgctattctacggccctcctggatgtgggaaaacccttctggccaaagctatcgcaaacgaatgtcaggcaaatttcattagcgtcaagggtccggaattgctcacaatgtggttcggagaaagtgaggccaatgttcgtgaaattttcgataaggctcgccagtctgctccttgtgttcttttctttgatgaacttgactcaattgctactcagagaggaagcagtgtcggagatgcaggtggtgttgccgatagggttctgaaccaacttcttaccgagatggatggcatgtctgccaagaaaactgttttcatcatcggagccaccaaccgaccagacattatagatcccgcacttttgcggccaggtcgtctcgatcagttaatctatattcccctccccgacgaggactctcgtcatcaaatctttaaggcttgcttgaggaagtcaccacttgcaaaagaagtcgacctccgtgctcttgccaaatatactcaaggctttagcggtgctgatattaccgaaatttgccaacgtgcaagcaaatatgccatcagagaagacattgagaaggacattgagagagaacggagaagaagggagaaccccgaagctatggaggaagatgtggatgacgaagtggcagagatcaagccggcgcatttcgaggaatcgatgaagtttgctcggaggagtgtgagtgatgctgatatccgaaagtaccaagcattcgcgcaaacgttgcagcaatcgagggggttcggaagcgaattcaagtttgcagaaaccggttccagggctgcaacatctgatccttttgcaactacagctggtggagctgatgaagatgatctttacagttaaaattgctttcatttgagggtttcttttttaaaattgttttaatttaatcctttatggtaacaattattgaactaaagggagcttttgctcgtggcttagccattggagtccaaaatagcagtgtttgttgttttgggaactgagaattttacatttgtctttttttaaatcaatttaaaatcgtaaacacgttaaaattgttgcattaacata

SEQ ID NO: 7329 - DNA, 2820 bp, Plantago ovata
tactacaatcatagtatttgtcttgcacaaaacgaaaccatcctcattctcagatcgccggaaaacatgagtcaccaagctgagtcctccgattcgaaaggtgtaaagaaggatttctcaactgcgattttggagaagaagaaggctcccaaccgtctggttgttgaggacgctgtcaatgatgacaattccgttgttgcgcttcatccggccactatggaaaagctccagcttttccgcggagacacgattctgatcaagggtaagaaaaggaaggacacagtctgcattgctcttgctgatgagagctgtgaggagcctaagatcagaatgaacaaggtaatcaggacaaatttgagggttcgccttggggatgttgtatctgtgcaccagtgcccagatgtcaagtatgggaaacgtgttcacatattgccattggatgatacaattgaaggtctcactggtgatctttttgatgcatacctcaaaccatacttccttgaagcttatcgtccagtgaggaaaggagatcatttcctcgtcagaggtggcatgaggagtgtggaatttaaagtaattgagactgaaccaggggagtactgcgttgttgctcctgacactgagatcttttgtgaaggtgaacctgtaaggagagaggatgaggatagactggatgaggttggttatgatgatgtgggtggtgttagaaagcaaatggctcagattcgtgaattggtggaattgccactgaggcatccccagcttttcaaatctattggagtcaaaccgccgaaaggaatcttactttatggccccccaggttcaggaaaaactttaattgccagggcggttgccaacgaaactggtgctttcttcttcttgatcaatgggcctgaaattatgtccaaattggctggagagagtgaaagcaatctgaggaaggcatttgaggaggcagagaaaaatgctccgtctattattttcattgatgaaattgactcgatagcacctaagagagaaaagacaaatggtgaagttgagaggaggattgtgtctcaactcttgacactcatggatgggttgaaatctcgggcacatgtcattgttatgggggctactaacaggccaaatagcattgatccagctcttagaaggtttggtaggtttgaccgagaaatagacatcggtgtccctgatgaagtgggaagacttgaagttttacgaattcatacaaagaatatgaaactttctgaagatgttgatttagaaagaatatcaaaggacacccatggttatgttggtgctgaccttgcagctctttgcactgaagctgcactacagtgcattagagaaaagatggatgttattgacctggaagatgatgagattgatgctgagatattgaactcgatggctgttactaatgagcacttccaaactgctcttggaacaagcaatccttctgctctgcgtgaaactgttgttgaagtgcctaatgtcagctgggaagatattggagggcttgaaaatgtcaagagagagcttcaggagacggtgcaatatcctgtcgaacacccagagaagttcgagaaatttggcatgtctccttcaaagggtgtgcttttctatggtccacctggatgtggtaaaactctacttgccaaggcaattgccaatgaatgtcaagcgaatttcatcagtgttaagggccccgagttgctcaccatgtggttcggagagagtgaagctaatgttcgtgagatatttgacaaggctaggcaatctgctccatgtgtcctcttttttgatgagcttgattctattgctactcagagaggtagtagtgtaggtgatgctggcggtgccgctgatcgtgtcctcaaccaacttctgaccgaaatggatggcatgaatgccaagaagactgtattcattattggggcgaccaatagacctgatattattgatccagccctattacgtcctggtcgtcttgatcagttgatttacatccctctgccggatgaggattcacgccaccagatcttcaaagcgtgcctccgaaaatccccccttcacaaagatgttgatatccgagctcttgccaaattcactcagggtttcagtggagctgatatcacagaaatctgtcagcgagcatgcaaatatgccattagagagaacatcgaaaaggacattgagagggaaaggaggagcaaggataatcctgattccatggaagaggatgaggttgatgaagtgtcagagattaaacccgcacacttcgaggagtcgatgaaatatgctcgccgaagtgttagtgatgctgatatacgcaaatatcaggcatttgctcagaccttgcagcagtctcgtggctttggaactgagttccgtttcactgaatcaacagctgcggctactactggatcagacccatttgcagcgtcagctggtggtgctgatgaagacgacttatacagttagggtgtgggtatcttcggtatttttatttagcagcaacctgttgaattctgatgttatgcacttttggtcagcatgactatctcccgttgcttatttatttatgtttaagttctaattgtcctttgggtacaagatttgtggtgtttgtccaatctcctttttgtaccggcctttctatatgttgatgtttctttaactgggttcatagactgatgtttatgtgatatgttaatgtcatcataaatctgtgtctttcaactcttcatctactattctctactcaaagaaaagattattatgtagtatagagaaagacaagttaacgtttgtgat

SEQ ID NO: 7330 - DNA, 2721 bp, Silene vulgaris
agtaatcggattagtacttgccgacttgccgtccctataaagacaagaatactcgtaatattcaccagttttactcctctcttacttttcaactccaacctttccttctgtttatctctccgaattacccactttaccgtttcactaatccggcaatcatggctggcgatcatgctgaatcatccgattcgaaaggagctaagaaagactttagcactgcgattctagagcgcaaaaaggcggcaaatcgactcgtcgttgatgaggcggttaatgatgacaattctgttgtttctatgcatcctgataccatggaaaagcttcagattttccgtggtgataccatcttggttaagggaaagaaacgaaaagataccatttgcattgcacttgctgatgagacatgtgaagaacctaaaattaggatgaacaaggttgttagattaaacttgagggttagacttggggatgtggtttctgtacatcagtgccctgatgtcaagtatggaaagcgtgttcacattcttcctgttgatgatactgtcgagggagtgactggaaatctttttgacgcgtacttgaaaccttatttcctagaagcctaccgtcctgtgcggaaaggtgatatgttcttggtcagagggggcatgagaagtgttgaattcaaagtcattgagactgaccctgctgagtactgcgttgttgcccctgatactgagatcttttgtgagggggagcctgtcaaaagagaagacgaagacagattggacgagattggttacgatgatgtcggtggagttcgtaagcaaatggctcagattagggagttggtcgaacttccactaagacaccctcaactatttaaatcaattggtgtgaagccaccaaagggaattttactgtatgggcctccgggttctgggaagactttaattgctcgtgctgttgcaaatgaaacaggtgctttctttttctgtatcaatggccctgagattatgtccaaaatggctggagaaagtgaaagcaatctcaggaaagcatttgaggaggcagaaaagaatgctccttctatcatctttattgatgagctcgattcaattgctcctaaaagagaaaagaccaatggcgaggttgagaggcgaattgtttcgcagcttctaacccttatggatggactgaagtcacgtgcccacgtcattgtcatgggggctactaatcgtcccaacagcattgaccctgcgttgagaaggtttggtcgatttgacagggaaatagatatcggtgttcctgacgaagttggacgacttgaagttctccgtattcacacaaagaacatgaagctttcagaagatgttgatcttgaaaaaatctccaaggagacccacggctacgttggtgctgacttggctgctttatgtactgaagctgctttgcaatgtatcagagagaagatggatgtgattgatttggaggatgacacaatagatgcagaaattctcaattctatggccgtaacaaatgagcatttcgagactgctcttggacaaagcaacccatctgctttacgtgaaactgttgttgaagttcctaatgttagttgggcagatattggtggtcttgaaaatgttaagcgagagctccaagagactgttcaatatcctgtggagcatccagagaaatttgaaaaatttgggatgtcgccttctaagggagtccttttctatgggcctcctggatgtgggaagactttgttggccaaggctattgcaaatgagtgtcaggcgaactttattagtgtgaaaggtcctgaattgctgaccatgtggtttggtgagagtgaggctaatgttcgtgagatttttgacaaggcccgccaagcagctccttgtgttttgttctttgatgagctcgattcaattgcaacacagaggggaagcagtagtggagatggtgggggtgctgctgatagagttttgaaccaacttctcactgaaatggatggcatgtctgcgaagaagacagtttttataattggagccaccaacaggcctgatattattgacccagctctcctacgtccaggtcgtcttgaccagctaatttacatcccactgccagatgatgagtcacgcctccaaatcttcaaggcagccttgaggaagtctcctattgctaaagacgttgatcttaaggcccttgccaattatacccagggcttcagtggtgcagatataactgaaatatgccagcgtgcttgcaagtacgccatccgagaaaacattgagaaggatatcgaaaaggagagaaggagaagtgagaatcctgaggcaatggaggaggatgtcgaagatgaagtggcagaaataaaggcagctcactttgaagaatcgatgaagtatgctcggaggagtgtcagcgatgccgacattaggaaataccaggcatttgctcagactctgcagcaatcccgtggctttggctccgagtttcggttcgcaagcacacctgcaggtggtactaccacctcagacgcatttgccactgcggctggtgctgctgatgaagatgatctttacaattaagtgtcttgtgtaagaaactgtattttctcggtttgcgtttgtaaaattatgacctgttgtcagactctacgctctgttttccagtagaaagactaaacttaatttacaacacttcttcttctttagtgcaacccgaact

SEQ ID NO: 7331 - DNA, 2683 bp, Silene vulgaris
acaatggcagacaaacctgaatcgtctgattcgaaggggactaagaaagactttagcactgcaattttagagcgcaaaaaggcggcgaatcgtctcgttgtagatgaagctgttaatgatgataattctgtggtttctctccatcctgataccatggaaaagcttcagattttccgtggtgataccatcttgattaaggggaagaaaaggaaagatacaatttgcattgcactggctgatgacacatgtgatgaaccaaaaattaggatgaacaaggttgtgaggtcgaacttaagagttagacttggagatgtggtttctgtgcatcagtgccctgatgtcaaatatggaaagcgtgtgcacattcttcctgttgatgatacagtggagggagtgactggaaatctgtttgatgcctacttgaaaccatatttcctagaagcttaccgccccgtgcgtaaaggtgatttgttcctcgtcagagggggtatgagaagtgttgagttcaaagtcattgagactgaccctgctgagttttgtgtcgttgccccggatacggagatcttctgtgagggggagccggtgaaaagagaagatgaaaacagattagacgaggttggctacgatgatgttggcggagttcgtaagcaaatggcgcaaattagggagttggttgaacttccacttcgacacccacaactatttaaatcaattggtgtaaaaccaccaaagggaattttgctctttgggcctcctggttctggaaagactttaatagcccgtgctgttgctaatgaaactggggctttcttcttttgtatcaatgggcctgagattatgtccaaaatggctggagaaagtgaaagcaatctcaggaaagcttttgaggaagcagaaaagaatgctccctctattatctttattgatgagattgattcaattgctccaaaaagagaaaaaaccaatggagaggttgagaggcgaattgtttcccagctccttacccttatggacggacttaagtcacgtgcccatgtcattgtcatgggggctactaaccgtcccaatagcattgatcctgcgttgagaaggtttggtcgctttgacagggaaattgatattggtgttcccgatgaagttggtcgcttagaagttcttcgcattcacacaaaaaacatgaagctttctgaagatgttgatatggaaaaaatctcgaaggaaacacatggttatgttggtgctgacttggctgctttatgtactgaagctgctctacaatgtatcagagagaagatggacgtaattgatttggaggacgacacaatagatgctgaaattctcaattctatggctgtcacaaatgagcattttcagactgctcttggtcagagcaacccatctgctttacgtgaaacagtcgttgaagttcctaatgttagctgggccgatattggtggccttgaaaatgttaagagagagcttcaagagactgttcaatatccagtggagcatccagagaaatttgaaaaatttggaatgtcaccttcaaagggtgttcttttctatggccctcctggatgtgggaagactttgctagccaaggcaattgcaaatgagtgtcaagctaattttattagtgtgaaaggtcctgaactgctgaccatgtggtttggtgagagtgaagccaatgttcgcgagctttttgacaaggctcgccaggcagctccatgtgttctgttctttgatgagctcgattctattgcaactcagagaggaagcagtgtcggagatgccggaggtgctgctgacagagtgttgaaccagcttctcactgaaatggatggcatgtctgctaagaagactgttttcattatcggagccactaacaggcctgatatcattgatccagctcttcttcgacctgggcgtcttgatcagcttatctatatcccgctgccagatgacgagtcacgcctccaaattttcaaggcagccttgaggaagtctcctattgctaaagatgttgatctcagtgcccttgccaagtacactcagggcttcagtggtgcggatattactgaaatttgccagcgtgcatgcaagtacgctatcagggaaaatattgagaaggatattgagagggagagaaggagaagcgagaatcctgaggcaatggaagaggatgttgaagatgaagttgccgagattaaggctgcccactttgaagaatcaatgaagtatgctcgaaggagtgtaagcgatgctgatatccgcaaatatcaggcgtttgctcagaccttacagcagtcccgaggcttcgggtctgagttccgtttctcctccaatacaactgctggagggaccaccacctccgatgcatttgctgcttcagctggtgcagctgatgaagatgacctttacaattaatcttgttatttaacattatgctttgcatcaattattcaattggatcatttggctgccattagagagaaaggcgtagacttggtaattttccttttatgattcaagtgaagatgattgtacattaaataaccatggaggaaaattatttacattttatatcgaactgataaaacagctttagtcaaaattcattttagaagttgtatacttgtatccgtgagaactgagatgacataaataacaatatgacggatat

SEQ ID NO: 7332 - DNA, 2663 bp, Castanea mollissima
tgggtcttctttttcttcttcaacaatctcatttttttgtctttctgattctgaataatcatggcgagccaacccgaatcctcggactctaagggaacgaagagggactttagcacagcgattcttgagcgcaagaaggccccgaatcggcttgttgtggatgaggcaatcaacgatgacaactctgtcgtggcgcttcatcccgataccatggagaagctccaactcttccggggagacacgatcttgatcaaggggaagaaaaggaaagatactatctgcattgcccttgctgatgacacttgtgatgagccaaagataaggatgaacaaggttataagaagcaacctcagggtgaggcttggagatgttgtttctgtgcaccagtgtgcagatgtcaaatatggaaagcgtgtccacattcttcctgtggatgatactattgaaggggtcactggcaatctctttgatgcatacttgaaaccttatttcctagaggcataccgcccagtgaggaagggtgatctgttccttgtgagaggggggatgagaagtgtagagtttaaggttattgagactgaccctccagagtactgtgtggttgctccagacactgagatcttctgtgagggagaacctgtgagaagggaggacgagaatagattagatgaagttggttatgatgatgttggtggtgttagaaagcagatggctcagattcgtgaattagtggagctgcccctgaggcatccacagctatttaaatcgattggtgtgaagccaccaaaaggaattctattgtatggaccccctggatctgggaaaactctaattgctcgggctgttgccaatgaaactggtgccttctttttctgtatcaatggacccgaaatcatgtcaaaattggctggggaaagtgagagcaacctcaggaaagcatttgaggaagcagagaagaatgcaccatccatcatctttattgatgagatcgattcaattgctcccaagagagagaagacacatggagaagttgagaggagaattgtttcccagctattgacacttatggatggactgaaatctcgtgctcatgttattgtcattggggctacaaatcgtcccaacagcattgaccctgccttgagaaggtttggaagatttgacagggaaatagatattggagttccagatgaagttgggcgtcttgaagttctccgtattcacacaaagaatatgaagctttctgaagatgttgacctagaaagaattgctaaggacacgcatggttatgttggtgctgatctagcagctctgtgtactgaggctgctcttcaatgcattagagagaagatggatgtgatcgatttggaagatgagacaatagatgcagagatactaaattcaatggcagtttcaaatgagcacttccagactgctcttggaacaagcaacccatctgctctccgtgaaactgttgttgaagtgcccaattgcagttgggaagatattggaggtcttgagaatgttaagagggaacttcaagagactgttcaatacccagtggagcatcctgagaaatttgagaagtttggaatgtcaccatcaaagggtgttcttttctatggccctcctggatgtgggaaaaccctcctggccaaagctattgctaatgaatgtcaggcaaactttatcagtgtcaagggtcctgagttgcttacgatgtggtttggagagagtgaagccaatgtaagggaaatattcgacaaggcacgccagtctgctccttgtgtcctattctttgatgaacttgactcaattgctactcagagaggtagcagtgtaggagatgctggaggtgctgctgatagggttctgaaccaactcttgactgaaatggatggcatgtctgcaaagaaaactgttttcatcattggggccaccaacagaccagacatcatagaccctgcacttctgcgtccaggtcgtcttgatcaattgatctacatccctctccctgacgaggactcccgccatcagatatttaaggcatgcttgaggaaatctcctatctccaaagacgttgatctcagagcccttgccaagtatactcaaggctttagcggtgctgacattactgagatatgccagcgtgcatgcaaatatgccatacgagagaacattgagaaagatattgagagggaaagaaggagaagggataatcctgaggcaatggaggaggatgttgaggatgaagtagcagagatcaaggcagcccattttgaggaatcaatgaagtatgctcggaggagtgttagcgatgctgacatccgcaaataccaggcatttgctcaaacattgcagcagtcaagagggtttggatccgaatttaggtttgctgataatactacttctggagccactgcatctgaccctttcgcaacggctgctgctggggctgatgaagatgacctatacaattaggttcttaaaatgggtgtttgtcttatttatgttagacattcctttattacatatgtcagtgtaatgatatgtttaaggctcttattgaattgcccttgtgtccaaggaggccttgggttttgccagcggatgatcccttggctaattaaagaaaaattattaattataattataaaaataaa

SEQ ID NO: 7333 - DNA, 2730 bp, Fragaria vesca
ctcctcctcaatctctctgcttcgtcttcatcggtcttcctccgcctgctctctcttcaatcatgaccgataaagctgaatcgtccgaccctaaggggaccaagagggatttcagcactgcgattctcgagcggaagaaggcggcgaatcgcctcgtcgtcgatgaggccatcaacgatgacaactccgtcgtcgcgctccaccctgagaccatggagaagctccagctcttcaggggcgacactattctcatcaagggaaagaaaaggaaggatacaatctgcattgcccttgctgatgatacttgtgacgaaccaaagattaggatgaacaaggttgtgaggagcaacctaagggttaggcttggggatgttgtctctgtccaccaatgtgctgatgtcaagtacggaaagcgggtgcacattctccctgtggatgacactattgaaggtgtcactggaagtttgtttgatgcctacttgaaaccttatttcttggaggcctaccgcccagtgaggaagggtgatctcttccttgtgagaggaggaatgaggagtgtagagttcaaggttattgagaccgatccttctgagtattgtgttgttgctccagacactgaaattttctgtgagggagagcctgtaagacgtgaggatgaggatagattagatgaggttggttatgatgatgttggtggtgttaggaagcagatggctcagattcgtgaattagtggagctgccattgaggcatcctcagctctttaaatcaattggtgtgaagccaccaaagggtattctgttgtatgggccacctggatctggtaagactctaatcgccagagctgtcgcaaatgaaactggggcattctttttctgcattaatgggcctgaaatcatgtcaaaacttgctggagagagtgaaagcaacctcaggaaagcttttgaggaagcagagaagaatgcaccatcaattatctttattgatgagattgattcaattgctcccaagagagagaagacacatggtgaagttgagaggagaattgtgtcccagctcttgacacttatggatggacttaaatcccgtgcacatgtaattgttatgggggctacaaatcgtcctaacagtatagacccagctctcagaaggtttggtagatttgatagggagatagatatcggtgttccagatgaagttgggcgtcttgaggtccttcgtattcatacaaagaacatgaagcttgctgaagatgttgatctggaaaagattggcaaggagacgcatggttatgttggtgctgatcttgctgctctatgtactgaggctgcacttcagtgcatcagagagaagatggatgtcattgacttggaagatgaggaaatagatgctgagatactcaactcaatggcagttacaaatgaacacttctctactgctctcggaacaagtaacccatctgctctccgtgaaacggttgttgaagtacccaatgtttcttgggatgctattggaggtcttgagaatgttaagagagaacttcaagagacagttcaatatcctgttgagcatcctgagaaatttgagaaatttgggatgtcgccctcaaagggagttctattctatggccctcctgggtgtggtaaaactcttcttgccaaggccattgcaaatgagtgtcaggcaaactttatcagtatcaagggacccgaattgcttactatgtggtttggagagagtgaggccaatgtgcgggaaatctttgacaaggctcgtggatctgctccatgtgttctgttcttcgacgaacttgattccattgctactcagagaggtagcagttcaggtgatgccggaggtgctgcagatagggttttgaaccaactgcttacagagatggatggaatgtctgcaaagaagactgttttcattattggcgccactaacaggcctgacattatagaccctgcacttctacgtccgggacgtctggatcaattgatatatatccctctccctgatgaggaatcccgccttcaaattttcaaggcagccttgaggaaatctccagttgccaaagatgtggatcttaatgcccttgccaagtacacccaaggattcagtggtgctgatatcacagaaatttgccagcgtgcttgcaaatatgccatcagagagaatattgagaaggatattgaaagggagaggaggagaagcgagaatcctgaggctatggaggaagatgtggaggatgaagtacctgaaatcagggcagctcactttgaggaatcaatgaagtttgctcgtcggagtgttagtgatgctgatatccgcaaataccaggcatttgctcagacactgcagcagtcaagaggatttggaactgagtttaggtttccagaaactggctctgctgcggccacaactggatctgatccttttgcaactagtagtgctggggccgatgaagatgacctttacaattagaatagttccattatgcacacttcatcttttaatttcaaactgcattttggattccatcacggtgctggtgctatgtccatttaatcgttattgtggctgaaaaggccttggggttcttgtggcctctggatgacccaaggatagtctaagttaaacagtgttttcttttgataagtttacaatggatgatgtaaagactgcacaatttatttcagttcgacagttctgtcctttgttctcattg

SEQ ID NO: 7334 - DNA, 3110 bp, Eucalyptus grandis
gcaaacaagaaagggagagtcctctccgacttaagaacccatccaccccggcgttctcctcttcacatctccccttcccccctcctctcgtctcccttcactctctctctcttctcctccatcgctgcagctcgctcccgaatcggaccgccatggccagccaagccgaatcctccgaccccaaggggacgaagagggacttcagcaccgcgatcctggagcgcaagaaggccgccaaccgcctcgtcgtcgacgaggccgtcaacgacgacaattccgtggtcgccctccacccggagaccatggagaagctccagctcttccgcggcgacaccatcctcgtcaaggggaagaaaaggaaagacactgtctgcattgctcttgctgacgacacatgcgacgagccaaagattaggatgaacaaagtggtgagacaaaacctgagggttagactgggagatgttgtttcagtgcatcagtgtcctgatgtcaagtatggaaagcgagttcacatccttcctgtggatgacaccatcgaagggattactggaagtctctttgatgcattcttgaagccttactttctggaggcatatcgccctgtgaggaaaggcgatcttttccttgttagaggaggaatgagaagtgtcgagttcaaggttattgagaccgatcctggcgagtattgtgttgttgccccagatacagagatcttctgcgagggagaacctgtgaggagggaggatgaaaatagattagatgaggttggttatgatgatgttggtggtgttaggaagcaaatggctcaaattagggagctggtagagctgccattgagacatccacagttattcaaatcaattggtgtgaaaccaccgaaaggaatcctgctgtatggacctcctggatctgggaaaaccctcattgctagggcagttgcaaatgaaaccggtgccttctttttctgtattaatggaccagagatcatgtcaaagttggctggtgaaagtgaaagcaatctcaggaaagctttcgaggaagctgagaaaaatgcaccttccatcatctttattgatgagatcgattcaattgctccgaagcgagagaagactcatggagaggtggagaggaggattgtgtctcagctgctaacgctcatggatggcttgaagtcccgtgcccatgtcatagttatcggggctactaaccgaccaaacagtattgacccagctttgagaagatttggaagatttgacagggaaatcgatattggagttcctgatgaagttgggcgccttgaagtcctccgcattcacacaaagaacatgaagcttgctgaagatgttgatctggaaagaattgctaaggacacacatggctatgttggtgctgatctggctgctctctgcactgaagctgcacttcagtgcatcagggagaagatggatgtaattgacttggaagatgagacgatagatgcggagatactcaactccatggcagttacaaatgagcacttccacactgctcttggaacgagcaacccatctgctctccgtgagacagtggttgaagtgccaaatgtgagctggcaagatattggcggtcttgagaatgttaagagagagcttcaagagactgttcaatatccagtggagcatcccgagaagtttgagaaatttggaatgtcaccttctaagggagttcttttctatggtcctcctggatgtggcaaaactcttctggctaaagctatagctaatgaatgtcaggcaaattttatcagtgtgaaaggccctgagttgcttactatgtggttcggagagagtgaggcaaatgtccgtgaaatttttgataaggcccgacaatctgccccttgtgttctgtttttcgacgaacttgactcgattgctacacagagaggaagcagtgtgggagatgctgggggtgctgctgatcgggttttgaaccaacttcttacagagatggatgggatgtctgcaaagaaaaccgtgttcatcattggagccaccaacaggcctgacattatagaccctgcacttctacgtccagggcgtcttgatcaactgatttacatccctctccctgatgaggactcccgacatcaaatatttaaggcatgcttgaggaaatccccagtctccaaagatgttgatctgagagctcttgctaagtatacgcaaggatttagtggtgctgatatcacagaaatatgccagcgttcatgcaaatatgccatcagagaaaacattgagaaagatatcgagagagaaaggaggagaagtgagaatccagaagcaatggaggaggacgtcgaggatgaagtggcggaaatcaaagctgctcatttcgaggaatcgatgaagtatgctcgcaggagtgtgagtgatgctgatattaggaagtatcaagctttcgctcagacactccagcagtcgagagggtttggaagcgaatttcgatttgcagatgccggtgctggtgctggcactgcgggatcagatccattcgcagcttctgctggcggtgctgatgacgatgacctctatagttaaaaagatagtctgtttacgtttccctttgcatatcaaacctttctcccttcctgtttcactgtatactgttggaattgtctcgtgggaaggctttggcttcatggtgtccgacgtactcccgatcattttgaggtccccaaacttcccgtgtttctgacattctgaggtagtggccttccatttaaaattcttactttgtctcaatttatttgcgctgcattaagcatgagcagtggaattcagtcccggaaatggattgctcttgctgtctactccagaaatatctaggtatatcttggaccatgtgcattgtgcacatgctcccaatgcaatgacgaggtgctttcgcgtgaatttcattctattgcatgaatttcgtatgtcaggcgttcagatgcatggggtacactttgattcggagcctgtgcaagttccggttatctacccttaagtaatcaccttgtgcttaatcttgttgatcattgctatcgttgtgttatgttgtcttattaagtcggaaaagttctctctcct

SEQ ID NO: 7335 - DNA, 2590 bp, Arabidopsis lyrata
tcttcttcttctctctgcgaagctctctctataatatcaaacatggcgaatcaagctgaatcatccgactcgaaggggacgaagagggattttagcaccgcaattctggagagaaagaaggcggcgaatcgtttggttgtggatgaggcgattaacgatgataactctgtcgtttctcttcaccctgaaaccatggagaagctacagctttttcgtggtgataccgttttgattaagggaaagaagaggaaggatactgtgtgtattgctttagctgatgatacttgtgatgaaccaaaaattaggatgaacaaggttgttaggtctaacctcagggttaggcttggagatgttatctctgttcatcaatgccctgatgtcaagtatgggaagcgtgttcacatattgcctatcgatgataccattgaaggagttagtggcaatatatttgatgcgtaccttaaaccttatttcttggaggcataccgtccggtgaggaagggtgatcttttcttggttagaggagggatgagaagtattgagtttaaggttattgagaccgatcctgctgagtactgtgttgttgctccagatacagaaattttctgtgagggtgaaccgataaagagagaggatgaggagaggttggatgaagttgggtatgatgatgttggtggtgtcaggaagcaaatggctcagattcgggaacttgttgagctcccattgaggcatccacaactcttcaagtccattggtgtgaaacctcccaaaggaatcttgctatatggtccccctggttctggaaagacactgattgcccgtgctgttgctaatgagaccggtgcatttttcttctgtatcaatggtcccgagatcatgtcgaagctagctggtgagagtgaaagcaacctcaggaaagcgtttgaggaagctgagaagaatgccccctcaatcatctttattgatgagctcgattcgattgctccaaaaagagaaaagacacacggggaagttgaaagacgtattgtatcccagctcttgacacttatggatgggcttaaatccagagcccatgtcattgttatgggagcgaccaaccgtcccaacagcattgaccccgctttgagaaggtttggacgatttgacagagagattgatattggtgttcctgatgagattggtcgtcttgaagttctcaggattcacaccaagaacatgaagcttgcggaagatgttgatttggaaagagtatccaaagacacccatggttatgttggtgctgatcttgcagcattatgcactgaagctgctctccaatgcattagggagaagatggacgtaattgacctagatgacgaggagatagatgctgaaattctcaattctatggctgtgactaatgatcatttccagactgcccttggtaacagcaatccttcagctctacgtgagacggtcgttgaggtgcctaatgtttcttgggaggacattggtggtcttgagaatgtcaagagggagctccaagagactgttcaatatccagtggagcatcctgagaaattcgagaagtttgggatgtcaccgtctaaaggagtcctattctatggtccccctggttgtggaaagactctcttggctaaggctattgcgaacgagtgtcaagccaacttcattagtatcaaaggtcctgagctcctcacaatgtggtttggtgagagtgaagccaatgtgagagagatattcgacaaggcacgccagtctgctccttgtgttcttttctttgatgagcttgactccattgccactcagagagggaacagtgtcggagatgctggtggtgcagcagatagagtattgaaccagcttcttacggagatggatggaatgaatgctaagaagacggtcttcatcatcggagctacaaacagaccagacatcatcgaccctgcacttctgcgtcctggtcgtctcgatcagctcatctacattcctcttcctgatgaggagtctcgttaccagatcttcaagtcttgcctgaggaaatcgcctgtagctaaagatgttgacctgagggctcttgcgaagtacacccaaggcttcagcggtgcagacatcacagagatttgccagcgttcttgcaagtatgcgatcagagaaaacatcgagaaggatattgagaaggagaggaagagagcagagtcgccagaagcaatggaagaggacgaggaggagattgcagagattaaagctggtcactttgaggaatccatgaaatatgcaaggagatcagtaagtgatgcagacattcgcaagtatcaggcttttgctcagactctacagcaatcacgtgggtttggaagcgagttcaggttcccagatgcgccgacagggactggagctgctgccacagtcgggggagtcgacccgtttgccacatccggaggagcagccgacgatgatgatctctacagctgaaagatctgatcagaccctgtgactactgtctttagtcttttactttgttctgcttgaaaaacttttgatggtctttgttgtgttttatttataagtcttttgtacataatagttg

SEQ ID NO: 7336 - DNA, 2483 bp, Arnica chamissonis
ttatgagtaatcaagccgaatcatccgattctaagggcacaaagcgcgactacagtacggctattctggaacggaagaaggccgcgaacaggcttgttgtcgatgaagctatcaacgatgataactctgttgttgccctacatcctgagacgatggaaaagcttcagcttttcagaggcgacacgatcttgattaagggaaagaaaagaaaagataccatatgtatagctcttgctgatgacacctgtgatgagcccaaaattagaatgaacaaggtcgtcagggctaacctacgggtcaggctcggagacgtggtatcggttcatcaatgtgctgatgtcaaatatggcaaacgggttcatatccttccggttgatgatacaatcgaaggcgtcactggcaatctgtttgatgcatacttaaaaccatactttttggaagcatacagacctgtgagaaagggtgactttttcctcgtgaggggaggcatgcgatccgtggagtttaaagttattgaaactgatcctgcagaatattgtgtagttgcacccgacactgagattttctgtgaaggtgagcccgttagaagggaggatgaggatcgattagatgaaatcgggtatgatgatgttggtggggttcgtaaacagatggcacaaatccgtgagcttgtggagctgccattaagacatccacagcttttcaagtcaatcggggtcaaaccacccaagggaattcttctttacgggcctcctgggtcaggtaagactttaatagcccgggctgttgctaatgaaacaggtgctttcttttttgtataaatgggcctgaaatcatgtcaaagttggctggagaaagtgagagtaatcttagaaaagcgtttgaggaagccgagaagaatgccccatcaattatttttattgatgaaattgattcgattgctcccaaaagggaaaaaacaaacggagaagttgaaagaagaattgtttcacaacttttgactctaatggacgggttgaaatcacgggctcatgttatcgtcatgggtgccactaaccgtcctaacagcattgacccagccttgaggcgatttggtaggtttgacagggaaatcgacatcggtgttcctgatgaagttggacggcttgaggttcttcgtattcataccaagaacatgaagcttgctgaggacgtggacttggaaaagatttctaaagagacacatggatatgtaggtgctgacctggcggctttgtgtaccgagtcagcactccagtgtattcgagagaagatggatgtgattgatttggaagatgagacaatcgatgctgagattctgaattctatggcggttacaaatgagcattttcaaaccgctcttggtacaagtaacccatctgcccttcgtgagacggttgttgaagtgcctaatgttagttgggaagatattggaggccttgaaaatgttaaaagagagctccaagagacggtacaatatccagtcgaacaccctgaaaaatttgagaaattcggcatgtcaccgtctaaaggagttctattttatggtccacctgggtgtggaaaaacacttctagccaaggctattgccaatgaatgccaggctaacttcatcagcattaagggtcctgaactgctaaccatgtggttcggtgaaagtgaagctaacgttcgtgagatctttgataaagcccgtgggtccgccccctgtgtcctattttttgatgagcttgactctattgctacccagagagggagtagtcaaggggatgcaggcggcgcagccgatagggttttgaatcaacttttaactgaaatggacgggatgtcagcgaaaaaaacagtttttattatcggtgcaactaaccggcctgatatcattgatccagctcttttgaggcccggtcgtcttgatcagttaatttacattcctctccctgatgaggaatcacgttattcgattttcaaatcagctttaaggaaatcacccgtcgcaaaagatgttgatcttcatgcccttgctaaatacactcagggatttagtggtgctgacattaccgaaatctgccagcgggcttgcaagtacgcaattcgtgaaaacattgaaaaagatattgagagggagaagagaagaagtgagaacccggaggctatggaggaggatgcggatgatgaggtggcggagattaaggcggcacattttgaagaatcaatgaaatttgcacgtagaagtgttagtgatgctgacatacgcaaatatcaggcgtttgctcagacacttcagcagtcaagagggttcgggtctgagttcaagtttgctgagacaggtggtgcagccgctggtgctggtggctcggacccgtttgctgcttctgcaggggcggctgatgaggatgacctgtacaactaactaactagcacaagtttattcaacctctgtagtttttatgtaaacttgattcttc

SEQ ID NO: 7337 - DNA, 2711 bp, Eucalyptus grandis
gcttcacatcaccccgtccccccctctcgtcttcctcacttcctccatcgctgcagctccctctcgatcggaccgccatggccagccaagccgaatcctccgaccccaaggggacgaagagggacttcagcaccgcgatcctggagcgcaagaaggccgccaaccgcctcgtcgtcgacgaggccgtcaacgacgacaattccgtggtctccctccacccggagaccatggagaagctccagctcttccgcggcgacaccatcctcgtcaaggggaagaaaagaaaagacactgtctgcattgcacttgctgatgacacatgcgacgagccaaagattaggatgaacaaagtggtgagacaaaacctgagggttaggctgggagatgttgtttcagtgcatcagtgtcctgatgtcaagtatggaaagcgggttcacatacttcctgttgatgacaccatcgaagggattactggaaatctctttgatgcattcttgaagccttacttcctggaggcatatcgccctgtgaggaaaggtgatctcttccttgttagaggaggaatgagaagtgttgaattcaaggttattgagacggaacctgccgagtattgtgttgttgccccagacacagagatcttctgcgagggagaacctgtgaggagggaggatgagaatagattagatgaggttggttatgacgatgttggtggtgttaggaagcaaatggcgcaaattagggagctggtagagctgccattgagacatccacagttattcaaatcaattggtgtgaaaccaccgaaaggaatcctgctgtttggacctcctggatctgggaaaaccctcattgctagggcagttgcgaatgaaaccggtgccttctttttctgtatcaatggaccagagatcatgtcaaagttggcgggtgaaagtgaaagcaatctcaggaaagctttcgaggaagccgagaaaaatgcaccttccatcatctttattgatgagatcgattcaattgctccgaagagagagaagactcatggagaagtcgagaggaggattgtttctcagctgctaacgctcatggatggtttgaaatctcgtgcccatgtcatagttatcggggctactaaccgaccaaacagtattgacccagctttgagaagatttggaagatttgacagggaaatcgatattggagttcctgatgaagttgggcgccttgaagtcctccgcatccatacaaagaacatgaagcttgcggaagatgttgatttggaaagaattgctaaggacacgcatggctatgttggtgctgatctggctgctctctgcactgaagctgcacttcagtgcatcagagagaagatggatgtcattgacttggaagatgagacgatagatgcagagatactcaactccatggcagttacaaatgagcacttccagactgctcttggaacaagcaatccatctgctctgcgtgagacggtggttgaagtgccgaacgtgagctggcaagatattggtggtcttgagaatgtcaaaagagagcttcaagagactgttcaatatccagtggagcatcctgagaagtttgagaaatttggaatgtcaccttctaagggagtccttttctatggacctcctggatgtggcaaaactcttctggctaaagctatagccaatgaatgtcaggcaaattttatcagtgtgaaaggccctgagttgcttactatgtggtttggagagagtgaggcaaatgtacgtgaaatttttgacaaagcccgacaatctgccccctgtgttctatttttcgacgagctcgactcaattgctacacagagaggaagcagtgttggagatgctgggggtgctgctgatagggttttgaaccaactgctcactgagatggatgggatgtctgcgaagaaaactgtgttcatcattggagccaccaacaggccagacattatagaccctgcacttctacgtccaggccgtcttgatcagctgatttacatccctctccctgatgaagactctcgacatcaaatattcaaggcatgcttgaggaaatctccagtctccaaagatgttgatctgagagctcttgctaagtatacacaaggtttcagtggtgctgatatcacagaaatatgccagcgtgcatgcaaatatgccatcagagaaaacatcgagaaagatattgagagggagagaaggagaagggataatcctgaagccatggaggaggacgtcgaggatgaggtggcagagatcaaagctgcacatttcgaggaatcgatgaagtatgctcgcaggagtgtgagtgatgctgatattaggaagtatcaagcttttgctcagacactccagcagtcgagagggttcggaagcgaatttcgctttgcagatgccagtgctggtgccggtgctgcgggatcagatccttttgcagcttctgctggcggcgctgatgacgacgacctatatagttaatcagataatctattgtgtttccatttccatttaaaacctttctccttcctgttttattactgtatcctgttggaattgtctaatgggaatgccatggcttcatatttgttagactttactccaatcattttcgggatctgaacttctcgtgtttctcacgttatcagctaagtggccatcccttacgaaatctgtactgtcgtgattttt

SEQ ID NO: 7338 - DNA, 2701 bp, Plantago ovata
acaacaaccgaaccaacttcttcttcttctgcaaacccaaatctctctttctttcattcggttcctcaccatgagcaatcaaccagaatcatccgattctaagggcaccaagagggatttcagtacggcgattctggagaggaaaaaagccccaaaccggttggttgttgatgaggctgttaatgatgataactcggtcgttgcacttcatcctgatactatggaaaagctccagctctttcgcggtgacactatcctcatcaagggtaagaagcgaaaggatacagtatgcattgctttagctgatgagacttgcgatgagccaaagattcggatgaacaaagttgtcagaaccaatctcagagttaggctcggagatgttgtttctgtacatcaatgtgctgatgtgaagtatggcaaacgtgttcacattcttcctgttgacgacacgatcgaagggctaaccggaaatctttttgattcttatctcaagccatattttctggaggcatatcgccctgttaggaaaggtgacatgtttcttgtgcgaggtggcatgaggagcgtagagttcaaggttattgaaacagatcctgctgagtactgtgtcgtagcccctgatacagaaatcttctgtgagggagagcctgtgagaagggaggatgaagatcgattggatgagattggctatgatgatgtgggtggtgtacgcaaacagatggctcaaatccgtgaattagtagagctgccactgaggcacccacagctttttaagtccattggcgtcaagcccccgaagggaattctgctttatggacctcctgggtccgggaagacattgattgctcgagcagtggctaatgaaactggtgcctttttcttctgtattaacggaccagaaatcatgtcaaagatggctggtgaaagtgaaagcaatctacgcaaggcatttgaagaagctgaaaagaatgcaccatccatcatatttattgatgaaattgattcaattgctcccaagagagacaaaaccaatggggaggtcgagaggaggattgtttcccagctattgacgcttatggatgggctcaaagcccgtgcccatattattgtaatgggtgctactaaccgtcccaatagcattgaccctgccttgagaaggtttggtagatttgacagagaaatagacattggagtacctgatgaagttggacgcctagaagttctccgtatccatacgaagaacatgaagcttgctgaagatgttgatttggaaaaaattggcaaggagacacatggctacgttggtgctgacttggctgctctttgtactgaggctgcacttcaatgcatcagggagaaaatggatgtgattgacttggaagatgattccatcgatgcagagattctcaactcaatggctgtttcaaatgagcacttccagacagctctaggaacaagcaacccctctgctctacgtgaaactgttgttgaagtgcccaatgtcagctggcaagatattggaggtcttgagaatgttaagcgcgagctccaagagactgttcaatatccagtggagcacccggagaagtttgaaaagtttggcatgtcaccttcaaagggagtcctattctatggtcctcctggttgtggaaaaaccttgcttgccaaggccattgctaatgaatgtcaagcaaactttatcagtgtcaagggtcctgagttgctcactatgtggtttggagagagtgaagcaaatgttagagaaatattcgacaaggcccgtcaatctgctccctgtgtgctgttctttgatgaattagactccattgctactcagagaggaagcagtgttggagatgctgggggtgctgcagaccgtgttttgaaccaactcctgactgaaatggatggaatgaatgcaaagaaaactgtgttcattattggtgccaccaataggcccgatattattgatcctgcccttctccgtcctggccgtcttgatcagttgatttacatccctctcccagatgaggactcacgtcatcaaatattcaaggcttgcttgagaaagtcccctctttccaaagacattgacctgagagctcttgccaagtacactcaaggatttagtggtgcagatattactgaaatatgccaacgggcatgcaagtacgccatcagagagaacattgaaaaggatattgagagggaaaggagaagaagcgacaatcctgaagcaatggaggaagatgtcgaggatgaggtcgcggagattacagctgcacactttgaggagtcgatgaagtatgctcgaaggagtgtgagtgatgctgatatccgcaagtaccaagcattcgctcagacactgcagcaatctagaggatttggaagcgagttccgttttgctgagaatagtacgagtggagctgcggctgccgcatccgatccttttgcatcagctgctggtgctgctgatgaagatgacctgtataattaggctccttgctgctaattttactatgttcttatttcttgttttactatgtgggatttcttttgtcagtcaatcttttgcttaaagaagaggaccgcaaactgccctatgggattcatgtataaattatggtctcactgaacttaaattggttatattcatagttcccacatggtgctgcctttataatactactaccctttccat

SEQ ID NO: 7339 - DNA, 2668 bp, Eutrema parvulum
aaccgattacttcatcaaatttattcatctcttttgaagatatcttctacctcttctctttgcgaagctctttctactcgaaaactagccatggcgaaccaagctgaatcatctgactccaagggaacgaagagggactttagcaccgcgattctggagcggaagaaggcggcgaatcgtttggtggtggatgaggcgatcaacgatgacaactccgtcgtgtctctacaccctgagaccatggagaagctacagcttttccgtggagataccgtcttaatcaagggaaagaagaggaaggatactgtgtgtattgctttagctgatgatacatgtgatgaaccaaaaattaggatgaacaaggttgtcagatcgaacctgagggttaggcttggagatgtaatctctgttcaccaatgccctgatgtgaagtatgggaagcgtgttcacatcttgcccatagatgataccattgaaggagttagcggaaatatatttgatgcataccttaaaccttacttcttggaggcgtaccgtccagtgaggaagggtgatcttttcctagttagaggagggatgagaagtattgagtttaaggttattgagaccgatcctgctgagtactgtgtggtcgctccagatacagagatattctgtgagggtgaaccgataaagagagaggatgaggataggttggatgaagttggttacgatgatgttggtggtgtcaggaaacaaatggctcagattagagaacttgttgagctcccattgaggcatccacagctcttcaagtccattggtgtgaagcctcccaagggaatcttgctctatggccctcctggttctgggaagacgcttattgctcgtgctgttgctaatgaaactggtgcatttttcttctgtatcaatggtcccgaaatcatgtcaaagctagctggtgagagtgaaagcaaccttaggaaagcgtttgaggaagctgagaagaatgccccctcgatcattttcattgatgagctcgattccatagctccaaaaagagaaaagacacacggagaggttgaaagacggattgtttcccagctcttgacgcttatggacgggcttaaatcccgagcccatgtgattgttatgggagcgaccaaccgtcctaacagcattgacccggctttgagaaggtttggacgatttgacagggaaattgatattggtgttcctgatgagattggtcgtcttgaagttctcaggattcacaccaagaacatgaagctcgcagaagatgttgatttggaaagagtatccaaagacacccatgggtatgttggtgccgaccttgcagcattatgcactgaagctgctctccagtgtatcagagagaagatggatgtgattgacctagaagacgaagagatagatgctgaaattctcaattctatggctgtgactaatgaacatttccagacagcccttggtaacagcaatccttctgctctacgtgagacggtcgttgaggtgcctaatgtttcttgggaggacattggtggtcttgagaatgtcaagagggaactccaagagacggttcaatatccagtcgaacatcctgagaaatttgagaagtttggtatgtcaccgtctaaaggagtccttttctatggtcctcctggttgtggaaagacccttttggcgaaggctatcgcgaacgagtgtcaagccaacttcatcagtatcaaaggtcctgagctcctaacaatgtggttcggagagagtgaggccaatgtcagagagatattcgacaaagcacgccaatctgctccttgtgtccttttctttgatgagctagactccatcgccactcagagagggaacagcgttggagacgctggtggtgcagcagacagagtattgaaccagcttcttacagagatggatggtatgtctgctaagaagactgtcttcatcatcggagcaacaaacagacctgatatcatcgaccctgcacttcttcgtcctggtcgtctcgatcagctcatctacattcctcttcctgatgaggagtctcgtttccagatctttaagtcttgcttgagaaaatccccagtggctaaagatgttgacttgagggctcttgccaagtacacacaaggcttcagcggtgcagacatcacagagatttgccagcgttcttgcaagtacgcgatcagagaaaacatcgagaaggatatcgaaaaggagaggaagagaacagagacaccagaagcaatggaagaggatgaggaggagattgcagagatcaaagctggtcactttgaggaatctatgaaatacgcgaggaggtcagtgagtgatgcagacattcgcaagtatcaggcttttgctcagactctccagcagtcgcgtgggtttggaagtgagttcagattccccgaagcgacagggaccggaacagccgccaccgcggctggtggagctgacccgtttgctactgcgggtggagcagccgaggacgatgatctctatagttaaataaatgtgatcatagtctcactgctcctctctttactttgttatgctgtaaaacctttcactggtttttgtcgtgtttgtatttagtgttatgtatgtaatctatatattatatggagttaagatgaaataaatgttagagaaa

SEQ ID NO: 7340 - DNA, 2752 bp, Trigonella foenum-graecum
aaaacctaccaaaccctctcacattcttttactttcacttttttcacatctcaaattctctctcaaaaaatcccaatttcttcttccatggctaatcaacctgaatcctccgattcgaagggaacgaaaagagacttcagcaccgcgattctggaacgcaaaaaggccccaaatcgtctcgtcgtcgatgaagccgtcaacgatgacaactccgttgttgcacttcatcctgaaaccatggagaaactccaacttttccgcggtgatacaattctgatcaagggtaagaaaagaaaagatacgatttgtatcgcacttgctgatgaaacatgtgaagagccaaagataagaatgaataaggttgtgaggaacaatcttagggttaggcttggtgatgttgtttctgttcatcaatgtcctgatgtcaaatatggaaagcgagttcatattcttcctgtcgatgatactattgaaggggttactgggaatctctttgatgcttacttaaaaccttatttcctggaggcatatcgtccagttaggaagggagatatgttccttgtgagaggggggatgagaagtgtggaattcaaggttattgagtgtgaccctgctgagtattgtgttgttgcacctgacactgagatcttctgtgaaggagagcctgttaaaagggaagatgagaatcgtttggatgaggttggttatgatgatgttggtggtgttagaaagcagatggctcagattcgtgaactggtagaactgccattgaggcatccacaattattcaagtctattggtgtgaagccaccaaaaggtattttgttgtatggaccccctggatctggtaagactttgattgcacgagctgttgcaaatgaaactggtgctttttttttctgcatcaatggccctgagatcatgtcaaagctggctggtgagagtgaaagtaatctgaggaaggcatttgaagaagctgagaagaatgcaccctcaatcatctttattgatgagatagactccattgctccaaagagggagaagactaatggtgaagttgagaggaggattgtttcccagctcttgaccctcatggatgggcttaaatcccgtgcacatgttattgttataggagcaacaaatcgtcccaatagcatcgaccctgctcttcgtaggtttggaaggtttgatcgggagatagatattggtgtaccagatgaagttggacgtcttgaggttcttcgcatccatactaaaaatatgaagcttgcagaagatgttgatttagaaaagattgctaaggaaacccacggttatgttggtgctgatttagccgctttgtgtactgaagctgcacttcagtgcatcagagagaaaatggatgtgattgacctagaagatgaaactattgatgctgagatattaaactcaatggcagtcacaaacgaacatttccagactgcacttggatcaagcaatccttctgctctccgtgaaacagttgttgaagtgcccaattgcagctgggaggatattggtggtcttgaaaatgttaagcgagaactccaggagactgttcaatatccagtggaacaccctgagaagtttgagaagtttggaatgtcgccttcaaagggggttctgttctatggtcctcctggttgtggtaaaacacttttggccaaagctattgccaacgaatgccaagcaaacttcattagtatcaaaggtcctgagctactgacaatgtggtttggagaaagtgaggctaatgtgagggaaatttttgacaaagctcgtggttctgctccatgtgtccttttctttgatgaacttgattctattgcaactcagagaggtagtagttcaggagatgctggtggtgctgctgacagggttttgaatcaactgcttacagaaatggatggaatgtcagcaaagaaaactgtgtttatcattggagccaccaatcgaccagacattatagaccctgctctactacgacctggacgtctggaccagttgatttatatcccccttccagatgaagattcccgccatcagatttttaaagctgccttgagaaaatcccccatcgcaaaggatgttgacatcagagctcttgccaagtacactcaaggcttcagtggtgctgatattactgagatttgccagcgtgcatgcaagtatgctataagagaaaacattgagaaggatattgagagagaaaggaggagaagcgataatcctgaggctatggaagaggataatgaagatgatgaggtagctgaaatcaaagccgcacattttgaagaatccatgaagtatgcacgaaggagtgttagtgatgctgacattcgcaagtaccaagccttcgcccaaactttgcaacagtcaagagggtttggaagcgagtttagatttgctgacactagtgctggtggtactactgccgctgcagctgacccttttgcagttgcaagtgctggtggagccgatgaagatgacctctacagttaggtcaacctttgctatctttttattcaggaactacaatgctgcctaatttatgtaccttttggttttgtttgtatggaatctggcttctgttagattattactatttcattgttccgtaaaagttattggtacatggttaggtgtgagcctttctaaagatttgaaacaattattttctctcagctcttttggggtcactacaattgtatttctgagcgtacacatatttaac

SEQ ID NO: 7341 - DNA, 2695 bp, Tripterygium wilfordii
agatacgctacctcgctttaactcttgcgaccaaccatggcgaaccaagctgaatcctctgactctaagggaacgaagagagactttagtacggccattctcgagcggaagaaggcggcgaatcgcctggtcgtggatgaggctgtcaacgatgacaattccgtcgtggcgctccacccggataccatggagaagctccaactctttcgcggagacacgatcttgatcaagggtaagaaaaggaaagatacaatctgcattgcccttgctgatgatacatgcgatgaacctaaaatcaggatgaacaaggtcgtgaggtctaacctcagggttaggcttggggatgttgtttctgtgcaccagtgtcctgatgttaagtatgggaagcgtgtccatattctaccggtggatgacacaatagaaggagtgactggaaatctatttgatgcatatttgaaaccgtatttccttgaggcataccgtccagtgaggaagggtgatctttttcttgtgagagggggaatgagaagtgtggagttcaaggttattgagactgaccctccagaatactgtgtggttgcccctgacacggagattttctgtgaaggagaacctgtgagaagggaggatgagaacagattggatgaggttggttatgatgatgttggtggtgttagaaaacagatggctcagattcgagagttagtggaacttccattgaggcatccacaactatttaaatcaattggagtaaagccacctaaaggaatccttctgtatgggcctcctggctctggaaagactctaattgcccgggctgttgctaatgagactggtgctttctttttctgtatcaatggaccggagataatgtcaaagttggcaggggagagtgaaagcaatctcaggaaggcattcgaggaagcagagaagaatgctccgtccattatattcattgatgagattgactcaattgcacccaagcgagagaagacacatggagaagttgagaggaggattgtctcccagctcttgacgctcatggacgggcttaaatcacgtgctcatgtcattgttatgggggctacaaatcgtcccaacagcattgacccagctttgagaaggtttggaagatttgacagggaaattgatattggtgtaccggatgaagttgggcgccttgaggttcttcgtattcatacaaagaacatgaagcttgctgaggatgttgacttggaaagaatttcgaaggatacccatggttatgtgggtgctgatctggcggctctgtgtaccgaggctgcactccaatgcatcagggaaaagatggatgtaattgacttggaagatgaaacaattgatgctgagatactgaactccatggctgtaagcaatgaacacttccagactgctcttggaacgagcaatccttctgctttgcgtgaaacagttgttgaggtgccaaatgtcagttgggaggacattggtggtcttgagaatgttaaaagggagcttcaagagacagttcaatatcctgtggagcatcctgagaaatttgagaagtttggaatgtctccctctaagggagttctgttctatggccctcctggctgcggtaaaactctcctggcaaaagctattgcaaatgaatgtcaggcaaacttcattagcgtcaagggtcctgaattgcttaccatgtggttcggagagagtgaggcaaatgtgcgagaaatttttgacaaggctcgccagtctgccccttgcgtcctattttttgatgaacttgactctattgctactcagagagggagcagtgtaggagatgctgggggtgctgctgacagggttttgaaccagcttctgactgagatggatggcatgtctgcaaaaaaaactgttttcatcatcggtgcaaccaatagaccagacattatagatcctgcacttcttcgtcctggtcgtcttgatcagttgatctatatccctctacctgatgaggaatctcgtcttcaaatcttcaaatcttgcctgaggaagtccccagtatccaaagatgttgacctcagagcacttgccaagtacactaatggattcagtggtgctgatctcaccgagatatgccagcgtgcttgtaaatatgctattagagagaatattgagaaggatattgagagggagaggaggagaagtgataacccagaggctatggaggaggatgtagaggatgaagttgcagaaatcaaggcagcacattttgaggaatcaatgaagtatgctcgcaggagtgtgagcgatgctgatattcgtaaataccaggcatttgctcagacattgcagcagtccagaggttttggaactgaattcaggtttgctgatgcaagcagtggtggagctgcagcatccgaccctttcgctgcctctgctggtggtgctgatgaagatgacctttacagttagtaattatcttttcatatttgcatatgctgtttatgcctatacatttatgcggtactcgtttattctgcatatgatgttgtaaaagccttgcttggacaactattgaatccaaagataccttttcgttggccagctgaagattactggctgtgggtgccttctaatttaaaagaacacaatttgctatttgtactagagtgggtgactttcactccacaagttcttaagctaattttat

SEQ ID NO: 7342 - DNA, 2557 bp, Vinca minor
gaaatatcctctctctcagcaccagttcctgatcgaagagaaccagtatccgaagatgagtaatccagcagagtcatctgactcgaaaggaaagaaggatttttctacagcgattttggaacgtaagaaagcaccaaatcggctaatcgtggatgaggcggtcaacgatgataattctgttgtggctctccatcctgctactatggaaaaactcaaactttttcgtggcgatacaattttgattaagggtaagaaaaggaaggatacagtttgcattgctcttgctgatgagacatgtgaagaaccaaaaatcaggatgaataaggtggtgagatcaaacttgagggttcggcttgcagatgttgtatctgtgcatcagtgcccagatgttaagtatggaacacgtatccatgtcctacccttggatgataccatagagggtgtcactggggatctctttgatgcatacctgaaaccctactttctggaggcatatcgtccggtgagaaaaggagatcatttccttgttagaggagggatgagaagtgtggaattcaaggtcatcgagactgatccaggtgagtattgtgttgttgcccccgacactgaaatattttgtgaaggggagcctgtgaagagggaggacgaggatagactcgatgagattggctatgatgatgtgggtggtgtcaggaaacagatggctcagattcgtgagttagtggagctgccactcagacatcctcagctcttcaagtccattggggtaaaaccacccaagggaattctcctttatggacccccaggatcaggaaaaactcttatagctagagctgtcgctaatgagacaggagcttttttcttctgcattaatggacctgagatcatgtcaaaattagctggagaaagtgaaagtaatctcagaaaggcatttgaggaggctgagaagaatgctccatctatcatttttattgatgaaattgattcaattgctcctaagagagaaaagacaaacggcgaagttgaaaggagaattgtttctcagctcttgactctcatggatggactgaaatctcgtgcccatgtcattgttattggggctacaaatcgaccaaacagcattgatcctgctcttagaaggtttggcaggtttgacagggaaatagacattggtgttcccgatgaagttggccgtcttgaagttcttcgcattcatactaagaatatgaaactttctgaagatgttgatttggaaagaatagcaaaagacacacacggctatgttggtgctgaccttgctgcactctgcactgaagctgcacttcagtgcatccgggaaaagatggatgttattgatttggaagatgattccattgacgctgaaatattgaattctatggctgtaacaaacgaacatttccagactgctcttggaacaagcaacccatctgctttgcgtgagacagttgttgaagtgcccaatgtctcatgggaagatattggaggccttgaaaatgtcaagcgcgagcttcaagagactgttcaatatcctgtggaacatccagagaagttcgagaaatttggtatgtcgccttcaaaaggtgtgttgttctatggccctcctgggtgcggtaaaactctgctggctaaggcaattgcaaatgaatgtcaagccaattttataagcatcaagggaccagaacttcttaccatgtggtttggagaaagtgaagctaatgtccgtgaaatctttgacaaggccagacaatctgcaccatgcgttctcttttttgatgagctggactctattgctacccagaggggaagcagtggtggagatgctggtggcgcagctgatcgagttcttaatcaacttttgaccgaaatggatggaatgtcggctaagaagactgtttttataattggtgccaccaacaggcctgatatcattgatcctgcacttctccgtcctggccgtcttgatcagttaatctatattcctctgccagatgaagactctcgtcaccagattttcaaggcctgcctcagaaaatcaccaatctccaaggatgtcgatttgagagctcttgccaaatatactcaggggttcagtggggctgatattacagagatatgccagagggcttgtaagtatgccataagagagaacattgagaaggacattgaaaaagaacggaggagaaaagacaacccagactctatggatgaggatgttgaggaagaagtagcggagatcaaggctggacattttgaggagtcaatgaagtatgctcgtagaagtgtcagtgatgctgacatccggaaataccaagcatttgctcagactttgcagcagtctcgagggtttggaagtgaattccgatttgcagactctgcaacgggtgcctcaggatctgacccgtttgcaactccggctggtgctggtgatgaagacgacttgtataattaagatatatatagagagagagagatattgcaggattacagttggtaacactttcagtaatgctggttaccttctggtgatcattttcct

SEQ ID NO: 7343 - DNA, 2422 bp, Manihot esculenta
atggctgaccaagcgggatcatccgattcgaaatcggggaagaaagacttctcgacagctattttggagaggaaaaagtcacctaataggttggtcgttgacgaggctgttaacgatgacaattcggttgtttcgatgcacccggatactatggagaagctccagctcttccgcggtgacaccattctcatcaagggaaagaaacggaaggatacaatttgcattgctcttgctgatgatacctgtgagccaccaaaaatcaggatgaacaaggttgttagatctaacctgagggttcgacttggagatgttgtatctgtgcaccaatgcccagacgttaagtatggaaagcgtgttcacattttgccaattgatgacaccatagaaggtgttactgggagtctgtttgatgcatacctgaaaccctatttcttggaggcttacaggcctgtgaggaaaggggaccttttccttgttagaggagggatgagaagtgtagagttcaaggtcatagaaactgatccagcggagtattgtgtggttgccccggatactgagattttctgtgagggggaacctgtgagaagggaggatgaggacaggcttgatgaagtaggatatgatgacgttggtggtgttcggaagcagatggctcagattcgtgagttagtggagctgccattaaggcatcctcaacttttcaagtcaattggtgtgaagccaccaaagggaattttgctttatggacccccaggttctggaaagacattgatagctagagctgttgctaatgaaactggtgcatttttcttttgtatcaatgggccagagataatgtcgaaattagctggggagagtgaaagcaatctgaggaaggcatttgaagaagctgagaagaatgctccttctatcatctttattgacgaaattgattcaattgctcccaagcgtgaaaagactcatggtgaggttgaaagacggattgtctcacagcttttaactcttatggatgggctcaaatctcgggcacatgttattgttattggggctactaatcgtccaaacagtattgatccagcattgagaaggtttggaaggtttgatagggagatagacattggtgtccctgatgaagttgggcgccttgaagttttacgaatccatacaaagaatatgaagctctctgatgaggcaagttgatctggaaaggattgcaaaagatacccatggttatgttggtgctgatcttgctgccttatgtactgaagctgcactccagtgcatcagagaaaagatggatgtgatcgacttggaggatgattctattgatgctgagatacttaattccatggctgttacaaatgagcacttccaaactgcccttggaactagcaacccgtctgctttacgagaaacggttgttgaagtgcccaatgttagctgggaagacattggtggccttgagaatgttaagcgggagcttcaggagactgttcaatatcctgtggaacatccagagaagtttgagaagtttggcatgtcaccttctaaaggtgtcctcttctatggccctcctggatgtgggaaaactctactagctaaagcaattgcaaatgaatgtcaagcaaacttcataagcgtcaagggtcctgaattactcacaatgtggtttggtgagagtgaagccaatgttagagaaatttttgacaaggcccgacaatctgcaccatgtgtccttttctttgatgagcttgactctattgctactcagagaggaagcagtgttggtgatgctggcggcgcagctgatcgggttttgaaccagcttcttactgaaatggatggcatgtcagcgaagaagactgttttcataattggggccaccaacagacctgacattattgacccagcactcctgcggcctggccgtcttgaccaattgatttatattcctcttccagatgaagagtcacgtcatcaaatattcaaagcttgtctgaggaaatcacctatctctaaagatgttgatttgagggcattggccaagtatactcaaggattcagtggtgctgatattactgaaatttgccagcgggcatgcaaatatgcaataagggagaatatagagaaggatattgagaaagagaggaggagaagggagaatcctgaggcaatggatgaggatgttgaggatgaagtggcagagatcaaggctgctcattttgaggagtctatgaaatttgctcgcaggagtgttagtgatgccgacattcgcaaatatcaagcatttgctcaaacgttgcagcaatctaggggattcgggtcagaatttaggttttccgagacaaggaccagtggcgcagcctctgatccattcgctacttcagctgggggggctgatgaagatgatctgtatgattag

SEQ ID NO: 7344 - DNA, 3040 bp, Cannabis sativa
aactaaaattaaatccaatccccaaacataaataaaacaggtaagtaagagtactttctcttataaataggtaaccacagcagaaccaagcataacagagatagtttcccttattttctttcttgccaaacaagttcagaatttcagactcttgaagtcttcaaactttcttctgaatttctttggcttcttcgcctaaacaaacgctcaacgtctctcactttttctacgagtttctgatctataagatcaactcatccgccatgactgacaaagctgaatcatccgaaaccaagaaggatttctcaacggctattctggagcgtaagaagtcgccgaaccgattggttgtggatgaggctattaatgacgacaactccgtcgtttcgattcaccctaataccatggaaaagttgcagcttttccgtggagatacgatcctcatcaagggaaagaaacgaaaggatactgtatgcattgcgcttgctgatgatacttgtgaggaggcaaagatcaggatgaacaaggtcgttagatcaaatttaagggttcgtcttggtgatgtggtgtctgtacaccaatgccctgatgttaagtatggaaagcgtgtccacatactgccagtggatgatactattgaaggtgttacggggaatctgtttgatgctttcttgaaaccttactttttggaagcctatcgtccagtgcgaaagggggatctgtttcttgtaaggggagggatgagaagcgtggagttcaaagtcatcgaaactgaacctggggagtattgtgtggtttctccagacactgaaatcttctgcgagggggagcctgttaaaagggaggatgaggaacggttggatgaagttggttatgatgatgttggtggtgtaaggaagcagatggctcaaatccgggagttagtggagcttccactaaggcatcctcaactttttaaatcaattggagtgaaaccgcccaaaggaattcttctatatggacctccaggttctggaaagacactgatagctagagctgtggctaatgagactggtgctttcttcttctgtattaatggtcctgagatcatgtctaaattggccggagaaagtgaaagcaatctcagaaaggcatttgaagaagctgagaagaatgccccgtccatcattttcattgatgagattgattcaattgctcctaagcgtgagaaaactcatggggaagtcgagaggcgcattgtttcacagcttctgactttgatggatgggctgaaatctcgtgctcatgttattgtcatgggtgctacaaatcgtccaaatagtatcgatccagctttgagaaggtttggcaggtttgacagggagatagatattggggttccagatgaaattggccgccttgaagttctgcgtatacataccaagaacatgaaactgtctgatgatgttgacttggaaagaatctcaaaagaaacccatggatatgttggagctgatcttgctgctctctgcactgaagctgcactgcaatgtattagagagaaaatggatgtgatagacttggaagatgaaactattgatgctgagatattaaattccatggctgtcacgaatgagcacttccaaactgcacttggaacaagcaatccttctgcattgcgtgaaacggttgttgaagtccccaatgtcagctgggatgatgttggaggtcttgagaatgttaagcgggagcttcaggagactgttcaatatcctgttgagcaccctgagaagtttgagaaatttggcatgtcaccttccaaaggagtcctcttctacggaccccctggatgtggaaaaactctgctggctaaggcaattgcaaatgagtgtcaagcaaatttcatcagtatcaaaggtcctgaattgctcactatgtggtttggggagagtgaagccaatgttcgagaaatttttgacaaggctcgaggatctgcaccatgtgtcctgttctttgacgagcttgactctattgctacccagagagggagcagtagtggagatgctggtggtgctgctgatagggttttgaatcaacttcttactgaaatggatggcatgtcagcaaagaaaactgtttttatcattggagccactaaccgacctgatattatcgacccagctcttttgcgtccaggacgtctagatcaattaatttacattcctctccccgatgaagattcacgtcaccaaatctttaaagctaacttgagaaagtcgccaatctcaaaagatgttgatttgagggctttggcaaagtatactcaaggcttcagtggagctgatatcacagagatatgtcagcgagcgtgcaaatacgccataagggagaatatagaaaaggatatagagaaggaaagaaggagaaaggataatccagaggccatggatgaggacatggaggaggatgaagtgtcagagatcaaagctgcccatttcgaggagtccatgaagtatgctaggaggagtgttagtgatgccgacatacgcaaataccaggcatttgctcagaccttgcagcagtctcggggattcggaacagaatttagatttgctgagtcggcaaccgggggttctggttcagatccatttgcagcttctgctggtgcggctgaggaagatgatttgtatagctaggctttacctctgcccctaagacttgttctagtttcgtatttagcaatgatttcattttcccccacacagtagagaagcaggctctccttgtttccgtgattaactttatactgtcgagttgcaatgttttttttttaaaaaagttattttagatgaatcaattaaaaggaactgaaagatatttcacggaattcttctcgtttatttgattatgttatttatgatcattatctgtcctgtggggccgtcgtcagaaggctgagaatgtctttaagtttgataattttactttagatctcgtggttttgatttggaaaggggagaaagtagttaatagaggcaatttaatgcaaatcaattaatat

SEQ ID NO: 7345 - DNA, 2787 bp, Euonymus alatus
aacaagaaaggagaaggcctctcctgactcctatggctatatgtactccttacttcattagtccgatctacatcccaccgttgtatctgcattagatacttctccctctctcgctttaactcttgcgaccagccatgtcgaaccaagctgaatcatctgactctaagggaacgaagagggactttagtactgccattctcgagcggaagaaggcggcgaatcgcctggtcgttgatgaggctgtcaacgatgacaactccgtcgtggcgctccacccggataccatggagaagctccaactctttcgtggagacacgatcttgattaagggtaaaaaaaggaaggatacaatctgcattgcccttgctgatgatacatgcgatgaaccaaagatcaggatgaacaaggttgtgaggtctaaccttagggttaggctcggggatgtcgtttctgtgcaccagtgtcctgatgtgaagtatggaaagcgtgtgcatattctgcctgtggatgatacaatagaaggggttactggaaatctgtttgatgcatatttgaaaccttatttccttgaggcataccgcccagtgaggaagggtgatctttttctcgtgagaggtggaatgagaagtgtagagttcaaggttattgagactgacccaccggaatactgtgtggttgcccctgacacagagattttctgcgagggagaacctgtgagaagggaggatgagaacagattggatgaggttggctatgatgatgttggtggtgttagaaaacagatggctcagattcgagagttagtggaacttccattgaggcatccacagctatttaaatcaattggtgtaaaaccacctaaaggaatccttctgtatgggccacctggctctggaaagactctaattgcccgcgctgttgctaatgagactggtgccttctttttctgtataaatggaccagagataatgtcaaagctggcaggtgagagtgaaagcaatctcaggaaggcatttgaggaagcagagaagaatgccccatccattatattcatcgatgagattgactcaattgcacccaagcgagagaagacgaatggagaagttgagaggaggattgtctcccagctcttgactctcatggacgggcttaaatcacgtgctcatgtcattgttatgggggccacaaatcgtcccaacagcattgacccagctttgagaaggtttggaagatttgacagggaaattgatattggggtaccagatgaagttgggcgccttgaggttcttcgtattcataccaagaacatgaagcttgctgaggatgttgacttggaaagaattgcaaaggatacccatggttatgtgggtgctgatctggcggctctgtgtaccgaggctgcacttcaatgcatcagggaaaagatggatgtaattgatttggaagatgaaacaatagatgctgaaatactgaactccatggcagtaagcaatgaacacttccagactgctcttggaacaagcaatccttctgctttgcgtgaaacggttgttgaggtgccaaatgtcagttgggaggacattggtggtcttgagaatgttaaaagggagcttcaagagactgttcaatatcccgtggagcatcccgagaaatttgagaagtttggaatgtctccctctaagggagttcttttctatggtcctcctggttgtggtaaaactctcctggcaaaagctattgcaaatgaatgtcaggcaaacttcattagtatcaagggtcctgaattgcttaccatgtggtttggagagagcgaggcaaatgtacgagaaatttttgacaaggctcgccagtctgccccttgcgtcctattttttgatgaactcgactcgattgctactcagagagggagcagtgtaggagatgctgggggtgctgctgacagggttttgaatcagctcctcactgagatggatggcatgtctgcaaagaaaactgttttcatcatcggcgcaaccaatagaccagacattattgatcctgcactccttcgtcctggtcgtcttgatcagttgatctatatcccactacctgatgaggaatctcgttttcaaatcttcaaatcttgcttgaggaagtctccagtagccaaagaagttgaccttagggcgcttgcaaagtacaccaatggattcagtggtgctgatatcaccgagatatgtcagcgttcttgtaaatatgctattagagagaacattgagaaggatattgagagggagaggagaaggcgggataacccagaggctatggaggaggatgtagaggatgaagtttcagaaatcaaggctgcacattttgaggaatcaatgaagtatgctcgcaggagtgtgagcgatgctgatattcgtaaataccaggcatttgctcagacactgcagcagtctagaggatttggaactgaattcaggtttgccgaagcaagcactggtggagctgcagcatctgatcctttcgctgcctctgccggtggtgctgatgaagacgacctttatagttagaaattatcttcgaatttgcataggctgtttatgcctatgacatttataaggtagaagtacttgttttttatccatatgatgatgtaaaagccttccttgggcaattattcaatccaaaaataccttgtgtctttggatatctgaagatcgctggattccttttaatttaaaagaacgcaatttgctaatttgtatttgactgggtgactttcactccacaatttctgaagct

SEQ ID NO: 7346 - DNA, 2696 bp, Citrus sinensis
gtttcactatttccatacccttcaaaatatctttgctttcggcctcttctgtcgagcgcaaccatgtctcacccagctgaatcgtccgacgcgaattccgggaagaaggactactccacggcgattctggagaggaaaaaatcgccgaatcggctggtcgttgacgaggcgatcaacgatgacaactctgtcgtcggcttgcaccctgacaccatggacaagctccagattttccgcggcgacaccattctcatcaaaggaaagaaaaggaaggacactatctgcattgctcttgctgatgacacatgtgagcagccaaagataaggatgaacaaggttgttcggtcgaatcttagggttcgacttggtgatgttgtatctgtgcaccagtgcccagatgtgaagtatggaaagcgtgttcacattctgccaattgatgataccatcgaaggtgttaccggaaatctgtttgatgcattcttgagaccttatttcacggaagcttatcgccctgtgaggaaaggagatttattccttgttagaggaggaatgagaagcgtagagttcaaggttatcgagactgatccaggggagtattgtgtagttgctccagacacagaaattttctgtgagggggaacctataaagagggaggatgaggataggttggatgaagttggttatgatgatgttggtggagtcaggaaacagatggctcagattcgtgagctagtggagctgcctctgaggcatcctcaactctttaaatcaattggtgttaaaccacccaaaggaatcttactttatggtcccccaggttctggaaagacgttgatagccagagctgtggctaatgaaactggtgcgttcttcttttgtatcaatgggccagagatcatgtccaaattggctggagagagtgaaagcaatctcaggaaagcctttgaagaagcagagaagaatgctccatcaatcatctttattgatgaaattgattcaattgcccccaagcgtgagaagacacatggtgaggttgaacgaagaattgtttcacagcttttaactcttatggatggtctgaaatcccgtgcccatgtcattgttattggagctactaacagaccaaatagtattgaccctgctttgagaaggtttggtagatttgatagggagatagatattggcgttccagatgaagttgggcggcttgaagttctccgcatccataccaagaacatgaagctgtctgatgatgttgatttagaaaggattgcaaaagatacacatggttatgttggtgctgaccttgctgctctttgtaccgaagctgcactgcaatgcatcagggagaagatggatgtgattgacttggaagatgaaaccatcgatgctgagattcttaattccatggctgtttcaaatgagcacttccaaactgcacttgggacaagcaacccctctgctctgcgtgaaactgttgtggaagttcccaatgtcagctgggaggacattggaggccttgagaatgttaagcgggagcttcaagagactgttcaatatccagtggagcatccagagaagtttgagaaatttggcatgtcaccttcgaaaggcgtccttttctatggtccccctggatgtgggaaaactttactggccaaggcaattgcaaatgaatgccaggcaaacttcatcagtgtcaaaggccctgagctgctcacaatgtggtttggtgagagtgaagccaatgttcgagaaatattcgacaaggcacgacaatctgccccatgtgttcttttctttgatgagctggactctattgcaactcagagaggaagcagtgtgggggatgcaggcggtgccgctgatcgggttttgaatcaacttctaactgaaatggatggcatgtcagctaaaaaaactgttttcattataggggcgacaaacagacctgacattattgaccctgcccttttgcggccaggtcgacttgaccagttaatttatattcctctcccagatgaagattcacgccaccagatctttaaagcctgtttgagaaagtcaccagtctcaaaagatgttgatctgagagcgttggccaagtatactcaaggcttcagtggggctgacatcacagagatttgccaacgagcttgcaagtatgccattagggaaaatatagaaaaggatatcgagagggagaggagaagaagggacaatcctgaggcaatggatgaggatgctgccgaggatgaagtgtcagagattaaggctgctcatttcgaggagtccatgaagtttgctcgaaggagtgtcagtgatgctgatatccgcaaatatcaggcatttgctcagacgctgcagcagtcccgcggtattggatctgaatttaggtttgcagaggcaggaactggggctacgactggtgctgatccgttttcaacctctgctggtggggctgatgacgatgatctgtatagttagattttactttccttaaattaagagaccattctgtctttagcttttaccacatcaaactcagttctgactttgagctgggggtaggtttccgggccaacgttattgcttttcaaaatgttttaaagatattgttgttatttatcattaataacttgcaatgaaaattcagaagttcatcgggattttatgtttgaacaagcagtatcttt

SEQ ID NO: 7347 - DNA, 2689 bp, Solanum phureja
atatctactcgtatttttcagttcctcttccccatctctctctgtgcagatcgcgaacgattcgaaaaaatgtctcaccaggccgagtcatctgactcaaaaaatgctaagaaggatttttctacggcgattttggagcggaagaaagctgcgaataggcttattgtagatgaaacggtcaacgatgataattccgttgtcgctttacatcctgctactatggagaaacttcagcttttccgtggagatacaattctcatcaagggaaagaagagaaaggatacagttgtcattgcccttgctgatgaaacatgtgatgagcctaagattaggatgaacaaggtagtccgttcaaatttgagggttcgtctcggagatgttgtatctgtgcaccagtgtccagatgtcaaatatgggaagcgtgtccacatacttcctattgatgatacaatagaaggtctcacaggggatttgtttgatgcattcctgaaaccttactttttggaggcatatcgtccattgaggaagggagacaattttcttgttagaggagggatgagaagtgtggaattcaaggtcatagaaactgaccctggggagtattgtgttgttgctccagacactgaaatcttttgtgagggtgagcctgtgaaaagggaggatgaggagagacttgatgaagttggctatgatgatgtgggtggtgtgagaaaacagatggcccagattcgtgaactggtggaactaccattgaggcatcctcaacttttcaaatctattggtgtgaaaccaccaaagggaattttactttatggaccccctggttctggaaagactttgatagccagagctgttgctaatgaaacaggtgcatttttcttttgcattaatggacctgaaatcatgtccaaattggctggagagagtgaaagtaatctcagaaaggcatttgaagaggcggaaaagaatgctccttctatcatatttattgacgaaattgattcaattgctcccaagcgagagaagacacacggtgaagttgaaaggaggattgtctcacaactcttgactctgatggatggactgaaatctcgcgctcatgttatagtgatgggagctaccaaccgtccaaacagcattgatccagctctgagaaggtttggtaggtttgatagagaaatagacattggtgttcctgacgaagttgggcgtcttgaagttcttcgcattcataccaagaatatgaagcttgcggaagaagtcgatttggaaagaattgggaaagatacacatggttatgttggggcagatcttgctgctctttgcactgaagctgcacttcagtgtattagggagaagatggatgtcattgatctggaagacgatactattgatgctgaggtgttgaactcaatggctgtaacaaatgagcacttccaaactgctcttggtacaagcaatccgtctgcattgcgtgaaacagtggttgaagtgcctaatgtctcatggcaagacattggaggccttgaaaatgtcaagcgagagcttcaagagactgttcaatatccagtggaacacccagagaagtttgagaagtttggtatgtcaccttcaaaaggtgtacttttctatggtcccccaggatgtgggaaaaccctacttgccaaggcaattgcaaatgaatgtcaagccaattttatcagtatcaaaggacctgaactgctcaccatgtggtttggagagagtgaggcgaatgttcgtgaaattttcgataaagcaagacaatctgcaccttgcgtcctcttctttgatgagcttgactctattgctactcagaggggaagcagcagtggagatgctggaggagcagctgatcgtgttttgaaccaacttctgactgaaatggatggcatgaatgcaaagaagactgtttttataattggggcaacaaacaggcctgatataattgaccctgcacttcttcgacctggccgtcttgaccagttaatttatattcctctgccagatgaagattcacgccatcagatttttaaggcatgtctcagaaaatcccccctatcaaaggatattgatctgagagctctcgccaaacatactcagggatttagtggggctgatatcactgagatttgtcaacgagcctgcaaatatgccataagggagaacatagagaaagatatagaaagggagaagagaagacaggagaatcccgattcgatggatgaggatgttgatgaagtaccagagatcaagcctgctcattttgaggagtctatgaagtatgcacgccgaagtgtcagtgatgctgatatacgcaaataccaggcatttgcgcagacattacagcagtctagaggttttggaacagaatttcgatttgcagaggctagtagcggcgggactgctgcagctgatccatttgcaacttctaatgctgcagccgatgacgatgacctatatagctgaagttctagtttttccttgttattttactgcaaatctcctacttctcgggttaaactcgaatatcggaacctagtacttgattctggatctcgggttttgactttttagaacgttaagataatttaaagctacagtttacacttgtatcctggtgaatatttttttgaatttgatgcgcaggtttaaatagcctagttgtaac

SEQ ID NO: 7348 - DNA, 2699 bp, Solanum lycopersicum
agaaaaaaatatctactcgtatttttcagttcttcttccccatttctctctgtgcagatcgcgaacgatttcgagaaaatgtctcaccaggctgagtcatctgactcaaaaaattctaagaaggatttttctacggcgattttggagcggaagaaagcagcgaacaggcttattgtagatgaaacggtcaacgatgataattccgttgtcgctttacatcctgctactatggagaaacttcagcttttccgtggagatacaattctgatcaagggaaagaagagaaaggatacagttgtcattgcccttgctgatgaaacatgtgatgagccaaagattaggatgaacaaggtagtccgttcaaatttgagggttcgtctcggagatgttgtatctgtgcaccagtgtccagatgtcaagtatgggaagcgtgtccacatactccctattgatgatacaatagaaggtctcacaggggatttgtttgatgcattccttaaaccttactttttggaggcatatcgtccattgaggaagggagacaattttcttgttagaggagggatgagaagtgtggaattcaaggtcatagaaactgaccctggggagtattgtgttgttgctccagacactgaaatcttttgtgagggtgagcctgtgaaaagggaggatgaggagagacttgatgaagttggctatgatgatgtgggtggtgtcagaaaacagatggcccagattcgtgaactggtggaactaccattgaggcatcctcagcttttcaaatctattggtgtgaaaccaccaaagggaattttactttatggaccccctggttctggaaagactttgatagccagagctgttgctaatgaaacaggtgcatttttcttttgcattaatggacctgaaatcatgtccaaattggctggagagagtgaaagtaatcttagaaaggcattcgaagaggctgaaaagaatgctccttctatcatatttattgatgaaattgattcaattgctcccaagcgagagaagacacatggtgaagttgaaaggaggattgtctcacaactcttaactctgatggatggactgaaatctcgtgctcatgttatagtgatgggagcgactaaccgtccaaacagcattgatccagctttgagaaggtttggtaggtttgatagagaaatagacattggtgttccagatgaagttgggcgtcttgaagttcttcgcattcatactaagaatatgaagcttgcggaagaagtcgatttggaaagaattgggaaagatacacatggttatgttggggcagatcttgctgctctttgcactgaagctgctcttcagtgcattagggagaagatggatgtcattgatctggaagatgacaccattgatgctgaggtgttgaactcaatggcagtaacaaatgagcacttccaaactgctctcggtacaagcaatccatctgcattgcgtgaaacagtggttgaagtgcctaatgtctcatggcaagacattggaggccttgaaaatgttaagcgagagcttcaagagactgttcaatatccagtggaacacccagagaagtttgagaagtttggtatgtcaccttcgaaaggtgtacttttctatggtcccccaggatgtgggaaaaccctacttgccaaggcaattgcaaatgaatgtcaagctaattttatcagtgtcaaaggacctgaactgctcaccatgtggtttggagagagtgaggcgaatgttcgtgaaattttcgataaagccagacaatctgcaccttgcgtcctcttctttgatgagcttgactctattgctactcagaggggcagcagcagtggagatgctggaggagcagctgatcgtgttttgaatcaacttctgactgaaatggatggcatgaatgcaaagaagactgtttttataattggggccacaaacaggcctgatataattgaccctgcacttcttcgacctggccgtcttgaccagttaatttatattcctctgccagatgaagattcacgccatcagattttcaaggcatgtctcagaaaatcccccttatcaaaggatattgatctgagagctctcgccaaacatactcaaggatttagtggggctgatatcactgagatttgtcaacgatcctgcaaatatgccataagggagaacatagagaaagatatagaaagggagaagagaagacaggagaatcccgattcgatggatgaggatgtcgatgaagtaccggagatcaaacccgctcactttgaggagtctatgaagtatgcccgtcggagtgtcagcgatgctgatatacgcaaataccaggcatttgctcagacattacagcagtctagaggttttggaacagagtttcgatttgcagagactagtagcggcgggactgctgcagctgacccatttgcaacttctaatgccgcagccgatgatgatgacctatatagctgaagttctagtttttccttgttattttactgcaaatctccttcttctcgggttaaactcgaatttcggaacctagtactcgtttctggatctcgggttttgactttttagaacgttaagataatataaatttactattatatcctggcggatatttttttgaatttaatgcgcaggtttaaatatagcctagttgtaacgtgcat

SEQ ID NO: 7349 - DNA, 2836 bp, Phalaenopsis aphrodite
gattggcagttttcatccaccgccaatgtttttcatgaaattatgatcacaaaacaatgaacggtgagcccttaatttaggtgcaacgaaaagattttagcaatcgcctcgcagcgactctatttattctccgtctccaacacctctcctcttctaaatcttcgcagctatattttttcttcttggattcgactcttgcgattcggttcagatggcgaaccagggagagggatcatcggatccaaaatcggtgaagaaggacttcagcacggcgattctggagaggaagaaatctcccaaccgtttggttgttgatgaggctatcaatgatgataactcggtggtttcaatgcatccggagactatggagaagctgcagctcttcagaggagatactattttgttgaagggaaagaaaaggaaggatacaatttgcattgcccttgctgatgatacatgtgaggaacctaagattaggatgaataaagttgtgagatcaaatcttagagtgagacttggtgacgttgtttcagtacaccagtgccaggatgtcaaatatggaaagcgtgtgcacattcttccaattgatgataccattgaaggcgttacaggaaatctctttgatgcatatttgaagccatatttcttggaggcttatcgtcctgtaaggaaaggagaccttttccttgttagaggtggcatgagaagtgtagagttcaaaatcatagaaactgacccacctgagtactgtgtagttgctcctgacactgagatctattgtgagggtgaacctgttaaaagggaagatgaaaataggctggatgaagtgggttatgatgatgttggcggtgttagaaaacaaatggctcaaatcagagaactagtagaacttccccttagacatccccagcttttcaaatctattggtgttaaaccgcctaagggcatcttgctctatggacctcctggttctggcaagacattaatagccagagcagttgcaaatgagactggagccttcttcttttgcattaatggtcctgagattatgtcaaaactagctggagagagcgagagcaatcttagaaaggcttttgaagaagcggagaagaatgctccatcaattatttttattgatgaaattgattcaatcgcacccaagcgtgaaaaaactcatggtgaagttgagaggcgcattgtttctcagcttctgacattaatggatggcctcaaatctcgtgcacatgtaattgttattggagcaacaaataggccaaacagcattgaccctgcccttagaaggtttggcaggtttgacagggaaattgacattggagtgcctgatgaaattggacgccttgaagtcctccggattcacacaaagaatatgaagctgtctgatgatgttgatcttgaaaggattgccaaagacactcatggatacgttggagctgatcttgcagcgctttgtactgaagctgctttgcaatgcatccgtgagaaaatggatgttattgacttggaagatgaatcaatagatgctgaggtgctcaactctatggctgtcactaatgaacacttcaagacggcccttggatctagcaatccatccgcactccgtgagacggttgtggaagttcccaatgtcagctgggaggacattggtgggctggagaatgtcaagagggagctgcaagagactgtccaatatcctgttgaacaccctgagaagtttgagaaatttgggatgtctccttcaaaaggagtgttgttctatggtcctccaggctgcggtaaaactttgcttgcaaaggctattgccaatgaatgccaagccaacttcatcagtgtcaaaggtcctgagctgctaaccatgtggtttggtgagagtgaggccaacgtgagagagatcttcgataaggcccggcaatcagcaccatgtgttcttttctttgatgagctcgactcaatcgccactcagagaggtagcagtgttggtgatgccggaggtgctgctgatagagttctgaatcaacttttgacagagatggatggaatgtcggccaagaaaactgtcttcatcattggtgctaccaatagacctgacatcatagatccagcgttgcttaggccagggcgtcttgatcagttaatttatattcctcttccagatgaggcttctcgtcaccaaatttttaaagcttgtctaaggaagtcccctgtatcaaaagatgttgacctatgggctcttgctaagtatactcaaggtttcagtggtgcagacattactgagatttgccagcgtgctgtcaaatatgccatcagggaaaatattgaaaaggacattgaaagggagaggagagcccgggagaaccccgaagccatggaggaagatgaaggtgatgaagttgctgagatcaaagctgttcactttgaagagtcgatgaaatatgctcgccggagtgtaagtgatgctgacatacgcaaataccaagcgtttgcccagactctgcagcagtcgaggggattcgggagcgagttccgcttcgcagatcattctgatgcagctgctggggcaggatccgacccatttgcagcttccggtgcagccggagacgacgatgacttatatagttgaaagccagccaaacattattccaatgaggttatcttatattatatgtttttattttgtagatctgggtgacgttctgaatgggtgtggagatttactcagtttgttttcccattagttaaccgtcgtcactcttccctgaaaaacatttacttttcatttcaagaaaaacatgtacttttatcttttgacgctttagct

SEQ ID NO: 7350 - DNA, 2761 bp, Gossypium hirsutum
ataactctccccttatattaataccccccaacgccccttttcttcgctcaattcttcagatcccacacattcagcaatcaattttaaacaaagccaacaccgaaaggcaagctcttcattgtttcttatttttggttatttaatcgaccaaaaactatgtcgaaccaagctgaatcttctgattcgaaagggactaagagggattttagtacggcgatcttggaaagaaagaaggctcccaatcggctcgttgttgatgaggcgatcaacgatgataactccgttgtttccatgcatcctgacaccatggaaaagctccagttgtttcgcggtgacactatcctcatcaagggaaagaagaggaaagatactatctgcattgctctcgcagacgacacatgtgatgaaccgaagatcaggatgaataaagttgtcaggtcgaacttgagggttaggctcggtgatgttgtctctgtgcaccagtgttctgatgttaagtacggaaaacgtgtgcacatcttgcccgtggatgacactatcgaaggggttactggaaatctttttgacgcctaccttaaaccttactttcttgaagcataccgcccagtgaggaagggtgatttcttccttgctagaggtggaatgagaagcgtagaattcaaggttattgagaccgaccctcccgagtactgtgtggttgcacctgacaccgagatattctgcgagggagagcctgtaaagagggaagatgaaaatagattagacgaggtcggttatgatgatgttggtggagtacgaaaacagatggctcaaattcgggaattagtggagcttccgttgaggcatccacaactctttaaatcaattggtgtgaagccacctaaggaattctgctttacggacctcctggatcaggaaagactttgatcgcccgtgctgttgcaaatgaaaccggtgctttctttttctgcatcaacggtccggaaatcatgtcaaagttggccggagagagtgaaagtaatctccgaaaagcatttgaagaagcagagaagaatgctccgtccattatatttatagatgaaatcgattcgattgctcccaagcgagaaaaaacgaatggtgaagtcgagaggaggattgtttctcagcttttgacactaatggatgggcttaaatcccgggctcatgttattgttattggggccacaaaccgtcctaatagcatcgatccagctcttagaaggttcggaagatttgatcgggagattgatattggtgtccccgatgaagttggtcgccttgaggtgcttcgtatccacacaaagaacatgaagctggctgaagatgttgatttagaaaaaatttcgaaggaaacccacggctatgttggtgcagatcttgcagctctttgtactgaggcagcattacaatgcatccgagaaaagatggatgtgattgacctggaagatgattcaatagacgctgagatattaaactctatggcagtcacaaacgaacacttcacgactgctcttggaacaagcaatccatcagctctgcgtgaaactgttgttgaagtgcccaatatcagttgggaagatattggaggtcttgagaatgttaagagagagcttcaagagacggttcaatatccagtggagcatcccgagaagtttgagaagtttgggatgtcaccgtcgaagggagtgctattctacggccctcctggatgtgggaaaacccttctggccaaagctatcgcaaacgaatgtcaggcaaacttcattagcgtcaagggtccggaattgctcacaatgtggttcggagaaagtgaggccaatgttcgtgaaattttcgataaggctcgccagtctgctccttgtgtccttttctttgatgaacttgactcaattgctactcagagaggaagcagtgtcggagatgcaggtggtgccgccgatagggttctgaaccaacttcttaccgagatggatggcatgtctgccaagaaaactgttttcatcatcggagccaccaaccgaccagacattatagatcccgcacttttgcggccaggtcgtctcgatcagttaatctatattcccctccccgacgaggaatctcgtcatcaaatctttaaggcttgcttgaggaagtcaccacttgcaaaagaagtcgacctccgtgctcttgccaaatatactcaaggctttagcggtgctgatattaccgaaatttgccaacgtgcatgtaaatatgccatcagagaaaacattgagaaggacattgagagagaacggagaagaagggagaaccccgaagctatggaagaagatgttgatgacgaagtggcagagatcaagccggcgcatttcgaggaatcgatgaagtttgctcggaggagtgtgagtgatgctgatatccgaaagtaccaagcattcgcacaaacgttgcagcaatcgagggggtttggaagcgaattcaagtttgcagaaaccggttccagggctgcaacatctgatccttttgcaactacagcaggtggagctgatgaagatgatctttacagttaaaattgctttcatttgagggtttcttttttaaaaaaattttaatttaatccattatggtaacaattattgaactaaaggagcctttgcttgtggcttaggcatcggagtccaaaataacagtttttgttgtttttggaactgagaattttacaattgtctatttttaaatcaatttaaaatcgtaaaca

SEQ ID NO: 7351 - DNA, 2732 bp, Arabidopsis thaliana
cacttctcgaatcttctttttcttctctgcgaagctctctctctctctctactcgattatcaaacatggcgaatcaagctgaatcatctgattcgaaggggacgaagaaggattttagcaccgcgattctggagaaaaagaaggcagcgaatcgtttggttgtggatgaagccattaacgatgataactccgtcgtttctcttcaccctgataccatggagaagctacagctttttcgtggtgatactatcttaatcaagggaaagaagaggaaggatactgtgtgtattgctttagctgatgagacatgtgatgaaccaaaaattagaatgaacaaggttgttaggtctaatctcagagttaggcttggggatgttatttctgttcatcaatgtcctgatgtcaagtatgggaaccgtgttcacatcttacctttagatgataccattgaaggagtaagtggcaatatatttgatgcataccttaaaccttatttcttagaggcatatcgtccggtgaggaagggcgatcttttcctagttagaggagggatgagaagtattgagtttaaggttattgaaactgatcctgctgagtactgtgtggttgctccagatacagaaattttctgtgaaggtgaaccgataaagagagaggatgaggagaggttggatgaagttgggtatgatgatgttggtggtgtcaggaaacaaatggctcagattcgtgaacttgttgagctcccattgaggcatccacagctcttcaagtctattggtgtgaaacctcccaaaggaatcttgctctatggccctcctggttctgggaagacacttattgcccgtgctgttgctaatgagactggtgcatttttcttctgtatcaatggtcccgagatcatgtcgaagctagctggtgagagtgaaagtaacctcaggaaagcgtttgaggaagctgagaagaatgccccttcgatcatattcattgatgagatcgattcgattgctccaaaaagagagaagactcacggagaagttgaaagacggattgtatcccagctcttgacacttatggatggtcttaaatccagagcccatgtgattgttatgggagctaccaaccgtcccaacagcattgaccctgctttgagaagatttggacgttttgatagagaaattgatattggtgttcctgatgagattggtcgtcttgaagttctcaggattcacaccaagaacatgaagcttgcggaagatgttgatttggaaagagtatctaaagacacccatgggtatgttggtgctgatcttgcagcattatgcactgaagctgctctccaatgcattagggagaagatggatgtaattgacctagatgacgaggagatagatgctgaaattctcaattctatggctgtcagtaatgatcatttccagactgcccttggtaacagcaatccttcagctctacgtgagactgtcgttgaggtgcctaatgtgtcttgggaggacattggtggtcttgagaatgtcaagagggagctccaagagactgttcaatatccagtggagcatcctgagaaattcgagaagtttgggatgtcaccgtctaaaggagtcctattctatggcccccctggttgtggaaagaccctcttggctaaggctattgcgaacgagtgtcaagccaacttcattagtatcaagggtcctgagctcctcacaatgtggtttggagagagtgaagccaatgtgagagagatattcgacaaggcacgacagtctgccccttgtgttcttttctttgatgagctggactccatcgccactcagagagggaacagtgttggagatgctggtggtgcagcagatagagtattgaaccagcttcttacggagatggatggaatgaatgctaagaagacggtcttcatcatcggagctacaaacagaccagacattattgatcctgcacttctgcgtcctggtcgtctcgatcagctcatctacattcctcttcctgatgaggagtctcgttaccagatctttaagtcttgcttgaggaaatcacctgtggcgaaagatgttgacctgagggctcttgctaagtacacccaaggcttcagtggtgcggacatcacagagatttgccagcgttcttgcaagtatgcgatcagagaaaacatcgagaaggatattgagaaggagaggaagagagcagagtcgccagaagcaatggaagaggatgaggaggagattgcagagattaaagctggtcactttgaggaatccatgaaatacgctaggagatcagtgagtgatgcagacattcgcaagtatcaggcttttgctcagactctccagcaatcacgtgggtttggaagcgagttcaggtttccagatgcgccgacagggactactggagctttccctggagctgctgccacagttgggggagtcgacccgtttgccacatccggaggagcagcggatgatgatgatctctacagttgaaaggtctgatcagaccctgtgactactctctttagtctttaactttgttctgcttgaaaaactttcgatggtctttgttgtgttttatttataagtcttttgtatataatcgttgagactctagaacaatgatggtgtcatgatgaaataaatctagagaaatgagaacactgcattcatcccaaaggaaaccggatatacatacacagattttgcgag

SEQ ID NO: 7352 - DNA, 3196 bp, Theobroma cacao
atcaagaaagaatgattctcgacaatgattttgaaaaagaaaaagttgccgaatcagttagtagttgatgaggcaatcaacgatgacaactctgtcatttgcatgcagccccgaccacagagaagttgcaactcttcacacaattctcatcaggcatttgcttaggcctcgtagcaatctaagataaatgaataaagagatgaaagactataaatatcaattgaagccttttaccaacaatttcttttgattaatccgtttgatttttttttcctcttctgttctctgcttttattctctctatttcggtttaccaatcatgagtcactctgctgaatcttccgactcgaaatcggggaaaaaagacttttcaactgcgattttggaaagaaaaaaatcaccaaatcgattggtcgttgacgaaacggtcaacgatgataattccgttgtgtctatgcacccagacacaatggagaagttgcagctctttcgcggtgatactattctcatcaagggaaagaagcgaaaggacacaatctgcattgctcttgctgatgaaacatgtgagacggcgaagattaggatgaacaaagttgttcggtcaaatctgagggttcgacttggagatgttgtgtctgtgcaccagtgccctgatgtgaagtatgggaagcgtgttcacattcttcccattgatgataccatcgaaggtgttactgggaatctgtttgatgcttacttgaagccttatttcttggaggcttatcgtcctgtgaggaaaggagatctattccttgttagaggagggatgaggagtgtggagttcaaggtcattgagactgacccaggggagtattgtgtagttgccccagatactgaaattttctgcgagggggaacctgtgaggagggaagatgaggataggttggatgaagttggttatgatgatgtaggtggtgttaggaagcagatggctcaaattcgtgagttggtggaattgccactaaggcatcctcaacttttcaaatcaatcggtgttaaaccacccaaaggaattttgctttacggaccaccgggttctggtaagacattaatagccagagctgttgctaatgaaaccggtgctttcttcttctgtattaatggaccagagattatgtccaagttggctggagagagtgaaagcaatcttaggaaggcttttgaagaagccgagaagaatgctccatctatcatatttattgatgagattgattcaattgctcctaagcgtgagaagacccatggtgaagttgagagaaggattgtttcacagcttttgactctcatggatggactgaaatcaagggctcatgtgattgttattggggctactaatcgtccaaatactattgatcctgctttgagaaggtttgggaggtttgatagggagatagacattggggttccggatgaagttggtcgccttgaagtccttcgcatccataccaagaacatgaagctttctgatgatgttgatctagaaaggatttcaaaagacactcatggttatgttggtgctgaccttgctgctttatgcactgaagctgcactgcagtgcataagagagaagatggacgtcattgacttggaggatgagtctattgatgcagagatacttaattcaatggcagttacaaatgagcacttccaaactgcccttggaactagcaatccatctgctctgcgtgaaacagtggttgaagtgcctaatgttagctgggaggatattggaggccttgagaatgttaagcgagaacttcaagagactgttcaatatcctgtggagcacccagagaagttcgagaaatttggcatgtcaccttcaaaaggggtccttttctatggtcctcctggatgtggcaaaactctccttgctaaggctattgcaaatgagtgccaagcaaacttcatcagcgtcaaaggccctgagctgctcaccatgtggtttggtgagagtgaagccaatgttagagaaatatttgacaaagcccggcagtctgcaccttgtgtccttttctttgatgagcttgattccattgctacacagagaggaagcagtgttggggatgcaggtggagcagctgatagggttctaaaccaacttttaactgaaatggatggcatgtcagctaaaaagactgtttttatcattggggccaccaacagacctgacattattgacccagcccttttgaggcctggccggcttgatcagttaatttatattcctctaccggatgaggaatcccgtcatcagatcttcaaggcctgtttgagaaaatcacccatctctaaagatgttgatttgagggcactggctaggtatacccagggttttagtggtgctgatattactgagatttgccagcgagcatgcaagtatgccatcagggagaacattgaaaaggacatagagagggaaagaaggaggagtgagaatcctgaagcaatggatgaggacgttgaagaagatgttgcagagattaacgctgcacactttgaagagtccatgaagtttgctcgtcggagcgtcagcgatgccgatattcgcaaatatcaggcatttgcccagactctgcagcagtctaggggttttggatctgaattcagattttcagagaccggaaccacggctgctcctgatcctttttcaacttccgcagctggggcagacgaggatgatttgtatagctaggttatgtaggtttagcaactgaattttcatatctggttattgctttttttattttggatttgggcacgttaagcctgaatctagttatactttttaatgtttttcatggataattacttcaaacttaaaaagtcttttctcttttaatctctttggctaccaccaatatgtgatacgtacgttttaagttagtcggtaaagcattatcgagttgcaaatagctaccaaactagattagtgtggaaaagttctgggtcaggtttggccccatcattctagcccatgttttccccattgaatggctatggggttgtaggccctactacattgcttagtttcacatgcttttggagaatccctggtgcctgctgcgtggtgtgacgcgtgaccccatccctgtggggttctttccgattggccattccccccaaccctgcatcatactaaattttggcatacctt

SEQ ID NO: 7353 - DNA, 2729 bp, Glycine max
tcttcttcaattccagcaaggatgtcacagcaaggcgaatcatcggacccgaaatcggggaagaaggacttctcgaccgcgattctggaacgtaaaaagtcgccgaaccggcttgttgtggatgaggctgtcaacgacgacaactccgtagtgaccatgcacccccaaaccatggaaaagcttcagcttttccgaggggacactatccttatcaagggtaagaaacgaaaggatactatttgcatagctcttgctgatgagaactgtgaggagccaaagatcaggatgaacaaagttgtgaggtcgaatttgcgggttcggcttggagatgttgtgtctgtgcaccagtgcccggatgttaagtatgggaaacgtgtgcacattcttcctattgatgataccattgaaggtgtcactggcaatctgtttgatgctttcttgaaaccctatttcttggaggcttatcgtcctgtcagaaaaggagatctatttcttgtccggggagggatgagaagtgtagagttcaaggtcattgagaccgatcctggggagtattgtgttgttgctccagacactgaaattttctgtgagggggagcctttgaaaagagaggatgaagaaagactggacgaagttgggtatgatgatgtgggtggtgtcaggaaacaaatggctcagattcgtgagttggttgagcttccattgaggcatccacagctttttaaatcaattggtgtgaagcctcccaagggaattttactttatggacccccaggttctgggaagacattaatagcaagagctgtagctaacgaaactggagcttttttcttttgtattaatggaccagagattatgtccaaacttgctggagagagtgaaagcaatctcaggaaagcgtttgaagaagctgaaaagaatgcaccgtccattatctttattgatgaaattgattccattgcccccaagcgggagaagacacatggtgaagttgaaaggaggattgtttcacaacttttgactcttatggatggattaaaatctcgtgctcatgttattgttattggagctactaatcgtccaaatagcattgacccagcattgagaaggtttggtagatttgatagggagattgatattggtgttcctgatgaagttgggcgacttgaagtccttcgcatacatactaaaaacatgaagctatctgatgatgttgatttagagagaattgcaaaagatactcatgggtatgttggtgctgaccttgctgccctttgcactgaagctgctttgcaatgcattagggagaagatggatgtaattgacttggaggatgagacaattgatgcagaagtactgaattccatggcagttacaaatgagcatttccagactgcccttggaacaagcaacccatcagctttacgtgaaactgttgttgaagtgcctaatgtcagctgggatgacattggaggcctcgaaaatgtcaagcgtgaactgcaagagactgtacaatatccagttgagcacccagaaaagtttgagaagtttggtatgtctccatcaaaaggagtactcttctatggtcctccgggatgtgggaaaactttgttagccaaagcaattgctaatgaatgtcaagctaacttcatcagtgtgaaaggtccagaactgcttacaatgtggtttggtgaaagtgaagctaatgttagagaaatttttgacaaggccagacaatcggctccatgtgtcctcttctttgatgagcttgactctattgccactcagagaggaagcagtgttggggatgctggtggtgctgctgatagagttctaaatcaacttctgactgaaatggatggcatgtctgccaaaaagactgtgttcataattggggcaactaacagacctgacattattgacccagcacttcttcggccaggccgtctggatcaattgatctatattcctctccctgatgaggattcccgtcatcaaatctttaaagcctgcttgaggaagtcacctgtcgcaaaaaatgttgatttgagaacattggctaggcatactcaagggttcagtggtgctgatattacagaaatatgccagcgagcatgcaaatatgcaataagagaaaacatagagaaggacattgagcgagagaggaagagtaaggaaaaccctgaggccatggatgaagacacagttgatgacgaagttgccgagatcaaggctgctcattttgaggagtcaatgaagtttgcacgtaggagtgttagtgatgctgatatacgcaaatatcaggcatttgctcagaccttacagcaatcaagagggtttggaagtgaatttaggtttccagagtctggagataggactactactggatctgacccctttgcaacttctgctggtggggctgatgaagatgatctgtatagttaggtttaattattatagtgatgtatgaaatcacatgtctacctcataggaagtgtccctagacttcctctttgaagcctctcttatattttgcttttcatgtactctaattatcctgaattgttactggcttaaccttaaataccatatatggtatgttcattttatggatgatattgttattgtagaaagtagttgagcatgtgcattcttggacgttctcatagtgtaattttcttctggtggggcatgtatgattgaaaaacaaactggtttggattttgaga

SEQ ID NO: 7354 - DNA, 2788 bp, Glycine max
gatctacacggctctgcggattcatccttttcttctgcagagcaaagaaccaaccaacacttgtttcttccgccatggccgatcaacctgaatcatcggacgctaagggcaccaagagagatttcagcaccgcgattttggagcgtaagaaggctctgaatcggcttgtggttgatgaggccgtcaacgatgacaactctgtcgtcgctcttcatcctgataccatggagaaacttcaactctttcgtggtgacaccatcttgatcaagggaaagaaaaggaaagatacagtctgtatcgcacttgccgatgagacatgtgaggaaccaaaaataagaatgaacaaggttgtgagaaacaaccttagggttaggcttggagatgttgtttcggtacatcagtgtcctgatgtcaaatatggaaagcgagtccacattcttcctgtggatgatactattgaaggagtaacaggaaacctctttgatgcctacttaaaaccttatttcctggaggcatatcgaccagtgaggaagggtgacctcttccttgtgagagggggaatgaggagtgttgagttcaaggttattgaaactgacccttctgagtactgtgttgtcgccccagacacagagatcttctgtgaaggagagcctgttaaaagggaagatgagaatagattagacgaggttggatatgatgatgttggtggtgtaagaaagcagatggcacagatccgggaattagtggaactgccactgaggcacccacagttattcaagtctattggtgttaagccaccaaaaggaattctgctgtacggacccccagggtctggtaagactttaattgctcgagcagttgcaaatgaaactggtgccttctttttctgcatcaatggacctgagatcatgtcaaagctggctggtgaaagtgaaagcaatctgaggagggcatttgaggaagcagagaaaaatgcgccatccattatcttcattgatgagatagattcaatagctccaaagagggagaagactcatggtgaagtggagcggaggattgtttcccagctcttgaccctcatggatggtcttaaatcacgtgctcatgtaattgttattggagccacaaatcgccccaacagcattgaccctgctcttaggaggttcggaagatttgaccgggagatagatattggtgttcctgatgaagttgggcgtcttgaggttcttcgaattcatacaaagaacatgaaactcgctgaagatgttgatttggaaagaatatccaaggacacacatggttatgttggtgctgatctagctgctttgtgtactgaagctgcacttcaatgcatcagagagaaaatggatgtgattgacttggaagatgagacaattgatgctgaaatattgaactccatggcagtgacaaatgagcatttccagactgctcttggatcaagcaacccttctgctctccgtgaaacagttgttgaagtgcccaatgtcagctgggaagatattggtggtcttgaaaatgttaagagggaactccaagagactgttcaatatccagtggaacaccctgaaaaatttgagaagtttggaatgtcaccttcgaagggagttctcttttatggtcctcctggttgtggtaaaacacttttggcaaaagctattgccaatgaatgtcaagcaaacttcataagtgtcaaaggtcctgagctactcacaatgtggtttggagaaagtgaggctaatgtgagggaaatttttgacaaggctcgcggttctgctccatgtgtcctattctttgatgaacttgactctattgcaactcagaggggtagtagtgtcggagatgctggtggtgctgctgacagggttttgaaccaactgcttacagaaatggatggaatgtcggcgaagaaaactgtgttcatcattggggccactaatcgaccagatattattgacccagctcttctgcgtccaggtcgtctcgaccagttgatttatatccctctcccagatgaggactcccgtcatcagatatttaaagcttgcttgaggaaatccccagtctcgaaagatgttgatcttagggcgcttgccaagtacactcagggtttcagtggtgctgatataacagagatttgccagcgcgcgtgcaagtatgccattagagagaacattgagaaggacattgagagagaaaggaggaaaagagataaccctgaagcaatggaagaggatgatgttgaagatgaaatagcagaaatcaaggcagctcattttgaggaatcaatgaaatatgctcgaaggagtgttagcgatgccgacattcgcaagtaccaggcatttgcccaaacattacagcagtcaagagggtttggaagtgagttcaggtttgcagattccacctccagtggtggtgctgccaccgcatctgatccatttgcttctgctggtggagctgatgaagatgatctttacagttaggtcaacttgaatggtagtaaatgccgtgctatcttagttatgtacttctcattttgtgtatgcaaatgaggtctctaaaggcttcctttggattattgttgtcattgttttgcaaacggcatttgttcatatggccagagcattaggttcgagcctcttcgaaagttgacaaaaattatttcagtttttttattttattacttgacaacttctgtagctttgctgctcaattctcaagtggtaacactttatatgaacataattttacacacaagtttatgctcttt

SEQ ID NO: 7355 - DNA, 2958 bp, Malus domestica
taagtttggatcagtttctaattattctgttcctatttccaattccaattccggttactgcctctccatataaccaaacagtccgactagtgagaaatatttctccgaatttcctgccaaacaagccatcccccataaaaactcagaccctgaaagataatcctcctacacactccatctctctctctctatctctcccctccgtttaccatagttcctgatctctgaaattctccaaccatggctcacccggccgaatcgtccgactcgaagaagaaggacttctcgacggcgattttggagcggaagaagtcgccgaaccgtctcgtcgttgatgaagctctaaacgacgataactccgtcgtttcaatgcatcccgaaaccatggaaaagctccagcttttccgcggtgacactatcctcatcaaggggaagaaacgaaaagacacaatctgcattgcacttgctgatgacacctgtgaagagccaagaatcaggatgaacaaggttgtcaggtcaaatttaagggttcgacttggagatgttgtgtctgtacatcaatgccctgatgttaagtatgggaagcgtgttcacattttgcctattgatgactctatcgaaggagttacaggaaatctctttgatgccttcttgaaaccttacttcttggaagcttatcgccctgtgaggaaaggagatctgttccttgtcagaggaggaatgagaagtgtagagttcaaggtcattgaaactgacccaggagaatattgtgtggttgcccctgacacggagatcttctgtgagggggaacccgtgaaaagggaggatgaggaaaggttggatgaagttggttatgatgacgtgggtggtgttcggaagcagatggctcaaatccgtgaactagtagagcttccactaaggcatccccaactcttcaaatcaattggtgttaaacctccgaaaggaattctactttatggacccccgggatcaggaaagacattaatagccagagctgttgccaatgaaactggtgcttttttcttttgcattaatggaccagagattatgtcaaaattggctggagagagtgagagcaatctcagaaaggcatttgaagaagcagagaagaatgctccatccatcatctttatcgatgagattgactcaattgctcctaagcgggagaagacacatggtgaagttgaaaggaggattgtctctcagcttttgactttgatggatggactgaaatctcgagcccatgttatcgttattggtgctacaaatcgtccaaacagtattgacgcggctttgagaaggtttggtaggtttgatagggagatagacattggtgttcctgatgaagtggggcgccttgaagttctccgcatacacacaaagaacatgaaactctctgatgatgttgatctagagaggatttccaaggatactcatgggtatgttggtgccgaccttgctgctctctgtactgaagctgctctgcaatgcattagggagaagatggatgtgatagacttggaagacgaatccattgatgcagagatacttaattcaatggctgttacaaacgagcacttccagactgctcttggaacaagcaatccatctgctttgcgtgaaacagttgtcgaagttcctaatgtcagttgggaggatattggaggccttgagaatgttaagcgggagttacaagagaccgttcaatatcctgttgagcacccggagaagtttgagaaatttggcatgtcaccttctaaaggagtacttttctacgggcccccaggatgtgggaaaactcttttggccaaggcgattgcaaatgaatgtcaagctaacttcatcagtattaaaggccccgaactgctaaccatgtggtttggtgagagtgaagccaatgtgcgagaaatctttgacaaggctcgatcatctgcaccgtgtgtccttttctttgatgagcttgattccattgctacgcagaggggaagcagttctggggatgcaggtggtgctgctgatcgtgttcttaaccaactcctgactgaaatggatggcatgtcagcaaaaaagactgttttcattattggggccacaaaccgacctgacatcattgacccagcactcctacgccctggccggcttgaccaattgatttacattcctcttccagatgaagaatcacgtttccaaatatttaaatcctgcttgagaaaatcacctgtttcaaaggatgttgatctgagagcactggccagatatacacagggctttagtggggccgatatcacagagatctgccagcggtcatgcaagtatgccataagagagaatatagaaaaggatattgagcgggagagaaggagagcagagaatccagattctatggatgaggacattgacgatgaagtggcggagattaaagctgctcattttgaggagtcgatgaaatatgctcgtaggagtgtcagcgatgctgatatacgcaaataccaggcctttgctcagaccttgcagcagtccaggggtttcggaactgagtttaagtttactgaaaatacacaaactgggacaactggttctgatgcattcgcaacttctgctggtgcggctgatgaagacgatttgtatggttagtaattatatatgcatggttcccaaggcatttctgtctaacgatacgcccttgggaaggcttttctttccacagttatgactctcaagtcttttttgtactaaagagtttgtggggttttgtaggataacatgatgtttttaagtttattacgctgttaatcgtatttttatcgatcgatggatggattgtaaaaggctaactactttgttcatgggatttgttatctttaagtagctacgttgtctgtattggatgaacgctagttaaaggtttctgtttatgcttcccagttcctctacgga

SEQ ID NO: 7356 - DNA, 2690 bp, Citrus clementina
gtttcactatttccatacccttcaaaatatctttgctttcggcctcttctgtcgagcgcaaccatgtctcacccagctgaatcgtccgacgcgaattccgggaagaaggactactccacggcgattctggagaggaaaaaatcgccgaatcggctggtcgttgacgaggcgatcaacgatgacaactctgtcgtcggcttgcaccctgacaccatggacaagctccagattttccgcggcgacaccattctcatcaaaggaaagaaaaggaaggacactatctgcattgctcttgctgatgacacatgtgagcagccaaagataaggatgaacaaggttgttcggtcgaatcttagggttcgacttggtgatgttgtatctgtgcaccagtgcccagatgtgaagtatggaaagcgtgttcacattctgccaattgatgataccatcgaaggtgttaccggaaatctgtttgatgcattcttgagaccttatttcacggaagcttatcgccctgtgaggaaaggagatttattccttgttagaggaggaatgagaagcgtagagttcaaggttatcgagactgatccaggggagtattgtgtagttgctccagacacagaaattttctgtgagggggaacctataaagagggaggatgaggataggttggatgaagttggttatgatgatgttggtggagtcaggaaacagatggctcagattcgtgagctagtggagctgcctctgaggcatcctcaactctttaaatcaattggtgttaaaccacccaaaggaatcttactttatggtcccccaggttctggaaagacattgatagccagagctgtggctaatgaaactggtgcgttcttcttttgtatcaatgggccagagatcatgtccaaattggctggagagagtgaaagcaatctcaggaaagcctttgaagaagcagagaagaatgctccatcaatcatctttattgatgaaattgattcaattgcccccaagcgtgagaagacacatggtgaggttgaacgaagaattgtttcacagcttttaactcttatggatggtctgaaatcccgtgcccatgtcattgttattggagctactaacagaccgaatagtattgaccctgctttgagaaggtttggtagatttgatagggagatagatattggcgttccagatgaagttgggcggcttgaagttctccgcatccataccaagaacatgaagctgtctgatgatgttgatttagaaaggattgcaaaagatacacatggttatgttggtgctgaccttgctgctctttgtaccgaagctgcactgcaatgcatcagggagaagatggatgtgattgacttggaagatgaaaccatcgatgctgagattcttaattccatggctgtttcaaatgagcacttccaaactgcacttgggacaagcaacccctctgctctgcgtgaaactgttgtggaagttcccaatgtcagctgggaggacattggaggccttgagaatgttaagcgggagcttcaagagactgttcaatatccagtggagcatccagagaagtttgagaaatttggcatgtcaccttcgaaaggcgtccttttctatggtccccctggatgtgggaaaactttactggccaaggcaattgcaaatgaatgccaggcaaacttcatcagtgtcaaaggccctgagctgctcacaatgtggtttggtgagagtgaagccaatgttcgagaaatattcgacaaggcacgacaatctgccccatgtgttcttttctttgatgagctggactctattgcaactcagagaggaagcagtgtgggggatgcaggcggtgccgctgatcgggttttgaatcaacttctaactgaaatggatggcatgtcggctaaaaaaactgttttcattataggggcgacaaacagacctgacattattgaccctgcccttttgcggccaggtcgacttgaccagttaatttatattcctctcccagatgaggattcacgccaccagatctttaaagcctgtttgagaaagtcaccaatctcaaaagatgttgatctgagagcattggccaagtatactcaaggcttcagtggggctgacattacagagatttgccaacgagcttgcaagtatgccattagggaaaatatagaaaaggatatcgagagggagaggagaagaagggacaatcctgaggcaatggatgaggatgctgctgaggacgaagtggcagagattaaggctgctcatttcgaggagtccatgaagtttgctcgaaggagtgtcagtgatgctgatatccgcaaatatcaggcatttgctcagacgctgcagcagtcccgcggtattggatctgaatttaggtttgcagaggcaggaactggggctacgactggtgctgatccgttttcaacctctgctggtggggctgatgacgatgatctgtatagttagattttactttccttaaattaagtgactattctgtctttagcttttaccacatcaaactcagttctgactttgagctgggggtaggtttccgggccaatgttattgcttttcaaaatgttttaaagatattgttgttatttatcattaataacttgcaatgaaaattcagaagttcatcgggattttatgtttgatcaagcagt

SEQ ID NO: 7357 - DNA, 2734 bp, Euonymus alatus
gaggtcggactccactctccttattatgaattcccgttcagatcccccatagaaagagaaaaaataactgcgtctccttcagataattctccctctctcgcttcaacttttgcgaccaaccatgtcgaaccaagctgaatcctctgactccaagggaacgaagagggactttagtaccgccattctcgagcggaagaaggcggctaatcgcctggttgtggatgaggctgttaacgatgacaactccgtcgtggcgcttcacccggataccatggagaagctccaactctttcgcggagacacgatcttgattaagggtaagaaaaggaaagatacgatctgcattgcccttgctgatgatacatgtgatgaaccgaagatcaggatgaacaaggtcgtgaggtctaaccttagggttaggcttggggatgttgtttctgtgcaccagtgtcctgatgttaagtatgggaagcgtgtgcatattctgccggtggatgacacaatagaaggggttactggaaatctgtttgatgcatatttgaaaccttatttccttgaggcataccgtccagtgaggaagggtgatcttttcctcgtgagaggggggatgagaagtgtggagttcaaggttattgagactgaccctccagaatactgtgtggttgcccctgacactgagattttctgtgagggagaacctgtgagaagggaggatgagaatagattggatgaggttggttatgatgatgttggtggtgttagaaaacagatggctcagattcgagagttagtggaacttccattgaggcatccacaactatttaaatcaattggtgtaaagccacctaaaggaatccttctgtatgggcctcctggctctggaaagactctgattgctcgggctgttgctaatgagactggtgctttctttttctgtataaatggaccagagataatgtcaaagttggctggggagagtgaaagcaatctcaggaaggcattcgaggaagcagagaagaatgccccatccattatattcattgatgaaattgactcaattgcacccaagcgagagaagacacatggagaagttgaaaggaggattgtttcccagctcttgacactcatggatggtcttaaatcacgcgctcatgtcattgttatgggggctacaaatcgtcccaacagcatcgacccagctctgagaaggtttggaagatttgacagggaaattgatattggtgtaccagatgaagttgggcgccttgaggttcttcgtattcatacaaagaacatgaagcttgctgaggatgttgacttggaaagaatttcgaaggatacccatggttatgtgggtgctgatctggcggctctatgtaccgaggctgcactccaatgcatcagggaaaagatggatgtaatcgacttggaagatgaaacaattgatgctgagatactaaactccatggcagtaagcaacgaacacttccatactgctcttggaacaagcaatccttctgctttgcgcgaaacagttgttgaggtgcccaatgtcaattgggaggacattggtggtcttgagaatgttaaaagggagcttcaagagactgttcaatatcctgtggagcatcctgaaaaatttgagaagtttggaatgtctccctctaagggagttcttttctatggtccacctggatgtggtaaaactcttctggcaaaagctattgcaaacgaatgtcaagcaaacttcattagtatcaagggtcctgaattgcttaccatgtggttcggagagagcgaggcaaatgttcgagaaatttttgacaaggctcgccagtctgccccttgcgtcctattttttgatgaacttgactctattgctactcagagggggagcagtgtaggagatgctgggggtgctggtgaccgggttttgaaccagcttctgaccgagatggacggcatgtctgcaaagaaaactgttttcatcatcggtgcaacaaatagaccagacattatagatcctgcacttcttcgtcctggtcgtcttgatcagttgatctatatccctctacctgatgaggaatctcgtcttcaaatattcaaatcttgcttaaggaagtcccctgtatccaaggatgttgacctcagagcgcttgccaagtacactaatggattcagtggtgctgatatcacggagatatgccagcgtgcttgtaaatatgctattagagaggacattgagaaggatattgagagggagaaaggggataacccagaggctatggaggaggatgaagttccagaaatcaaggcagcacattttgaggaatcaatgaagtatgctcgcaggagtgtgagcgatgctgatattcgtaaataccaggcatttgctcagactttgcagcagtccagaggatttggcactgaattcaggtttgctgatgcaagcactggtggagctgcaacatccgacccttttgccgcttctgctggtgttgctgatgaagatgacctttatagttagaatttatcttcgtatttgcttctcatgttatatacatttacgtgttagaagtgcttttttattctgctaatcatgttgtaaaacccttttttgggcaattatttagtccaaaaatcccgtctttggctagttgagattaccggctgcctttcgattttaaagaacacaattttctatttgtactagagagtgggtgactttcactct

SEQ ID NO: 7358 - DNA, 2829 bp, Glycine max
ctcgctcagatctacacgtctctgcggattcatccttttcttctgcagagcaaagaaccaaccaacacttgtttcttcagccatggccagtcaacctgaatcatctgacgcaaagggcacaaaaagggattttagcaccgccatattagagcgtaagaaggctccgaatcggctcgtggttgatgaagctgtcaacgacgacaactctgttgtcgcgcttcatcctgataccatggagaaacttcaactttttcgtggtgacaccatcttgatcaaggggaaaaaaagaaaggatacaatatgtatcgcacttgctgatgagacatgcgaggaaccaaaaataagaatgaacaaggttgtaagaaacaaccttagggttaggcttggagatgttgtttcagtgcatcagtgtcctgatgtcaaatatggaaagcgagtccacattcttcctgtggatgatactattgaaggagtaacaggaaacctctttgatgcctacttaaaaccttatttcctagaggcatatcgaccagtgaggaagggtgacctcttccttgtgagaggggggatgagaagtgttgaattcaaggttattgaaactgacccttctgagtactgtgttgtcgctccagacacagagatcttctgtgaaggagagcctgttaaaagggaagatgagaatagattagacgaggttggatatgatgatgttggtggtgtaagaaagcaaatggcacagattcgggaattagtggaactgccactgaggcacccacagttattcaagtctattggtgttaagccaccaaaaggaattctgttgtatggacccccagggtctggtaagactttaattgctcgggcagttgcaaatgaaactggtgccttctttttctgcatcaatggacctgagatcatgtcaaagctggctggtgaaagtgaaagcaatctgaggaaggcatttgaggaagcagagaaaaatgcgccatccatcatcttcatcgatgagatagattcgatagctccaaagagggagaagactcatggtgaagtggagcggaggattgtttcccagctcttgaccctcatggatggtcttaaatcacgtgctcatgtaattgttattggagctactaatcgccccaacagcattgaccctgctcttaggaggtttggaagatttgaccgggagatagatattggagttcctgatgaagttgggcgtcttgaggttcttcggattcatacaaagaacatgaaacttgctgaagatgttgatttggaaaaaatagccaaggatactcatggttatgttggtgctgatctagctgctttgtgtactgaagctgcacttcaatgcatcagagagaaaatggatgtgattgacttggaagatgagacaattgatgctgaaatattgaactccatggcagtgacaaatgagcatttccagactgctcttggatcaagcaatccttctgctctacgtgaaacggttgttgaagtgcccaatgtcagctgggaagatattggtggtcttgaaaatgttaagagggaactccaagagactgttcaatatccagtggaacaccctgaaaaatttgagaagtttggaatgtcaccttcgaagggagtcctcttttatggacctcctggttgtggtaaaacgcttttggcaaaagctattgccaatgaatgtcaagcaaacttcattagtgtcaaaggtcctgagctactaacaatgtggtttggagaaagtgaggctaatgtgagggaaatttttgacaaggctcgtggttctgctccatgtgtcctattctttgatgaacttgactctattgcaactcagaggggtagtagtgtcggagatgctggtggtgctgctgacagggttttgaaccaactgcttacagaaatggacggaatgtcggcaaagaaaactgtgttcatcattggggccactaatcgaccagatattattgacccagctcttctgcgtcctggtcgtctcgaccagttgatttatatccccctcccagatgaggattcccgtcatcagatatttaaagcctgcttgaggaaatcccccgtgtcgaaagatgttgatcttagagcacttgcaaagtacactcagggtttcagtggtgctgatatcacggagatttgccagcgtgcgtgcaagtatgccattagagagaacattgagaaggacattgagagagaaaggaggaaaagagataaccctgaagcaatggaagaggatgatgttgaagatgaaatagcagaaatcaaggctgctcattttgaggaatcaatgaaatatgctcgaaggagtgttagcgatgctgacattcgcaagtaccaggcattcgcccaaacattacagcagtctagaggatttggaagtgagttcaggtttgcagattccacctccgccggtggtacagctgctgcatctgacccattttcctctgctggtggagctgacgaggatgatctttacaattagataaacttgtatgcctgttatttgttcgtatatgccgtgctatcttaattatctacttctcatttcgtgtatgcaaatgaggtctgtaaacgcttcctttggattattattgtctattgtttttgcaaacggcatttgttcatatggccagagcattaggttcgagcctcttcgaaagttgacaaaaatttatttcagttttattgtattacttgacagcttttgtagctttgctgctcaatttccaagtgtataacactttatatggacataatttacacacaaatttatgctatttttgtgccatgagattttaacgg

SEQ ID NO: 7359 - DNA, 2630 bp, Valeriana officinalis
gcaccgctcactcagcagatctccataccaaaccctttcgtttatcctctcatctttctctaattgctcacagttttcgacaaatcatggctgatcaacctgaatcttctgactctaagggtgggaagagagactttagtactgcaattctggagaggaagaaggcagctaatcgtttggttgttgatgaagctattaacgacgataacagtgtcgtcgctctccatcctgagactatggaaaagcttcagcttttccgaggcgatactatattgatcaagggcaagaaaaggaaagacacaatttgcattgctcttgcagacgatacttgcgatgaacccaaaattaggatgaacaaagttgtaagatcgaacttgcgagtcaggcttggggatgttgtttctgttcatcagtgtgctgatgtcaaatatgggaagcgtgttcacattcttccaatcgatgatactatcgaaggtgtctctgggaatctgtttgatgcttacgtaaaaccgtatttcctggaagcttatcgccccgtaagaaaaggtgatttctttttagtaagaggaggaatgcgaagtgtggaattcaaagtcatcgaaaccgaccctgccgaatactgtgttgttgcccccgatactgaaatcttctgtgaaggcgaaccggtgagaagagaagacgaagaccggcttgacgaagtcggctatgatgatgttggcggggtccgcaaacaaatggctcaaattcgcgagcttgtggagcttccgctaaggcacccccagctcttcaagtcgatcggtgtcaaaccaccgaagggaattctcctctatggtccacctggctctggcaaaaccctaattgcacgagctgttgctaacgaaacaggagccttctttttctgcatcaacggccctgagatcatgtcaaagctggctggtgagagtgagagtaatctgaggaaagcatttgaggaagccgagaagaacgctccttccattatctttatcgatgagatcgattcaattgcacccaagagagagaagacgcacggtgaagtggagcgtaggattgtgtctcagcttctgacgcttatggacggtctcaaatccagggcacacgtcattgttatgggcgctactaacaggccgaatagtatcgatcctgctttgaggaggtttggtcgattcgatagggaaatcgatattggcgtacctgacgaaattggtcgtcttgaggttcttcgtatccatacaaagaacatgaagcttgctgaagatgtcgatctggaaaaaatttcaaaggaaactcatggttatgttggtgctgatttggcggctctctgcactgaagccgcgcttcaatgcattagggagaaaatggatgtgattgacctcgaggatgactcgattgatgcagagattctcaattcaatggcagtttccaatgagcactttgcaactgctcttggaactagcaatccctctgctctacgtgaaacggtcgttgaagttcctaatgttaaatgggaagatattggaggcctcgaaaatgtcaaaagggaacttcaagagacggtgcaatatccagtggagcatcctgagaaatttgagaagtttggtatgtcaccgtcaaagggagtgttgttttacggaccgcctggatgtggtaaaacactgctggcaaaggcaatcgcgaatgaatgtcaggccaactttatcagtatcaaaggccccgaacttctcaccatgtggttcggtgaaagtgaagccaacgttcgtgaaatcttcgataaagctcggggttctgctccttgtgttctcttctttgatgaactcgactccattgccactcagaggggaagtagtgcaggagattcaggtggagctgatagggttttgaaccaacttctgacggaaatggatgggatgtcagcgaagaagactgtatttattatcggggcaaccaacaggcccgatattatcgacccggcactcttgcgtccgggtcgtttggatcaacttatttatattcctctaccagacgtcgaatcccgtttccagatcttcaagtcctgccttagaaaatctccagttgctaaagatgtcgaccttcgagctctctccgagtacactcaaggattcagtggtgcagatattactgaaatttgtcaacgtgcttgcaaatacgccattcgggagaatatcgagaaagatattgagaaggaaaggaggagaagcgagaatccagaagccatggaagaggacgatgctgacgacgaggtgtcagaaataaaggcagcccacttcgaagaatcaatgaaatacgcacgaaggagtgtgagcgacgctgatatccgcaagtaccaagcctttgctcagaccttacagcagtctcgagggtttggatcagagttcagattctcagagaccagttcggcagccaccactacagcagctgatccgtttgcagcttctgctggcgcagccgacgaagatgatctctacggttaatttacattacgtttttactgttcccaagacttagtttttactgtgtattttttattacaccctcgtacttaacattatgtttgctatctctactacttaccaacttttttactgctgtgc

SEQ ID NO: 7360 - DNA, 2768 bp, Mimulus guttatus
tacatctccaattcttctcaccaagcggattcacatctcgaaacccctgttattcagatcgtcggagatatgagtcaccaagctgagtcgtctgacgcgaaaggtgggaagaaggacttctcgaccgcgatattggagaggaaaaaggcagcgaatcggctcgtcgttgatgaggcggtcaacgatgacaactccgttgtcgctctccaccccgccactatggaaaagctccagcttttccgcggagacactattttgattaaggggaagaaaagaaaggatacagtttgcattgcccttgctgatgaaacttgtgaagagccaaagattcggatgaacaaggttgtcagatcaaatttgagggttcgtctaggggacgttgtatctgtgcatcaatgcccagatgttaaatatggaaagcgcgtccacatactccccttggatgatacaatagaagggatcactggggatcttttcgatgcatatctcaaaccttactttctggaggcatatcgccctgtgaggaaaggagaccattttcttgttagaggagggatgagaagtgtggaatttaaagttgttgaggctgatccaggggagtactgtgttgtggcccctgatactgagatcttctgtgaaggggaacctgtgaggagagaggatgaggaaaggctggacgaggttggctatgatgatgtgggtggcgttaggaagcagatggctcagatccgtgaattagtggagttgccactgaggcatcctcagcttttcaaatctattggtgtgaaaccccccaaaggaattttgctttttggccccccaggttctggaaagactttaattgctcgagctgttgctaatgaaactggcgctttcttctttttgataaatgggccggaaattatgtccaaactggctggagagagtgagagcaatctgagaaaggcatttgaggaggctgagaagaatgctccatctattatatttattgatgaaattgattcgattgcacctaagcgagagaagaccaacggtgaagttgagaggaggattgtttctcaactcttgactctcatggatgggttgaaatctcgtgcccatgttattgtcatgggggccactaaccggcccaacagcattgacccggctcttagaaggtttggtaggtttgacagggaaatagacattggtgtccctgatgaggttggacgccttgaagttcttaggattcatacaaagaacatgaagctttcagatgatgttgatttagaaagaatatcaaaggacacacatggatatgttggtgcggatcttgcagctctctgcactgaagcagcgctccagtgtatcagagagaaaatggatgtcattgatttggaagatgatacaattgatgctgagatactcaactccatggctgtctcgaatgagcacttccacactgctctagggacaagcaatccttctgctttgcgggagacggttgttgaagtacccaatgtctcttgggaagatatcggagggcttgaaaatgtcaagagggagcttcaggagaccgttcaatacccagtggaacatccagagaaatttgagaaatttggtatgtcaccttcaaagggtgttcttttctatggtcctcctggatgtggtaagactctgctagccaaggcaatcgcaaatgaatgtcaggccaactttatcagtataaaaggacctgaactactcactatgtggtttggagagagtgaagctaatgtccgtgaaatatttgacaaggctagacaatctgctccatgtgttctcttctttgacgagcttgactctattgctactcagagaggaagcagtggtggagatgccggtggtgcggcagaccgtgttcttaaccaacttctgactgaaatggatggcatgaacgcaaagaagaccgtttttataattggggccactaacagacccgacataattgatcctgcacttcttcgcccaggtcgtcttgatcagttaatatatatccctctgccagatgaggattctcgtcaccagatcttcaaagcctgcctccgaaaatctccactttcgaaaaatattgatttgcgagctcttgccaagtatactcaaggatttagtggtgcagatatcacagaaatatgccagagggcttgcaaatatgccataagggagaacattgagaaggacatagaaagggagactaggagaaagaacaatccagattccatggaggaggatattgatgacgaagtttccgaaataacccctgcacatttcgaagagtccatgaaatacgctcgtagaagtgtgagtgatgctgatatacgcaagtaccaggcctttgctcagaccctgcagcagtctcgtggattcggaacagagttccggtttaccgagtcagcacctggggcagcggcatctggatccgatccatttgcagcctctgctgttggagctgatgaagacgatttgtacagttagtttatctgggatttccgaatttttagtttgcagcaaactcccagattcagttacatgcactatgtgtattcaccagaaatggttgagcacttttcgctttatatttcggaaaactaatttatttcttaacttaaaattccttttgtcaacttgtcctatcctaatacagtctttcctgttattgatttggtaccccaattactgtttatttatcgactggcttaaactatatcccctcctcattttcaaattatctgttgccttaggtttttttt

SEQ ID NO: 7361 - DNA, 3393 bp, Prunus persica
ttccaagtccaattcgggttactgcttctccatataaccaaacaacccagttagaaatatttctccgattttcgtgccaaacaagccataaaactcaggcccagatatatccacccacacacaagatcacacaaacactctctctctcttggtctctttgcttttcgtctaccatacttcctgatctctgaaatctccaccatggctcacccagccgaatcgtccgactcgaagaagaaggacttctcgaccgcgattttggagcggaagaagtcgccgaaccgtctcgtcgtggatgaggctataaacgatgacaactctgtcgtttcgatgcatccagagaccatggaaaagctccagcttttccgtggcgacactatcctcatcaaggggaagaaacggaaggacacaatctgcattgcacttgctgatgacacctgtgaagagccaagaatcaggatgaacaaggttgtcagatcgaatttgagggttcgacttggagatgttgtgtctgtacaccaatgccctgatgtgaagtatgggaaacgtgttcacattctgcctattgatgactccatagaaggagttactggaaatctctttgatgcctttttgaaaccttacttcttggaagcttatcgccctgtgaggaaaggagatctgttccttgtcagaggaggaatgagaagtgtagagttcaaggttattgaaacagacccaggagaatattgtgtggttgccccagacactgagatcttctgtgagggggaaccagtgaaaagggaggatgaggaaaggttggatgaagttggttatgatgatgtgggtggtgttcggaagcagatggctcaaatccgtgagttagttgagctgccactgaggcatcctcaactgtttaaatctattggtgtgaaaccaccaaaaggaattctactttatggacccccgggttcaggaaagacattaatagccagagctgttgccaatgaaactggtgcttttttcttttgcattaatgggccagagattatgtctaaattggctggagagagtgagagcaatctcagaaaggcatttgaagaagcggagaagaatgccccatcaatcatctttattgatgagcttgattcaattgctcctaagagggagaagacacacggtgaggtcgaaaggcggattgtttctcaacttttgactctgatggacggattgaaatctagagctcacgttattgttattggtgctacaaatcgtccaaacagtattgactcggctttgagaaggtttggtaggtttgatagggagatagacattggtgttcctgatgaagttgggcgtcttgaagttcttcgcattcacaccaagaacatgaaactctctgatgatgttgatttagagaggatttccaaagatacacatgggtatgttggtgctgaccttgctgctctctgcactgaagctgcactccaatgcattagggagaagatggatgtgattgacttggaagatgaaaccattgatgcagagatactcaactcaatggctgtaacaaatgagcacttccagactgctctaggaacaagcaatccatctgctttgcgcgaaacggttgttgaagttcccaatgttagttgggaggatattggaggccttgaaaatgtcaagcgggagctacaagagactgttcaatatcctgttgagcacccagagaagtttgagaaatttggcatgtcaccttctaaaggggtccttttctatggacccccaggatgtgggaaaactcttttggccaaggcaatcgcaaatgaatgtcaagctaacttcatcagtatcaaaggccctgaactactcaccatgtggtttggtgagagtgaagccaatgttcgagaaatctttgacaaggctcgtgcatctgcaccatgtgtccttttctttgatgagcttgattccattgctacacagagaggaagcagttctggggatgcagggggtgctgctgatcgggttcttaaccaactcctgactgaaatggatggcatgacagcaaaaaagacggttttcattattggggccacaaaccgacctgacatcattgacccagcacttctccgacctggccgtcttgatcaattgatttatattcctcttcctgatgaagaatcgcgtttccaaatctttaaatcctgcttgagaaaatcacctgtctcaaaagatgttgatttgagagcattggccaggtatacacagggcttcagtggggctgatatcacagagatctgccagcggtcctgcaagtatgccataagagaaaatattgagaaggatatagagcgggagaggaggagaggggagaatccggattctatggatgaggacatcgatgacgaagtggcagagattaaagctgctcattttgaggagtcaatgaaatatgctcgtaggagtgtcagcgatgcagatattcgcaaatatcagacctttgctcagaccttgcagcagtccaggggtttcggaactgagtttaggtttgctgataaccaaactggggcaactggtgctgatccattcgcaacttctgctggtggggctgacgaagatgatttgtatagttaatatttatttatatatgcatggtttcgggtgacatttgtgtctactgatatgcttttgtctgctcctcgtgccaccctggaggaagcctttccttttcatagttatgcctagtcttctgtgtattaaagagtttgtggggtttgctaggatgacatgctgtttcaagtttcatatgctgttaatcaatttctatcaatcaatggatggatggattgaaaaaggccacttactatattcatggaatttgttatgtttaaatattaaagttgtctgtactggatgaagtcgagttagatgctactggttttgctttgttgttcctcttcagatgggacggattgcgacttggagcggtgagtatagagcccgctgcttctggcttgcctacttgactttggtctatagatgatctatggtggattgggagggtagttttaatctcagctctaaattattttggagtggctggattttgtggaattacccgagccttcacctaatggacaaaagaaactgaaataatgcaagaattgtaggtattttatatagatcaaattgcagatgatgtgattttgctttacgccggcttcaagtcaggtgcatgacttctcacccttttgagatgggccaggttttagtgcctggtgtcatggatgatgactctcaaaaattaagagaaatgtcggaaattggtcaccagtttttaaccacgatgtaaacagagtctcactattcacgtgaaatgaactttttatttatttattataaaagaattcatat

SEQ ID NO: 7362 - DNA, 2689 bp, Actinidia deliciosa
  misc_feature (918)..(918): n is a, c, g, or t
  misc_feature (954)..(954): n is a, c, g, or t
  misc_feature (957)..(957): n is a, c, g, or t
  misc_feature (1227)..(1227): n is a, c, g, or t
  misc_feature (1234)..(1235): n is a, c, g, or t
  misc_feature (1254)..(1255): n is a, c, g, or t
  misc_feature (1584)..(1584): n is a, c, g, or t
  misc_feature (1794)..(1794): n is a, c, g, or t
  misc_feature (1824)..(1824): n is a, c, g, or t
  misc_feature (2145)..(2145): n is a, c, g, or t
ttgtctccgctctcgttgcgtcttcgtcgtcgcctctcccagatcacccatcgtcaactcacaccacaaaccgaacacaaagacatgagtaaccaagctgaatcctccgactcgaaaggagcgaagaaggacttctcgacggcgatcttagagcgcaagaagtcacccaatcggctcgtcgtcgatgaggccgtcaacgatgataactccgtcgtagcgatgcaccctgctacgatggaaaagcttcagctcttccgtggcgacacgatcctgatcaagggaaagaaacggaaggatacagtctgtattgcccttgctgatgatacgtgtgaagagccaaagattaggatgaacaaggttgttagatcaaatctgagggttcggctgggagacattgtatctgtgcatcagtgcccagatgttaagtatggaaaacgtgtccacatactgccactggatgacaccatagaaggcatcactggggatctgtttgatgcatacctgaaaccttactttttggaggcataccgcccagtgaggaaaggggatcatttccttgtgagaggagggatgaggagcgtagaatttaaggtcattgagacggaaccaggagaatactgcgtggttgcaccagacacagagatattttgtgagggggagcctgtgagaagagacgatgaggataggttggatgaaattggctatgatgatgtcggtggtgttaggaagcagatggctcagattcgtgaattggtggagttgccattaaggcatcctcaacttttcaagtcaattggtgtgaaaccacccaaaggaattttactttatggaccccccggttctggaaagacattgatagctagggccgttgctaatgagaccggtgctttcttcttttgtataaatgggccggaaatnatgtccaaattggctggagagagtgaaagcaatctnagnaaggcattcgaggaggctgagaaaaacgcaccatccatcattttcattgatgagcttgattcaattgctccaaagagagagaagacacatggtgaagttgaaaggcggattgtttcacagctcttgacgctcatggatggactgaaatctcgggcccatgttattgtaatgggggcaacgaatcggccaaacagcattgacccagctttgagaaggtttggaaggtttgatagggagatagacattggtgttcctgatgaagttgggcgncttgaanntcttcgcattcataccaannacatgaagctctctgatgaggttgacttagaaaggatttcaaaggatactcatggctatgttggtgctgatcttgctgctctttgcaccgaagctgcacttcagtgcattagagaaaagatggatgtcattgatttggaagatgactctattgatgctgagatactgaattccatggcagttacaaatgagcattttcagactgctcttggaacgagcaacccatctgctttgcgggaaacggttgttgaggtgccaaatgtcagctgggaggatattggaggacttgagaatgtcaagcgggagcttcaagagactgttcaatatccngtggagcatccagaaaagttcgagaaatttggaatgtcaccttcaaaaggggttcttttctatgggccccctggatgtggaaaaactctactggccaaggcaattgctaatgaatgtcaagctaattttatcagtgtcaaaggacctgaactgcttaccatgtggtttggcgagagtgaagccaatgttcgagaaatatttgacaaggcnagacaatccgcaccatgtgtcctctttttngacgagcttgactctattgctactcagaggggaagcagtgttggggatgcaggtggcgctgccgatcgggttctgaaccaactcttgactgaaatggatggcatgtctgcaaaaaagactgttttcattattggggccacaaacagacctgacatcattgacccagcactcctgcggccaggccgacttgatcagctaatttatatacctctaccagatgaagaatcacgtcttcagatattcaaggcctgcttgagaaaatcacccatctccaaagatgttgatttgagagctcttgccaaatacactcaaggatttagnggagctgacattacagaaatatgccagcgggcatgcaagtatgctataagagagaacatcgagaaagatatagagaaggaacgcaggaggggggagaatcctgactctatggacgaggacattgacgacgaagtggcagagattaaggctgcccattttgaggagtctatgaagtatgcacgtaggagtgtgagcgacgctgacatacgcaaataccaggcctttgctcagactttgcagcagtctcgaggtttcggaactgaattcaggttttcggagtcgggaactggagctcaatctgggtccgatccctttgcagcttctgctggtggggctgacgaagatgacctgtatagctaggttcttggtgtcctgcttttcactccctcataaaagttttttgtttttggaaaattctcaaggaatttaacttccacctctgtttagattcacttacgtttccttgctattttatatttgatggtactttgatacttatggatggatacttgaaaatggtcaatttggtgaatcaaaaaaaaaa

SEQ ID NO: 7363 - DNA, 2766 bp, Orobanche aegyptiaca
tttctttcctaacacgaaagggagtcgtcttctctctatatatttgatatttctatcacccctaattcccagatccctcattcgcattcttcaatttattcatcaacatatcaaaaaaccctaaaaccttaattatttcccttgatactacgcgatgagtaatcaagcagaatcctccgatgccaagggtacgaagagggactttagcacggcgattttggagaggaaaaaggctccgaatcggctagtagtggatgaagctatcaatgatgataactccgtggtatctctacatcccgacactatggaaaagcttcagctttttcgcggagacacgatcttaatcaagggtaagaaaagaaaggatacaatatgcattgcccttgctgatgaaacttgtgatccaccaaagattcgaatgaacaaggttgtccgaagcaacctgagagttaggctcggagatgtcgtttccgtgcatcagtgcgctgatgtcaagtatgggaagcgtgtccacattctccctttggatgacacgattgaagggattactggaaacctctttgatgcctacctgaaaccatattttctcgaggcataccggcctgtaaggaaaggtgacttgtttcttgtcaggggaggaatgagaagcgtagagttcaagattatcgagaccgacccctctgagtactgtgttgttgcccctgataccgagattttctgtgagggggagcctattaagagggaggacgaggatcgtttgaatgaggttggttatgatgatgttggtggggtccgcaaacagatggctcagattcgtgagttggtcgagctcccactcaggcacccgcagcttttcaaatcgatcggcgtcaagccaccgaagggaatacttctctacgggcccccgggatctggaaagaccttaatcgccagggcagttgccaacgagactggcgctttctttttctgcattaatgggccggagattatgtcgaaattggctggagagagtgagagtaatctaaggaaggcgtttgaagaagccgagaagaatgcgccagcaattatctttattgacgagattgactcgattgctccgaagagagagaaaacaaacggtgaggtcgagaggagaattgtttctcagctgttgacgttgatggatggcctcaaggcccgtgcccatattatagtgatgggtgctacaaacaggcccaatagcattgacccggccctgagaagatttggtagatttgacagagaaatagatattggggttcctgatgaagtcggacgtcttgaagttttacgtattcatacgaagaacatgaagcttgctgaagatgttgatctggaaagggttggtaaggacacacatggctatgttggtgctgatttagctgcgttgtgcacggagtctgcccttcaatgcatcagggagaaaatggatgtgattgatttggaagatgacaccattgatgcagaggtactgaattccatggccgtcaccaatgaacacttcctaactgctctcggaataagcaatccctctgctctgcgtgaaaccgttgttgaagtgcccaatgttaactgggcagatattggaggccttgagaatgtcaagcgtgaactccaagagactgttcaataccctgtggagcatcccgagaaattcgaaaaattcggcatgtccccttccaagggagttctgttctatggtccccctggttgtggaaagactttactcgcaaaggctattgccaatgagtgccaggccaactttatcagtgtcaagggtcccgaattactcaccatgtggtttggtgagagtgaggctaatgtcagggagattttcgacaaggcccgtcaatccgccccttgtgtcctcttcttcgatgaattggactctattgcaactcagagaggaagcagttcgggagatggtggcggtgctgccgaccgtgtgttgaatcagcttctgacagaaatggacggcatgaatgccaagaaaaccgtgttcattatcggtgccactaacagacccgatataattgattcggcccttctccggcccggtcgtctcgatcagttgatttacatccctctccctgacatggagtcgcgccatcagatattcaaggcgtgcctgagaaagtcgcctgtttctaaagatgtggatcttagggcccttgctgagtacacccaaggctttagtggtgccgacattacagagatatgccagcgcgcatgcaaatatgccatcagagagaacattgagaaagatatcgagagggagaagagaagaagtgaaaacccagattccatggaggaagacgttgaagacgaggtacctgagattaaggcagctcactttgaggaatcgatgaagtacgctcggaggagtgttagtgatggcgatattcgcaaatatcaggcctttgctcagacattgcagcagtcaagagggtttggttctgaatttaggtttcagaacaatactactactgctactactgggcccgctgctgatccctttggggcggcatctggtgctgcggatgatgatgacctttatagttaggttgcctcttgtcggcaaaaacggtttgcccgtgttggttttattttaagttctgagttaacttaaaatttcatagaatggattatgatgaaatatttggatactttttttttcctgggaaatatgaagaattgagaactgggatttggagagctataatttattttaccagaattttaactgcc

SEQ ID NO: 7364 - DNA, 2731 bp, Glycine max
acagatccctttttcccattcattctctttcaactctctcttcaattccatcatggccaaccaacccgagtcctctgatgctaagggaacgaagagagactttagcacggcgatcctggaacgcaagaaggcgccaaaccggcttgtcgtcgacgaggctgtgaatgatgacaattccgtcgtggtgcttcatcccgacactatggagaaactccagctcttccgtggtgacactattctgctcaagggaaagaaaaggaaggatacaatttgtatcgcgcttgcggatgagacttgtgaggagccgaagataaggatgaacaagattgtgaggaacaaccttagagttagacttggagatgttgtctccgttcaccagtgcgcggatgttaagtacggaaaacgtgtgcacattcttcccgtggatgataccattgaaggggttactgggaatctctttgatgcttacttgaaaccttatttccttgaggcatataggccagtgaggaagggtgatatgttccttgtgagaggggggatgagaagtgtggagttcaaggttattgaaactgatcctgctgagtactgtgttgttgctccagacactgagatcttctgtgagggagagcctgttaaaagggaagatgagaatcggttagatgaggttggttatgatgatgttggtggtgttagaaagcagatggcgcagattagggaactggtggaactgccattgaggcatccacaattgttcaaatctattggtgttaagccaccaaaaggaattcttctatatggaccacctgggtctggtaagactttaattgctcgggctgttgcaaatgaaaccggtgccttctttttctgcattaacggccctgagatcatgtcaaaattggctggtgagagtgaaagcaatctcaggaaggcatttgaggaagctgaaaagaatgcaccctctattatcttcattgatgagatagattcaatagctccaaagcgtgagaagactcatggggaggttgagaggagaattgtttcccagctcttgaccctcatggatgggcttaaatcccgtgcacatgtaattgttattggagccacgaatcgtcccaatagcattgaccctgctcttaggaggtttggaagatttgatcgggagatagatattggtgttccagatgaagttgggcgtctagaggttcttcgtatccatacaaaaaatatgaagctcgctgaagatgttgatttggaaaggattgccaaggacacccatggatatgttggtgctgatttggctgctttgtgtactgaagctgctcttcagtgcatccgagagaaaatggatgtcattgacttggaagatgagaccattgatgctgagatactgaactcaatggcagtgacaaatgagcatttccagactgcccttggaacaagcaatccttctgctctccgagaaacagttgttgaagtgcccaatgtcagctgggaagatattggtggtcttgaaaatgtgaagagagaactccaagagactgttcaatatccagtggagcaccctgaaaaatttgagaagtttggaatgtcaccttccaagggggttcttttctatggtcctcctggttgtggtaaaacccttttggcgaaagctattgccaatgaatgtcaggcaaatttcatcagtgtcaaaggtcccgagctactcacaatgtggtttggagaaagtgaggcaaatgtgagggagatttttgacaaagctcgtggttctgctccatgtgtcctattctttgacgaacttgactctattgcaactcagagaggcagcagtgtaggagatgctggtggtgctgctgacagggttttgaatcaattgcttacagagatggatgggatgtcagcaaagaaaactgtgttcatcattggggccactaatcgaccagacattatagatcccgcacttctgcgaccaggtcgtctggaccaattgatttatatcccactcccagatgaggattcccgtcatcagatatttaaagcttgcttgagaaaatctcctgtctcaaaagatgttgaccttagagctcttgccaagtatactcaagggttcagtggtgcagatattactgaaatttgccagcgtgcatgcaagtatgctataagagagaacattgagaaggacattgagagagaaaggaggaaaagagataaccctgaggccatggaagaggatattgaagaggaagaggtagctgaaatcaaggcagcacattttgaagaatcaatgaagtatgcacgaaggagtgtaagtgatgctgacattcgcaagtaccaggcttttgcacaaacattgcagcagtcgagagggtttggatctgacttcacttttgcaaataccagctctggtggtggtggtgctgccactggcactgcatccgacccttttgcaagtgctggtggagctgatgaagatgatctttacagttaggttaacctgtggcttttgtttacgaacggcaatactgcctagtttatgtacttctcattttctgtatgaagtcaggcttcaattcgatgatttattgtcgttggtctgtaaaaggcactggttgaaagtggaagatttatttgaacctgaaaagaagatttaaagaacattttaaaatttgaagagcttaggtttatttgactttataatgatttatgaattccaatttattcgaatgagttc

SEQ ID NO: 7365 - DNA, 2683 bp, Glycine max
cttggttctgaactttctttgttgcgttgtgaattctgctctttgatcatcatcatcttcttcttcttcaatttaagcaagcatgtctcagcaaggcgaatcatcggacccgaaatcggggaagaaggacttctcaaccgcgattctggaacgcaaaaagtcgccgaaccggcttgtcgtggatgaggctgtcaacgacgacaactccgtggtcaccatgcatccccaaaccatggaaaagcttcagcttttccgaggggacactatcctcatcaagggtaagaaacggaaggataccatttgcatagctcttgctgatgagaactgtgaggagccgaagatcaggatgaataaagttgtgaggtcaaatttgcgggttcggcttggagatgttgtgtctgtgcaccagtgcccggatgttaaatatgggaaacgtgtgcacattctgcctattgatgataccattgaaggtgtcactggcaatctgtttgatgctttcttgaaaccctatttcttggaagcttaccgtcctgtcagaaaaggagatctatttcttgtccggggagggatgagaagtgtagagttcaaggtggttgaaaccgatcctggagaatattgtgttgttgctccagacactgaaattttctgtgagggggagcctttgaaaagagaagatgaagagagactggatgaagtcgggtatgatgatgtgggtggtgtcaggaaacaaatggctcagattcgtgagttggttgagcttccattgaggcatccacagctttttaaatcaattggtgtgaaaccacccaaaggaattttactttatggacccccaggttctgggaagacattaatagcaagagctgtagctaatgaaactggagcttttttcttttgtattaacggaccagagattatgtccaaacttgctggagagagtgaaagcaatctcaggaaagcgtttgaagaagcagaaaagaatgcaccatccattatcttcattgatgaaattgattccattgcccccaagcgggagaagacacatggtgaagttgaaaggaggattgtttcacaacttttgactcttatggatggattaaaatctcgtgctcatgttattgttattggagctactaatcgtccaaatagcattgacccagcattgagaaggtttggtagatttgatagggaaattgatattggtgttcccgatgaagttgggagacttgaagtccttcgcatacatactaaaaacatgaagctatctgatgatgttgatttagagagaattgcaaaagatactcatgggtatgttggtgctgaccttgctgccctttgcactgaagctgctttgcaatgcattagggagaagatggatgtaattgacttggaggatgagactattgatgcagaagtactgaattccatggcagttacaaatgagcatttccagactgcccttggaacaagcaacccatcagctttacgtgaaactgttgttgaagtgcctaatgtcagctgggaagacattggaggccttgaaaatgtcaagcgtgaactgcaagagactgtacaatatccagttgagcacccagaaaagtttgagaagtttggtatgtctccatctaaaggagtacttttctatggtcctccaggatgtgggaaaactttgttagccaaagcaattgctaatgaatgtcaagctaacttcatcagtgtgaaaggtccagaattgcttacaatgtggtttggtgaaagtgaagctaatgttagagaaatttttgacaaggccagacaatcggctccatgtgtcctcttctttgatgagcttgactctattgccactcagagaggaagcagtgttggggatgctggtggtgcggctgatagagttctaaatcaacttttgactgaaatggatggcatgtctgccaaaaagactgtgttcataattggggcaactaacagacctgacatcattgacccagcacttcttcgaccaggccgtctggatcaattgatctatattcctctccctgatgaggattcccggcatcaaatctttaaagcctgcttgaggaagtcacctatcgcaaaaaatgttgatttgagagcattggctaggcacactcaagggttcagtggtgctgatattacagaaatatgccagcgagcatgcaaatatgccataagagaaaacatagagaaggacattgagcgagagaggaagagtagggaaaaccctgaggccatggatgaagataccgtcgacgacgaagttgcggagatcaaggctgctcattttgaggagtcaatgaagtttgcacggaggagtgttagtgatgctgatattcgcaagtatcaggcatttgctcagaccttacagcaatcaagagggtttggaagtgaatttaggtttccagagtctggagataggactactactggatctgacccctttgcagcttctgctggtggggctgacgaagatgatctatatagttaggctttattatcacagtgatgtatgaaatcacatgtctacctcacctctcaggagggataactttgaagcctgtcttatattttgcttttcttgtactcaattatcctgaattgttaccgggttaaccttaaataccatatatggatcgtatcttcattttatggaaagatattgtag

SEQ ID NO: 7366 - DNA, 2546 bp, Tripterygium wilfordii
gaatcctctgactctaagggaacgaagagggactttagtactgcaattctcgagcggaagaaggcgacgaatcgcctggttgttgatgaggctatcaacgatgacaactccgtcgtggcgctccacccagataccatggagaagctccaactctttcgtggagacacgatcttgattaagggtaagaaaaggaaggatacaatctgcattgcccttgctgatgatacatgtgatgaaccaaagatcaggatgaacaaggttgtgaggtctaaccttagggttaggcttggggatgttgtctctgtgcaccagtgtcctgatgtgaagtatggaaagcgtgtgcatattctgccagtggatgacacaatagaaggggttactggaaatctttttgatgcatatttgaaaccttatttccttgaggcataccgcccagtgaggaagggtgatctttttctcgttagaggtggaatgagaagtgtggagttcaaggttattgagactgaccctccagaatactgtgtggttgcccccgatacggagattttctgcgagggagaacctgtgaaaagggaggatgagaatagattggatgaggttggctatgatgatgttggtggtgttagaaaacagatggctcagattcgagagttagtggaacttccattgaggcatccacagctgtttaagtcaattggtgtaaaaccacctaaaggaatccttctgtatgggcctcctggctctggaaagactctaattgcccgtgctgttgctaatgagactggcgctttctttttctgtataaatggaccagagataatgtcaaagttggcaggggagagtgaaagcaatctcaggaaggcatttgaggaagcagagaagaatgccccatccattatattcattgatgagattgactcaattgcacccaagcgagagaagacacatggagaagtggagaggaggattgtgtcccagctcttgacgctcatggacgggcttaaatcacgtgctcatgtcattgttattggggctacaaatcgtcccaatagcatcgacccagctctgagaagatttggaagatttgacagggaaattgatattggtgtaccagatgaggttgggcgacttgaggttcttcgtattcatacaaagaacatgaagcttgctgaggatgttgacttggaaagaattgcgaaggatacccatggttatgtgggtgctgatctggcggctctgtgtaccgaggctgcacttcaatgcatcagggaaaagatggatgtaattgatttggaagatgaaacaatagatgctgaaatactgaactccatggcagtaacccaagaacacttccagactgctcttggaacaagcaatccttctgctttgcgtgaaacagttgttgaggtgcccaatgtcagttggcaggacattggtggtcttgagaatgttaaaagggagcttcaagagactgttcaatatcccgtggagcatcccgagaaatttgagaagtttggaatgtctccctctaagggagttcttttctatggtcctcctggatgcggtaaaactctcctggcaaaagctattgcaaatgaatgtcaggcaaacttcattagtatcaagggtcctgaattgcttaccatgtggtttggagagagtgaggcaaatgtacgagaaatttttgacaaggctcgccagtctgccccttgtgtcctattttttgatgaacttgactcgattgctactcagagaggtagcagtacaggagatgctggcggtgctgctgacagggttttgaaccagcttctcacggagatggacggcatgtctgcaaagaaaactgttttcatcatcggcgcaaccaatagaccagacattattgatcctgcactactccgtcctggtcgtcttgatcagttgatctacatccccctacctgatgaggaatctcgtcttcaaatcttcaaagcttgcttgaggaaatccccagtatccaaagatgttgaccttagagctcttgcgaagtacactaatggattcagtggtgctgatataaccgagatatgtcagcgttcttgtaaatatgctattcgagagaacattgagaaggatattgagagggagaggagaagaagggataacccagaggctatggaggaggatgttgatgatgaagttgcagaaatcaaggcagcacattttgaggaatcaatgaagtatgctcgcaggagtgtgagcgatgctgatattcgtaaataccaggcatttgctcagacactgcagcagtccagaggattcggaactgaattcaggtttgctgaagcaggcactggtggagctgcagcatccgaccctttcgctgcgtctgctgggggtgctgaagaagatgacctttatagttagaaatttatctttgaatttgcatatgctgtttatgcctatacatttatatggtagaattgtttattatgcagatgattagttagtaaagtccttcgttagggtaattattaatacaaaatcctcttcttggtctagaaact

SEQ ID NO: 7367 - DNA, 2700 bp, Saccharum officinarum
ctcgcatcctcgccggtgctgctgcaattaacgacatcccccggccaaccacccgaaacctacctccgccgccgtcgtcgccaccgcaaacatggcgagccaaggggagccctcggcgtccgcttccgatccgaaggagaagaaggactactcgacggcgatcctggagaggaaaaagtctccgaaccgccttgtcgtcgacgaggccaccaacgacgataactccgtcgtcgcactgcaccctgacaccatggagaggctgcagctcttccgcggcgacaccgtgctcctcaagggtaagaagaggaaagacactatttgcattgtccttgcggatgaaacctgtgaggagccaaaggttcggatgaacaaggttgtccgccagaacctgagggtgaggcttggtgatgtggtttctgtccaccagtgccaggatgtaaaatacgggaagcgtgtgcacattcttccaattgatgatacagttgaaggcattacagggaacttgtttgatgccttcttgaaaccatacttcctggaagcatacaggcccgtgaggaaaggagaccttttccttgtcaggggtggaatgagaagtgtggaattcaaagttatagagactgatcctgctgaatattgtatcgttgcgccagatactgaaatattttgtgatggggagcctattaagagggaggatgaggagcgtcttgatgaagttggttatgatgatgttggtggagttagaaaacaaatggcccaaatcagagagcttgtcgagcttccactacgccatcctcagcttttcaaatctattggtgtgaagccaccaaagggcatattgctgtatgggccacctggttctggaaagactcttattgctcgtgctgttgcaaatgagactggagcctttttctttctgatcaatggcccagagattatgtcgaagctagcaggagagagtgagagcaatctccgaaaggcatttgaagaagcggagaagaatgctccatctatcattttcattgatgaaattgattccattgcacccaaaagagagaagaccaatggagaagtagagcgtcgcattgtttcacagctactgactcttatggatggactcaaatctcgttcccatgttattgtcatgggtgctacaaacagaccaaacagcattgatccggctcttcgaagatttggaaggtttgaccgggaaattgacattggagttcctgatgaagttggccggcttgaggttctccgcattcacactaagaacatgaaactagctgaagatgttaatttggaactcatttcaaaggatacccatggatacgttggtgctgatcttgctgccctttgcactgaggctgctcttcagtgcattcgtgagaagatggacatcatagatcttgaggatgagacaatagatgcagagatactgaactcgatggctgttacaaatgaccatttcaagactgcgcttggaacaagcaacccatctgctctccgtgaaactgttgtcgaagtcccaaatgtctcttgggaggatattggtgggctggagaatgtcaagagggagctccaggagactgttcaatatcctgtggagcatccggagaagttcgagaagtttggtatgtctccatctaaaggagttctgttctatggtcctcctggttgcggtaagaccttgttggcaaaggcaattgccaatgagtgccaggctaacttcatcagtgtcaagggtcctgagttgcttaccatgtggtttggtgagagtgaagccaacgtccgtgaaattttcgacaaggctcgccaatctgctccttgtgtcctcttctttgatgagcttgactcgattgctactcagagaggaagcagtgtgggtgatgctggaggtgcagctgatagagtgcttaatcagctactgacagagatggatggcatgaatgccaagaaaactgtgtttattattggggctacaaacaggcctgacatcattgaccctgctctgctgaggccagggcgtcttgaccagctgatctacattccactgcctgatgagcagtctaggctccagatcttcaaggcttgtcttaggaagtcccctgtggcgaaggatgtggacttgaatgctcttgctaagtacacgcaagggttcagtggagcagatatcacagaaatttgccagcgtgcgtgcaaatatgcaatcagagagaacattgagaaggacattgagagggaaaagcggagaaaggacaaccctgaggcgatggaggaagacgaagtggacgagattgccgagatcaaggcggctcacttcgaggagtcgatgaagtatgctcggcgtagcgtcagtgatgctgatatccgcaagtaccaggcgtttgcccagacattgcagcagtcccgtgggtttggcagcgagttccgcttctcggagcagtcggcgacagctggtgctgctgcagccgatccgtttgcctctgccggtgctgcagctgatgatgacgatctatacagctaggtgtcctgttgggttggttctgggttgttcgatatcagtctcgtcagtcgtctgtttaaaactgatcatactttagacacggatgtcatgcaatgatatttattttccgtacatttggacgtcgctgagataccctctcggcttttgattattttttcatgccaatattctccatg

SEQ ID NO: 7368 - DNA, 2655 bp, Euonymus alatus
gactctaaggggacgaagaaggactttagtaccgccattctcgagcggaagaaggcggccaatcgcctggttgttgatgaggctgtcaacgatgataactccgtcgtggcactccatccggataccatggagaagctacaactctttcgcggagacacgatcttgattaagggtaagaaaaggaaagatacaatctgcattgctcttgctgatgatacatgtgatgaaccaaagataaggatgaacaaggtggtgaggtctaaccttagggtcaggcttggcgacgttgtttctgtgcaccagtgtcctgatgttaagtatggaaagcgtgtgcatattctgcccgtagatgacacaatagaaggagttactggaaatctgtttgatgcatatttgaaaccgtatttccttgaggcataccgcccagtgaggaagggtgatctttttctcgtgagaggaggaatgagaagtgtggagttcaaggttattgagactgaccctccagagtactgtgtggttgcccctgacacagagattttctgtgagggagaacctgtgagaagggaggatgaggacagcagattggatgagattggttatgatgatgttggtggtgttagaaaacagatggctcagattcgagagttggtggaacttccattgaggcatccacagctatttaaatcaattggtgtaaaaccacctaaaggaatccttctgtatgggcctcctggctctggaaagactctaattgctcgggctgttgctaatgagactggtgctttctttttctgtataaatggaccagagataatgtcaaagttggccggggagagtgaaagcaatctcaggaaggcattcgaggaagcagagaagaatgccccgtccattatatttattgatgagattgactcaattgcacccaagcgagagaagacacatggagaagttgagaggaggattgtctcccagctcttgacgctcatggacgggcttaaatcacgtgcacatgtcattgttatgggggcaacaaatcgtcccaacagcattgacccagctctgagaaggtttggaagatttgacagggaaattgatattggtgtaccagatgaagttgggcgccttgaggttcttcgtattcatacaaagaacatgaagcttgctgaggatgttgacttggaaagaattgcaaaggatacccatggttatgtgggtgctgatctggcggctctgtgtaccgaggctgcacttcaatgcatcagggaaaagatggatgtaattgatttggaagatgaaacaatagatgctgaaatactgaactccatggcagtaagcaatgaacacttccagactgctcttggaacaagcaatccttccgccttgcgtgaaacagtggttgaggtgcccaatgtcagctgggaggacattggtggtcttgagaatgttaaaagggagcttcaagagacggttcaatatcctgtggagcatcctgagaaatttgagaagtttggaatgtctccctctaagggagttctgttctatggtcctcctggatgcggtaaaactctcctggcaaaagctattgcaaatgaatgtcaggcaaacttcattagtgtcaagggtcctgaattgcttaccatgtggttcggagagagtgaggcaaatgtacgagaaatttttgacaaggctcgccagtctgccccttgcgtcctattttttgatgaactcgattctattgctactcagagagggagcagttcaggagatgctgggggtgctgctgatagggttttgaaccagcttctgactgagatggatggcatgtcagcaaagaaaactgttttcatcatcggtgcaaccaatagaccagacattatagatcctgcacttcttcgtcctggtcgtcttgatcagttgatctatatccctctacctgatgaggaatctcgccttcaaatcttcaaatcttgcttgaggaagtccccagtatctaaagatgttgatctcagagcgctagccaagtacactagtggattcagtggtgctgatatcaccgagatatgccagcgtgcttgtaaatatgctattagagagaacattgagaaggatattgagagagagaggaggaggagcgataacccagaggccatggaggaggatgtggaggatgaagtttcagaaatcaaggcagcacattttgaggaatcaatgaagtatgctcgcaggagtgtgagcgatgctgatattcgtaaataccaggcatttgctcagacattgcagcaatccagaggatttggaactgaattcaggtttgctgactcaagcactggtggagctgcagcatctgacccttttgctgcctctgctggcggtgctgatgaagacgacctttatagttagtaattatctttttcgtatttgcatatgctgtttaggcctatacatttatgtggtacttgcttattctgcatatggtgttgtaaaatgccaaccttggtcaaattattgattccaaaaaatacctcgtcgttgactagctgaatagtgttggctgccttgccttctaatttaaaagaagacaatttgctatttgtaccagagtggttgactttcactcaatttcttaagttgaatttaatcaatgttggaccttgg

SEQ ID NO: 7369 - DNA, 2652 bp, Solanum lycopersicum
caaaaaaaaaaaaatcatgagtaacaaagctgaatcatctgattcgaaggggactaagaaggattttagtacagcaattttggagaggaagaaatcacctaatcgtcttgtcattgatgaagcaatcaatgatgataattctgttgtttcacttcatcctgatactatgcaaaagctccagttttttcgtggtgacacaattttgataaagggaaagaaaagaaaagatactatctgcattgccattgttgatgacaagtgtgatgagtcaaagattaggatgaacaaggttgtcagaaataaccttagtgttcgtcttggtgatgttgtctctgttcatcaatgccctgatgtcaaatatggtaaacgtgtgcacattcttccaattgatgacagcattgagggggttacaggaaatctgtttgatgcttacttgaaaccctatttcgttgaagcatatcgaccagtgaggaagggtgatctatttcttgtaagaggaggaatgagaagtgtagaattcaaggttattgaaactgatccagctgaatattgtgttgtcgccccagatactgagatattctgtgagggtgaacctgtaaacagagaagatgagaatcggttagatgaggttggttatgatgacattggtggcgtgcgtaaacaaatggctcagatccgcgagcttgttgagcttccgttgaggcatccacaaatgttcaaatctattggtgtgaaacctcccaaaggaattctcttgtatggacctcctggatcagggaagacattgatagcgcgagcagttgctaatgagactggtgcgttcttcttttgtattaatggaccagagatcatgtccaaattggcaggagaaagtgaaagcaatctcaggaaagcatttgaggaagctgagaagaatgcaccttcaattatttttattgatgaaattgattcaatagctcctaaacgtgagaagactcatggagaggtcgagaggaggattgtttctcagctcttgactctcatggatggtctcagatcacgtgcccacgtaattgtcatgggtgccactaatcgccctaatagtattgaccccgccctaagaaggtttggcagattcgatagggagatagatattggtgtcccggatgaagtcgggcgtcttgaggtgcttcgtatccatacaaagaacatgaagctcgctgaagatgttgatttggaaaggatttgcaaagaaacacatggttatgttggtgcggatttggcagctttgtgtactgaggctgcacttcagtgcatcagagagaagatggatgtgattgatttggaagatgaatctatcgacgcagagatattaaattcaatggctgtgaccaacgagcacttctcaactgctcttgggacaagcaatccatctgccctgcgtgaaactgttgttgaagttcctaatatctcctgggaggacattggaggccttgagaatgtcaagcgtgagcttcaagagactgttcaatatcctgtggaacatcccgagaagttcgagaagtttggtatgtctccttctaagggtgttctcttctatgggccacctggatgcgggaaaactttgttggcgaaggctattgcaaacgaatgccaggccaattttattagtatcaagggtccagaattgcttaccatgtggtttggagagagcgaagccaatgttagagaaatattcgataaggctcgagggtctgctccttgtgtcctgttttttgatgaattggactcgattgctactcagagaggcagtagcagaggagatgccgggggagctgctgatagagttttgaatcaactcctcactgaaatggatggtatgaatgccaagaaaacggttttcatcatcggtgccaccaacaggcctgacattattgatcctgcacttctacgtcccggtcgtcttgaccaattgatttacattcctcttcctgacgaggattcccgctatcaaattttcaaggcatgcctgcggaaatcacccctttctaaggatatcgatctcagagctcttgcaaaatatacgcaagggttcagcggagctgacattacagagatctgtcaacgtgcatgcaaatacgctatccgagagaacattgagaaagatattgagagggagagaaggagaagggataatccggaagctatggaggaagacgttaacgatgaagtatctgagatcaagcctgctcactttgaggaatcaatgaagtacgctcgaaggagtgtgagtgatggtgatatccgcaagtatcaagcgtttgctcagacgttgcagcagtcccgagggtttggttctgagttccggtttgcaggtcccaccatcggtcccaccaccggaactactgatccctttgcaacttctgctggtggtgcagcagatgaagatgagctgtataactagactgtcttcagcttatttttcatatcttatgctttaccacttacaactttgctaatattagtaattatttttatgaaactttgaaagttagtaactatttccattcattgtcttgagtttgtaattttattgatttttctaagctttacataaataatactctgtagctattattttgtctacttaaaaagttttagattttatttggc

SEQ ID NO: 7370 - DNA, 2832 bp, Oryza sativa
gcaagaaagaggcttataaaagaacactttaatccccctcctctcgcctctctctcttctcccaaatctcatcgccttctccgccgcgacgcggacgcgctcgaattaacgccgccgccgccaaccaccgcccgccgccaccgcgatggcgagccagggggagccctcgtcgtcggccgatccgaaggggaagaaggactactcgacggcgatcctggagaggaagaagtcgccgaaccggctggtggtggacgaggccaccaatgacgacaactccgtcgtcgcgctgcacccggacaccatggagaggctgcagctcttccgcggcgacaccgtcctcctcaagggcaagaagaggaaagatactatttgcattgtccttgcggacgaaacctgtgaggagcccaagattaggatgaacaaggttgtcaggaagaacctgagggtgcgacttggtgatgttgtttctgtccaccagtgccaggatgtgaaatacgggaaacgtgtgcacattcttccgattgatgatacagttgaaggcattaccgggaacctgtttgatgccttcctgaagccatacttcttagaagcataccgcccagtgaggaaaggagatctcttccttgtcaggggtggaatgagaagtgtggaattcaaagtcatagagactgaccctactgagtattgcatcgttgcaccagatacagaaatattctgtgatggggagcctattaagagggaagatgaggaaaggcttgatgaggttggatatgatgatgttggtggagttagaaagcagatggctcaaatcagagagcttgttgagcttccactgcgtcatccccaacttttcaaatccattggtgtgaagccaccaaagggcatattgctgtatggaccacctggttctggaaaaaccctcattgctcgtgctgttgcaaatgagactggagcctttttctttttgattaatggacctgagattatgtcaaagctagctggagagagtgagagcaatctcaggaaggcatttgaagaagcagagaagaatgcaccatctatcattttcattgatgagattgattccattgctcccaagagagagaagaccaatggagaagtggaacgtcgtattgtttcacagctgttgactcttatggatggactcaaagctcgttctcatgttattgttatgggtgctacaaaccgtcccaacagcattgatcctgctcttcggaggtttggaaggtttgaccgtgagattgacattggtgtccctgatgaggttgggcggcttgaggttcttcgtattcacactaagaacatgaagctagctgaagatgttgatttggaactcattgcgaaggatactcatggatatgttggtgctgatcttgctgccctttgcactgaggctgctcttcagtgcattcgtgagaagatggatatcatagatcttgaggacgagacaatagatgctgagatattgaactcgatggctgtcacaaatgaccatttcaaaaccgcgcttggtacaagcaacccatctgctcttcgtgaaactgttgttgaagttcctaatgtctcatgggaggacattggtgggctggagaatgtcaagagggagctgcaggagactgtccaatatccagtggagcacccagagaagttcgagaagtttggaatgtctccatccaaaggagttctgttctatggccctcctggctgtggtaagaccttgttggccaaggcaattgccaatgagtgccaggcaaacttcatcagtgtgaagggcccagagttgctcaccatgtggtttggagagagtgaagctaatgttcgtgagatatttgacaaggcccgccagtctgcgccatgtgtgctcttcttcgacgagcttgactcaattgctactcagagaggaagcagtgtgggtgatgctggaggtgcagctgatagggtgctgaatcagctgttgacagagatggatggcatgaatgccaagaagactgttttcattattggggctacaaacaggcctgacatcatagatccggccttgcttaggccagggcgtctcgatcagctgatctacattccactgcctgatgagcaatctaggctccaaattttcaaagcttgcctcaggaagtcccctgtggcgaaggatgtggacttgaacgctcttgccaagtacacccaaggcttcagtggtgcagatattacagaaatctgtcagcgtgcatgcaaatatgcgattagagagaacatcgagaaggacattgagagggagaggcggagtaaggagaaccctgaagcgatggaggaagatgaagtcgacgacattgctgagatcaaggcagcccacttcgaggagtcgatgaagtacgcgcgccgcagtgtcagcgatgccgacatccgcaagtaccaggcgttcgcccagacgttgcagcagtctcgcgggtttggcagtgagttccgtttcgagcggacagaagctggtgctggagctgcggctgatccttttgcgtctgctgccgccgtcgctgatgatgacgatttatatagttaggttgtctgttgtgtccttcgttagctcgccctccgagtttgtgttcaatattggttccatctgccatgcctttgtgttgaaactaatcgtacttgaaacacggcaaagccctctggttatatttattttcagtgcaatagggtgctgcttggctgaggacgatgccctcggtctaagccgttgccctcctgtggctggctactggacgatgacaatttctgaatttcccaacaatatacagctatttttttatacttctc

SEQ ID NO: 7371 - DNA, 2441 bp, Cucumis sativus
tgcttgatcctgctttcaatgcgtttttttatttttttgtttcttccagtaagggtcccaagagggattttagtaccgcgattctagaacgtaagaaagctgccaaccggcttgttgttgatgaggccattaatgatgataactcggtggttgcgcttcaccctgacactatggagaagcttcaactcttccgtggcgacacgatcttgatcaaggggaaaaaaaggaaggatacaatctgcattgctcttgccgatgaaacatgtgatgagccaaaaataagaatgaacaaggttgtgagaagcaaccttcgcgtcaggcttggagatgttgtctccgtgcatcaatgtgctgatgttaagtatggaaagcgggtacacattcttccagtagatgacactattgaaggtgtcaccgggaatctttttgatgcatacttgaaaccgtatttcttggaagcctatcgcccagtgaggaagggtgatctcttccttgtgaggggaggaatgagaagtgtcgagttcaaggtcattgaaactgatcctcctgaatattgtgtggttgcccctgatactgaaattttctgtgatggggagcctgttaaaagagaggacgaagatagattagatgaggttggctatgatgacgttggtggtgttagaaaacaaatggcacaaattcgtgaattggtagaacttcctctgagacatccacagctttttaaatccatcggagtaaagccaccaaagggaattctgctttatggcccccctggatctggaaagactttgattgccagagccgtagctaatgaaactggggctttctttttctgtatcaacggaccagaaattatgtcaaagttggctggagagagtgaaagcaaccttaggaaagcttttgaggaggcagaaaagaatgctccatctatcatctttattgatgagattgattcgattgctcctaagcgagaaaaaactcatggagaagttgagagaaggattgtgtctcagctcttgacactaatggatgggttaaaatctcgtgcccatgtcattgttattggagctacaaatcggccaaacagcattgatccagctttgagacgatttggaaggtttgatagggaaatagatattggggttcctgatgaagttgggcgacttgaggttcttcgtatccataccaagaacatgaagcttgctgaagatgttgacttggaaagaattgccaaggatacacatgggtatgttggagctgacttggcagctctttgtaccgaggctgcacttcaatgcattagagaaaaaatggatgttattgatttggaagatgaaacaatcgatgcggagattctgaattcaatggcagtcacaaatgagcacttccaaactgctcttgggaccagtaatccatctgctctacgtgaaactgttgttgaagtgcctaacgtcagctgggaagacattggaggacttgagaatgtcaagagagaacttcaagagactgtacaatatccagtggaacatcctgagaagtttgagaaatttggaatgtcaccctcaaagggagttcttttttatgggcctcctggatgtggaaaaactcttctggccaaagctattgccaatgagtgccaggcaaacttcatcagtgtcaagggtcctgaattgcttacaatgtggtttggagaaagtgaagctaatgttcgtgaaatttttgacaaggctcgccagtctgcaccttgtgttctgttctttgacgagcttgactctattgccactcagagaggcagcagcgtgggagatgctggaggtgctgctgatcgagttttgaaccaacttctgacagaaatggatggaatgtcagcaaagaaaactgtctttataattggggcaaccaacagaccggatattatagatcctgcacttctccgtccaggacgtttagatcaattgatttatattcctctacctgacgaggattctcgacaccaaattttcaaggcttgcttgaggaagtcgccagtatcaaaggatgttgaccttagagcccttgccaagtacactcaaggttttagtggtgctgatattacagagatctgccagcgtgcttgcaaatatgctatcagagagaatattgagaaagatattgagagggagaggaggagaagagataaccctgaggctatggaagaggatgtagaggacgaggtggcagagattaaggctgctcattttgaggagtcgatgaagtttgctcgcagaagtgtgagtgacgccgatattcgtaaataccaggcatttgctcaaacactgcagcagtcgagagggtttggttcagaattcaggttttcagacaacccttcttctggaactgcagcagctgacccgtttgcaacttcagctggtggtggggctgatgatgatgatctttacaac

SEQ ID NO: 7372 - DNA, 2656 bp, Solanum lycopersicum
tctgcaaaaaaaaaaaaatcatgagtaacaaagctgaatcatctgattcgaaggggactaagaaggattttagtacagcaattttggagaggaagaaatcacctaatcgtcttgtcattgatgaagcaatcaatgatgataattctgttgtttcacttcatcctgatactatgcaaaagctccagttttttcgtggtgacacaattttgataaagggaaagaaaagaaaagatactatctgcattgccattgttgatgacaagtgtgatgagtcaaagattaggatgaacaaggttgtcagaaataaccttagtgttcgtcttggtgatgttgtctctgttcatcaatgccctgatgtcaaatatggtaaacgtgtgcacattcttccaattgatgacagcattgagggggttacaggaaatctgtttgatgcttacttgaaaccctatttcgttgaagcatatcgaccagtgaggaagggtgatctatttcttgtaagaggaggaatgagaagtgtagaattcaaggttattgaaactgatccagctgaatattgtgttgtcgccccagatactgagatattctgtgagggtgaacctgtaaacagagaagatgagaatcggttagatgaggttggttatgatgacattggtggcgtgcgtaaacaaatggctcagatccgcgagcttgttgagcttccgttgaggcatccacaaatgttcaaatctattggtgtgaaacctcccaaaggaattctcttgtatggacctcctggatcagggaagacattgatagcgcgagcagttgctaatgagactggtgcgttcttcttttgtattaatggaccagagatcatgtccaaattggcaggagaaagtgaaagcaatctcaggaaagcatttgaggaagctgagaagaatgcaccttcaattatttttattgatgaaattgattcaatagctcctaaacgtgagaagactcatggagaggtcgagaggaggattgtttctcagctcttgactctcatggatggtctcagatcacgtgcccacgtaattgtcatgggtgccactaatcgccctaatagtattgaccccgccctaagaaggtttggcagattcgatagggagatagatattggtgtcccggatgaagtcgggcgtcttgaggtgcttcgtatccatacaaagaacatgaagctcgctgaagatgttgatttggaaaggatttgcaaagaaacacatggttatgttggtgcggatttggcagctttgtgtactgaggctgcacttcagtgcatcagagagaagatggatgtgattgatttggaagatgaatctatcgacgcagagatattaaattcaatggctgtgaccaacgagcacttctcaactgctcttgggacaagcaatccatctgccctgcgtgaaactgttgttgaagttcctaatatctcctgggaggacattggaggccttgagaatgtcaagcgtgagcttcaagagactgttcaatatcctgtggaacatcccgagaagttcgagaagtttggtatgtctccttctaagggtgttctcttctatgggccacctggatgcgggaaaactttgttggcgaaggctattgcaaacgaatgccaggccaattttattagtatcaagggtccagaattgcttaccatgtggtttggagagagcgaagccaatgttagagaaatattcgataaggctcgagggtctgctccttgtgtcctgttttttgatgaattggactcgattgctactcagagaggcagtagcagaggagatgccgggggagctgctgatagagttttgaatcaactcctcactgaaatggatggtatgaatgccaagaaaacggttttcatcatcggtgccaccaacaggcctgacattattgatcctgcacttctacgtcccggtcgtcttgaccaattgatttacattcctcttcctgacgaggattcccgctatcaaattttcaaggcatgcctgcggaaatcacccctttctaaggatatcgatctcagagctcttgcaaaatatacgcaagggttcagcggagctgacattacagagatctgtcaacgtgcatgcaaatacgctatccgagagaacattgagaaagatattgagagggagagaaggagaagggataatccggaagctatggaggaagacgttaacgatgaagtatctgagatcaagcctgctcactttgaggaatcaatgaagtacgctcgaaggagtgtgagtgatggtgatatccgcaagtatcaagcgtttgctcagacgttgcagcagtcccgagggtttggttctgagttccggtttgcaggtcccaccatcggtcccaccaccggaactactgatccctttgcaacttctgctggtggtgcagcagatgaagatgagctgtataactagactgtcttcagcttatttttcatatcttatgctttaccacttacaactttgctaatattagtaattatttttatgaaactttgaaagttagtaactatttccattcattgtcttgagtttgtaattttattgatttttctaagctttacataaataatactctgtagctattattttgtctacttaaaaagttttagattttatttggc

SEQ ID NO: 7373 - DNA, 2640 bp, Ambrosia trifida
aatattattaatattgataacaaattcttcttccctcaatcttcatcaccatgagtaaccagcctgaatcctcttcatctgatccaaaagcgtcgaagaaggacttttcgactgctatcttggagcgcaagaaatctcccaatcgtcttgttgttgacgaggctgtcaatgacgataactccgtcgtcgctatgcatcctgctaccatggagaaattgcagctctttcgtggcgatactattttgatcaagggaaagaaaagaaaggatacagtttgcattgcccttgctgatgaaacgtgtgatgaaccgaagatacgaatgaacaaggttgttaggactaacctaagaattcggcttggtgatgttgtgtcagtgcaccaatgcccagatgtcaagtatggtaaacgtatccatgttcttccacttgatgacaccattgaaggtgtcacaggagacttatttgatgcctatctgaaaccatactttttggaggcatataggcctgttaggaaaggagaccatttccttgttagaggaggtatgcgcagcgtcgagtttaaggtgattgagactgatccaggggagtattgtgttgttgctccagacaccgaaatattctgtgagggtgagccaattaagagagatgacgaggacagattggatgaggtgggctatgatgatgtaggaggtgtcaggaaacaaatggctcagatacgtgaattggtggagttaccattaagacaccctcaacttttcaagtcaattggagtcaagcctccaaaaggaatcttgctctatggaccacctggttcgggaaagacactaatagccagagccgttgctaatgaaaccggagctttctttttctgcatcaatggtcctgaaattatgtcaaagttagctggagaaagtgaaagcaatctcaggaaagcatttgaggaggctgagaagaacgccccgtcaattattttcattgatgagatagattcgattgcgccaaagagagagaagactaatggtgaagttgaaaggaggattgtatcacagcttttgacacttatggatggattaaaatcacgagcccatgttattgtaatgggggcaacaaaccgcccaaatagcattgaccctgctctcagaagatttggtaggttcgatagggaaatcgacattggtgtcccagatgaaattgggcgtcttgaggttcttcgtatccacacaaagaacatgaagctttctgaggatgttgatttggaaaagatatcaaaagaacacatggttatgttggtgctgatcttgctgctctttgcactgaagctgcacttcaatgcattagagagaaaatggatgttattgatttggaagatgatgctattgatgctgagatacttaattccatggccgtcaccaatgaacatttctctactgctcttggaactagcaatccatctgctctgcgtgaaactgttgttgaggttcccaatgttagctgggatgatattggagggctcgagaatgttaagcgtgagcttcaagagacggttcaatatccagtggagcatccagagaaatttgagaaatttggcatgtcaccgtcaaaaggagttcttttctacggtccacctggatgtgggaaaacacttcttgcaaaagctattgcaaatgaatgtcaagctaatttcattagtatcaaaggacccgaattgctaacgatgtggttcggtgaaagtgaagccaatgttcgtgaaatttttgacaaggccagaggatctgctccatgtgtccttttctttgatgaactcgactccattgcaactcagagaggaagcagttctggagatgcaggtggtgctgctgaccgtgttctgaatcaactgttgactgaaatggatggaatgtctgaccaaaaagacggttttcataattggagccaccaacagacccgacattattgatccagcattacttcgacctggacgtcttgatcaacttatttacattccactaccagatgaagagtcacgttactcgatcttcaaggctgcaatgaggaaatcccctgtttctaaagatgtcgatttgagagctcttgctaagtacactcaaggatttagtggggcggatattactgaaatatgtcaacgggcatgcaagtatgcaattagggagaacatcgagaaagatatagagaaggaaagaaagaggagtgagaatcccgactccatggatgaggatgatgacgatgatgtggctgagataaaggcggctcactttgaggaatccatgaagtatgcacgcagaagtgtgagcgatgctgacattagaaagtaccaggcgtttgcgcagacattgcagcagtcgagaggatttggatccgaatttcggttctcggaagcaacatctggtggcgctgatccatttgctgcttctgctggtggagctaatgatgatgatctatacaactaactagcttttctagattattatctcttaaactcatgtttaaggaagaaaagcttgttggattattaatttgtgcattttcatgattttcctcatatgagagaatggtatttatgtatcataatttcataggaaccagaattattcatgattcctggagtaatatttttataaa

SEQ ID NO: 7374 - DNA, 2772 bp, Prunus persica
aaattgcttttagctactcttccgctctctctctcttcgaactcttcaatcgacaaaacaatctcagactctctctcttcgtctacttgggtcttctctgctccatcttcacgatgactgacaaggctgaatcttcagactctaagggaacgaaaagggacttcagcacggcgatccttgagcgcaagaaggctgcgaatcggcttgttgtggatgatgctatcaacgatgacaactcggtcgtcgcgctccatccagataccatggagaagctccagctctttcgtggtgacacaatcttgatcaagggaaagaaaaggaaagatacaatctgcattgccctggctgatgatacatgtgaggaaccaaagataaggatgaacaaggttgtcaggagcaacctaagggttaggctgggggatgttgtttctgttcaccaatgtgctgatgtcaagtatggaaagcgtgtccacattcttcctgtggatgacactattgaaggggtcactggaaatctgtttgatgcatacttgaaaccttatttcctggaggcctaccgtccagtgaggaagggtgatctcttccttgtgagaggaggaatgaggagtgtagaatttaaggttattgaaactgaccctcctgagtactgtgtggtcgctcccgacactgaaatcttctgtgagggggagcctgtgaaaagggaggatgaggagagattaaatgaggttggctatgatgatgttggtggagttaggaaacagatggctcagattcgtgaattagtggagctgccactgaggcatcctcaactatttaaatcgattggtgtgaagccaccaaagggtattctgctgtatggacctcctggatcgggtaagactctaattgcccgagctgtggctaatgaaactggggcattctttttctgcatcaatggacctgaaatcatgtcaaaattggctggggagagtgaaagcaatctcaggaaagcttttgaggaagcagagaagaatgcaccatcaattatctttattgatgaaattgattcaattgctcccaagagagagaagacacatggagaagttgagaggaggattgtttcccagctcttgacgctcatggatggactaaagtctcgtgcacatgtaattgttatgggggctacaaatcggccaaacagtattgatccagctctcagaaggtttggaagatttgatagggaaatagatattggtgtaccagatgaagttgggcgtctcgaggttgtccgtattcatacaaagaacatgaagcttgctgaagatgttgatttggaaaagatagctaaggacacacacggttatgttggtgctgatctagctgctttgtgtactgaggctgctcttcaatgcatcagagagaagatggatgtgattgacttagaagatgaggaaatagatgctgagattctgaattcaatggcagtgacaaatgagcacttcaagactgctcttggcacaagcaacccatctgctcttcgtgaaacagttgttgaagtgcccaatgttagctgggaagatattggaggtcttgacaatgttaagcgagaacttcaagagactgttcagtatcctgttgagcatcctgagaaatttgagaaatttggaatgtcaccttcaaagggagttcttttctatggtcctcctggatgtggtaaaactcttctcgccaaagctattgccaatgagtgtcaagcaaacttcatcagtgtcaagggacctgaattgctaacgatgtggtttggagagagtgaggccaatgtgagggaaattttcgacaaggcccgtgggtctgctccatgtgtcctgttctttgatgaactcgattccattgctactcagagaggtagtagcgtaggtgatgctgggggtgcagctgacagggttttgaaccaactccttacagaaatggacggaatgactgctaagaaaactgttttcattattggggctaccaacagtcccatttaattacaaaccatgccttctacgtccaggacgtctggatcagttaatttacatccctctccctgatgaggaatctcgctttcaaatattcaaatcttgcttgaggaaatctccagtttccaaagatgtggacatcagagcacttgccaagtacacccaaggattcagtggtgctgatataactgaaatatgccagcgtgcttgcaaatatgccattagagagaatattgagaaggatatcgagagggagaggaggagaagcgagaatcctgaggcaatggaggaggatgttgatgacgaagtagcagagatcagggcagctcattttgaggagtcgatgaagtatgctcgtaggagtgttagtgacgctgatatccgcaaataccaggcatttgcgcagacattgcagcagtcaagagggtttggaaccgagttcaggttcgcagacaatccttctggcacagccgctggatccgacccttttgcaactgttgctgctggggctgatgaagatgacctttacaactaggatagtctctcattacgcgtctttttcatatttgaatttcaactttgcattttgtattccattgatgatgtggtagaaccgtgaaagtgcccatttaatcacattattgtatccagaaagtcctcggggtttccagccattgggtgacccctggatactacgaagtttaaaacagtgttaattattttcttttcagattataatggataattaaaaaacacagcaggttttacttca

SEQ ID NO: 7375 - DNA, 2840 bp, Amorphophallus konjac
atctaacccttttcccaatccaccgcggttgctccaggcttcctctgcagaccagctcgccatggcgaaccagggggagtcctcggcggctgcctccgatccgaaagggccgaagagggattactcgacggcgatcttggagaggaagaaggcggcgaaccggctggtcgttgatgaggcggtgaatgacgacaactcggtggtttctatgcaccccgagacgatggagaagctgcagcttttccggggtgacacggtcctcgtcaagggaaagaagagaagagacaccatttgcattgcacttgccgatgatacatgtgaagagccgaagatcaggatgaacaaggttgttaggtcgaacctgagggttcggcttggagacgtggtttctgtgcaccagtgccaagatgtcaaatatgggaaaagggttcatatattacctattgatgatacaattgagggaataacggggaatatttttgatgcatatcttaagccttacttccaagaagcatatcgtccagtgagaaagggagatcttttccttgttagaggggggatgaggagtgtggaattcaaggtaattgaaactgatcctgcggaatattgtgtggttgctcctgatactgaaatcttttgtgagggggagcccgtgaaaagagaggatgaagaaaggcttgatgaagttggttatgatgatgttggaggagtgaggaagcaaatggcccagatcagagagttagttgagcttcctcttaggcaccctcagcttttcaaatcaattggtgtcaaaccacctaaaggaatcctattatatgggccccctggttctggaaagacactgatagctagggcagtggcaaatgagacaggtgcttttttcttctgtattaatggcccggagattatgtcaaaattggctggggaaagtgagagcaacctacggaaagcttttgaagaagcagagaagaatgcaccatcgattatttttattgatgagattgactcaattgcaccgaagcgagagaaaacgcatggagaagttgagagacgtattgtttctcaactattgactctcatggatggtttaaaatcacgtgcacatgttattgtaattggagctacgaatcgacctaacagtattgacccagctctgagaaggtttggcagatttgacagggaaattgacattggtgtgccagatgaagttggaaggctggaagtcctgcgcattcataccaaaaacatgaagctgtctgatgatgttgatttggagagaattgccaaggacacacacggttatgttggtgctgatcttgccgctctctgcactgaagctgcacttcagtgcataagagagaaaatggatattattgacttggaggatgaatcaattgatgctgaggtactgaactctatggctgttacaaatgaacatttcaagacggctcttggaaccagcaacccatccgcactccgagaaactgttgttgaagtacctaatgttagttgggatgacattggtggccttgacaacgtcaagagagaactccaagagactgttcaataccctgtggaacatccagagaagtttgaaaagtttggcatgtcaccttcgaagggagttcttttctatggtccccctggttgtgggaaaactcttcttgccaaagcaattgccaacgagtgtcaggctaacttcatcagtgtcaagggtcctgagctattaaccatgtggtttggagaaagtgaggcaaatgtacgagaaatctttgacaaggcacgacagtcagctccatgtgttctgttctttgatgagcttgactccatagcgacacagagaggaagcagtgttggagatgccggaggtgccgccgacagggtcctcaatcagctgctgacagagatggatggaatgtcagccaagaaaactgtattcattattggggcaacaaacaggccagatataatagatcctgctttgctgaggccaggtcgtctggatcagttgatatacattcccttgcctgatgaagcttcaagatatcagatttttaaggcctgcttgaggaagtctcctgtctcaaaagatgttgacctggcagcacttgccaagtacactcagggttttagtggagcagatatcacggagatatgccaaagagcatgcaaatatgcaatcagagaaaatattgagaaggacattgaaagggagaggaggaggagcgagaatcccgaggcaatggaagaagatgttgccgatgaagtctcagagatcaaagctgttcactttgaggaatcaatgaagtatgcgcgccggagtgtcagcgatgcggacatccgcaagtaccaggccttcgcccagacattgcagcagtccagaggatttggcagcgagttccgcttcacggaacggtcggaggctggcgcagggaccgctgggtctgatccatttgggtccgcagccgcgggggctgatgacgacgacttatatagctagtcgccatgttataatcctacactccctcaagttaactcatatgtttgatcgcagcagagcagtggatccaaggttaggctggcaccgcccgtaggtgttatagtggatgtgaccgtggtggtctctctgcctcttctgcttagaaggaggaaaaatgagtttttgactgcatttttataattcaaaggatttgcgagtcttctgtcctctctttttttctctctccccgtctggtttgcaaaccatcgtgttgtgttcggcatcttttgttgaaccatgaactcttggccgccgtagggctgcccggtaaccttacgctggttgtccacttgggaattct

SEQ ID NO: 7376 - DNA, 2793 bp, Malus domestica
atggctcaccaagccgaatcgtccgactcgaagaagaaggacttctcgacggcaattctggagcggaagaagtcgccgaaccgtctcgtcgttgatgaggctgtaaacgacgataactccgtcgtttcaatgcatcccgaaaccatggaaaagctacagcttttccgtggcgataccatcctcatcaaggggaagaaacgaaaagacacaatctgcattgcacttgctgatgacacctgtgaagagccaagaatcaggatgaacaaggttgtcaggtcgaatttaagggttcgacttggggatgttgtgtctgtacatcaatgccctgatgttaagtatgggaagcgtgtccacattctgcctattgatgactctatagaaggagttaccggaaatctctttgatgcctttttgaaaccttatttcttggaagcttaccgccctgtgaggaaaggagatttgttccttgtcagaggaggaatgagaagtgtagagtttaaggtcattgaaactgacccaggagaatattgtgtggttgcccctgacactgagatcttttgtgagggggaacctgtgagaagggaggatgaagaaaggttggatgaagttggttatgatgatgtgggtggtgttaggaagcaaatggctcaaatccgtgaactagtagagctgccactaaggcatcctcaacttttcaaatcaattggtgtgaaacctccgaaaggaattctactttatggacccccgggttcaggaaagacattaatagccagagctgttgccaatgaaactggtgcttttttcttttgcattaatggaccagagattatgtcaaaattggctggagagagtgagagcaatctcagaaaggcatttgaagaagcggagaagaatgccccatccatcatctttattgatgagcttgattcaattgctcctaagcgggagaagacacatggtgaggttgaaaggcggattgtctctcagctcttgactctgatggatggactgaaatctcgagcccatgttattgttattggtgctacaaatcgtccaaacagtattgatgcggctttgagaaggtttggtaggtttgatagggagatagacattggtgttcctgatgaagttgggcgccttgaagttcttcgcatacacacaaagaacatgaaactctctgatgatgttgatctagagaggatttccaaggatactcatgggtatgttggtgctgaccttgctgctctctgcactgaagctgctctgcaatgcattagggagaagatggacgtgattgacttggaagatgaatccatagatgcggagatactgaattcaatggcggttacaaatgagcacttccaaactgctcttggaacaagcaatccatctgctttgcgtgaaacagttgttgaagttcctaatgtaagttgggaggatattggaggccttgagaatgttaagcgagagttacaagagactgttcaatatcctgttgagcacccggagaagtttgagaaatttggcatgtcaccttctaaaggggtgcttttctacgggcccccaggatgtgggaaaactcttttggccaaggcaattgcaaatgaatgtcaagctaacttcatcagtattaaaggccccgaacttctcaccatgtggtttggtgagagtgaagccaatgtgcgagaaatctttgacaaggctcgtgcatctgcaccatgtgtccttttctttgatgagcttgattccattgctacccagaggggaggcagttctggggatgcaggtggtgctgctgatcgtgttcttaaccaactcctgactgaaatggatggcatgacagcaaaaaagactgttttcattattggggccacaaaccgacctgacattattgacccggcacttctgcgccctggccggcttgaccagttgatctacattcctcttccagatgaagaatcacgtttccaaatctttaaatcttgcttgagaaaatcacctgtttcaaaggatgtggatttaagagcactggccaggtatacacagggctttagtggggctgatatcaccgagatctgccagcggtcatgcaagtatgccataagagagaatatagaaaaggatatcgagcgggagaggaggagagcagagaatccagattctatggatgaggacattgacgatgaagtggcggagattaaagctgctcattttgaggagtcgatgaaatatgctcgtaggagtgtcagcgatgctgatatacgcaaataccaggtctttgctcagaccttgcagcagtccaggggtttcggaactgagtttaagtttactgaaaatccacaaactgggacgaccggctctgatgcatttgcaacttctgctggtgctgccgatgaagacgatttgtatagttaatattatcatgggcatggttccggaggcagttccgtccgaggatacgccttttgtaggctcatgttatcaactttgtggaaggctttccttttcatggttatgactgtcaagtcttttgtgtactaaagagtttgtggggtttgtaggataacatgatgtttttaagtatattatgctgttaatcttatttgtatcaatcaactgatggattggaaaaggctagttactttgttaaagagatttgttctctttaaatacttacgttgtttgtattggatgaaagctggttaaggttgctgtttgtgccccctacttcttttactgtgtttggtttccatgtcggttcttaggggatggtaaatggaatatttctttctc

SEQ ID NO: 7377 - DNA, 2673 bp, Cannabis sativa
gattctaattttcctttgtgggtttttctatcttggcagtaagggaacgaaaagggacttcagtaccgctattcttgagcggaagaaagctgctaatcggcttgttgtagatgaggctatcaacgatgacaactctgtcgtctctcttcacccggacaccctggagaaactccagcttttccgtggcgatacgattttgataaagggaaagaaaaggaaggacactgtctgcattgctcttgctgatgatacctgcgatgaaccaaagataaggatgaacaaggttgttaggagcaacttaagagtcaggcttggagatgttgtttccgtgcaccagtgtgctgatgtcaagtatggaaaacgtgtgcacattcttcccattgatgattccattgagggagttactgggaatctttttgatgcatacttgaaaccttacttcttggaagcatatcgtccagtaagaaagggtgatcttttccttgttagaggtggaatgagaagtgttgaattcaaggttattgaaactgatcctccagagtattgtgtggttgcacctgacactgagatcttttgtgagggggagcccgtgagaagggaggacgaggatagattggatgaggttggttatgatgatgttggtggtgttagaaagcagatggctcagattcgtgagcttgtggaactgcctcttagacacccacagctgtttaaatcaattggagttaagccaccaaaaggaattctactgtatggacctcctggatctggtaaaactttaattgcaagagctgttgcaaatgaaactggtgcattctttttctgcattaatggaccagagatcatgtcaaagttggccggagagagtgaaagcaatttgaggaaagcttttgaggaagcagagaagaatgccccatcaattatttttattgatgagattgattccattgctccaaagcgagagaagacacatggagaagttgagaggaggattgtgtcccagctattgacactcatggatggactgaaatctcgtgcacatgtcattgttatgggagctacaaatcgtcccaacagtattgacccggcccttagaaggtttgggagatttgatagggaaatagatattggggttcctgatgaaattggacgccttgaggtccttcgcattcatacaaagaacatgaagcttgctgaagatgtggatttggaaagaatttccaaggacacacatggttatgttggtgctgatcttgctgctctgtgtactgaggctgcacttcagtgcattagagaaaagatggatgttattgacttagaggatgagtcaatagatgctgagatactgaactcaatggctgttacaaatgagcactttgctactgctcttggaacaagcaatccatctgccctccgtgagacggttgttgaggtgcctaatgttagttgggaggatattggaggtcttgagaatgtcaagagggaacttcaagagactgtacagtaccctgtggagcatcctgagaaatttgagaagtttggcatgtcgccttctaagggagttcttttctatggtcctcctggatgtggaaagacccttcttgccaaagccatcgccaatgagtgtcaggccaactttatcagtatcaagggtcccgagttgcttactatgtggtttggagagagtgaggctaatgtaagggaaatttttgataaggccagaggatctgcaccatgtgttctgttctttgatgaacttgactcaattgccacccagagagggagcagtgttggagacgctggtggtgctgctgatagagttctgaaccagcttcttactgaaatggatggcatgtctgccaaaaagactgttttcattattggagccaccaacagaccagacattatagaccctgctcttctacgtcctggccgtcttgatcagttgatttatattccccttccagatgaggaatctcgttttcaaatcttcaagtcctgccttaggaagtctcctgttgccaaagatgttgacctcagtgctcttgccaagtatactcaaggatttagtggtgcagatatcactgaaatctgtcagcgtgcctgcaaatatgccatcagagagaatatcgagaaagatattgagaaggagaggagaaggaaggataaccctgaggccatggaagaggatgtggatgatgaggtggcagagatcaaggcagctcactttgaggaatcaatgaagtatgcccggcggagtgtcagcgatgctgatatccgcaaataccaggcatttgcgcaaacattgcagcagtcaagagggtttggaactgaattcaggtttgccgaatctggttctgcggctgcaggtgctgacccttttgcaaccactgctggtgcggctgatgaagatgacctttacaattaggcttatctttgatatttgtcctatttatgtttgcaattggattgtaatgatggcaggatgctccatgttgggctcctgtggatgctctctgacttagtttacaaacattttacttataattaaattgaatactgccaaatactctcttgaatatcttcattttttttttgttattgtttttcgttatagagcacactcgatctagcaaaatataaatatttcacctttccttttctagtttacaa

SEQ ID NO: 7378 - DNA, 2463 bp, Flaveria ramosissima
aatatctcaaatcttcctttcacaaatcgattattctgaaccatgagtgatcaacctgaatcatccgactctaaggggacgaaaagagactttagtaccgcgattcttgagcgaaagaaggcggcgaatagactcgttgttgatgaagccatcaacgatgataactctgtggtatctctgcatcctgagaccatggagaagcttcaacttttcagaggagatactatcttgattaagggaaagaaaaggagagatacaatctgtatcgcccttgctgatgacacctgtgaagaaccaaagattaggatgaataaggttgtcaggtcaaacctgagggttagacttggggatgtggtttcagtgcaccagtgtcctgatgttaagtacgggaagcgtgttcacatccttccaattgatgataccattgagggagtcactggaaatctgtttgatgcttacttgaaaccttacttcctggaagcatatcgccctgtgaggaagggtgactactttttggtaaggggaggaatgagaagtgttgagttcaaagttatcgagactgatcctgctgagtactgtgtagttgcacctgatactgagatcttctgtgagggtgagcctgtgagaagggaagacgaggaccggttagatgaggttggttatgatgatgttggtggcgttcgcaaacagatggcacaaattcgtgagttggttgaacttccattaaggcatccacagctcttcaagtctattggtgttaagccaccaaagggtattctgctttatgggcctcctgggtccggaaagactttgatagcacgtgctgttgctaatgagactggtgctttctttttctgcattaacgggccagagatcatgtcaaaaatggctggagagagtgagagcaatctaaggaaagcatttgaggaagctgagaaaaatgcaccttcgatcatcttcattgatgagattgattcaattgcgccaaaacgtgaaaaaacacacggtgaagttgaaagaaggatcgtttcccagctattgactttaatggacgggctgaaatctagggcacatgttattgtcatgggtgcaaccaatcgccctaacagtattgatcctgcattgagacggtttggtagatttgaccgggaaattgatattggcgtgcctgatgaagttggtcgtcttgaggttcttaggattcatactaagaacatgaagctatctgatgatgtggatttggagaaggttgcaaaagatacacatgggtatgtaggtgctgatttggcagccttatgtactgaggctgcactgcaatgcatcagagagaaaatggatgtgattgatttggaggatgaatccattgatgctgagatcctgaactccatggcagttacaaatgagcattttcagacagcccttgggaccagcaatccatctgctcttcgtgagactgttgtggaagtgcccaatgttagctgggaagacattggtggacttgagaatgtcaaaagagagctacaagagactgttcaatatccagtggaacatcctgagaaatttgagaagtttggcatggctccgtctaaaggagttcttttctatggtccacccggttgtggtaaaactcttctagccaaggctattgcaaatgaatgtcaagctaactttataagtatcaagggtcctgagttgcttacaatgtggtttggtgagagtgaggccaatgttcgtgaaatttttgacaaggctcgtgggtctgctccttgtgttctcttctttgatgaacttgattccattgcaacccagagaggaagcagtcaaggagatgctggtggtgcagctgacagagttctgaaccaacttctgactgaaatggatggaatgtctgcgaagaaaacagttttcatcattggtgcaaccaacaggcccgatatcattgatccagcacttttgaggcctggccgtcttgatcaactgatttacattcccttacccgatgaggagtctcgttaccagatctttaaatctgccttaaggaaatccccaatttctaaagatgtcgatctacgagctcttgccaagtacacccaaggtttcagtggtgctgatatcactgaaatctgtcagcgcgcctgcaaatatgccatccgtgagaacatagaaaaagatattgagagggaaaagagaagaagtgagaaccctgaagctatggaggaagatgttgaagatgaggtcgcggagattaaagctgctcactttgaagaatccatgaagtttgcacggaggagtgttagtgatgctgacataaggaaataccaagcgtttgctcaaacactgcagcagtcaagagggattggttccgagttcagattctcagagaccagtggacgtgcagccgctagtgacccatttgccgccccagctggtgcagctgatgatgacgacctttacaattagttt

SEQ ID NO: 7379 - DNA, 2728 bp, Glycine max
aactttcagatcccttttctttttactcattcattttctttccactctcttcatttccatcatggccaaccaacctgagtcttcctcctccgatgctaagggtacgaaaagagacttcagcaccgcgatccttgagcgcaagaaggcgccgaaccggctcgttgttgatgaggctgtaaacgatgacaactccgtcgtcgcacttcatcccaacaccatggagaagctccagctcttccgtggtgatactattctgctcaaggggaagaagagaaaagatactatttgtattgcgcttgccgatgagacgtgcgaggagccgaagatacggatgaacaaggttgtgaggaacaaccttagggttaggcttggagacgttgtttccgttcaccagtgcgctgatgtaaagtacggaaagcgtgtgcacattcttcccgtggatgataccattgaaggggttactgggaatctcttcgatgcgtacttgaaaccttatttccttgaggcatataggccagtgaggaagggtgatatgttccttgtgagaggggggatgagaagtgtggagttcaaggttattgaaactgatcctgctgagtactgtgttgttgctcctgacactgagatcttctgtgagggagagcctgttaaaagggaagatgagaatcgattagatgaggttggttatgatgatgttggtggtgttagaaagcagatggcgcagattcgggaactggtggaactgccattgaggcatccacaattgttcaaatctattggtgttaagccaccaaaaggaattcttctatatggaccacctgggtctggtaagactttaattgctcgggctgttgcaaatgaaactggtgccttctttttctgcattaatggccctgagatcatgtcaaaattggctggtgagagtgaaagcaatctgaggaaggcatttgaggaagctgagaagaatgcaccctctattatcttcattgatgagatagattcaatagctccaaagcgtgaaaagactcatggggaggttgagaggagaattgtttcccaactcttgaccctcatggatgggcttaaatcccgtgcacatgtaattgttattggagccacgaatcgtcccaatagcattgaccctgctcttaggaggtttggaagatttgatcgggagattgatattggtgtaccagatgaagttgggcgtctagaggttcttcgtatccatacaaaaaatatgaagcttgctgaagatgttgatttagaaaggattgctaaggatactcatggatatgttggtgctgatttggctgctttgtgtactgaagctgctcttcagtgcatcagagagaaaatggatgtcattgacttggaagatgagaccattgatgctgagatactgaactcaatggcagtgacaaatgagcatttccagactgctcttgggacaagcaatccttctgctctccgagaaacagttgttgaagtgcctaatgtcagttgggaagacattggtggtcttgaaaatgtgaagagagaactccaagagactgttcaatatccagtggaacacccggaaaaatttgagaagtttggaatgtcaccttccaagggggttcttttctatggtccccctggttgtggtaaaacccttttggcaaaagctattgccaatgaatgtcaggcaaatttcatcagtgtcaaaggtcctgagctactcacaatgtggtttggagaaagtgaggcaaatgtgagggagatttttgacaaagctcgtggttctgctccatgtgtccttttctttgatgaactcgactctattgcaactcagagaggcagcagtgtaggagatgctggtggtgctgctgacagggtgttgaaccaattgcttacagagatggatggcatgtcagcaaagaaaactgtgttcatcattggggccactaatcgaccagacattatagatcctgcacttctgcgaccaggtcgtctggaccaattgatttatatcccacttccagatgaggattcccgccatcagatatttaaagcttgcttgagaaaatctcccgtttcaaaagatgttgaccttagagctcttgccaagtatactcaaggcttcagtggtgcagatattactgaaatttgccaacgtgcatgcaagtatgctataagagagaacattgagaaggacattgagagagaaaggaggaaaagagaaaaccctgaggccatggaagaggatattgaagaggaagaggtagctgaaatcaaagcagctcattttgaagaatcaatgaagtatgcacgaaggagtgtaagtgatgctgacattcgcaagtaccaggcttttgcacaaacattgcagcagtcgagagggtttggatctgacttcacttttgcaaataccagctctgttggtgctgctgctggtgccggggctgcatccgacccttttgcaagtgctggtggagccgatgaagatgatctttacagttagaggtcaacctgtggcttttgtttatgaacggcaatactgccaatttatgtacttctcattttctgtatgaagtcagtcttcaattggatttattattgtcgttggtctgtaaacggcactggttcatgtggtgtgagcctcattgaaagtggaaagatttatttgaacttacaaagaagatttaaagaacattttaagatttaaagagcttagttttgactttat

SEQ ID NO: 7380 - DNA, 2579 bp, Vinca minor
gtaatccagcagagtcctctgactcgaaaggaaagaaagatttttctactgcgattttggaacgtaagaaagcaccaaatcggctcatcgtcgatgaggcggtcaacgatgataattctgttgtggctctccatcctgctactatggagaagctcaatatttttcgtggcgataccattttgattaagggtaagaaaaggaaggatactgtttgcattgctcttgctgacgagacatgtgaagaaccaaagattaggatgaataaggtggtgagatcaaatttgagggttcggcttgcagatgttgtatctgtgcatcagtgcccagatgttaagtatggtaagcgcatccatgtcctgccgttggatgataccattgagggtgtcacgggggatctctttgatgcatacctgaaaccctattttctggaggcatatcgtcctgtgagaaaaggagaccattttcttgttagaggagggatgagaagtgtggaattcaaggtcatcgagactgatccaggcgactattgcgttgttgcccccgacactgaaatattttgcgaaggggagcctgtgaagagggaggacgaggatagactcgatgaggttggctatgatgatgtgggtggtgtcaggaaacagatggctcagattcgtgagttagtggagctgccactaaggcatccccagctcttcaagtccattggggtaaaaccgcccaagggaattctcctttatggacccccaggatcggggaaaacacttatagctaaagctgttgctaacgaaacaggtgcttttttcttctgcattaatggacctgagatcatgtcaaaattagctggagaaagtgaaagcaatctcagaaaggcatttgaggaggctgagaagaatgctccatcgatcatctttattgatgaaattgattcaattgctcctaaaagagaaaagacaaacggtgaagttgaaaggagaattgtttctcaactcttgactctcatggatggactgaaatctcgtgcccatgtcattgtcatgggggctacgaatcgaccaaacagcattgatcctgctcttagaaggtttggcaggtttgacagggaaatagatattggtgttcctgatgaagttggccgtcttgaagttcttcgcattcatactaagaatatgaaactttctgaagatgttgatttggaaagaatagcaaaagacacacacggctatgttggcgctgaccttgctgcactatgcactgaagctgcacttcagtgcatccgggaaaagatggatgttattgatttggaagatgattccattgacgctgaaatattgaattctatggctgtaacaaacgaacatttccagacagctcttggaacaagcaacccgtctgctttgcgtgagacagttgttgaagtgcccaatgtctcatgggaagatattggaggacttgaaaatgtcaagcgtgagcttcaagagactgttcaatatcctgtggaacatccggagaagttcgagaaatttggtatgtcgccttcaaaaggtgtgttgttctatggccctcctggatgcggtaaaactctgctggctaaggcaattgcaaatgaatgtcaagccaattttattagtgtcaagggaccggagcttcttaccatgtggtttggagaaagtgaagctaatgtccgtgaaatctttgacaaggccagacaatctgcaccatgtgttctcttttttgatgaactggactctattgctacccagaggggaagcagtgttggagatgctggtggtgcagctgatcgagttcttaaccaacttttgactgaaatggatggaatgtcagctaagaagactgtttttataattggtgccaccaacaggcctgatatcattgatcctgcacttctccgtccaggccgtcttgatcagttaatttatattcctctgccagatgtagactctcgtcaccagattttcaaggcctgcctcagaaaatctccaatctccaaggatgtcgatttgggagctcttgccaaatatactcaggggttcagtggggctgatattacagagatatgccagagggcttgcaagtatgctataagagagaacattgagaaggacattgaaagagaacggaagagaaaagacaaccctgactctatggatgatgatgtcgaggaagaagtagcagagataaaggctggacattttgaggagtcaatgaagtatgctcgtagaagtgtgagtgatgctgacatccgaaaataccaagcatttgctcagactttacagcagtctcgagggtttggaagtgaattccgatttgcagactctgcaacggctgcctcaggatctgacccgtttgcaaccccggctggtgctggtgatgaagacgacttgtataattaagatatatatagagagatattccataactacacttagtagagtaaattatcctttccctatgcattttcctaccatgtattagggaacttttagtaatgcttggttaccctttccttgtggacaaattggtttcaattcctacctaacggattcatcgttcaagtctat

SEQ ID NO: 7381 - DNA, 2833 bp, Sorghum bicolor
tccgagtcccaaacccccgctgcaagaaagaagctataaaggaaagctaatcccccctcctcgagtcctccgcatctcgcatcctcgccgcgccggtgctgctgcaattaacgccaacccccggccaacaacccgaaacctacctccgccgccgccgtcgtcgccgccgcaacatggcgagccaaggggagccctcggcctctgcttctgatccgaaggagaagaaggattactcgacggcgatcctggagaggaaaaagtctccgaatcgccttgtggtcgatgaggccaccaacgacgataactccgtcgtcgcgctgcaccctgacaccatggagaggctgcagctcttccgcggcgacaccgtcctcctcaagggtaagaagaggaaagacactatttgcattgtccttgcggatgaaacctgtgaggagcctaaggttcggatgaacaaggttgtccgccagaacctgagggtgaggcttggtgatgtggtttctgtccaccagtgccaggatgtgaaatacgggaagcgtgtgcacattcttccaattgatgatacagttgaaggcattaccgggaacttgtttgatgccttcttgaaaccatacttcctagaagcctacagacctttgaggaaaggagaccttttccttgtcaggggtggaatgagaagtgtggaattcaaagttatagagactgatcctgctgaatattgtatcgttgcgccagatactgaaatattctgtgatggggagcctattaagagggaggatgaggagcgtcttgatgaagttggttatgatgatgttggtggagttagaaagcaaatggcccaaatcagagagcttgttgagcttccactacgccatccccagcttttcaaatctattggtgtaaagccaccaaagggcatattgctgtatggaccacctggttctggaaagactcttattgctcgtgctgttgcaaatgagactggagcctttttctttctgatcaatggcccagagattatgtcgaaactagcaggagagagtgagagtaatctcagaaaggcttttgaagaagcagaaaagaatgctccatctatcattttcattgatgaaattgattccattgcacccaagagagagaagaccaatggagaagtagagcgtcgtattgtttcacagctattgactcttatggatggactaaaatctcgttcccatgttattgttatgggtgctacaaacagaccaaacagcattgatccggctcttcgaagatttggaaggtttgaccgggaaattgacattggagttcctgatgaagttggccggcttgaggttctccgcattcacactaagaacatgaaactagctgaagatgttaatttggaactcatttcaaaggatacccatggatatgttggtgctgatcttgctgcgctttgcactgaggctgctctccagtgcattcgtgagaagatggacattatagatcttgaggatgagacaatagatgcagagatattgaactcgatggctgttacaaatgaccacttcaagaccgcgcttggaacaagcaacccatctgctctacgtgaaactgttgtcgaagtcccaaatgtctcttgggaggatattggtgggctggagaatgtcaagagggagctccaggagactgttcaatatcctgtggagcatccagagaagttcgagaagtttggcatgtctccatcgaaaggagttttgttctatggtcctcctggttgcggtaagaccttgttggcaaaggcaattgccaatgagtgccaggctaacttcatcagtgtcaagggtcctgagttgcttaccatgtggtttggtgagagtgaagccaacgtccgtgaaattttcgacaaggctcgccaatctgctccttgtgtcctcttctttgatgagcttgactcgattgctactcagagaggaagcagtgtgggtgatgctggaggtgcggctgatagagtgcttaatcagctactgacagagatggatggcatgaatgccaagaaaactgtgtttattattggggctacaaacaggcctgacatcattgaccctgctctgctgaggccaggacgtcttgaccagctgatctacattccactgcctgatgagcagtctaggctccagatcttcaaggcttgccttaggaagtcccctgtggcgaaggacgtggacttgaatgctcttgctaagtacacgcaagggttcagtggagcagatatcacagaaatttgccagcgtgcctgcaagtatgcaatcagagagaatattgagaaggacattgagagggaaaggcggagaaaggacaaccctgaggcgatggaggaagacgaagtggacgagattgctgagatcaaggcggctcactttgaagagtcgatgaagtacgctcggcgtagtgtcagtgatgctgatattcgcaagtaccaggcgtttgcccagacattgcagcagtcccgtgggttcggcagtgagttccgcttctcggagcaatcggcgacagctggtgctgctgcagctgatccgtttgcctctgctggtgctgcggctgatgatgacgatctatacagctaggtgtcctgttgggttggttctgggttgttcaatatcagtctcgtcagtcgtctgtttaaaactgatcatactttagacacggatgtcatgaaatgatatttattttccgtacatttggatgtcgctgagaatgccctctcggcttttgattatttctttcatgccatattctccatgacattttctgggccatgacattttattaatgattgttgtcattgtattgc

SEQ ID NO: 7382 - DNA, 2903 bp, Sorghum bicolor
cgagtcccaaacccccgctgcaagaaagaagctataaaggaaagctaatcccccctcctcgagtcctccgcatctcgcatcctcgccgcgccggtgctgctgcaattaacgccaacccccggccaacaacccgaaacctacctccgccgccgccgtcgtcgccgccgcaacatggcgagccaaggggagccctcggcctctgcttctgatccgaaggagaagaaggattactcgacggcgatcctggagaggaaaaagtctccgaatcgccttgtggtcgatgaggccaccaacgacgataactccgtcgtcgcgctgcaccctgacaccatggagaggctgcagctcttccgcggcgacaccgtcctcctcaagggtaagaagaggaaagacactatttgcattgtccttgcggatgaaacctgtgaggagcctaaggttcggatgaacaaggttgtccgccagaacctgagggtgaggcttggtgatgtggtttctgtccaccagtgccaggatgtgaaatacgggaagcgtgtgcacattcttccaattgatgatacagttgaaggcattaccgggaacttgtttgatgccttcttgaaaccatacttcctagaagcctacagacctttgaggaaaggagaccttttccttgtcaggggtggaatgagaagtgtggaattcaaagttatagagactgatcctgctgaatattgtatcgttgcgccagatactgaaatattctgtgatggggagcctattaagagggaggatgaggagcgtcttgatgaagttggttatgatgatgttggtggagttagaaagcaaatggcccaaatcagagagcttgttgagcttccactacgccatccccagcttttcaaatctattggtgtaaagccaccaaagggcatattgctgtatggaccacctggttctggaaagactcttattgctcgtgctgttgcaaatgagactggagcctttttctttctgatcaatggcccagagattatgtcgaaactagcaggagagagtgagagtaatctcagaaaggcttttgaagaagcagaaaagaatgctccatctatcattttcattgatgaaattgattccattgcacccaagagagagaagaccaatggagaagtagagcgtcgtattgtttcacagctattgactcttatggatggactaaaatctcgttcccatgttattgttatgggtgctacaaacagaccaaacagcattgatccggctcttcgaagatttggaaggtttgaccgggaaattgacattggagttcctgatgaagttggccggcttgaggttctccgcattcacactaagaacatgaaactagctgaagatgttaatttggaactcatttcaaaggatacccatggatatgttggtgctgatcttgctgcgctttgcactgaggctgctctccagtgcattcgtgagaagatggacattatagatcttgaggatgagacaatagatgcagagatattgaactcgatggctgttacaaatgaccacttcaagaccgcgcttggaacaagcaacccatctgctctacgtgaaactgttgtcgaagtcccaaatgtctcttgggaggatattggtgggctggagaatgtcaagagggagctccaggagactgttcaatatcctgtggagcatccagagaagttcgagaagtttggcatgtctccatcgaaaggagttttgttctatggtcctcctggttgcggtaagaccttgttggcaaaggcaattgccaatgagtgccaggctaacttcatcagtgtcaagggtcctgagttgcttaccatgtggtttggtgagagtgaagccaacgtccgtgaaattttcgacaaggctcgccaatctgctccttgtgtcctcttctttgatgagcttgactcgattgctactcagagaggaagcagtgtgggtgatgctggaggtgcggctgatagagtgcttaatcagctactgacagagatggatggcatgaatgccaagaaaactgtgtttattattggggctacaaacaggcctgacatcattgaccctgctctgctgaggccaggacgtcttgaccagctgatctacattccactgcctgatgagcagtctaggctccagatcttcaaggcttgccttaggaagtcccctgtggcgaaggacgtggacttgaatgctcttgctaagtacacgcaagggttcagtggagcagatatcacagaaatttgccagcgtgcctgcaagtatgcaatcagagagaatattgagaaggacattgagagggaaaggcggagaaaggacaaccctgaggcgatggaggaagacgaagtggacgagattgctgagatcaaggcggctcactttgaagagtcgatgaagtacgctcggcgtagtgtcagtgatgctgatattcgcaagtaccaggcgtttgcccagacattgcagcagtcccgtgggttcggcagtgagttccgcttctcggagcaatcggcgacagctggtgctgctgcagctgatccgtttgcctctgctggtgctgcggctgatgatgacgatctatacagctaggtgtcctgttgggttggttctgggttgttcaatatcagtctcgtcagtcgtctgtttaaaactgatcatactttagacacggatgtcatgaaatgatatttattttccgtacatttggatgtcgctgagaatgccctctcggcttttgattatttctttcatgccatattctccatgacattttctgggccatgacattttattaatgattgttgtcattgtattgcaatcacgaatctttcttttttgatggggacgagtatctgttagtacgtacgtgatccgtgattagcggagta

SEQ ID NO: 7383 - DNA, 2825 bp, Zea mays
cgagttccaaaccctcgccgcaagaaagaagctataaaggaaagctaatcccccttccttgagtcctccgcatctcgcattctcgccggtgctgctgcaattaacgccacccccggccaaccgcctgaaaactacctctgccgccggcgccgccatccccaacatggcgagccaaggggagccctcggcctctgcttccgatccgaaggagaagaaggactactcgacggcgatactagagaggaaaaagtcaccgaaccgccttgtcgtcgacgaggccaccaacgacgataactccgtcgtcgcactgcaccctgacaccatggagaggctgcagctcttccgcggcgatactgtgctcctcaagggtaagaagaggaaagacactgtttgcattgtccttgcggatgaaacctgtgaggagccaaaggttcggatgaacaaggttgtccgccagaacctgagggtgaggcttggtgatgtggtttctgtccaccagtgccaggatgtgaaatatgggaagcgtgtgcacattcttccaattgatgatacagttgaaggcattacagggaacctgtttgatgccttcttgaaaccatacttcctagaagcatacaggcccgtgaggaaaggagaccttttccttgtcaggggtggaatgagaagcgtggaattcaaagtgatagagactgacccttctgaatattgtatcgttgccccagatactgaaatattttgtgatggggagcctattaagagagaggatgaggagcgtcttgatgaagttggttatgatgatgttggtggagttagaaagcaaatggcccaaatcagagagcttgttgagcttccactacgccatcctcagcttttcaaatctattggtgtgaagccaccaaagggcatattgctgtatgggccacctggttctggaaagactcttattgctcgtgctgttgctaatgagactggagcctttttctttctgatcaatggcccagagattatgtcgaagttagcaggagagagtgagagcaatctcagaaaggcatttgaagaagcagagaagaatgctccatctatcattttcattgatgaaattgattccattgcacccaagagagaaaagaccaatggagaagtagaacgtcgtattgtttcacagctactgactcttatggatggactcaaatctcgttcccatgttattgttatgggtgctacaaaccggccaaacagcatcgatcctgctcttagaagatttggaaggtttgaccgggaaattgacattggagttcctgatgaagttggccggcttgaggttctccgtattcacactaagaacatgaagctagctgaagatgttaatttggaactcatttcaaaggatacccatggatacgttggtgctgatcttgctgctctttgtactgaggctgctcttcagtgcattcgtgagaagatggacatcatagatcttgaggatgagacaatagatgcagagatattgaactcgatggctgttacaaatgaccatttcaagactgcgcttggaacaagcaacccatctgctctccgtgaaactgttgttgaagtcccaaatgtctcttgggaggatattggtgggctggagaatgtcaagagggagctccaggagactgttcaatatcctgtggaacatccagagaagttcgagaagtttggcatgtctccatccaaaggagttctgttttatggtcctcctggttgtggtaaaaccttgttggcgaaggcaattgccaacgagtgccaggctaacttcatcagtgtcaagggtcctgaattgcttaccatgtggtttggtgagagtgaagccaacgtccgcgaaatttttgataaggctcgccaatctgctccttgtgtcctcttctttgatgagcttgactcaattgcgactcagagaggaagtagtgtgggtgatgctggaggcgcggctgatagagtgcttaatcagctactgaccgagatggatggcatgaacgccaagaaaactgtgtttattattggtgctacaaacaggcctgacatcattgatcctgctcttctgaggccagggcgtcttgaccagctgatctacattccactgcctgatgagcagtctaggctccagatcttcaaggcctgcctaaggaagtcccctgtggcaaaggatgtggacctgaatgctcttgctaagtacacacaagggttcagtggagcagatatcacagaaatttgccagcgtgcgtgcaaatatgcaatcagagagaacattgagaaggacattgagagggaaaggcggatgaaggacaaccctgaggcgatggaggaagatgaagtggacgagattgccgagatcaaagcagctcacttcgaggagtctatgaagtatgctcggcgcagtgtcagtgatgctgatatccgcaagtaccaggcgttcgcccagacgttgcagcagtcccgtgggttcggcagcgagttccgcttctcagagcagtcggcgacagctggtgctgctgcagccgatccgtttgcttcggctggtgctgcggctgacgatgacgatctatacagctaggtgtcctgttgggttggttctgggttgtgcaatatcagtctcatcagtcatctgtttaaaactctgattatacttagacacgggatgtcatgcaatgatatttgttttccgtacatttggacgttgagataatgcctgtttattttatgccatactctccatgccattttatgaatgattgtttgtcattgagtatatgagtcacgttttatatggtgacgtgactgag

SEQ ID NO: 7384 - DNA, 2671 bp, Amsonia hubrichtii
atctctttctatctctctctgtatccgtctcccatcaaaggaaaacagaatccgaagatgagtactcaagcagagtcatcggacacgaaaggcaagaaagatttttccactgcgattttggaacgtaagaaggcgcctaatcgtctcatcgttgatgaggcagtcaacgatgataattccgttgtcgctctccaccctactactatggagaagctccagctttttcgtggcgataccattttgattaagggtaagaaaaggaaggatacagtatgcattgctcttgccgacgaggcatgtgaagaaccaaagattaggatgaataaggtggtccgagcaaatttgagggttcggcttggagatgttgtatctgtgcatcagtgcccagatgttaagtatggaaaacgtatccacgttctgcccctggatgacaccatagaaggtgtcactggggatctctttgatgcatacctgaagccctattttctggaggcatatcgtccagtaagaaaaggagaccattttcttgttagaggagggatgagaagtgtcgaattcaaggtcattgagactgaaccaggtgagtattgtgttgttgcccctgacactgaaatattttgtgaaggggagcctgtgaggagggaggatgaggatagactggatgaggttggctatgatgatgtgggtggtgtcaggaaacagatggctcagattcgtgagttagtggagctgccactaaggcatccgcagctcttcaagtccattggggtaaaaccacctaagggaattctcctttatggacccccaggatctggaaaaaccctgatagctagagctgttgctaatgagactggggcttttttcttctgcattaatggacctgagatcatgtcaaaattagctggagaaagtgaaagcaatcttaggaaggcatttgaggaggctgagaagaatgctccatctatcatctttattgatgaacttgattcaattgctcctaagcgagagaagacacacggtgaagttgaaaggagaattgtttctcaactcttgactctcatggatggactgaaatctcgtgcccatgtcattgttattggggctacaaatcggccaaacagcattgatcctgctcttagaaggtttggtaggtttgacagggaaatagacattggtgttcctgatgaaattggacgtcttgaagttcttcgcattcatactaagaacatgaaactttctgaagatgttgatttggaaagaattgcaaaagacacacatggctatgttggtgctgatcttgctgctctatgcacggaagctgcacttcagtgcatccgggaaaagatggatgtcattgatttggaagatgattccattgatgctgaaatattgaattctatggctgtaacaaatgaacacttccagacagctcttggaacaagcaacccatctgctttgcgtgagacagttgttgaagttcccaatgtctcatgggaagatattggaggccttgaaaacgtcaagcgggagcttcaagagactgttcaatatcctgtggaacatccagaaaagtttgagaaatttggtatgtcgccttcaaaaggggtgttgttctatggccctcctggatgtggtaaaaccctgctggctaaggcaatagcgaatgaatgtcaggccaactttattagtgtcaagggacctgaacttcttaccatgtggtttggagaaagtgaagccaatgttcgtgaaatctttgacaaggcgaggcaatctgcaccatgcgttctcttctttgatgagctggactccattgctactcagaggggaagcagtgttggagatgctggtggtgcagctgatcgggttcttaatcaacttttgactgaaatggatggaatgtcagctaagaagactgtgtttataattggtgccaccaacaggcctgacattattgatcctgcacttctccgtccaggccgtcttgatcagttaatctatatccctctgccagatgaagactctcgtcaccaaattttcaaagcctgcctcaggaaatcaccagtctccaaggatgttgatctgagagctcttgccaagcatactcagggatttagtggggctgatattactgagatatgccagagggcttgcaagtatgccataagagagaatattgagaaggatattgaaagagaacggaggatattgaaagacaatccggattctatggatgaggatgttgaggaagaagtagcagagatcaaggctgcacattttgaggagtcgatgaagtatgctcgtagaagtgtgagtgatgctgacattcggaaataccaggcatttgctcagactttacagcagtctcgagggtttggaagtgaattccgatttgcagattctgcaacaggtgcccctgaatctgatgcctttgcaacttcggctggtgctgctgatgaagatgacttgtatagttaaagagagatagatcttcagtattacacagaacagtaaaccttatgcattatatgtagtcactcctctccggttccttttaaacttattttctagttatcaaacattgtactcgggaatttctggtgaccgttggttaccttctgcgaattcttccttttcaacgtggattttctatttataaatacctcttcattgg

SEQ ID NO: 7385 - DNA, 2535 bp, Arnica chamissonis
tcatgagtaatcaagccgaagcatcggactctaagggtacaaagcgcgactacagtacggcgattctggaacgaaagaaagccgcgaacaggctcgttgttgatgaagccatcaacgatgataactccgttgttgccctacatcccgagacgatggaaaagcttcagcttttcagaggagacactattctgatcaagggaaagaaacgtaaagacactatttgtatagctcttgctgatgacacgtgtgaagagcccaaaattaggatgaacaaggttgtcagggctaacctacgggtcaggctcggtgatgtggtctctgttcatcaatgccctgatgtcaaatatggcaaaagggtgcatatccttccagttgatgatacaattgaaggtgttactggcaatctctttgatgcatatttaaaaccatactttctggaagcatacagacccgttaggaagggcgactttttccttgtgaggggagggatgcggtctgttgaatttaaagttattgaaactgatcctgctgaatactgtgtagttgcacccgatactgagatcttctgtgaaggtgagcccattagaagggaggatgaagatcgattagacgaaatcggttatgatgatgtgggtggggtccgcaaacagatggcacaaatccgtgagctggtggagttgcctctaagacatccacaacttttcaagtcaatcggtgtcaaaccaccaaaaggaattcttctttatgggcctcctgggtcaggtaagactttaatagcccgggctgttgcaaatgagacaggtgctttctttttttgtataaatgggccggaaatcatgtcaaagttggctggagaaagtgagagtaatcttagaaaagcttttgaggaagctgagaaaaacgctccatcgattatttttatcgatgaaattgattcaattgctcccaaacgggaaaaaacaaatggagaagttgaaagaagaattgtctcgcagcttttgactctaatggacgggctgaaatcgcgggcccatgttattgtcatgggtgcaaccaaccgtcccaacagcattgacccggctctgagaagattcggcaggtttgaccgggaaatagatattggtgttcctgatgaagtgggccggcttgaggtgctccgcattcataccaagaacatgaagctggctgatgatgtggacttggaaaagatttccaaggagacacatggatatgttggggctgacctggcggctctgtgtactgagtcagcactccagtgtattcgtgagaagatggatgtgattgatttggaagatgagtcaattgatgctgagattcttaattcaatggcggttactaatgagcatttccaaactgcccttggtacaagtaacccgtctgctcttcgtgaaacggttgttgaagttcctaatgttagctgggaagatattggtgggcttgaaaatgttaaaagagagctccaagagactgtacagtatccagttgaacaccctgaaaaattcgagaaattcggcatgtcaccatctaaaggagttctgttttacggccctccagggtgtggcaaaacacttctagccaaggctatagccaatgaatgccaagctaacttcatcagcatcaagggtccagaattgctaaccatgtggtttggtgaaagtgaagctaatgttcgcgagatcttcgataaggctcgtgggtctgctccttgcgtcttattttttgatgagctggactccattgctacccagagaggtagtagtcaaggagatgcaggaggtgcagctgatagggttttgaatcaacttttgactgaaatggacgggatgtcagctaaaaagacggttttcataatcggtgcaactaaccgtcctgatatcattgatccagcccttttgaggcccggtcgtcttgatcagttaatttacattcctctccctgatgaggagtcacgttattccattttcaaatcagctttaaggaaatcacccgttgcaaaagaagttgatcttcacgcacttgctaaatacactcagggattcagtggtgctgacatcaccgaaatctgccagcgtgcagttaaatacgccatccgtgagaacattgagaaggatattgaaagggagaagagaagaagtgagaacccggaggctatggaggaagatgtggatgaggtggcagagattaaggcggcacattttgaagaatcaatgaagttcgcacgacgaagtgttagtgatgctgacatacgcaaataccaggcatttgctcagacactacagcagtccagagggtttgggtctgagtttaggttttctgagacgagtggtgctaccgctagtgctggtggctcagacccatttgctgcttctgctggtgcagcccgatgaagatgatttgtataactagctctttttattaatcgtatccagatcgcgtatcattttctcgttaaaacactctgttgaccttttgtaatttatgtgaacttggttgttacttgatttgatgtgtttc

SEQ ID NO: 7386 - DNA, 2823 bp, Distylium racemosum
aaataggatccgatcgagtcgaagagcccgcatagaagacaaggttttcattctcagctgctatataacccggttgcctgtgcgcctctcttcctaagcctattcttctttttctctctgaattgcttttttggcgcataccgacgttttacggcaaggtaactactttcgcagcaatggctaagggggaatcatctgaaccgaagggaacaaaaagagattacagcacggcaattctggagcggaagaaggctcccaaccgcctggttgtggatgaagcgatcaacgatgataattctgtggtttcgctgcaccccgacaccatggaaaaattacaactctttcgcggtgacacaattctcattaaggggaagaagcggaaggacacgatttgtattgccttggcggacgagacgtgcgaggagccgaagattagaatgaataaggtggtgcgttcgaatctgagggttcgtcttggtgacgtcgtttccgtccaccagtgccccgatgttaagtacgggaagcgcgtccacattcttccgatcgatgataccatcgagggtgtcaccgggaatctcttcgatgcatatttaaaaccctatttcttggaagcatatcgcccagtgagaaaaggagatctgttcctggtgaggggtggtatgcgaagtgtggagttcaaagtaattgagacagaccctggggagtattgtgttgtttctccggatacagaaattttctgtgagggagagccagtgaagcgggaggatgaagatagattggacgaaataggttatgacgatgttggtggtgtaaggaaacaaatggctcagatccgtgaactggtggaacttccactaaggcatccgcagctctttaaatcaattggtgtcaagcctccaaagggtatcttactctatggaccacctggttccggaaaaacattaattgctagggcagttgcaaatgagactggcgccttctttttctgtataaatggacctgagattatgtcaaagttggctggggaaagtgaaagcaatcttaggaaggcttttgaagaggcagagaagaatgcaccctcaataatttttattgatgaaattgattccatagctccaaagagagagaaaacccatggcgaagttgagaggagaattgtttctcaacttctcacacttatggatgggttaaaatctcgagctcatgttattgtaattggagcaacaaatcggccaaacagtattgacccagctctgagaaggtttggaaggtttgacagagaaattgacattggagttcctgacgaagtgggcaggctggaggtgcttcgaatccatacaaagaatatgaagctcgctgaggatgttgatcttgaaaggattgcaaaggatacacatggatatgttggagcagatcttgcagctctgtgcacagaagctgcgctgcaatgcattagggaaaaaatggatgttattgacttggaagatgagacaattgatgctgagatccttaattcaatggctgttactaacgaacacttccagactgccttgggatccagtaacccatccgctctgcgtgaaactgttgttgaagtgcccaatgtttcttgggaagatattggtgggttggaaaatgtcaagagggagcttcaagagactgttcaatatccagtggagcatccggagaagtttgaaaagtttggcatgtctccttcaaaaggagtactcttctatggtccgcctggttgtggtaagaccttgcttgcaaaagctattgcaaatgagtgccaggccaacttcatcagtgtgaaaggtccggaattgttaacaatgtggtttggggagagtgaagcaaatgtcagagaaatttttgacaaagccaggcagtcagctccatgcgtcttgttctttgatgagctcgactctattgctacacagcgtgggagcagtgttggggatgctggtggtgctgcagacagagtccttaaccagttgttgacggagatggatggtatgacggccaagaaaactgtttttattattggggcaacaaacaggccagatatcattgatcctgctttgctgaggcctggtcgacttgatcagttgatctatatacctttacctgatgaaagctcacgctaccaaattttcaaatcttgcttgagaaaatcacctgtttcaaaggatgttgatcttatggcacttgctcgttatacccatggatttagtggagctgatattacagagatttgtcagcgggcttgcaagtatgctatcagagaaaatattgaaaaggacattgaacgcgaacgaaaaagaagagataatcctgaggccatggatgaggatgatagtgacgaggtatcagaaataaaagcggctcattttgaggaatcaatgaaatatgcccgaagaagtgtgagcgatgctgacatccgaaagtatcaggcatttgcacagacactgcagcaatctcgaggttttggttctgaatttcgatttcctgacagaccatccagtacagtgggggctgggtcttctgatgcatttgccacagctgacaataaagacgatgatgatttatacggttaagagatttcgcaatttatctgattttgctggcaccttggcaccttcctctgacaacacgccaatgttatttggagtaacttcttagtttaatgttatcaaatgtagtaaacctttattagtgttttaaaaactatctgtaacttgtatggttacagattcagctatattacaatgaaaggatatttagctggtagttctttctatgaaaatctgctttaactctgca

SEQ ID NO: 7387 - DNA, 2805 bp, Euonymus alatus
cggccgggggaatagaataggattatcttgaaaaacaaatatcaaaactggggactgtataaatatctatagcaattgacccaaggtcatcataaatcctttcgagttagcgaagcaagcatacagaaaatctttggattgtttacgatgtctaatcaaggcgaatcttcggactcgaaatctgcgaagaaggacttctcgacggcgattttggaacgcaaaaagtctccaaatcggctggttgtagacgaggctgtcaacgatgacaactccgtggtttcgatgcacccagagaccatggagaagctccagctcttccgtggtgatacgattctcatcaagggtaagaaacggaaggatacaatatgtattgctcttgctgatgacacatgtgagcagccaaggatcagaatgaataaggttgttagatcaaatctaagggttcgactaggagatgttgtatctgtgcaccaatgcccggatgttaagtatggaaagcgtgttcacatattgccaattgacgataccatagaaggtgttactgggaacctgtttgatgcatacctgaaaccatacttcttggagtcctatcggcctgtgaggaaaggagacctatttcttgtcagaggagggatgagaagtgtcgagttcaaggtgattgagactgaccctggagagtattgtgtggttgcaccagacactgaaatattctgcgagggagagcctgtaagaagggaggatgaggatagattggatgaaatagggtacgatgacgttggtggtgttcgcaaacagatggcccagattcgtgagctagtggagctgccattaaggcatcctcaactttttaaatcaattggtgtaaaaccaccaaaaggaattctattgtatggacctccaggatctggtaagacattgatagccagggctgttgccaatgaaactggtgctttcttcttttgtattaatggtccagagataatgtccaaattggctggtgagagtgaaagcaatctcaggaaggcatttgaagaagctgagaagaatgccccctccatcatctttattgatgagcttgattcaatcgctcccaagcgtgagaaaacccatggtgaagttgaaaggcggattgtttcacagcttttgactcttatggacggactgaaatcgcgtgcccatgttattgttattggtgctacgaaccgcccaaatagtattgatcctgccctgagaaggtttggtaggtttgacagggaaattgacatcggagttccagatgaagttgggcgtcttgaagtccttcgcatccataccaagaacatgaagctttctgatgatgtggatttagaaagaatcggaaaagatactcatggatatgttggtgctgaccttgctgctttatgcactgaagctgctctgcagtgcatcagagaaaagatggatgtgattgacttggaggatgaaaccattgacgctgagatactaaattccatggctgttacaaatgatcacttccagaccgctcttggaacaagcaacccatctgcattgcgtgaaacagtcgtcgaagtgcctaatgtcaactgggaggatattggcggtctcacgaatgtgaagagggaacttcaagagactgttcagtaccctgtggagcatcctgagaagtttgagaagtttggaatggcaccatcaaaaggggtcttattttatggtccacctggatgtggaaaaactttgctggcaaaggcaattgcaaatgaatgtcaagctaacttcatcagcgtgaaaggccccgaactgctcaccatgtggttcggtgagagtgaagctaatgtccgagaaatatttgacaaggctcgacaatctgcaccatgtgtccttttctttgatgagcttgactctattgcaactcagagggggaacagtggtggggatgcagggggtgcagcagatcgagtcctaaaccagcttttgactgaaatggatggcatgtcagccaaaaagactgtttttatcattggggccacgaacagacctgatattattgaccctgcacttttgcggccagggcgtcttgatcaattaatttatatccctcttccagacgaggagtcacggttccaaattttcaaagcctgcttgagaaaatcaccaatcgcaaaagatgttgatttgggggcattggctaaatatactaatggcttcagtggagctgatatcacggagatatgtcagcgagcatgcaaatatgctataagagagaatattgagaaggatattgaaagagagaagtggagaagtcagaatcctgaagctatggaagaggacactggagaagaagtggacgaaatcaaggctgctcatttcgaggaatcaatgaagtttgctcgtagaagtgtcagtgatgctgatatacgcaagtaccaggcttttgcacagacgctgcagcagtctaggggatttggaactgaatttaggtttccagagacgggatctggtgctgcagcagctactgatccgttttcaacttctggtgctgctggggctgatgaagatgatttgtatagttaagttttatctaaagtttgtcgtcctaatcctaatatagacctctgtagggcaacttttcttcctcgcttgggacatggctctcctggtcaattactgttaatatttttggactttttcaacttcagggttcagggtttgctactgaattgatattttatagggtttgatgtgttttctgtattgacgtttatcctgaacaggctagatcttatctataattgcatgtatgcagta

SEQ ID NO: 7388 - DNA, 2492 bp, Flaveria ramosissima
tcacaaatcgtctccaaaccctcgctccacaatcctcaaatcttccatacacaagtcgattattctgcaccatgagtgatcagcccgaatcatccgaccctaaggggacgaaaagagactttagtaccgcgattcttgagcgaaagaaggcggcgaatagactcgttgttgacgaagccatcaacgatgataactctgttgtatctctgcatcctgagaccatggagaagcttcaacttttcagaggagatacaatcttgattaagggaaagaaaaggagagatacaatctgtatcgcccttgctgatgacacctgtgaagaaccaaagattaggatgaataaggttgtcaggtcaaacctgagggttagacttggggatgtggtttcagtgcatcagtgtcctgatgttaagtacgggaagcgtgttcacatccttccaattgatgatactattgagggagtcactggaaatctgtttgatgcttacttgaaaccttacttcttggaagcataccgccctgtgaggaagggtgactactttttggtaaggggaggaatgaggagcgttgagttcaaagttatcgagactgatcctgctgagtactgtgtggttgcacctgatactgagatcttttgtgagggtgagcctgtgagaagggaagacgaggaccgattagatgaggttggttatgatgatgttggtggtgttcgcaaacagatggcacaaatccgtgagttagtggaactcccattgaggcatccacaactcttcaagtctattggtgttaagccaccaaagggtattctgctttatgggcctcctgggtccggaaagactttgatagcacgtgctgttgctaatgagactggtgctttctttttctgcattaacgggccagagatcatgtcaaaaatggctggagagagtgagagcaatttaaggaaagcatttgaggaagctgagaaaaatgcaccttcgatcatcttcattgatgagattgattcaattgcgccaaaacgtgaaaaaacacacggcgaagttgaacgaaggattgtttcccagctattgactttaatggacgggctgaaatccagggcacatgtaattgttatgggtgcaaccaatcgccccaacagtattgatcctgcattgagacggtttggtagatttgaccgtgaaattgatattggtgtgcctgatgaagttggtcgtcttgaggttcttaggattcatactaagaacatgaagctatctgatgatgtggatttggagaaggttgcaaaagatacacatgggtatgtcggtgctgatttggcagccttatgtactgaggctgcactgcaatgcataagagagaaaatggatgtgattgatttggaggatgaatccattgatgctgagatcctgaactccatggcagttacaaatgagcattttcagacagcccttgggaccagcaatccatctgctcttcgtgagactgttgtggaagtgcccaatgttagctgggaagacattggtggacttgagaatgttaaaagagagctgcaagagactgttcaatatcctgtggaacatcctgagaaatttgagaagtttggcatggctccgtctaaaggagttcttttctatggtccacccggttgtggtaaaactcttctagccaaggctattgcaaatgaatgtcaagctaactttatcagcatcaagggtcctgagttgcttacaatgtggtttggtgagagtgaggccaatgttcgtgaaatttttgacaaggctcgtgggtctgctccttgtgttctcttttttgatgaacttgattccattgcaactcagagagggagcagtcaaggagatgctggtggtgcagctgacagagttctgaaccaacttctgactgaaatggatggaatgtctgcaaagaaaacagttttcatcattggtgcaaccaacaggcctgatatcattgatccagcacttttgaggcctggccgtcttgatcaactgatttacattcccttacccgatgaggagtctcgttaccagatctttaaatctgccttaaggaaatccccaatttctaaagatgtcgatctacgagctcttgctaagtacacccaaggtttcagtggtgctgatatcactgaaatatgtcagcgtgcctgcaaatacgccatccgtgagaacatagaaaaagatattgagagggaaaagagaagaagtgagaaccctgaagctatggaggaagatgttgaagatgaggttgcggagattaaagctgctcactttgaagaatccatgaagtttgcacggaggagtgttagtgatgctgacataaggaaataccaggcgtttgctcaaacgctgcagcagtcaagagggattggttccgagttcagattctcagagaccagtggacgtgcagccgctagtgacccatttgccgccccagctggtgcagctgatgatgacgacctttacaattagttt

SEQ ID NO: 7389 - DNA, 2676 bp, Aquilegia formosa
ctcactactctctctactttctctactctctctttctctcacctcaatctgttcttcatcttcttcgaaatcatggcagatcaacccgaatcatctgaccctaaaggtggaaagaaggatttcagtacagcaatactagaacgtaagaaagcagcaaatcgacttgttgttgatgaagcgatcaatgatgataactcagtcgtttcattacacccagatactatggaaaaacttcagcttttccgtggagacactattctcatcaagggaaagaaaaggaaggatactatctgcattgcacttgctgatgatacctgtgatgaacccaaaatcaggatgaataaagttgttcgatctaatttgagggttagacttggtgatgttgtatctgtgcatcaatgtcctgatgtcaaatatgggaagcgtgtgcatatcttgccagtggatgataccattgaaggtctcaccgggaatctatttgaaacgtttttgaaaccttatttcctggaagcttatcgccccgtaaggaagggaaacctcttcctagtcagaggtggaatgagaagtgtagaattcaagatcattgagactgaccctgctgagtactgcgttgttgcaccggataccgaaatcttctgtgaaggagagccagtgaaaagagaggatgaagataggctggatgatgttggttatgacgatgtgggtggtgttcgtaaacagatggctcagatccgggagttagttgagcttccactaagacatcctcagcttttcaaatcaattggtgtgaaacctcctaaaggaatattattgtatggaccacctggatctgggaagacattgatagccagggctgttgccaatgaaactggtgcttttttcttctgtatcaatggtcctgagattatgtccaaattagctggtgagagtgaaagcaaccttcggaaggcttttgaggaagctgaaaagaatgctccttctatcatcttcattgatgagatagactcaattgctcccaagcgagagaagactcatggagaggttgagcgacgaattgtatcacagcttttgacactcatggatggtttgaaatcccgtgcacatgtcattgtcatgggggctaccaatcggcccaacagcattgatccagctttgagaaggtttgggagatttgacagggaaattgatattggggttcctgatgaaattggacgtcttgaggttctacgcatccatacaaagaacatgaagctctcagatgatgttgatttagaagcgatttccaagaacactcatggatatgttggtgctgacctggctgctttgtgcactgaagctgccctacagtgcattagagaaaagatggatgtgattgatttggaagatgaatcaatagatgctgagattcttaattccatggctgttacagatgagcacttcaagactgccctgaatacaagcaatccctctgctttgcgtgaaactgttgttgaagtgcctaatgtcagctggcaggatattgggggtcttgaaaatgttaagagggagcttcaagagaccgtgcaatatccagtggagcatcctgagaagtttgaaaagtttggtatgtctccatcaaaaggagttctcttctatggacctcctggctgtgggaaaactcttttggccaaagctattgcaaatgaatgtcaagcaaatttcatcagtattaagggtcctgagctgctcactatgtggtttggtgagagtgaggctaatgtacgagaaatttttgacaaggctcgcggatctgcaccctgtgtacttttcttcgatgaacttgattccattgctacccagagagggagtagtagtggagatgcgggcggtgctgctgatagggttttaaaccaacttttgactgaaatggatggaatgtctgcaaagaagacggttttcatcattggtgctaccaataggccggatattatcgaccctgcattgctcaggccaggccgtcttgatcagctgatctatattcctctacctgatgaggagtcacgtttccagatcttcaagtcctgtctcaggaaatcacctgtttcgaaagatgttgatctgagagccttggccaagtatactcaaggctttagtggggctgatatcacggagatatgccaacgtgcatgcaagtatgccatcagagaaaacattgagaaagatatagaaagggagaggaggagaagtgataatcctgaggctatggaagaagatgtcgatgatgaggtgcccgagatcaaggctgctcattttgaggagtccatgaagtttgcccgtagaagtgtgagtgatgcagacattcgtaagtatcaggcatttgcacagacattgcagcagtcaagggggttcggaagtgagttccgatttgcggaaacaggggctgggacaacaactgcgtcggatccgtttgcagcagctggtggtgctgatgaggatgatctgtacagctagattttgtacagcctctttcatagttgtagtttataactttataatactttttgttgctcaactctgaggggtacaagctccagtctggcatctatcttttgaaattggttttgggagctgttaaagtatgttaaagacttaacttcagtattctatattaaaacttggtttgatggtatccttttc

SEQ ID NO: 7390 - DNA, 2706 bp, Lactuca sativa
gccgggggctttccaaattcaccatatatgcataagtcccctctacccaaaccctcacacatcccaaaaattcacaattctgtcaatcggaatttataatcaaccaatcttcttcaacaacatgagtaatcaagcagaatcatccgatgccaaggggacaaagcgggacttcagtacggcgattctggagcggaagaaggctgctaacagactcgttgtcgatgaagcaatcaacgatgataattctgttgttgccttacatccagagaccatggaaaagcttcagttattcagaggcgacaccatcttgatcaagggaaagaaaaggaaagacacaatctgtatagttcttgctgatgacacttgtgaagaaccaaagatcaggatgaataaggtagtcagaacaaatctcagagtgagacttggtgatgtagtctcagttcaccaatgtgctgatgtcaaatacgggaaacgtgttcacattcttccaattgatgacacaatcgaaggcgtaacaggaaatctcttcgatgcttatctaaaaccttacttcatggaggcatatagacctgtgagaaaaggtgacttctttcttgtaaggggaggaatgagaagtgtagagttcaaggtcatagaaacagatccaccagagtattgtgtagtagcacccgatacagaaatcttctgtgaaggcgaacccataagaagagaagatgaagatcggttagatgaaatcggttatgatgatgtcggtggggtccgcaaacaaatggcacaaatccgtgagctagttgagcttccattgagacacccacagctctttaagtcaatcggggtcaaacccccaaagggtattttactatacggaccccctggatccgggaagactttaatagctcgggcagttgctaacgaaaccggggctttctttttctgcatcaatgggcccgaaatcatgtcgaaaatggcaggagaaagcgagagtaatttgaggaaagcttttgaagaagctgaaaagaacgctccatcaattatcttcatcgatgaaattgactcaattgcccctaagcgtgagaagacacacggtgaagttgaaagaagaattgtgtcacagttgttgactttaatggacgggttgaaatcgcgtgcacatgttattgtcatgggtgctaccaatcgtcctaatagcattgaccctgcgttgagaagattcgggaggtttgaccgggaaattgacattggtgtccctgatgagattgggagacttgaagttcttcgtattcataccaagaacatgaaattagctgaagatgttgacttggagaagatttcgaaagagacacacgggtatgtgggtgctgacctggcggctttgtgtactgaagctgcacttcagtgtattagagagaagatggatgtgattgatttggaagatgagtcgattgatgcggagattttgaactccatggctgtacgaatgagcactttgcaactgcacttgggactagtaatccttctgctctccgtgagactgttgtggaagtgcctaatgttagttgggaagatatcggaggccttgagaatgtcaaacgtgagctccaagagactgttcaatatccggttgaacacccggagaaatttgaaaaattcggaatgtcaccatcaaagggagtcctcttctatggcccaccagggtgtgggaaaacacttctcgcgaaagctatcgccaacgaatgccaagcgaacttcatcagcatcaagggaccagaactactcacaatgtggttcggtgaaagtgaagcgaatgtacgcgaggtcttcgataaagcacgtgggtccgccccttgtgttctcttcttcgacgaactcgactccatcgccacccagagaggaagtagtcaaggagatgcgggaggtgcagcagatcgggttttgaaccaactgttaaccgaaatggacgggatgtcggcgaaaaagacggttttcataatcggtgcgacgaaccgaccggatataatcgacccggcacttttgagacccggtcgactcgatcagttaatttacattcctctccctgatgaagaatctcgctattccatcttcaaatccgctttacgaaagtcgcccgttgcaaaggacgttgaccttcacgcccttgctaagtacacccaaggcttcagtggcgctgacatcaccgaaatctgtcaacgcgcgtgcaagtacgccatccgtgaaaacattgaaaaagatattgagagggagaagaagaggagtgagaatccggaggcgatggaggaggatgtggaggaggatgaggtggcggagataaaggcggctcattttgaagagtcgatgaagtttgcacgaaggagtgtgagtgatggggatattaggaagtatcaggcgtttgcgcagacgttgcagcagtcgagagggtttgggtcggagtttaggtttgcggaggccagcggtggtgctgcggctgcgggtggtggagcggacccgtttggtgcggcggcaggtggtgctgatgatgatgatctttataattagtttagtttggttaataatgtcatacacggatgatgctttctaatatcgttgtctatggtgtgaaaatacttggtttcttgaatttatttatgtatttatgtaacttaaatcctaccttgtttctatgagcatggttttattagacgttttcta

SEQ ID NO: 7391 - DNA, 2755 bp, Cephalotaxus harringtonia
aatacctatttcattcttatttgaggaggccttgcagcaatctctctctctctctgtaatcatggctcacaagggagaatcctcagaaccgaaaggaaccaaaagggatttcagcactgcaattttagagcgaaagaaggcggcgaatcgcctagtggttgatgaagcgattaacgatgacaactccgtagtttgtctgcaccccgacaccatggaaaaattgcaattgttccgtggagataccatccttattaagggtaagaagaggaaggatactatttgtattgctctagcggacgagacatgcgaagagcctaaaatacgaatgaacaaggttgtgcgttcgaatctcagggtacgtttgggggacgtggtttctgttcaccaatgtcccgatgttaagtacggcaagcgcgtccatattcttcctatcgacgataccatcgagggcgtcaccggcaatttgttcgatgcctatctaaaaccctatttcttggaagcttatcggccagtcagaaaaggagatcttttccttgtcagaggtggaatgcgtagtatagagtttaaagttattgagacagacccgggggaatattgtgttgtttctcctgatactgaaattttctgtgagggtgagccagtgaagcgggaagatgaagatagattggatgagattggttatgatgatgttggtggcgtacggaaacaaatggcgcagatacgtgaattggtagaacttccacttaggcatccacagctctttaaatcaattggtgtgaagcccccaaagggtattctgctttatgggccacctggttctgggaaaaccttaattgctagagcagttgcaaatgaaactggtgcgttctttttctgtatcaatggccctgaaattatgtcaaagctggctggagaaagtgaaagcaatctcaggaaggcttttgaggaggctgagaagaatgccccgtccattatatttattgatgaaattgattccatagctcccaagagggaaaaaacccatggtgaagttgagaggaggattgtttctcaacttctcacactcatggatggactaaaatctcgtgctcatgttattgtaattggagcaacaaaccgaccaaacagtattgacccagctctgagaaggtttggaaggtttgacagggaaattgatatcggggttccagatgaagtgggcaggttggaagtgctccgtatccatacaaagaatatgaagctctctgatgatgttgatcttgaaaggattgcaaaggacacacatggatatgttggagcagatcttgctgctctgtgcaccgaggctgcactccaatgcattagggaaaagatggatgttattgatttagaagatgagacaatagatgcagaaattctcaattcaatggctgttactaatgagcactttcaaacggcattgggctctagtaacccgtctgctctgcgtgaaactgttgttgaagtgccaaatgtcacttgggaagatattggtgggttggaaaatgtcaagagggagcttcaagagactgttcaatacccagtggaacatcctgagaaatttgaaaaatttggcatgtctccttcaaaaggagttcttttctatgggccaccaggttgtggaaagacattgcttgcaaaagccattgctaatgaatgtcaggccaattttatcagtgtgaaaggcccagaattgctaacaatgtggtttggagagagtgaagctaatgttagggaaatttttgacaaagccagaggttccgctccttgcgtcctgttctttgatgagcttgattctattgctacacagcgtgggagtagtgttggggatgctggtggtgctgcagacagagtgcttaatcaattgttgacggagatggatggtatgacagccaagaaaactgttttcattattggggctacaaacaggcctgatatcattgatcctgcgttgctacggcctggtcgacttgatcagttgatctatattcctttgcctgatgagagctcacgttaccaaattttcaaatcttgcttgagaaagtcacctgtgtcaaaggatgttgacctaatggcacttgcccgttatacccaaggattcagtggagctgatattacagagatttgtcagcgggcttgcaagtatgctattagagaaaatattgagaaggatattgaacgtgaaaggaaaagaagtgagaatcccgaggcaatggatgaggatgatagtgatgaggtgtctgaaataaaagcagctcattttgaggaatccatgaaatatgcacgaagaagtgtcagtgatgctgatattcggaagtatcaagcatttgcacaaacactgcagcaatctcgaggctttggttctgaatttcgatttccagacagacctgctggtgctgtggccggggcttcagatgcatttgctacagcagataataaagatgacgatgacttatacagttaagagacattgtacatataaagtgtcatctttatcaagtggcaaatgttatctgctttagcagggaccttgctctgacaactagccagtactattaaatgtggctcggctatgcttgtatgagttaatatattgatatattttatgaacttaatttaatttagtggttctttattagtgaacttaatattttcgtaatttgtaagtttactaaaatcagctttgtggcaaggaaaccttgttcaactgatagttaatgctattctattgaaacct

SEQ ID NO: 7392 - DNA, 2713 bp, Mimulus guttatus
ctcccaaaccccaaaaaaaacatcatagtatttattccccgaccttcgattctctcagatcaccgacaacatgagcaaccaaccggaatcatctgatccgaaaggagggaagaaggacttctcgacggcgatcttggagaggaagaaggctgcgaaccgattggttgttgatgaggctgtcaacgatgacaactcagtcgtcgccatccatccggccactatggagaagctccagcttttccgtggtgacactattttgattaagggtaagaaaagaaaggacacagtgtgcattgcccttgctgatgaaacttgtgaagaggcgaagattcgtatgaacaaggttgtcaggacgaatctgagggttcgtcttggtgatgttgtatctgtgcatcagtgcccagacgtgaaatacggaaaacgtgtccacatattgcccttggatgacacaatcgaaggtctcactggggatcttttcgatgtatatctaaaaccttactttctagaagcatatcgcccactgaggaagggtgaccattttcttgtgagaggaggaatgaggagcgtcgaatttaaagtcattgaaactgaccctggtgagtattgtgttgtcgcccccgacactgagattttctgcgaaggggaaccagtgaggagagaagatgaagacaggctggacgaggttggttacgatgatgtgggaggtgttagaagacagatggctcagattcgtgaactggtcgaattgcctctaaggcatcctcagcttttcaaatcgatcggtgtgaaaccgcccaaaggaattttactctacggtcctccaggttctggaaaaaccttgattgcaagagctgttgctaacgaaacgggtgctttcttctttctgatcaacgggcctgaaattatgtccaaattggccggagagagtgagagcaatttgaggaaagcgtttgaggaagctgagaagaatgccccttcgattatttttatcgacgaaattgattcaatagcacccaagagagagaagacacacggtgaagttgaaaggaggattgtttcgcagctgttgaccctcatggatggtttgaaatctcgtgcacacgtcattgttatgggggcgactaatcggcccaacagcattgacccagctcttagaaggtttggtaggttcgatagagaaatagacattggtgttcctgatgaagttgggcgccttgaggttctacgtattcataccaagaacatgaaactctctgaggatgttgatttggaaagaatatcgaaagacacacatggatatgtcggtgctgacctggcagctctctgcactgaagctgctcttcagtgcatcagagagaaaatggatgttattgatttggaagatgacacaattgatgctgagatactgaactccatggctgttagcaacgagcatttccacactgctcttggaacaagcaatccttctgctttgagggagacggttgttgaagtgccaaatgtctcctgggaagatattggagggctggaaaatgtcaagagagaacttcaagagactgttcaataccccgtggaacatccagagaagtttgagaaatttggcatgtcaccttcaaagggtgttctgttctatggtccacctggatgtggtaaaaccctactcgccaaagcaattgcaaacgaatgtcaagccaacttcatcagtatcaaaggacccgagttgctcactatgtggtttggagagagtgaagcaaatgttcgtgagatattcgacaaggctagacagtctgctccctgtgttctcttctttgatgagctcgactctattgctacacagagaggaagcagtgtcggagatgctggtggtgccgccgacagagttctgaatcaacttctgactgaaatggatggaatgaatgccaaaaagactgtattcataatcggagctactaacagacctgatattatcgatccggcacttttacgtccaggtcgtcttgatcagttgatatatattccactgcctgatgaagactcacgccaccagatcttcaaagcctgcctccgaaaatcaccactttccagagatattgatctgcgagcacttgctaagtatactcagggattcagtggagcagatatcacggaaatttgtcagagggcttgcaaatatgccattcgagagaacattgagaaagacatagaaaaggagaggaaaaagaaggataatcccgactccatggatgaagaccttgaagacgaattttcggaaataaagccagcacattttgaggagtcaatgaaatacgcacgtagaagtgtgagcgacgcagacatacgcaaataccaagcctttgctcagacattgcagcaatcacgaggttttggaactgagttccgttttgctgagtcagcgggcggggcaacaactggatccgacccatttgcagcccctgccggaggagctgctgatgaagatgatttgtatagttagatgtttgaggtggcttttattttattacttttgaaccacctccctctgtttcagtttatgcactaattaactagtctccagaaatggctggattattcatgctcttggttttttttatatttcttaattaatgttaaaatatttattttagacatcttgggatttgctggataaacttataatctcttttgttggcatccttaaactgtgacacttttt

SEQ ID NO: 7393 - DNA, 2716 bp, Sciadopitys verticillata
gccgctgtaacccctataacctattcctattcctattcttctaattctggtttttccagacatcgcatagcaatggctcacaagggcgaatcatctgaaccgaaagggaccaaaagggattatagcacagcaattttagagagaaaaaaagcacccaaccgtctcgttgtggacgaagccatcaacgatgataactctgtggtttgtctgcaccccgacaccatggaaaaattacagctgttccgcggagacacaatcctaattaagggaaagaagaggaaagacacaatttgcattgcgctggccgacgagacctgcgaagaaccgaagattaggatgaacaaagtggtgcgttcgaatttgagggttcgtcttggcgacgtcgtttctgttcaccaatgtcccgacgttaagtatgggaagcgcgtgcatattcttcctatcgacgatacaatcgagggtgtcaccgggaatttgttcgatgcttatttaaaaccttatttcttggaagcttatcgcccagtaagaaaaggagatcttttccttgtcagaggtggaatgcgtagtgtggagttcaaagtaattgagacagaccctggggaatattgtgttgtttctcctgatactgaaattttctgtgagggagagccagttaaacgagaggatgaagatagattggatgaaattggttatgatgatgttggtggtgtaaggaaacaaatggctcagatccgtgaattggtagaacttccacttaggcatccacagctctttaaatcaattggtgtgaagcccccaaagggtatcctgctttatggtccacctggttctggaaaaacgttaattgctagggcagttgcaaatgagactggtgccttctttttctgtatcaatggacctgaaattatgtcaaagttggctggagaaagtgaaagcaatctccggaaggcttttgaggaggcagagaagaatgccccgtccattatttttattgacgaaattgattccatagctcccaaaagagaaaaaacccatggtgaagttgagaggagaatcgtttctcaacttctcacacttatggatgggctgaaatctcgtgctcatgtcattgtaattggagcaacaaaccgaccaaacagtattgacccagctctaagaaggtttggaaggtttgacagggaaattgatattggggttcctgatgaagtgggcaggctggaggttctccgtatccatacaaagaatatgaaactctctgacgatgttgatcttgaaaggattgcaaaggatactcatggatatgtgggagctgatcttgcagctctgtgcactgaggctgcactacaatgcattagggaaaaaatggatgttattgacttagaagacgagacaatagatgctgaaattcttaattcaatggctgttactaatgagcacttccagactgcattgggctctagtaacccgtctgctctccgtgaaactgttgttgaagtgcctaatgtcacttgggaagacattggtggtttggagaatgtcaagagggaacttcaagagactgttcaatatccagtggagcatcccgagaaatttgaaaaatttggcatgtctccttcaaagggagtgctcttttatgggccacctggatgtggaaagactttgcttgcaaaagccattgctaatgaatgccaggccaatttcatcagtgtcaaaggtccagaattgttaacaatgtggtttggagagagtgaggccaatgtaagagaaatctttgacaaagccagggggtctgctccatgcgtcctgttctttgatgagcttgattctattgctacacagcgtgggagcagtgttggagatgctggtggtgctgcagacagagtcctcaaccagttgttgacagagatggatggtatgacagccaagaaaactgttttcatcattggggctacaaacaggcccgatatcattgatcctgcattgctaaggcctggtcgtcttgaccagttgatctatatacctttacccgatgaaagctcacgataccaaattttcaaatcttgcttgagaaagtcacctgttgcaaaggatgttgatcttatggcacttgcccgttatacccatggatttagtggagcagatattacggagatttgtcagcgggcttgcaagtatgctatcagagaaaatatcgagaaggatattgaacgtgaaaggaaaagaagtgagaatcccgaggctatggatgaggatgatagtgatgaggtatcggaaatcaaagcagctcattttgaggaatcaatgaaatatgcccgaagaagtgtcagtgatgctgatattaggaagtatcaagcttttgcgcaaacactgcagcaatcacgaggctttggttctgaatttcgatttccggacagaccagctactgctggagctggggcttcagatgcatttgccacagaagataacaaagatgatgatgacttatacagttgagagacttttacacaattgtcatctttatgaaatgggcgttattatacgttcttaaacgaacctgacttaacttgccaatgctatttaatttggcttggcttaatctgatgtttagctatctagtgctcctttagtagtggagtaaggatatttataacttacgttaccgctatggaagcctgctttctctttgacttgttggacaattgttttaatttaacac

SEQ ID NO: 7394 - DNA, 2637 bp, Glycine max
caatgtctcaccaagccgaatcctccgactcgaaatcttggaagaaggatttttccactgcgattcttgaacggaagaaatcgccgaatcggttagtcgtggacgaagcggttaacgatgacaattcggtggttgccatgcaccctcaaacgttggaaaaactccaactttttcggggagacaccatcctcatcaaggggaagaaacggaaggacacggtttgcatagctcttgcagacgataattgtgaagaatcgaagataagaatgaataaagttgttaggtcgaatttgagggttcgtcttggagatgttgtttctgtgcatgcgtgccctgatgtcaagtatgggaagcgcgtccacattcttcccattgatgataccatcgaaggtgtcactggcaatctctttgatgcttacttgaaaccatatttcttggaggcttatcgtcctgtcagaaagggggatttatttcttgtccgaggaggaatgagaggagtagagttcaaagtcattgaaactgatcctggggagtattgtgtggttgctccagacactgaaatattctgtgagggggaacctgtgaaaagagaggacgaagaaaggctagatgaggttggctatgatgatgtgggcggtgtcaggaagcaaatggcacagattcgtgagttggtagagcttccactgagacacccacaactttttaaatcaattggtgtgaaaccacccaaaggaattttgctgtatggacccccaggctctggtaagacattgatagctagagctgttgctaatgaaactggagcattcttcttttgtattaatggcccagaaattatgtctaaactggctggagagagtgaaagtaatctcaggaaggcatttgaagaagctgaaaagaatgctccctccatcatctttattgatgagattgattctattgcacccaagcgggagaagacacatggtgaagtcgaaaggagaattgtttcacagcttttgactcttatggatggattgaaatctcgtgctcatgttattgttattggagctacaaatcgaccaaatagcattgaccctgcattgagaaggtttggtagatttgatagggaaattgatattggtgttcctgatgaagttggaagacttgaagtccttcgcgtacataccaaaaacatgaagctttcagataatgttgatctagagagaattgcaaaagatactcatggatatgttggtgctgaccttgctgccctttgcactgaagctgctctacaatgcatcagggagaagatggatgtcattgatttggaagatgagagtattgatgctgaagtactgaattctatggcagtttcaaatgagcatttccatattgctttgggaacaagcaatccatctgctttacgagaaactgttgttgaggtgcctaatgtcagctgggaggatattggaggccttgagaatgtcaagcgtgagctgcaagagactgttcaatatcctgtggagcacccagaaaaatttgagaagtttggtatgtcaccgtcaaaaggggttctcttctatggtcctccaggatgtggaaaaactttgttggccaaagcaattgctaatgaatgtcaagctaacttcatcagtgtgaagggcccagaattgctcactatgtggtttggtgaaagtgaagccaatgttcgagaaatttttgacaaggccagacaatcagctccatgtgtcctcttctttgatgagcttgactccattgctactcagagaggaagtagtggtggagatgctggtggagctgctgatagagttctgaatcaacttctgactgaaatggatggcatgaacgccaaaaagactgtgttcataattggggccaccaacagacctgatatcattgactcagcacttcttcggcctggtcgtctagatcaactgatctacattcctcttcctgatcaggagtcccgttatcaaatcttcaaggcctgcatgaaaaagtcacctgtctcaaaagatgttaatttgggagcactagctgagtatactaaaggctttagcggtgctgatataactgagatatgccaaagagcatgcaaatatgctattagagaaaacatagaaaaggacatagagcatgagaggaagagaagagaaaaccccgaggctatggatgaagacatggagggggaagatgtttcagagatcaaggcggctcattttgaagagtcaatgaagtatgcgcgtaggagtgttagtgatgctgatatacgcaaataccaagcatttgctcagactttacagcaatccaggggctttggaagtgactttaattttcctgcagctgtgagtaggaccgcaggatctgaaccctttgcaacttctgctggtggagctgatgaagatgatctctatagttaggttttgtttatttaaagttacacacctagctcggaactgcgaagcctttttcagtttttacttttcgtacattaattagccaacattagtagtactggattttgtataacacacacacacatgatggatgaaattcggattatgttggaaaataattgagcatgcctaatcctggatttcagtactgtagtgtggtgggttactacttactagt

SEQ ID NO: 7395 - DNA, 2915 bp, Oryza sativa
cacaatcacttctccccccggaatatctccgccaagagaagagaagagacacccaacaacccaaaacctagcgcctctgcgctcgaggcccccccgaatccgcgaatccgccgactcccatggcgagccagggagagccctcctcctcctccgatccgaaggggaagaaggatttctcgacggcgatcctcgagaggaagaagtcgccgaaccggctggtggtcgacgaggccaccaacgatgataactccgtcatcgggatgcaccccgacaccatggagaagctccagcttttccgcggcgacactgtgctgctcaagggtaagaagagaaaagacaccatctgcattgttcttgctgatgacacctgcgaggagccgaagatcagaatgaacaaggttgtcaggaagaacctgagagtacgacttggtgatgtcgtgtctgttcatcaatgcccagatgtcaaatacggcaagcgtgtgcacatacttccaattgatgatactgttgagggcatcaccggaaacttgtttgatgccttcctgaaaccgtacttccttgaagcataccgtcctttgaggaaaggagaccttttccttgttaggggtgggatgagaagtgttgaattcaaagttatagagactgaccctgcagagtactgcattgttgcacctgatacggagatattctgtgatggtgagcctattaagagggaggatgaggaaagacttgatgaagttggttacgatgatgttggtggagttaggaagcagatggcccaaatcagagaacttgttgagctcccattgcgccatccccaacttttcaagtctattggtgtgaagcctccaaagggcatactgctttatggaccccctggctctggaaagaccctcattgctagagctgttgctaatgaaacaggtgctttcttctttctgattaatggcccggagattatgtcaaagctagcaggagaaagtgagagtaatctcaggaaggcatttgaagaagctgagaagaatgcaccatcaatcattttcatcgatgagatagactccatagcaccaaagagagagaagacccatggagaagttgagaggcgcatcgtttcacagctgttgactcttatggatgggctcaaagctcgttcccatgtcattgtcatgggtgctacaaaccggccaaacagtattgatcctgctctcagaaggtttggtaggttcgatcgggagattgacattggtgttcctgatgaagttgggcggcttgaagttcttcggattcacaccaaaaacatgaagctggctgaagatgttgacctggaacacattgccaaagacactcatgggtatgtgggtgctgatcttgctgctctttgcactgaggctgctctccaatgcatccgtgagaagatggatattatagatcttgaggatgagaccatagatgctgagatacttaactcgatggctgttacaaatgatcacttcaagactgcactagggacaagcaacccgtctgctctccgtgaaactgttgttgaagttccaaatgtctcttgggaggatattggtggactggagaatgtcaaacgggagctgcaggagactgtccaatatccagtggagcatcctgagaaatttgagaagtttggcatgtctccgtccaaaggtgttctgttctatggccctcctggctgtggtaagactttgttggccaaggcaattgctaacgagtgccaggctaacttcattagtgtcaagggacctgagctgcttaccatgtggtttggtgagagtgaggccaatgtgcgtgagatttttgacaaggctaggcagtcagctccttgtgtcctcttctttgatgagcttgactcaattgctacccagagaggaagcagtgttggtgatgccggaggtgctgctgatagagtgctgaaccagttgttgactgagatggacggcatgaacgcgaagaaaaccgtgttcattattggtgctactaacaggccagatatcattgaccctgccttgctaaggccagggcgtcttgatcagcttatctacattcctctgcctgatgatcaatctaggctgcagatcttcaaagcttgcctccggaagtcacctgtggccaaggatgtagacctgaatgctcttgccaaatacacccaaggtttcagtggtgctgatattacagaaatctgccagcgtgcatgcaaatacgccatcagagagaacattgaaaaggacatcgagatggagaagcggaggaaggacaaccctgaagccatggaggaggacgaggttgatgatattgctgagatcaaggcggctcacttcgaggagtcgatgaagtacgcacgccggagtgtgagtgacgccgacatccgcaagtaccaggccttcgcccagactctgcagcagtctcgtgggttcggcaccgagtttaggttcgctgaccagccagcgtctggcgccggcgccgccgctgaccccttcgcatccgctgccgccgcagctgacgatgatgatttatatagttagatcgctgtgctatttatatttaacctccgtgcttttgttcagtatgtctatttcgctttggtaaactttatcatatgtaacatacggggaaacagtgtactatttttaagttaatattttgagaggtactgaaccgaattgcatgtttctgtatggatgtgtcgtggatgagcatggttgcgggttgtattcatcgattggagcatggatagatttgcgttgtatgtttgtgaggtttatagatgctcctgcaaggctggaacttgttgaagtttgtttttatagtgttaatccgaggcttcatttggtcggcgagacaccaaccgacaaaaaaaaacaaaggtcagagggcagacataagttgac

SEQ ID NO: 7396 - DNA, 2873 bp, Sorghum bicolor
cctatcccctgccccctcctcgtcttcatcttcacttgagcccccgaacccgaacgaacacccgcaaatatctgtcgccgtcctcgcgaacagcaccaaccgccgctccgaattcgatcgccatggcgagccaaggcgagccgtcttcgtcggatccgaaggggaagaaggattactcgacggcgatcctcgagaggaagaagtcgccgaaccggctggtggtcgacgaggccaccaatgatgacaactccgtcgtcgctctgcacccggacactatggagaggctccagctcttccgcggtgacactgtcctgctcaagggtaagaagagaaaggacactatctgcatcgtgcttgcagatgacacgtgtgaggagccaaaggtccgaatgaataaggttgtcaggaagaacttgagggtacggcttggtgatgtggtatctgtccatcaatgcccagatgtcaaatacgggaagcgcgtgcacatacttccaattgatgacaccattgaaggcatcactggcaacttatttgacgcctttctaaaaccatacttccttgaagcctatcgtcctttgaggaaaggagaccttttcctagtcagaggtggcatgagaagtgtagaattcaaagtcatagagactgatcctatagagtattgtatcgttgcaccagatacagaaatattctgtgagggtgagcctgttaagagggaggatgaggaaagacttgatgaggttggctatgatgatgttggtggagttagaaagcagatggcccaaattagagaactggttgaacttccactgcgtcatccccagcttttcaagtctattggtgtgaagccaccaaagggcatattgctgtttgggcctcctggatctggcaagacccttattgctagagctgtagctaatgagacaggtgctttcttctttttgataaatgggccagaaatcatgtcaaaactagcaggagaaagtgaaagtaatctcagaaaggcatttgaagaagctgaaaaaaatgcaccttccatcatttttattgatgagatagattccatagctcctaagagagaaaagacccatggagaagttgaaaggcgtattgtttcacagctcttgactcttatggatggtctgaagtctcgtgcacatgttattgttatgggtgccacaaaccgtccaaacagtatcgatcctgctcttagaaggtttggtaggtttgatcgtgagattgatattggtgttccagatgaagttggacgccttgaggttctccggattcacaccaaaaacatgaagttggctgaaaatgttgacttggagctcattgcgaaggatacccatggttatgttggtgctgatcttgcagccctttgtaccgaagctgctcttcaatgcatccgtgagaagatggatattatagatcttgaggatgagaccatagatgctgagatattgaactctatggctgtcacaaatgaccatttcaagactgcacttgggacaagcaacccatctgctctgcgtgaaactgttgttgaagttccaaatgtctcttgggaagatattggtggtctggaaaatgttaagagggagctacaggagactgttcaatatcctgtagagcatcccgagaaatttgaaaagtttggcatgtctccttcaaagggtgttttgttttatggccctcctggctgtggcaagactttgttggccaaggcaattgctaatgaatgccaggctaacttcattagtgtgaagggtcctgaactgcttaccatgtggtttggtgagagcgaggctaatgtccgtgagatttttgataaggctaggcagtctgctccatgtgtcctcttcttcgatgagcttgattccattgctactcagagaggaagcagtgttggtgacgcaggtggtgctgctgatagggtgttgaaccagctgcttactgagatggatggcatgaatgctaagaagactgttttcatcatcggtgcaactaacagaccagatatcattgaccctgccctgctgaggccagggcgtctggatcagcttatctacattcctctacctgatgagcaatccaggctccagatcttcaaagcctgcctcaggaagtctcctgtggctaaggatgtcgacttgaatgctcttgccaaatacacccagggtttcagtggtgcagatatcactgagatctgccagcgtgcgtgcaagtatgctatcagggagaacatcgagaaggatatcgagagggagcggcgcaggaaggacaaccctgaggctatggaggaagacgaggtagacgacattgctgagatcaaggctgctcacttcgaggagtcgatgaagttcgcccgacgcagtgttagtgatgccgacatccgcaagtaccaggccttcgcccagacactccagcagtcccgtgggtttggcagcgagttccgtttcccggaccaaccgacggcagctgcgggatctgctggtgcggccgatccttttgcatccgctgcagcagcagctgacgatgatgacttgtataattagtttagcagtcctgtgacgcttcttgagtactttccttcgttatatatgcttattatatatattaatgttacacttatgtgtaagacacgggcagtggctgtacctatacagttaagttaatattttattagtataggtccttaaatcgtgccatctgttttgcatgcttgcctggtgccaacgtttgtgttgatttgagaaaaaaatggccaattctcctccccgtttggcatggctgctccagcgacttcagaagccgtttggagccgttttgtgccaaacggggtaaaatagaatggctctactaaggaagcctct

SEQ ID NO: 7397 - DNA, 2867 bp, Sorghum bicolor
ccctgccccctcctcgtcttcatcttcacttgagcccccgaacccgaacgaacacccgcaaatatctgtcgccgtcctcgcgaacagcaccaaccgccgctccgaattcgatcgccatggcgagccaaggcgagccgtcttcgtcggatccgaaggggaagaaggattactcgacggcgatcctcgagaggaagaagtcgccgaaccggctggtggtcgacgaggccaccaatgatgacaactccgtcgtcgctctgcacccggacactatggagaggctccagctcttccgcggtgacactgtcctgctcaagggtaagaagagaaaggacactatctgcatcgtgcttgcagatgacacgtgtgaggagccaaaggtccgaatgaataaggttgtcaggaagaacttgagggtacggcttggtgatgtggtatctgtccatcaatgcccagatgtcaaatacgggaagcgcgtgcacatacttccaattgatgacaccattgaaggcatcactggcaacttatttgacgcctttctaaaaccatacttccttgaagcctatcgtcctttgaggaaaggagaccttttcctagtcagaggtggcatgagaagtgtagaattcaaagtcatagagactgatcctatagagtattgtatcgttgcaccagatacagaaatattctgtgagggtgagcctgttaagagggaggatgaggaaagacttgatgaggttggctatgatgatgttggtggagttagaaagcagatggcccaaattagagaactggttgaacttccactgcgtcatccccagcttttcaagtctattggtgtgaagccaccaaagggcatattgctgtttgggcctcctggatctggcaagacccttattgctagagctgtagctaatgagacaggtgctttcttctttttgataaatgggccagaaatcatgtcaaaactagcaggagaaagtgaaagtaatctcagaaaggcatttgaagaagctgaaaaaaatgcaccttccatcatttttattgatgagatagattccatagctcctaagagagaaaagacccatggagaagttgaaaggcgtattgtttcacagctcttgactcttatggatggtctgaagtctcgtgcacatgttattgttatgggtgccacaaaccgtccaaacagtatcgatcctgctcttagaaggtttggtaggtttgatcgtgagattgatattggtgttccagatgaagttggacgccttgaggttctccggattcacaccaaaaacatgaagttggctgaaaatgttgacttggagctcattgcgaaggatacccatggttatgttggtgctgatcttgcagccctttgtaccgaagctgctcttcaatgcatccgtgagaagatggatattatagatcttgaggatgagaccatagatgctgagatattgaactctatggctgtcacaaatgaccatttcaagactgcacttgggacaagcaacccatctgctctgcgtgaaactgttgttgaagttccaaatgtctcttgggaagatattggtggtctggaaaatgttaagagggagctacaggagactgttcaatatcctgtagagcatcccgagaaatttgaaaagtttggcatgtctccttcaaagggtgttttgttttatggccctcctggctgtggcaagactttgttggccaaggcaattgctaatgaatgccaggctaacttcattagtgtgaagggtcctgaactgcttaccatgtggtttggtgagagcgaggctaatgtccgtgagatttttgataaggctaggcagtctgctccatgtgtcctcttcttcgatgagcttgattccattgctactcagagaggaagcagtgttggtgacgcaggtggtgctgctgatagggtgttgaaccagctgcttactgagatggatggcatgaatgctaagaagactgttttcatcatcggtgcaactaacagaccagatatcattgaccctgccctgctgaggccagggcgtctggatcagcttatctacattcctctacctgatgagcaatccaggctccagatcttcaaagcctgcctcaggaagtctcctgtggctaaggatgtcgacttgaatgctcttgccaaatacacccagggtttcagtggtgcagatatcactgagatctgccagcgtgcgtgcaagtatgctatcagggagaacatcgagaaggatatcgagagggagcggcgcaggaaggacaaccctgaggctatggaggaagacgaggtagacgacattgctgagatcaaggctgctcacttcgaggagtcgatgaagttcgcccgacgcagtgttagtgatgccgacatccgcaagtaccaggccttcgcccagacactccagcagtcccgtgggtttggcagcgagttccgtttcccggaccaaccgacggcagctgcgggatctgctggtgcggccgatccttttgcatccgctgcagcagcagctgacgatgatgacttgtataattagtttagcagtcctgtgacgcttcttgagtactttccttcgttatatatgcttattatatatattaatgttacacttatgtgtaagacacgggcagtggctgtacctatacagttaagttaatattttattagtataggtccttaaatcgtgccatctgttttgcatgcttgcctggtgccaacgtttgtgttgatttgagaaaaaaatggccaattctcctccccgtttggcatggctgctccagcgacttcagaagccgtttggagccgttttgtgccaaacggggtaaaatagaatggctctactaaggaagcctct

SEQ ID NO: 7398 - DNA, 2810 bp, Artemisia annua
cggggacatctcatcatcttacttaaattcttctccaagccatctcttctcacaactctcattcccccacaaatcaaaccaaaccaaccatcttccttcatcatgagtaaccaacccgaagcatcctcatcttctgaaccgaaaggagcgaagaaggatttttcgacagcgatactagagcgaaagaagtcgccaaacaggctggtggttgatgaagctgttaacgatgataactctgttgtcgctatgcatccttccactatggaaaagcttcagcttttccgaggcgataccattctcattaagggcaagaaaaggagagatacagtctgcattgcccttgctgatgaaacatgtgatgagccaaagatcagaatgaacaaggttgttaggacaaatttgagggttcgtcttggtgatgttgtgtctgtgcaccagtgcccagatgttaagtatggaaagcgtatccatgttcttccactggatgacactattgaaggtgtcacgggagacttgtttgatgcatatctgaaaccctactttttggaggcatacagacctgtgaggaaaaatgaccatttccttgttagaggagggatgagaagcgtagagttcaaggtgatcgagactgatcctggggagtactgtgttgttgctccagacactgaaatcttttgcgagggtgagcccattaagagggatgatgaggataggttggatgaggttggttatgatgacgtaggaggtgtcaggaaacaaatggcccagattcgtgaattagtcgagttgccattaaggcaccctcaacttttcaagtctattggagttaagcctccaaagggaattttgctctacggacctcctggttcaggaaagacactgattgcccgggctgttgctaatgaaaccggagcattctttttctgcatcaatgggccagaaatcatgtccaagttggccggagagagtgaaagtaatctcaggaaggcatttgaggaggctgagaagaacgccccatcaattatcttcattgacgagattgattcaattgcacctaagagagagaagactaatggtgaagttgagaggaggattgtgtcacagcttttgacacttatggatggattaaaatcccgtgcacatgttatcgtaatgggggcgacaaatcgcccaaacagcattgatcctgctctcagaaggtttggtaggttcgatagggaaattgacatcggtgtgccagacgaaattggccgtcttgaggttctccgtatccacacaaagaacatgaagctttctgaggatgtcgatttggaaaaaatatctaaagagacacatggttatgttggtgctgaccttgctgctctttgcactgaagctgcacttcagtgcattagagaaaaaatggatgttattgacttggaagatgaatccattgatgctgagattctgaattcgatgtcagtctcaaacgaacatttctcgactgctcttggaacaagcaatccatctgctcttcgtgagacggttgttgaagttcccaactgtagctgggacgatattggaggccttgagaatgtcaagcgtgagcttcaagagacagtacaatatcccgtggagcatccagagaaatttgagaagttcggtatgtcaccatccaaaggagttcttttctatggtcctcctggatgtggaaagacacttctggccaaggctattgcaaatgaatgccaagcaaatttcattagtatcaagggacctgaattgctaactatgtggtttggggagagtgaagcgaatgttcgtgaaatctttgacaaagccagaggatctgcaccatgtgttcttttctttgatgaactcgactccattgcaactcagagaggaagcagttctggtgatgcaggtggtgcagctgacagagttttgaatcagcttttgactgagatggatggaatgtctgcaaaaaagactgttttcataattggagccaccaacagacctgacatcattgaccctgcactactacgtccaggacgtcttgatcaacttatctacatccccttaccagatgaggactcccgacaccagattttcaaggctgcaatgaggaaatcacctgttgctaaggatgtcgatttgagagctcttgccaagtacactcaaggctttagtggggctgatattactgagatttgccaacgtgcctgcaagtacgcaataagagagaacattgagaaagacattgagagggaaaggaggaggagcgagaaccccgactccatggatgaggacgaggatgaggtagctgagatcaaggctgctcactttgaggaatccatgaaatatgcacgcagaagtgtgagtgatgctgacattcgcaagtaccaggcgtttgctcagacattgcaacagtcaaggggatttgggtctgaattcaggttctcagaagccacatctggtgggactgctgctgctgacccgtttgctgcttctgctggaggagctgatgatgatgatttatacaattaagtcttataaattattccttaaatgtcatgtttatgaaagaaatacacttgcaggatctccaatttgtgcattttcgtcaaggcattctgcttctctcgatggtagagataacttatttgcttatgaatgatctcttttggagtctttatcttttgaacatatgtttatgtatggtttactttacactttcttttgctgggaagtggtggattttaggttgatgtgtagatcgattttcatttgtgttaaatggatagtggatttgaagaccggatcttttt

SEQ ID NO: 7399 - DNA, 2801 bp, Zea mays
gctatgacccctcgaccctcgtcttcatcttcccacttcagcccccaaacccgaacactcgcaatcgcaagtcgcaaatatctgtcgccgtctcgccaacagcaccaaccgcctcctagaactcgaccgccatggcgagccaaggcgagccgtcttcctccgatccgaaggggaagaaggattactcgacggcgatcctggagaggaagaagtcgccgaaccggctggtggtcgacgaggccaccaatgatgacaactccgtcgtcgctctgcacccggacaccatggagaggctccagctctttcgcggtgacacggtcctgctcaagggtaagaagagaaaggacactatctgcattgtgctcgcagacgagacgtgtgaggagccaaaggtccggatgaacaaggtcgtcaggaagaacttgagggttcggcttagtgatgtggtatctgtccatcaatgcccagatgtcaaatacgggaagcgtgtgcacatacttccaattgatgacaccattgaaggcatcactggcaacttatttgatgcctttctgaaaccatactttcttgaagcctatcgtcctttgaggaaaggagaccttttcctagtcaggggtggcatgagaagtgtagaattcaaagtcatagagactgatcctgcagagtattgtattgttgcaccagatacagaaatattctgtgagggtgagcctattaagagggaggatgaggaaagactcgatgaagttggctatgatgatgttggtggagttagaaagcagatggcccaaatcagagaactggttgaacttcccctgcgtcacccccagcttttcaagtctattggtgtgaagccaccaaagggcatattgctgtatgggcctcctggctctggcaagacccttattgctagagctgtagctaatgagacaggtgctttcttctttttgatcaatggaccagaaatcatgtcaaagctagcaggagaaagtgaaagcaacctcagaaaggcatttgaagaagctgagaaaaatgcaccttcaatcatttttattgatgagatagattccatagcacccaagagagaaaagacccatggagaagttgaaaggcgtattgtttcacagctcttgactcttatggatggcctcaagtctcgtgcacatgttattgttatgggtgccacaaaccgtccaaacagtatcgatcctgctcttagaaggtttggtcggtttgatcgtgagattgatatcggtgttccagatgaagttgggcgccttgaggttcttcggattcacacgaaaaacatgaagcttgctgaagatgttgacttggagatcattgcgaaggatactcatggttatgttggtgctgatcttgctgccctttgtactgaagctgctcttcaatgcattcgtgagaagatggatattatagatcttgaggatgagacaatagatgcggagatactgaactctatggctgtctcaaatgatcatttcaagactgcacttgggacaagcaacccatctgctctgcgtgaaactgttgttgaagtgccaaatgtctcttgggaagatattggtggcctggaaaatgttaagagggagctacaggagactgttcaatatccagtggagcatccagagaaatttgaaaagtttggcatgtctccttcaaagggtgttttgttttatggccctcctggctgtggcaagactttgttggccaaggcaattgccaatgaatgccaagctaacttcattagtgtgaagggtcctgaactgcttaccatgtggtttggtgagagtgaggccaatgtccgtgagatttttgacaaggctaggcagtctgctccatgtgtcctcttttttgatgagctcgactccattgctactcagagaggaagcagtgttggtgacgccggtggtgctgctgatagggtgttgaaccagctgcttactgagatggatggcatgaatgccaagaagacggtttttattatcggtgcaactaacagaccggacatcattgacccagccttgctgaggcctgggcgtcttgatcagcttatctatattcctctgcccgatgagcagtccaggcttcagatcttcaaagcctgtctcaggaagtctcctgtggccaaggatgttgacttgaatgctctcgccaaatacacccagggtttcagcggtgcagatatcacagagatctgccagcgcgcgtgcaagtatgccatcagggagaacatcgagaaggatatcgagagggagaggcgcagcaaagacaaccccgaggctatggaggaagacgaggtagacgacatcgctgagatcaaggctgctcacttcgaggagtccatgaagtacgcccgtcgcagcgtgagtgacgccgacatccgcaagtaccaggccttcgcccagacactccagcagtcccgcgggtttggcagcgagttccggttccccgaccaaccgacggcagctgctgctgcggccgatcccttcgcatccgctgcagcagcagctgacgatgatgacttatacagttaaattagcagtcctgtgttgtgacgcatattgagtactttgcttcgttatatgcttattatagtagactacgtgcaagacgcggagtcgctgtacctatataatacttaagttaatattttggtacgatcctctgaatcgtgccatgagccatggtttgtgttcatttgagattatcaaagatggccagctctaccattgtgaatgataaattttcgttcaatgagaagtttaggttgcattcacatt

SEQ ID NO: 7400 - DNA, 2752 bp, Zea mays
gctccgcatctcgcattctcgccggtgctgctgcaattaacgccgcctccggccaaccacccgaaacctacctccgccgccgtcgtcgccaccgtcaacatggcgagccaaggggagccctcggcctctgcttccgatccgaaggagaagaaggacttctcgacggcgatcctggagaggaaaaagtcaccgaaccgccttgtcgtcgacgaggccaccaacgacgataactccgtcgtcgcgctgcaccctgacaccatggagaggctgcagctcttccgcggcgacaccgtgctcctcaagggtaagaagaggaaagacactatttgcattgtccttgcggacgaaacctgtgaggagccaaaggttcggatgaacaaggttgtccgccagaacctaagggtgaggcttggtgatgtggtttctgtccaccagtgccaggatgtgaaatatgggaagcgtgtccacattcttccaattgatgatacagttgaaggcattacagggaacctgtttgatgccttcttgaaaccatatttcctagaagcatacaggccgttgaggaaaggagaccttttccttgtcagaggaggaatgagaagtgtggaattcaaagtgatagagactgatcctgctgaatattgtatcgttgcgccagatactgaaatattttgtgatggggagcctattaagagggaggatgaggagcgtcttgatgaagttggttatgatgatgttggtggagttagaaagcaaatggcccaaatcagagagcttgttgagcttccactacgccatcctcaacttttcaaatctattggtgtgaagccaccaaagggcatattgctgtacgggccacctggttccggaaagactcttattgctcgtgctgttgcaaatgagactggagcctttttcttcctgatcaatggtccagagattatgtcaaagctggcaggggagagtgaaagcaatctcagaaaggcatttgaagaagcagagaagaatgctccatctatcattttcattgatgaaattgattccattgcacccaagagagagaagaccaatggagaagtagagcgtcgtattgtttcacagctactgactcttatggatggactgaaatctcgttcccatgttattgttatgggtgctacaaaccgaccaaacagcattgatcctgctcttcgaagatttggaaggtttgatcgggaaattgacattggagttcctgatgaagttggccgtctcgaggttctccgcattcacactaagaacatgaaactagctgaagatgttaatttggaactcatttcaaaagatacccatggatatgttggtgctgatcttgctgccctttgcactgaggctgctcttcagtgcattcgtgagaagatggacatcatagatcttgaggatgagacaatcgatgcagagatattgaactcaatggctgttacaaatgaccatttcaagactgcgcttggaacaagcaacccatctgctcttcgtgaaactgttgtcgaagtcccaaatgtctcttgggaggatattggtgggctggagaatgtcaagagggagctccaggagactgttcaatatcctgtggagcatccggagaagttcgagaagtttggcatgtctccatccaaaggagttttgttctatggtcctcctggttgcggtaagaccttgttggcaaaggcaattgccaacgagtgccaggctaacttcatcagtgtcaagggtcctgagttgcttaccatgtggtttggtgagagtgaagccaacgtccgtgaaatttttgacaaggctcgtcaatctgctccttgtgtcctcttctttgatgagcttgactcaattgctactcagagaggaagcagtgtgggtgatgctggaggtgcggctgatagagtgcttaatcagctactgacagaaatggatggcatgaatgccaagaaaactgtgtttattattggagctacaaacaggcctgacatcattgaccctgctctgctgaggccagggcgtcttgaccagctgatctacattccactgcctgatgagcagtctaggctccagatcttcaaggcctgccttaggaagtcccctgtggcgaaggatgtggacttgaatgctcttgctaagtacacgcaagggttcagtggagcagatatcacagaaatttgccagcgtgcgtgcaaatatgcaatcagagagaacattgagaaggatattgagagggaaaggcggagaaaggacaaccctgaggcgatggaggaagacgaagtggatgagatcgccgagatcagggcccctcacttcgaggagtcgatgaagtatgctcggcgtagtgtcagtgatgctgatatccgcaagtaccaggcgtttgcccagacattgcagcagtcccgggggttcggcagtgagttccgcttctcggatcagccggcgacagctggtgctgctgctgcagccgatccgtttgcttctgcgggtgctgcggctgatgacgacgatctatacagctagttgggttgttcaatatcagtcccgtcactcatctgtttaaaactgatcatactaaacacgcatgtcatgcaatgatatttatttgccgtacatttggacgtcgctgagatgatgcactctcggccttcggttaccttttcatgccatattctccatgccattgtctgggccatgacattttattaattattgtgaaatctatcatctctcatctgtc

SEQ ID NO: 7401 - DNA, 2651 bp, Ambrosia trifida
atcccattaatattattaatattgataacaaactcttcttccctcaatcttcatcaccatgagtaaccagcctgaatcctcttcatctgatccgaaagcgtcgaaaaaggacttttcgactgctatcttggagcgcaagaaatctcccaatcgtcttgttgttgacgaggctgtcaatgacgataactccgtcgtcgctatgcatcctgctaccatggagaaattgcagctctttcgtggcgatactattttgatcaagggaaagaaaagaaaggatacagtttgcattgcccttgctgatgaaacgtgtgatgaaccgaagatacgaatgaacaaggttgttaggactaacctaagaattcggcttggtgatgttgtgtcagtgcaccaatgcccagatgtcaagtatggtaaacgtatccatgttcttccacttgatgacaccattgaaggtgtcacgggagacttatttgatgcctatctgaaaccatactttttggaggcatataggcctgttaggaaaggagaccatttccttgttagaggaggtatgcgcagcgttgaatttaaggtaattgagactgatccaggggagtattgtgttgttgctccagacaccgaaatattctgtgagggtgagccaattaagagagatgaagaggacagattggatgaggtaggctatgatgatgtaggaggcgtgaggaaacaaatggctcagattcgtgaattggtggagttaccattaagacaccctcaacttttcaagtcaattggagtcaagcctcctaaaggaatcttgctctatggaccacctggttcgggaaagacattaatagccagagccgttgctaatgaaaccggagctttctttttctgcatcaatggtcctgaaattatgtcaaagttagctggagaaagtgaaagcaatctcaggaaagcatttgaggaggctgagaagaacgccccgtcaattattttcattgatgagatagattcgattgcaccaaagagagagaagactaatggtgaagttgaaaggaggattgtatcacagcttttgacgctcatggacggattaaagtcacgagcccatgttattgtaatgggggcaacaaaccgcccaaacagcattgaccctgctctcagaagatttggtaggttcgatagggaaatcgacattggtgtcccagatgaagttgggcgtcttgaggttcttcgtatccacacaaagaacatgaagctttctgaggatgttgatttggaaaagatatcaaaagaaacacatggttatgttggtgctgatcttgctgctctttgcactgaagccgcacttcaatgcattagagagaaaatggatgttattgatttggaagatgattctattgatgctgagatactgaattccgtggctgtcaccaatgaacatttctctactgctcttggaactagcaatccatctgctctgcgtgaaactgttgttgaggttcccaatgttagctgggacgatattggagggctcgagaatgttaagcgtgagcttcaagagacggttcaatatccagtggagcatccagagaaatttgaaaaatttggtatgtcaccgtcaaaaggagttcttttctacggtccacctggatgtgggaaaacacttctggcaaaagctattgcaaatgaatgtcaagctaatttcattagtatcaaaggacccgaattgctaacaatgtggttcggtgaaagtgaagccaatgttcgtgaaatttttgacaaggccagaggatctgctccatgtgtccttttctttgatgaactcgactccattgcaactcagagaggaagcagttctggagatgcaggtggtgctgcagaccgcgttctgaatcaactgttgactgaaatggatggaatgtctgccaaaaagcggttttcataattggagccactaacagacccgatattattgatccggcattacttcgacctggacgtcttgatcaacttatttacattccactaccagatgaagagtcacgttactcgatcttcaaggctgcaatgaggaaatcccctgtttctaaagatgttgatttgagagcccttgccaagtatactcaaggatttagtggggcggatattactgagatatgtcaacgggcctgcaagtatgcaattagagagaacatcgagaaagatatagagagggaaagaaagaggagcgagaatcccgactctatggatgaggatgatgacgatgatgtggctgagataaaggcggctcactttgaggagtccatgaagtatgcacgcagaagtgtgagcgatgctgacattaggaagtaccaggcgtttgcgcagacattgcagcagtcgagaggatttggatccgaatttcggttctcggaagcaacatctggtggcgctgatccatttgctgcttctgctggtggagctaatgatgatgatctatacaactaactagcttttctagattattatttcttaaaactcatgttttaaggaagaaaaagacttgttggattattaatttgtgcattttcatgactttcctcatatgagagaatggtatttatgtatcataatttcataggaaccagaattattcatgattcctggagttacatttttataaa

SEQ ID NO: 7402 - DNA, 2552 bp, Arnica chamissonis
caaaccctcgccctagaattcccaaatcagtctaaacataatcgattgtctgcaccatgagtaatcaacctgaatcatccgactctaaggggaacaagcgggactttagcaccgccattcttgagcgaaagaaggcgccgaatagactcgttgttgatgaagccatcaatgatgataactccgttgtttccctgcatcctgagaccatggaaaagcttcaactattcagaggagatacaatcttaattaagggcaagaaaaggagagatacaatctgtatagcccttgctgatgacacctgtgaagaaccaaaaattaggatgaataaggttgttaggtcaaacctgagggtcaggcttggggatgtgatttcagtgcatcagtgtgctgatgttaagtacgggaagcgcgttcacatccttccgattgatgataccattgaaggagtcactgggaatctgtttgatgcttacttgaagccttacttcctggaagcataccgccctgtgaggaagggtgactactttttagtaaggggaggaatgagaagtgttgaattcaaagttatcgagactgatcctgctgagtactgtgtggtggcacctgatactgagatattctgtgagggtgagcctgtgagaagggaagatgaggaccggttagatgagattggttatgatgacgttggtggtgttcgcaaacaaatggcgcaaatccgtgagttagtggaactcccattaaggcatccacagctcttcaagtctattggtgttaaaccaccaaagggtattctgctttacgggcctcccgggtctggaaagactttgatagcacgtgctgttgcaaatgaaaccggtgctttctttttctgcatcaatgggccagagatcatgtcaaaaatggctggagagagtgagagcaatttaaggaaagcatttgaggaagctgagaaaaacgcaccttcgatcatcttcatcgatgagcttgattcaattgcaccaaaacgtgaaaaaacacatggtgaagtcgagcgaaggattgtttcccagttattgactttaatggacgggctgaaatcccgggcacatgtaattgttatgggtgcaaccaaccgccctaacagtattgatcctgcattgagacggtttggtagatttgaccgggaaattgatataggtgtgcctgatgaagttggccgtctagaggttcttaggattcatactaagaacatgaagctatctgatgatgtggatttggagaaggttggaaaagaaacacatggttatgtaggtgctgacttggcagctttatgcaccgaggctgcactccaatgcatcagagagaaaatggatgtgattgatttggaagatgagaccattgatgcagagattctgaactccatggcagttaccaatgagcatttccagacagccctcgggaccagcaatccgtctgctcttcgtgagactgttgtggaagtgcccaatgttagttgggaagacattggtggactcgagaatgttaaacgagagctacaagagactgttcaatatccagtggaacatcctgagaaatttgagaagttcggtatggctccatctaaaggagttctgttctatggtccacctggttgtggtaaaactcttctagccaaagctattgcaaatgaatgtcaagctaactttatcagcatcaagggtcctgagttgcttacaatgtggtttggtgagagtgaggccaatgttcgggaaattttcgataaggctcgtgggtctgccccttgtgtcctctttttcgatgaacttgattccattgcaacccagagagggagcagtcaaggagatgctggtggtgcagctgacagagttctgaaccaacttctgactgaaatggacggaatgtctgccaagaaaacggttttcatcatcggtgcaaccaacaggcctgatatcattgatccagcacttttgaggcctggtcgtcttgatcaactgatttacattcctttaccagacgaggagtcacgatatcagatctttaaatctgctttaaggaaatccccaattgctaaagatgttgatctacgtgctcttgctaagtacacacaaggtttcagtggtgctgacataaccgaaatctgccagcgcgcctgcaaatatgccattcgtgagaacatagaaaaagatattgagagggaaaagaagagaagtgagaacccagaggctatggaggaggacttggaagatgaggttgcagagattaaagcagctcattttgaagaatccatgaagtttgcacgaaggagtgttagtgatgccgacataaggaagtaccaggcgtttgctcaaacactgcagcagtcgagagggattggttctgagttcagattctcagagactagtggacgtgctgcagctagtgacccgtttgccgccccagctggtgcggttgatgacgatgatctttataattaggtttacggaataaacgtttactctgtttcgtgtgcttttgtatctttggttaataaagatgttcctgttatatgtttt

SEQ ID NO: 7403 - DNA, 2496 bp, Catharanthus roseus
aaatatcatttctatgtgcatccgtctctggtagaatagaaggacaacagaatctgaaaatgagtaatcaagcagagccatctgactcgaaaggcaagaaagatttttccactgcgattttggaacgtaagaaggcgccaaatcggctcatcgtcgatgaggcggtcaacgatgataattctgttgtcgctctccaccctgttactatggagaagctccagctttttcgtggcgataccattttgattaagggtaagaaaaggaaagatacaatatgcattgctctggctgacgaggcatgtgaagagcctaagattaggatgaataaggtggtgagatcaaatttgagggttcgtcttggagatgttgtatctgtgcatcagtgcccagatgtcaagtatggaaaacgtatccatgttctgcccttggacgatagcatagaaggtgtcactggggatctctttgatgcatacttgaaaccgtactttctggaggcatatcgtcctgttagaaaaggagaccattttctcgttagaggagggatgagaagtgtggaattcaaggtcattgagactgatccaggcgagtattgtgttgttgcccctgacactgaaatattttgtgaaggggatcctgtgaagagggaggatgaggatagactagatgaggttggctatgatgatgttggtggtgtcaggaaacagatggctcaaattcgtgagttagttgagctgccactaaggcatcctcagctcttcaagtccattggggtaaaaccacctaagggaattcttctttatgggcctccaggatcaggaaaaaccctaatagctagagctgttgccaatgagacgggggcctttttcttctgcattaatggacctgagatcatgtcaaaattagctggagaaagtgaaagcaacctcagaaaggcatttgaggaggcggagaagaatgctccatccatcatttttattgatgaaattgattcaattgctcctaagcgagaaaagacaaatggtgaagttgaaaggagaattgtttctcaacttttgaccctcatggatggactgaaatctcgtgcccatgtcattgttattggggctacgaatcggccaaacagcattgatcctgctcttagaaggtttggtaggtttgacagagaaatagacattggtgttcctgatgaagttggacgtcttgaagttcttcgtattcatactaagaatatgaaactttcggaagatgttgatttggaaagaatagcaaaagatacacacggttatgttggtgctgatcttgcagcattatgcacggaggctgcacttcagtgcatccgggaaaagatggacgttattgatttggaagatgattccatcgatgctgaaattttgaattctatggctgtaacaaacgaacatttccagacagctcttggaacaagcaacccatctgccttgcgagagacagtcgttgaggtgcccaatgtctcatgggaagatattggaggccttgaaaatgttaagcgggagcttcaagagactgttcaatatcctgtggaacatccagaaaagttcgagaagtttggcatgtcaccttcgaaaggtgtgttgttctatggtcctcctggttgtggtaaaactctgcttgctaaggcaattgcaaacgaatgtcaagccaattttattagtgtcaagggacctgagcttcttaccatgtggtttggagaaagcgaagcaaatgttcgtgaaatctttgacaaggccagacaatctgcaccttgtgttctcttttttgatgagctggactctattgctactcagaggggaagcagtgttggagatgctggcggtgcagctgatcgagtccttaaccaacttttgactgaaatggatggaatgtctgctaaaaagactgtttttataattggtgccactaacaggcctgatattattgaccctgcacttctccgtccaggccgtcttgatcagctgatctacattcctctgccagatgaagattctcggctccagattttcaaggcttgcctcagaaaatcaccagtctcgaaggatgttgatttgagagcccttgccaaatatacacaggggtttagtggggctgacatcaccgagatatgtcagagggcttgtaagtatgccatacgagagaatattgagaaggatattgaaagagagcggaggagaaacgagaatccggattctatggatgaggatgttgaggaagaaatagcggagataaaggctgcacattttgaagagtcaatgaagtatgctcgtaggagtgtgagtgatgctgacattcggaaataccaggcatttgctcagactttgcagcagtctagagggttcggaagtgaattccgatttgcagagtctgcaacaacaggtgcctcaggatccgacccatttcgtaacttcggctggtgctgctgatgaagatgatttgtatagttagagagagagagagagagag

SEQ ID NO: 7404 - DNA, 2783 bp, Cephalotaxus harringtonia
ccaatacctaattcattcttgtttgaggaggccttgcagcaatctcattctctctgtttctgtttctgtttctgtgttgctgcaataatggctcacaagggagaatcctcagaaccgaaaggaaccaaaagggatttcagcactgcaattttagagcgaaagaaggcggcgaatcgcctagtggttgacgaagcgattaacgatgacaactccgtagtttgtctgcaccccgacaccatggaaaaattgcaattgttcaggggagataccattcttattaagggtaagaagaggaaggatacgatttgtatagctctggcggacgacacatgcgaagagcctaagatacgaatgaacaaggttgtgcgttcgaatctcagggttcgtttgggggacgtggtttctgttcatcaatgtcccgatgttaagtacggcaagcgcgtccatatacttcccatcgacgataccatcgagggcgtcactggcaatttgttcgatgcctatctaaaaccctatttcttggaagcttatcggccagtaagaaaaggagatcttttccttgtcagaggtggaatgcgtagtgtggagtttaaagttattgagacagatccgggggaatattgtgttgtttctcccgatactgaaattttctgtgagggtgagccagtaaagcgggaagatgaagatagattggatgagataggttatgatgatgttggtggtgtaaggaaacaaatggctcagatacgtgaattggtagagcttccacttaggcatccacagctctttaagtcaattggtgtgaagcccccaaagggtattctgctttatgggccacctggttctgggaaaaccttaattgctagagccgttgcaaatgaaactggtgcgttctttttctgtatcaatggccctgaaattatgtcaaagctggctggagaaagtgaaagcaatctccggaaggcttttgaggaggctgagaagaatgccccttccattatttttattgatgaaattgattccattgctcccaaaagggaaaaaacccatggtgaagttgagaggagaattgtttctcaacttctcacacttatggatggactaaaatctcgagctcatgttattgtgattggagcaacaaaccgaccaaacagtattgacccagcgctgagaaggtttggaaggtttgacagagaaattgatattggggttccggatgaagtgggcaggttggaagtgctccgtattcatacaaagaatatgaagctgtctgatgatgttgatcttgaacggatcgcaaagaacacacatggatatgttggagcagatcttgcagctctgtgcactgaggctgcactccaatgcattagggagaagatggatgttatcgatttagaagatgagacaatagatgctgaaattctcaattcaatggctgttactaatgagcacttccaaactgcattgggctccagtaatccatctgctctgcgtgaaactgttgttgaagtgccaaatgtcacatgggaagatattggcgggttggagaatgtcaagagggagcttcaagagactgttcaatatccagtggaacatcctgagaaatttgaaaaatttggcatgtccccctcaaaaggagtgcttttctatgggccgccgggttgtggaaagacattgcttgcaaaagccattgctaatgaatgccaggccaattttatcagtgtgaaaggcccagaattgctaacaatgtggtttggagagagtgaggctaatgtaagggaaatttttgacaaagccagaggttcagctccttgcgtcctcttctttgatgagcttgattctattgctacacagcgtgggagtagttctggggatgctggtggtgctgcagacagagtgcttaatcagttgttgactgagatggatggtatgactgccaagaaaactgttttcattattggggctacaaataggcctgatatcattgatcctgcattgctaaggcctggtagacttgatcagttgatctatattcctttgcctgatgaaagttcacgctaccaaattttcaaatcttgcttgagaaagtcacctgtgtcaaaggacgttgacctaatggcacttgcccgttatacccagggattcagtggagctgatattacagagatttgtcagcgggcttgcaagtatgctattagagaaaatattgagaaggatattgaacatgaaaggaaaagaagtgagaatcctgaggcaatggatgaggatgatagtgatgaggtgtccgaaataaaagctgctcattttgaggaatccatgaaatatgcccgaagaagtgtgagcgatgctgatattcggaagtatcaagcatttgcacaaacactgcagcaatctcgaggttttggttctgaatttcgatttccagacagaccggctggttctgtggctggcgcttcagatgcatttactacagcagataataaagatgatgatgacttatacagttaagagactttgtacataattgtcatctttatcaagtggcaaatgttatctgctttagcagggaccttcctctgacaactagccagttctattaaatgtggctcggctaggcttgtatgagtttaatatttatatgtttttttggacttaatttaattcagcagcccttatgtagtggactaaattcttctcgtaatttgtaagctttattaatatcagctctgcggcaaggaaaccttgttcaactggtagttaattgaaacgtgctttatcttttt

SEQ ID NO: 7405 - DNA, 2647 bp, Amorphophallus konjac
caatatcgtcgctcgctctccctggttttgatccttcctgcagcgatccagatggcgaaccagggggagtcttcttcggcgccgtccgattcgaaagggacgaagagggatttctcgacggcgattctggagcggaagaaggcggcgaacaggctgatcgtggacgaggcggcgaatgacgacaactcggtggtgtcgatgcacccggagacgatggagaagctgcaattgttccggggtgataccatcctgatcaagggaaagaagagaaaggataccatctgcattgcacttgctgacgatacatgtgatgagccaaaaattagactgaacaaggttgttagatctaatttgagggttcggcttggtgatgtggtttctgtgcaccaatgccaagatgttaaatatggaaaaagggtgcacatattaccaattgatgataccattgagggtataactgggaacctctttgatgcttacttgaaaccttatttctcggaagcctatcgccctgtgaggaaaggagatcttttccttgtcagaggaggaatgagaagtgtggagttcaaggtaattgagacggatccaccagagtactgcgtggttgctcctgacacagagatcttttgtgatggggagcctgtgaagagggaagacgaagataggctcgatgaagttggctatgatgatgttggaggggtcaggaagcagatggctcagattagggagttggttgaactccccttaaggcatcctcagcttttcaagtcaattggtgttaaaccgccaaaaggaattctactgtatggaccacctggttctgggaagacattgatagctagggcagtggccaatgagacaggtgcatttttcttctgcattaatggcccggagattatgtcaaagttggctggagagagtgagagcaatctaaggaaagcttttgaggaagcagaaaagaatgcaccctcaattatttttattgatgagattgactctattgcaccaaagcgagagaaaacccatggagaagttgagagacgtattgtctctcaactgttgacactaatggatggtttgaagtctcgtgcacatgtcattgtaattggagctacaaatcggcctaatagtattgacccagctctgagaagatttgggagatttgacagggagattgacattggcgtccctgatgaagttgggaggcttgaagtcctccgtattcataccaaaaatatgaaactctctgatgatgttgatctggaaagaattgccaaggatacacatggttatgttggtgctgatcttgctgctctctgcaccgaagctgcacttcagtgcatcagggagaaaatggatatcattgatttggaggatgaatcaattgatgccgagatacttaactctatggctgttacaaacgaacatttcaagactgcccttggatccagtaatccatctgccctgcgtgaaactgttgttgaagttcctaatgttagctgggatgacattggtggtctcgagaatgtcaagagggaacttcaagagaccgttcaatatcctgttgagcacccagagaagtttgagaagtttggcatgtcaccttcgaagggagttcttttctatggtccccctggttgtggaaaaactctccttgcaaaagcgattgccaatgagtgtcaggcaaactttatcagtgtgaaaggccctgaattgctgactatgtggttcggagaaagtgaggcgaatgtacgtgaaatttttgacaaggctcggcaatctgctccatgtgtcttgttctttgatgaacttgattctattgccacacagagagggagcagtgttggagatgcaggcggtgcagctgatcgggtcctcaatcagctgctgacagagatggacgggatgtcagccaaaaaaactgtgtttataattggagccaccaataggccagatatcatagatcctgccttgttgaggccaggtcgtctggatcagttgatctatatacctttaccagatgaagcctctcgttttcagatctttaaagcctgcctgaggaaatctcctgtctcaaaagatgttgaactagcagcgcttgccaagtatacccaaggttttagtggagcagatattactgagatatgtcaacgagcatgcaaatatgcgatccgagaaaatattgagaaggacatagaaagggagaggaggaggagtgagaatcccgaggcaatggaagaagatgctgctgatgaggtcgcagaaattaaagcagttcacttcgaagaatcgatgaagttcgcacggaggagtgtgagcgatgctgatatccggaagtaccaggcgttcgcccagacattgcaacagtccagaggttttgggagtgagttccgcttctcggaacggtcggagacggctgcgggcactaccgcgtctgatccattcggatctgcggctgcaggcgctgacgatgatgacttatacaactagttcctttgttgtcacttacttcagatactattttctccgttaagctgtcaccataactagacggttgagtcattaaatgttggagggtgtgtactgccccacatggctattatgactccctcggacagaaacttgggagcacgttgataggactttc

SEQ ID NO: 7406 - DNA, 2871 bp, Amorphophallus konjac
ccttcctacagcgatccagatggcgaaccagggggagtcttcttcggcgccgtccgattcgaaagggacgaagagggatttctcgacggcgattctggagcggaagaaggcggcgaacaggctgatcgtggacgaggcggcgaatgacgacaactcggtggtgtcgatgcacccggagacgatggagaagctgcaattgttccggggtgataccatcctgatcaagggaaagaagagaaaggataccatctgcattgcacttgctgacgatacatgtgatgagccaaaaattagactgaacaaggttgttagatctaatttgagggttcggcttggtgatgtggtttctgtgcaccaatgccaagatgttaaatatggaaaaagggtgcacatattaccaattgatgataccattgagggtataactgggaacctctttgatgcttacttgaaaccttatttctcggaagcctatcgccctgtgaggaaaggagatcttttccttgtcagaggaggaatgagaagtgtggagttcaaggtaattgagacggatccaccagagtactgcgtggttgctcctgacacagagatcttttgtgatggggagcctgtgaagagggaagacgaagataggctcgatgaagttggttatgatgatgttggaggggtcaggaagcagatggctcagattagggagttggttgagctccccttaaggcatcctcagcttttcaagtcaattggtgttaaaccgccaaaaggaattctactgtatggaccacctggttctgggaagacattgatagctagggcagtggccaatgagacaggtgcatttttcttctgcattaatggcccggagattatgtcaaagttggctggagagagtgagagcaatctaaggaaagcttttgaggaagcagaaaagaatgcaccctcaattattttattgatgagattgactctattgcaccaaagcgagagaaaacccatggagaagttgagagacgtattgtctctcaactgttgacactaatggatggtttgaagtctcgtgcacatgtcattgtaattggagctacaaatcggcctaatagtattgacccagctttgagaagatttgggagatttgacagggagattgacattggcgtccctgatgaagttgggaggcttgaagtcctccgtattcataccaaaaatatgaaactctctgatgatgttgatctggaaagaattgccaaggatacacatggttatgttggtgctgatcttgctgctctctgcactgaagctgcacttcagtgcatcagggagaaaatggatatcattgatttggaggatgaatcaattgatgccgagatacttaactctatggctgttacaaacgaacatttcaagactgcccttggatccagtaatccatctgccctgcgtgaaactgttgttgaagttcctaatgttagctgggatgacattggtggtcttgagaatgttaagagggaacttcaagagaccgttcaatatcctgttgagcacccagagaagtttgagaagtttggcatgtcaccttcgaagggtgttcttttctatggtccccctggttgtggaaaaactctccttgcaaaagcgattgccaatgagtgtcaggcaaactttatcagtgtgaaaggccctgaattgctgactatgtggtttggagaaagtgaggcgaatgtacgtgaaatttttgacaaggctcggcaatctgctccatgtgtcttgttctttgatgaacttgattctattgccacacagagagggagcagtgttggagatgcaggcggtgcagctgatcgggtcctcaatcagctgctgacagagatggacgggatgtcagccaaaaaaactgtgtttataattggagccaccaataggccagatatcatagattctgccttgttgaggccaggtcgtctagatcagttgatctatatacctttaccagatgaagcctctcgttttcagatctttaaagcctgcctgaggaaatctcctgtctcaaaagatgttgaactagcagcgcttgccaagtatacccaaggttttagtggagcagatattactgagatatgtcaacgagcatgcaaatatgcgatccgagaaaatattgagaaggacatagaaagggagaggaggaggagtgagaatcccgaggcaatggaagaagatgctgctgatgaggtcgcagaaattaaagcagttcacttcgaagaatcgatgaagttcgcacggaggagtgtgagcgatgctgatatccggaagtaccaggcgttcgcccagacattgcaacagtccagaggttttgggagtgagttccgcttctcggaacggtcggagacggctgcgggcactaccgcgtctgatccattcggatctgcggctgcaggcgctgacgatgatgacttatacaactagttcctttgttgtcacttacttcagatactattttctccgttaagctgtcacataactagacggttgagtcattaaatattggagggtgtgtactgcccctcgtggctattacgactctctcggacagaaacttgggagcacgttgataggactctttttttttttgttgttttttgaaccttctttctcctgtttgctttacggtcctccctccctaagacaatggtttcttcaccaatgggttgtgtctatttgatgttgcacttgctttcaccacctcttcctctggtgcgccctcgggttgacagccaaacaacacgacgcgtccggagcctgcctgcttattgtgagcttatgggaggcggattcaaaaggtagctgattgccattttttggagggttctctggttcgtg

SEQ ID NO: 7407 - DNA, 2588 bp, Taxus baccata
ttcgcagcaatggcgcacaagggagaatcatcagaaccgaagggaaccaaaagggattttagcactgcaattttagagcgaaagaaggcggcgaatcggctggtggtggacgaagccatcaacgatgacaactccgtggtctgtctgcacccggacaccatggaaaagcttcaattgttccgtggagataccatccttattaagggaaagaagaggaaggataccatttgcatcgctctggcggacgagacatgcgaagagcccaagatacgaatgaacaaggtcgtgcgttcgaatctcagggttcgtttgggggacgtggtttctgttcaccagtgtcccgatgttaagtacggcaagcgcgtccatattcttcccattgacgacaccatcgagggtgtaaccgggaatttgtttgatgcttatctaaaaccctatttcctggaagcttatcgcccagtaagaaaaggagatcttttccttgtcagaggtggaatgcgcagtgtggagttcaaagtaattgagacggaccctggggaatattgtgttgtttctcctgatactgaaatcttctgtgaaggcgagcctgtaaagcgggaggatgaagatagattggatgaaataggttatgatgatgttggtggtgtacggaaacaaatggcccagattcgtgaattggtagaacttcccctgcggcatccacagctctttaaatcaataggtgtgaagccccctaagggtattttgctttatggaccacctggttctggaaaaacattaattgccagagcagttgcaaatgagacgggtgcgttctttttctgtattaatggacctgaaattatgtcaaagttggctggagaaagtgaaagcaatctccggaaggcttttgaggaggccgagaagaatgccccatccattatatttattgatgagattgattccatagctcccaagagggaaaaaacccatggtgaagttgagaggagaattgtttctcaacttctaacacttatggatgggctaaaatctcgtgctcatgttattgtgattggagcaacaaaccgaccaaacagtattgatgcagctctgaggaggtttggacggtttgacagagaaattgatattggtgttccggatgaagtgggtaggttggaagtgctccgtatccacacaaagaatatgaagctctctgatgatgttgatctcgaaaaaattgcaaagaatacacatggatatgttggagctgatcttgcagctttgtgcactgaggctgcactacaatgcattagggaaaaaatggatgtcattgacttggaagatgagacaatagatgctgaaattcttaattcaatggctgttactaacgagcatttccagactgcattgggctctagtaacccatctgcgctacgtgaaactgttgttgaagtaccaaatgtcaattgggaagatattggtgggctggaaaatgtcaagagagagcttcaagagactgttcaatatccagtggagcatcctgagaaatttgaaaaatttggcatgtctccttcaaaaggagtgctcttttatgggccaccaggctgtggtaagacattgcttgcaaaagccattgctaatgaatgccaggccaattttatcagtgtgaaaggcccagaattgttaacaatgtggtttggagagagtgaggccaatgtaagagaaatttttgacaaagccagaggttcagctccctgtgtcctgttctttgacgagcttgattctattgccacacagcgtgggggcagtgttggggatgctggtggtgccgcagacagagtgcttaatcagttgttgacagagatggatggtatgacagccaagaaaactgtttttattattggggctactaacaggcctgatatcattgatcctgcattgttaaggcctggtcgacttgatcagttgatctatattcctttgcctgatgagagttcacgataccaaattttcaaatcttgcttgaggaagtcacctgtgtcaaaggatgttgacctaatggcacttgctcgttatacccaaggattcagtggagcagatattacagagatttgtcaacgggcttgcaagtatgccattagagaaaatattgagaaggatattgaacatgaaaggaaaagaagtgagaatcctgaggcaatggatgaagatgatagtgatgaggtatctgaaataaaagcagcacattttgaggaatccatgaaatatgcccgaagaagcgtgagtgatgctgatattcgtaagtatcaagcatttgcacaaacattgcagcaatctcgaggctttggttctgaatttcgatttccagacagacccgctggtactgcagttggggcaacggatgcttttgctacagcagataataaagatgacgatgacttatacagttaatagactttgtacataaatgtcatctttattaagtggcaaatgttatctgctttagcaggaaccttccaatgacaaatagccggtactattaaatgtggttcggctatgcttgtatgagttaaatatttatatgttatctaaactttatgcgttaacat

SEQ ID NO: 7408 - DNA, 2733 bp, Helianthus annuus
ctctctggatatatacaaaaaccagaatcctctcccaacatcataatcctctccaaaccctctttccatatttctcaaatcttcccttctttcaccactctaaactcaatcaataatcctgcatcatgagcaatcaacctgaatcatccgactctaagggcgggaagaaggacttcagtaccgcgattcttgagcgaaaaaaggcgccaaatagactcgttgttgatgaagctatcaacgatgataactctgtcgtttccatgcatcctgaaaccatggaaaagcttcaacttttccgaggcgatacaatcttgattaagggcaagaaaaggagagatacaatttgtattgcacttgctgatgacacctgtgaagaaccaaagattaggatgaataaggttgtcaggtcaaatttgagggttaggctcggcgatgtggtttcggtgcatcagtgtgctgatgttaagtatgggaagcgcgtccacatccttccgatcgatgataccatcgaaggagttactgggagtctgtttgatgcttacttgaaaccctactttctggaagcgtaccgcccggtgagaaagggtgactactttttggtaaggggaggaatgagaagcgtcgagtttaaagttatcgagactgatcctgctgagtactgtgtggttgcacctgataccgagatattctgtgagggtgagcctgtgagaagggaagatgaggaccggttagacgagatcggttatgatgacgttggtggtgtgcgaaaacagatggcgcaaatccgtgagttagtggaactcccattaaggcatccgcagcttttcaagtctattggtgttaaaccaccaaagggtattcttctttacgggcctcctgggtctggaaagacgttgattgcccgtgctgttgctaatgaaaccggtgctttctttttctgcattaacgggccagagatcatgtcgaaaatggctggagagagtgagagcaatttaaggaaagcgtttgaagaagccgagaaaaacgcaccatcgatcatctttattgatgagcttgattcaattgcaccaaaacgggaaaaaacacacggtgaagttgaacgaaggatcgtttcccagttgttgactttaatggacgggctgaagtcccgggcacatgtaattgttatgggtgcaaccaaccgccctaacagcatcgatcctgcattgagacggttcggtagattcgatcgtgaaattgacattggcgtgcccgatgaagttggccgtcttgaggttcttagaattcatactaagaacatgaagctagccgatgatgtggacttggagaaggttggaaaggatacacatgggtatgtaggtgctgacctggcagctctatgcactgaggctgcactccagtgcatcagagagaaaatggacgtgatcgatttggaagatgagtccatcgatgcggagattctaaactccatggcagttacgaatgagcattttcagaccgccctcgggaccagcaatccttctgctcttcgtgagaccgttgtcgaagttccgaatgttagctgggaagacatcggtggactggagaatgttaaacgagagctacaagagactgttcaatatcctgtcgaacatcccgagaaatttgagaagttcggtatggctccgtctaaaggagtcctgttctacggtccaccaggttgtggtaaaacacttctagcaaaagctattgcaaatgaatgtcagtctaattttatcagcatcaagggtcccgagctgcttacaatgtggttcggtgagagtgaggccaacgttcgtgaaattttcgacaaggctcgcggctctgctccttgtgtcctctttttcgatgaacttgattccatcgcaacccagagagggggtagtcaaggagatgctggcggtgcagccgacagagttctgaaccaacttctgaccgaaatggatggaatgtctgccaagaaaacggttttcatcatcggtgcaaccaacaggcccgatatcatcgatccagcactgttaaggcccggccgtcttgatcaactgatctacattcctttaccggatgaggagtcacgttatcagatctttaaatccgcgttaaggaagtcaccgatttctaaagatgttgatctccgagctcttgccaggtacacacaaggtttcagtggtgctgacatcaccgaaatctgccagcgcgcatgcaaatatgccattcgtgagaacatagagaaagatattgagagggaaaagaggagaagcgagaaccctgaagctatggaggaagacatggacgatgaggtggcggagattaaagctgctcattttgaagaatcaatgaagtttgcgagaagaagtgtcagtgatgcggacataaggaaataccaggcgtttgctcaaacactgcagcagtcgagagggattggttctgagttcagattctcggagactagtgggcgtgctgccgctagtgacccgtttgccgcccccgctggtacggtcgatgatgatgacctttataattaggtttttgcttgctggataaatgttacttgttttttcgtgtgttactaagatgtttctagtacgtggtaactttgtttatgatggttcaccatctgtgttatgagtttgtgaataagtaattagtaatatatcctaaaaatctagtctgtgttatgagtttatgaaaatacggttttattattatattcac

SEQ ID NO: 7409 - DNA, 2547 bp, Flaveria ramosissima
agtttgcttctcaataaattgttacccacgaaacactcaaatctctcatcatcttcatcacaacatcatctccttcattctgcaaatcaatttctccgatccaccgtcgtcttccgccatgagcaaccagccggaatcctcttcctccgatccgaaaggtgcgcctccgtcgaagaaggacttttcgactgctatcttggagcgcaagaagtctccgaatcggcttgttgttgatgaggctgttaatgatgataactccgtcgtcgctatgcatcctgctaccatggagaaattgcagcttttccgtggtgatacgattttgatcaagggcaagaaaagacgtgatacagtttgcatcgcccttgctgatgaaacgtgtgatgaaccaaagatcagaatgaacaaggttgttaggactaacctaagaattcggcttggtgatgttgtgtcagtgcaccaatgcccagatgtcaagtatggaaaacgtatccatgttcttccacttgatgacaccattgagggtgtcaccggagacttatttgatgcatatctgaaaccatacttcttggaggcatataggcccgtaagaaaaggagaccatttccttgttagaggaggtatgcgcagcgtcgaattcaaagtaattgaaactgatccaggggaatattgtgttgttgccccagatactgaaattttctgtgagggtgagccgattaaaagagacgacgaggatagattggatgaagtgggctatgatgatgtaggaggcgtaaggaaacaaatggctcagatccgtgaattggtggaattaccattaagacacccccaacttttcaagtcaattggagtcaaaccaccaaaaggaatcttgctctatggaccacccggttcaggaaagacactgatagccagagccgttgctaatgaaacaggagctttctttttctgcatcaatggtccagaaattatgtcaaaattggcaggagaaagtgaaagcaatctcaggaaagcattcgaggaggccgagaagaacgccccatctattattttcattgatgagatagattcaattgctccaaagagagagaagactaacggtgaagttgaaaggaggattgtatcacagcttttgacacttatggatggattaaaatcacgggctcatgttattgtaattggggccacaaaccgccctaacagcattgatcctgctctcagaagatttggtaggttcgatagggaaatcgacattggtgtcccagatgaagttgggcgtcttgaggttcttcgtatccacacaaagaacatgaaactttctgaggatgttgatttggaaaagatatctaaagaaacacatggttatgttggtgcggatcttgctgctctttgcactgaagctgcacttcaatgcattagagaaaagatggatgttattgatttggaagatgaatctattgatgctgagatactgaattctatggctgtcacaaatgaacatttcgctactgctcttggaactagcaatccatctgctctgcgtgaaactgttgttgaggttcccaatgttagctgggatgatattggaggccttgagaatgttaagcgtgagcttcaagagacggttcaatatccagtggagcatccagagaagttcgagaaatttggtatgtcaccatcaaaaggagttcttttctacggtccacctggatgtgggaaaacacttcttgcaaaagctattgcaaatgaatgtcaagcaaatttcatcagcatcaaaggacctgaattactgactatgtggtttggtgagagtgaagccaacgttcgtgaaatttttgacaaagccagaggatctgctccatgtgtccttttctttgatgagcttgactccattgcaactcagagaggaagcagttctggagatgcaggtggtgctgcagaccgtgttctgaaccaactcttgactgaaatggacggaatgtctgctaagaagacagttttcataatcggagccactaacaggcccgatattattgacccagcattacttcggcccgggcgtctcgatcaacttatctacattccattaccagatgaagaatcgcgctactcgattttcaaggctgcaatgagaaaatcccctgtttctaaagatgttgatttgagagctcttgctaagtacactcaaggattcagtggggctgatattactgagatatgtcaacgggcctgcaagtatgcaattagagagaacatcgagaaagatatagagagggaacgaaagaggagtgagaatcccgactccatggatgaggatgaggatgacgtggccgagataaaggcggctcactttgaggaatcgatgaagtatgcacgcagaagtgtgagcgatgctgacatcaggaagtaccaggcgtttgctcagacactgcagcagtcgagaggatttggttccgagtttcgattcccagaagcaacatctggtggcgcggctgacccgtttgctgcttctgctggtggagctaatgatgatgacttatacagttaggt

SEQ ID NO: 7410 - DNA, 2620 bp, Silene vulgaris
agactttagcactgcgattctagagcgcaagaaagccgctaatcgccttgtcgttgatgagtctgttaatgacgacaattctgttgtttctctccatcctgatgccatggaaaagcttcagattttccgtggcgataccatcttgattaagggaaaaaaaaggaaagatactatttgcattgcacttgctgatgagacatgtgaagtacctaaaattaggatgaacaaggttgtgaggtcaaacttgagggttagactcggggatgtggtctctgtacaccagtgccctgatgtcaaatatggaaaacgtgttcacattcttcctgttgacgatacagtggaaggagtgaccggaaatctttttgatgcctacttgaaaccttactttctagaagcttaccgtcctgtgcggaaaggtgatttgtttctggtcagagggggcatgagaagtgttgagttcaaagtcattgagactgaccctgctgagtattgtgttgttgcccctgataccgagatcttctgtgagggggaacctgttaaaagagaagatgagaatagattagacgaggttggttacgatgatgttggtggagtgcgtaagcaaatggcgcaaattagggagcttgtcgaattgccactccgacacccacagctctttaaatcaattggtgtgaagccaccaaagggaattttgctgtttgggcccccgggttcggggaagacattgatagctcgggctgttgctaatgaaactggtgctttcttcttttgtatcaatggacccgagattatgtcaaaaatggctggagaaagtgaaagcaatctcaggaaagcattcgaggaagcagaaaagaatgctccgtcaattatctttattgatgagattgattcaattgcccctaaaagagacaaaactaatggagaggttgagaggagaattgtttcccagcttcttactcttatggacggactcaaatcacgtgcccacgttattgtcatgggggctaccaatcgtccgaacagcattgaccctgcattgagaagattcggtagatttgacagggaaatagatatcggtgtgcctgatgaagtcggacgacttgaggttctccgcattcacacgaagaacatgaagctagctgaagatgttgatctggaaaaagtctgcaaggaaacacatggctacgttggtgctgacttggctgctttatgtactgaagctgctctgcaatgtattagagagaagatggacgtgattgatttggaggacgacacaatagatgcagaaattctcaattctatggccgttacaaatgaacactaccagactgctcttagccagagcaatccatctgctttgcgtgaaaccgttgttgaagttcctaatgtttcttggcaagatattggcgggcttgaaaatgttaaaagagagctccaagagactgttcaatatccagtagagcatccagagaaatttgagaaatttgggatgtcaccttcaaaaggagtccttttctatggtcctcctggatgtggaaaaacattgctagccaaggctattgcaaatgagtgtcaggccaactttattagtatcaaaggtcctgaattgttgaccatgtggtttggagagagtgaggctaatgttcgtgaaatttttgacaaggcacggcaggcagctccatgtgttctgttctttgacgagcttgattcaattgcgacacagaggggaagcagtgttggagatgccgggggtgctgctgatagagttttgaaccaacttctcactgaaatggatggcatgtctgccaagaagacggttttcattattggagcgactaacaggcctgatatcattgatccagctctcttacgaccgggtcgtcttgaccagctaatttatatcccactaccagatgacgaatcacgcctccaaattttcaaggcagccttgaggaagtcccctatcgctaaagatgttgacctcagtgcccttgccaagtatactcagggctttagtggtgcagatatcactgaaatatgccagcgtgcatgcaagtacgccatccgagaaaacattgagaaggacatagagagggagcgaaggagaagcgaaaaccccgaggcaatggaggaggatgttgaagatgaagtagccgaaattagtgctgcccactttgaagagtcgatgaagtatgctcgaagaagtgtaagcgatgctgatattcgcaaatatcaggcattcgctcagaccctacagcaatcaagaggctttgggtctgagttccgattttccaacacaagtgcaggcgggactgccacatcagatgcgtttgctgccccagctgctgctgctgatgaagatgacctttacaattaattttctcttgtttctcatcttgaacagttgcataataatataattattgaatgtaggttgctttactgtctcttaagttttacccattagaaagatcatcgaggttttgaggattgtgtttctggctgatgatttaccttggaatttaaactgaaaattactgccttcctggacaaatccttgatgaagtaaatggttctattttccttatttcttacgagtatgttgttatttttgtgactc

SEQ ID NO: 7411 - DNA, 2892 bp, Populus trichocarpa
atcgaacatttgaattaagacgaccactctcaatttcattaaccctagcaaaatctcaaaatcaatggaggatccaagctctagccagccctcctcttccactgacccgaaaagtggtaagaaagatttttcgactgcgattttagagcgaaagaagtctcccaatcgtcttgttgttgacgaggcgatcaatgatgataactctgtggttgctatgcatcctgctacaatggagaagcttcagttttttcgtggtgacactgtgctaattaagggaaagaagcgtagagacactgtttgcattgttcttgctgaggaacaatgtgaggaaccaaaaatcagaatgaacaaagttgtcagggctaatcttagagtctgtcttggtgatgttgtgtctgtccatcaatgtcctgatgtgaagtatgggaagcgggttcatatccttcctattgatgacactattgagggtgttactggcaatctttttgatgcatatttgaagccatatttcttggaatcttaccgccctgttaggaaagatgaccttttccttgtcaggggtggcatgcgcagtgtcgagttcaaagtaattgagacagaccctggtgaatactgtgttgtggcaccagataccgagatcttttgtgaaggagagcccatcaaacgcgaggatgaagagagattgaatgaagtgggctatgatgatgttgggggtgttaggaaacaaatggctcagattcgtgagctagttgagcttcctcttagacacccacagcttttcaaatcaattggtgtgaaaccaccaaaaggtatattgctgtatggaccacctgggtccggtaaaactctgattgcaagagctgttgctaatgagacaggggcattcttctttttgattaatggtcctgagataatgtcaaagctggctggtgagagtgaaagcaacctgaggaaggcgtttgaagaagctgaaaagaatgcaccatccataatttttatcgatgagatagattctattgctcctaagagggaaaagactcatggtgaagtggagaggcgtatagtttcacaacttttgactttaatggatggccttaagtcacgggcacatgtgattgttatgggggctaccaataggcccaatagcattgatccagctttgaggagatttgggagatttgatcgagagattgacattggtgtgccagatgaagttggacggttggaggtcctcagaattcatactaaaaatatgaaacttgctgaagaggttgatcttgaaaaagttgcaaaggacacccatggttatgttggtgcagatcttgcagctctttgtactgaggcagctcttcagtgtattagggagaaaatggatgttattgatttggaggatgacacaattgatgccgaggtgttaaactcaatggctgtgactaatgagcacttccgaactgcattgggaacttcaaatccatcagccttgcgtgaaacagttgtggaggttcctaatgtctcatgggaggatattggtggattggagaatgttaaaagagagcttcaagagactgtccaatatccagtggagcatcctgagaagtttgagaaatttggcatgtcaccttctaaaggtgttctcttttatggacctcctggctgtggtaaaaccctacttgcaaaggcaattgctaatgaatgccaggccaacttcattagtgtcaagggtcctgagcttctaaccatgtggtttggagaaagtgaagcaaatgtgcgggagatattcgacaaagcacggcagtcagccccatgtgtacttttctttgacgaacttgattccattgctactcagcgtggcagctctgtaggagatgctgggggtgctgctgatagagtcttgaatcaacttctgacggaaatggatggcatgacagcaaagaaaacagtttttatcattggagcaacaaacaggccagatattatcgacccagcattgcttaggcccgggcgtctggaccagttgatttatattcctcttccggacgaggcttcccgtcttcagatatttaaagcatgtttgcggaagtcacctgtttctaaggatgttgacctgacagctcttgcacgatatactaatggttttagtggtgctgatatcactgaaatttgtcaacgtgcctgcaaatatgccattagagaaaatattgagaaggatattgagaaggagaaaaggaagcaagagaatcccgaagcaatggaagaggatgatgttgatgaggtcccagaaataaaggcagcacattttgaggagtcaatgaaatatgcacgacgaagtgtcagtgatgcagacatcaggaagtaccaatcttttgctcagaccttgcagcaatctcgcggatttggtactgagttccggtttccagaccgtcctgagaatgctgcagatggaggagctgcagatccttttgcttcagcaactaccgctgccgatgaggatgatctatacagctgaactgaaaccagtgcaagttcttggccatttcgcttgtgtaacatctaacacagcacggcaatacatattgccatatcaatttgctttttattcgcaaaggaattgaagttttatgtttcgtgcaccctgcggattatgtcagaatttgatgataatcagcccatcacgggttggatcctcacatgaggtggaaaaaaaaatggaccctctgcgttctgcttaatttcttccttttttttcgctcaagtttttgcgaactagggagttctgccccccgagaattgtaagagatgtgctcaacattctcccccttttatttcaatatgcagttaacccctgggattaaaacaattttgattccaaaacgcttgtcaattcctaacaaa

SEQ ID NO: 7412 - DNA, 2890 bp, Zea mays
acccggaagaaagaagctataaaggcgaacctatcccctcgcccctctcgtcttcatcttcacttcgccccccgaacccgagcacccgcaaatatctgtcgccgtctcgccaacagcaccaaccgcgcctcctcgaattcgaccgtcatggcgagccaaggcgagccgtcttcctccgatccgaaggggaagaaggattactctacggcgatcctggagaggaagaagtcgccgaaccggctggtggtcgacgaggccaccaatgatgacaactccgtcgtcgctctgcacccggacaccatggagaggctccagctcttccgcggtgacactgtcttgatcaagggtaagaagagaaaggacactgtctgcattgtgcttgcagatgagacatgtgaggagccaaaggtccggatgaacaagattgtcaggaagaacttgagggtacggcttggtgatgttgtatctgtccatcaatgcccagatgtcaaatacgggaagcgtgtgcacatacttccaattgatgacaccattgaaggcatcactggcaatttgtttgatgcctttctaaaaccatacttccttgaagcctatcgtcctttgaggaaaggagaccttttcctagtcaggggtggcatgagaagtgtagaattcaaagtcatagagactgatcctgcagagtattgtatcgttgcaccagatacagaaatattttgtgagggtgagcctattaagagggaggacgaggaaagactcgatgaggttggctatgacgatgttggtggagttagaaagcagatggcccaaatcagggaactggttgaacttccattgcgtcatccccagcttttcaagtctattggtgtgaaaccaccaaagggcatattgctgtttgggcctcctggctccggcaagacccttattgctagagctgtagctaatgagacaggtgctttcttctttttgatcaatggaccagaaatcatgtcaaagctagcaggagaaagtgaaagcaatctcagaaaggcatttgaagaagctgagaaaaatgcaccttccatcatttttattgatgagatagattccatagcacctaagagagagaagacccatggagaagttgaaaggcgtattgtttcacagctcttgactcttatggatgggctcaagtctcgtgcacatgtgattgttatgggtgccaccaaccgtccaaacagtatcgatcctgctcttagaaggtttggtaggtttgatcgcgagattgatattggtgttccagatgaagttggccgccttgaggttcttcggattcacacgaaaaacatgaagctggctgaagatgttgacttggagctcattgcgaaggatacccatgggtatgttggtgctgatcttgctgccctttgtactgaagctgctcttcaatgcattcgtgagaagatggatattattgaccttgaggatgagaccatagatgctgagatactgaactctatggctgtctcaaatgaccatttcaagactgcacttgggacaagcaacccatctgctctgcgtgaaactgttgttgaagtcccaaatgtctcttgggaagatattggtggtctggaaaatgttaagagggagctacaggagactgttcaatatccagtggagcatccagataaatttgaaaagtttggcatgtctccttcgaagggtgttttgttttatggccctcctggctgtggcaagactctgttggccaaggcaatcgctaatgaatgccaggctaacttcatcagtgtgaagggtcctgaactgctcaccatgtggtttggtgagagcgaggccaatgtccgtgagatttttgacaaggctaggcagtctgctccgtgtgtcctcttctttgatgagctcgactccattgctactcagagaggaagcagtgttggtgacgcgggcggtgctgctgacagggtgttgaaccagctgcttactgagatggatggcatgaatgccaagaagacggttttcattatcggtgcgactaacagaccagatatcattgaccctgccttgctgaggccaggacgcctcgatcagcttatctacattcctctgcccgatgagcagtccaggcttcagatcttcaaagcctgcctcaggaagtctcctgtggctaaggacgttgacttgcatgctcttgccaagtacacccagggtttcagtggagcagatatcaccgagatctgccagcgtgcgtgcaagtatgccatcagggagaacatcgagaaggacatcgagcgggagaggcgcaggaaggacaaccctgaggccatggaggaagacgaggtggacgacattgccgagatcatggctgcccacttcgaggagtccatgaagtacgcccgccgcagtgtcagtgatgccgacatccgcaagtaccaggccttcgcccagacactccagcagtcccgtgggtttggcagcgagttccggttctccgaccaaccgacggcagctgccggtgcggccgacccctttgcatccgcagccgacgatgacgacttatacagctaaactgcacttctattgtgacgcatctttcctccctccgtatatatgattatatcatatgttaatgcgtgtgtgggggtgttgctgtacctatacagtgaagttaatatttctgttttgcatgcttgcctgttgcctaatttcactaatttgagatgattaaggtagtgtttgtcggagcccagttgagaggagtggctctcgaagggctttttttttgtgaccgtttagtaaagattcacgataaactagaggtgaagctaccgaaagagtgtgccaaagggacactaagttgagccttaattaattttagtttaaaaataaatagaaa

SEQ ID NO: 7413 - DNA, 2661 bp, Phalaenopsis aphrodite
tctctctctactgttctctacctctgcgattcagatcggatggcgaaccaggacgaggcctcctcgtcggatccgaagtcggcaaagagggatttcagcacggcgattttggagaggaagaaggctccgaatcggctgatcgttgacgaggctgttaatgacgataattctgtggtgtcgatacacaccaatacgatggagaagctccagtttttcagaggggatacgatccttttgaaggggaagaaaaggaaagatacaatctgtattgttcttgctgatgattcatgtgaggaacctaagattaggatgaacaaggttgtgagatcaaatctaaaagtaagacttggtgacgtggtttcagttcaccaatgccaggatgtgaaatatggaaagcgtgtgcatatacttccaattgatgataccattgaaggtgtcacggggaatctgttcgatgcatatttgaagccatattttatggaggcctatcgtcctgttaggaaaggagatctctttcttgtccgaggtggtatgagaagtgtggagtttaaaatcatagaaactgacccagctgagtattgtgttgtggctcccgacaccgaaatctactgcgagggggagcctgttaatagggaagatgaaaacagacttgatgatgtgggctatgatgatgtgggtggagtcagaaaacagatggctcagattagagaattggtagagcttcccctcagacatcctcagcttttcaaatcaattggtgttaaaccaccaaaagggatcttactctatggacccccaggctctggcaagactttgatagccagagcagttgcaaatgagactggagccttcttcttttgcattaacggtcctgagattatgtcaaagttagctggagaaagtgaaagcaatctcaggaaggcttttgaagaagctgagaagaatgcaccatctattatttttattgatgaaattgattcaattgctccaaagcgcgagaaaactcacggcgaagttgagaggcgaattgtttcacagctgcttacgttgatggatggactcaaatcccgtgcgcatgtaattgtaattggagcaacaaataggccaaacagtattgacccagctcttagaaggttcggtaggtttgacagggaaattgatattggtgtgccagatgaaattggacgtcttgaagtcctccgcattcacacgaagaatatgaagctttctgatgatgttgatctggagagaattgctaaagacacccatggctatgttggggctgaccttgctgcgctctgtacagaagctgctctccaatgcattagggagaaaatggatgttattgatttggaagatgaaaccattgatgctgaggtgctcaactcaatggctgtcacagatgaacatttcaagacagctctgggaacaagcaatccatctgcactccgtgagacggttgttgaagttcccaatgtcagctgggatgatattggtggacttgagaatgttaagagggaacttcaagagactgtccaatatccagttgaacatccagagaagtttgagaagttcggaatgtctccttcaaaaggggtgttgttctacggtcctcctggctgtggtaagactctgcttgctaaggccattgccaatgaatgccaagccaactttatcagtgtgaagggtcctgagctgctcaccatgtggttcggtgagagcgaggcgaatgttcgcgagatttttgataaggctcgacagtctgcaccttgtgttctgttctttgatgagcttgactcaattgctactcagagagggagcagtgttggcgatgccggaggtgctgctgatagagtcctcaatcaacttctcacagagatggatggaatgtctgcgaagaaaactgtcttcattatcggcgctacaaacaggcctgacatcattgaccctgcattgctccggccaggccgcctggaccagttgatttacattcctctaccagatgaggcttccagatatcagatatttaaagcttgtctcaggaaatcccccatctcaaaagaggttgatttgggggctctggctaagtacacccaaggcttcagcggcgcagatattacagaaatttgtcagcgcgcctgcaagtatgcaatccgagaaaatattgagaaggacattgagaaggagaggcgtcgtaacgaaaacccagaagccatggaggaagacgaaggagatgaagttgcagaaatcaaagctggccactttgaggagtccatgaaatacgctcggcggagcgtgagtgatgccgacatccgcaagtaccaggcattcgcccaaaccctgcagcagtcgagaggtttcggcagcgagttccggttttcagatcgcccaacggcgacggccggtgcggctggaggagctgatccattcgctacctctgccgctgctgatgaggatgacttgtatagttaaacgtcatggcttcttaattgtgttgtagtgcttgaaaatgatagacatggtgtcaagtttcatttaatttcctaacattgtttcatgcgtctagttgttttgttttctacctaagatggttgttgtcttctccctaaattgtttagggggagctaaaaggatttattaatagtttgttaatgagtttag

SEQ ID NO: 7414 - DNA, 2740 bp, Saccharum officinarum
tcggcggcccctgaacacgaacgaacacccgcaaatatctgtcgccgtctcgcgaacagcaccaaccgcccgccttgaattcgaccgccatggcgagccagggcgagtcgtcttcctccgatccgaaggggaagaaggattactcgacggcgatcctcgagaggaagaagtcgccgaaccggctggtggtcgacgaggccaccaatgatgacaactccgtcgtcgctctgcacccggacaccatggagaggctccagctcttccgcggtgacactgtcctgctcaagggtaagaagagaaaggacactatctgcattgtgcttgcagatgacacgtgtgaggaaccaaaggtccggatgaacaaggttgtcaggaagaacttgagggttcggcttggtgatgtggtatctgttcatcaatgcccagatgtcaaatacgggaagcgtgtgcacacacttccaattgatgacaccattgaaggcatcactggcaacttatttgatgtctttctgaaaccatacttccttgaagcctatcgtcctttgaggaaaggagaccttttcctagtcaggggtggcatgagaagtgtagaattcaaagtcatagagactgatcctccagagtattgtattgttgcaccagatacagaaatattctgtgagggtgagcctgttaagagggaggatgaagaaagacttgatgaggttggctatgatgatgttggtggagttagaaagcagatggcccaaattagagaactggttgaacttccactgcgtcatccccagcttttcaagtctattggtgtgaagccaccaaagggcatattgctgtttgggcctcctggatctggcaagacccttattgctagagctgtagctaatgagacaggtgctttcttctttttgatcaacggaccagaaatcatgtcaaagctagcaggagaaagtgaaagcaatctcagaaaggcatttgaagaagctgaaaaaaatgcaccttccatcatttttattgatgagatagattccatagctcctaagagagagaagacccatggagaagttgaaaggcgtatagtttcacagctcttgactcttatggatggtctcaagtctcgtgcacatgttattgtcatgggtgccacaaaccgtccaaacagtatcgatcctgctcttagaaggtttggtaggtttgatcgtgagattgatattggtgttccagatgaagttggacgccttgaggttctccggattcacaccaaaaacatgaaactggctgaaaatgttgacttggagctcaatgcaaaggatacccatggttatgttggtgctgatcttgctgccctttgtaccgaagctgctcttcaatgcatccgtgagaagatggatattatagatcttgaggatgagaccatagatgctgagatattgaactctatggctgtcacaaatgaccatttcaagactgcacttgggacaagcaacccatctgctctgcgtgaaactgttgttgaagttccaaatgtctcttgggaagatattggtggtctggaaaacgttaagagggagctacaggagactgttcaatatcctgtggagcatcctgagaaatttgaaaagtttggcatgtccccttcaaagggtgttttgttttatggccctcctggctgtggcaagactttgttggccaaggcaattgctaatgaatgccaggctaacttcattagtgtgaagggtcctgaacttcttaccatgtggtttggtgagagcgaggccaatgtccgtgagatttttgataaggctaggcagtctgctccatgtgtcctcttcttcgatgagcttgactccattgctactcagagaggaagcagtgttggtgacgcaggcggcgctgctgatagggtgttgaaccagctgcttactgagatggatggcatgaatgccaagaagactgttttcatcatcggtgcgactaacagaccagatatcattgaccctgccctgctgaggccagggcgtcttgatcagctaatctacattcctctacccgatgaacaatccaggcttcagatcttcaaagcctgcctcaggaagtctcctgtggctaaggatgttgacttgaatgctcttgccaaatacacccagggtttcagcggtgcagatatcactgagatctgccagcgtgcgtgcaagtatgctatcagggagaacatcgagaaggatatcgagagggagaggcgcaggaaggacaaccctgaggccatggaggaagacgaggttgatgacattgctgagatcaaggctgcgcacttcgaggagtccatgaagttcgcccgccgcagtgttagtgacgctgacatccgcaagtaccaggcctttgcccagacactgcagcagtcccgcgggtttggcagcgagttccgcttccccgaccaaccgacggcagctgcaggctctgctggtgcggctgatcccttcgcatccgctgcaggagcagctgacgatgatgacttgtacaattagattagcagtcatgttgtgacgcttcttgagtactttccttcgttatatatgcttattattatatgttagtgttatacttatgtttaatacacggggagtggctgtacctatgcagttaagttaatattttagtaggtccttgaatcgtgccattgcatgcttgcctggtgcccaggtttgtgttcatctgagataaaaaaaaaatggccaattctacc

SEQ ID NO: 7415 - DNA, 2650 bp, Artemisia annua
attcacaatgagcaatcaaccagaatcatcatcatcatcagaaccgaagggtaaaaaggatttttcgacggcgatattggagagaaaaaagtcgccgaataggttggttgtagatgaggcggtgaatgatgataattcagttgtggctatgcatcctaatactatggagaagctccagttgtttcgcggtgataccattttactcaaggggaagaaaagaaaagatactgtctgtattgcccttgctgacgaaagttgtgatgaaccaaagattagaatgaacaaggttattagaacaaacctgagggttcgacttggagatgttgtgtctgtgcaccaatgccctgatgtgaagtatgggaagcgtatccatgttcttccactagatgacacgattgaaggtgtcacgggggacttgttcgatgcatacctgaaaccctacttcttggaggcatacagacctgtaagaaagggggatcattttcttgttagaggagggatgagaagtgtagagttcaaggtaatcgagactgacccaggggagttctgtgttgttgctccagacactgaaatcttttgcgagggtgagcccattaagagggatgatgaggataggctggacgagattggttatgatgatgtaggtggtgtcaggaaacaaatggctcaaattcgtgagttagttgaattgccattaaggcaccctcagcttttcaaatccatcggagtaaagccccctaaaggtattttactctacggaccacctggttctggaaaaacactcatagcaagagctgtagctaatgagacaggagctttctttttctgcatcaatggacctgaaatcatgtcaaagttggctggtgaaagtgagagtaatcttagaaaggcgtttgaggaagctgaaaagaatgctccatcaataatttttattgatgagattgattcaattgcccccaagagagaaaaaactaatggtgaagttgagaggaggattgtgtctcagttattgacacttatggatgggttaaagtctcgtgctcatgttattgtaatgggggctactaaccgcccaaacagtattgatcctgccttgagaaggtttggtaggttcgatagggaaattgatatcggtgtgcctgatgaagttgggcgtcttgaggtcatccgcattcacaccaagaatatgaagctttctgatgatgttgatttggaaaagattgctaaagaaacacatggttatgtcggtgctgatctcgctgcactctgcactgaagctgcccttcaatgcattagagaaaagatggacgtcattgatttggaagacgactctattgatgctgagatactgaactcaatggcagtctcgaatgaacatttccaaacagctcttggaacaagcaacccatctgctttgcgtgagactgttgtggaagttcccaattgcagctgggatgatattggaggtctcgagaacgttaagcgtgagcttcaagagactgtccaatatcctgtggagcaccccgagaaattcgagaaatttggaatgtcaccctcaaaaggagttcttttctatggtcctcctggatgtggtaagacccttcttgctaaggctatcgcaaacgagtgtcaagccaacttcatcagcatcaaaggaccagaattgcttacaatgtggttcggtgagagtgaagccaatgttcgtgaaatcttcgacaaggcccgtgggtctgcaccgtgtgtcctcttctttgatgaacttgattccattgcaactcagagaggaagtagctctggagatgcaggcggtgctgctgaccgtgttctaaatcagctgttgaccgaaatggatggaatgtctgccaaaaagacagttttcattattggagccaccaatagaccagatatcattgaccctgctctgcttcgtccagggcgtcttgatcaactaatttatatcccattaccagatgaggactcacgtcaccaaatcttcaaggcagcaatgaggaagtctccggttgcaaaggatgttgatttgagagctctagccaaatatacacaaggctttagtggggctgatattactgagatatgccaacgtgcgtgcaagtatgcaatcagggagaacatcgagaaggacatcgagagggaaagaaggagaaatgagaatcccgactctatggatgaggatgaagatgaagttgcagagatcaaggcagctcactttgaggaatccatgaagtatgctcgcagaagtgtgagtgatgctgacatcaggaaataccaggcgtttgctcagactttgcagcagtctcgtggattcgggtcggaattccggttcacagaatcttcatctggtgcggctgccgctgcctctgacccatttgccgcctcagctggtggagctgatgatgatgacttatatagttagatctttattatttatgttaaagtcatgacttgtgggattatatatttataacctgaaacagttgccgatcaactgcttccttttaaaccttttgtaatggatttggtttgacgcttatggtgtcgaacttgtaactatgtttggattcggcatgcaagtccgttgtgaacgaaaaaaaaaaaaaaaaacaatgtcggatctagaattagagacacg

SEQ ID NO: 7416 - DNA, 2858 bp, Aristolochia fimbriata
gtcgagaacttcaaattgtaccaggaggaaaactggtttcgtccaactcttctcccctttataaataaggcctttcggcacagtttcagttcgcgaacctctcagattcacgaattcgttccctagatactgcgaaaccctagcaatggcggacaagggtcaggcgtcctcgtcggaatccaaaggaaagaaggattttagtactgctattctggaacgcaaaaagtcgcccaatcgtcttattgttgatgaagctgtcaacgatgacaattctgttgtgtcgatgaatcctgcgacaatggataaactgcaatttttccgtggagacacgatacttataaaaggaaagaaaaggagggacactgtttgtattgttctagttgacgatcaatgtgaagagcccaaaattaggatgaacaaagttgtccgttcaaatcttagggtacggcttggagatgttgtgtctgttcatcagtgtccagatgtgaagtatgggaagcgagttcacattctcccaatcgatgatactattgagggtgtcactggcaatctttttgatgtttatttgaaaccatactttttggagtcttatcgacctgttcgtaaaggtgaccttttccttgtcagaggaggcatgcgtagtgttgagtttaaagttcttgagacagatcctggggagtactgtgttgttgccccagatacagagatcttttgtgaaggtgaacctgtaaagcgtgaagatgaagaaagattgaatgaagttggttatgatgatgtaggtggggttagaaaacaaatggctcaaattcgtgaattggtcgaacttcctcttaggcacccacagcttttcaagtccattggtgtgaagcctcccaagggtatcttactttatggtcctcctggttctggcaaaaccttgattgccagagcagttgctaatgaaactggggctttcttcttcctgatcaatggaccggaaatcatgtcaaagttagctggagaaagtgagagtaatttgagaaaggcttttgaggaagctgagaagaatgcaccttcaattatctttatagatgaaatagattctattgctccaaaaagagaaaagacacatggtgaagtggagagacgcattgtgtcccagcttttgactttgatggatggtctcaaatcccgtgcccatgttattgtcatgggagccaccaacaggccaaacagcattgaccctgcactaaggagatttggaaggtttgatcgagaaattgatattggtgttcctgatgaggttgggaggttggaagttctccgtatccacactaagaacatgaaacttgctgaagatgttgatcttgagagagttgcaaaagatactcacgggtacgttggagctgatctagctgcactatgtactgaggctgcccttcaatgcattagggagaagatggatgttattgaccttgaagatgagtcaattgatgcggaggttctcaactccatggctgtcacggatgaacacttcaagactgctttaggatcttctaatccttctgccttgcgtgaaacggttgttgaagtgcctaatgtgtcttgggatgatgttggtggattggaaaatgttaaaagagaactccaggagactgtacaatacccagtggagcaccctgagaagtttgagaaatttggtatgtcaccttctaaaggagtccttttctatggacctcctgggtgtggcaagaccctgcttgcaaaggccattgcaaacgagtgccaagccaatttcatcagtgtcaagggtcctgaactgttgacgatgtggttcggagaaagtgaagctaacgtcagggagatatttgataaagcacgtggatctgctccttgtgttctcttttttgatgaattggattcgattgctactcagcgtgggagctcggttggagatgctggtggtgccgctgacagggttttgaaccagctcctgacggaaatggatggcatgacagctaagaagacggtatttataattggagcaacaaataggccagacatcatcgacccagcactattaaggcctggtagattagatcaattgatttacataccgttgccagatgaggcttcccggttgcagattttcaaagcctgcttacgcaagtcgcctgtctccaaggatgtagatcttgccgctttggctaagtatactcatggattcagtggtgctgatatcactgaaatatgccaacgtgcctgcaaatatgccattcgagaaaatatcgagaaggatatcgagagggaaaggaagaggagagataatcctgaagccatggaggaagatgagacagacgatgtcccagagatcaaggcagctcacttcgaggaatccatgaaatatgcgcgtcgtagtgtaagtgatgctgatatccgaaagtatcaactgtttgctcaaactttgcagcagtctcgtgggtttggatccgagttccggttcccagataggccagaaaatgccgaggcgaccactgctgccgatcctttttcctctactacggctgcagaagacgatgatctgtacaattaagagtctggcttaagaaactcgatatggagatacagttcgtttcttcacaaattgatgttttttctttattagggaatactaatagaaacgagatcttggggggaacccctaatcttacatacgcttattattgtttcctttgggtgcgttagaaggttatgctactctaccctgcaattatcctcccaatgctttgtgtggaatgagctaattatggttgatgatgtgctctggactctaccaaagagacagaacttatactctgcttcaatagtttcgttttatc

SEQ ID NO: 7417 - DNA, 2666 bp, Arnica chamissonis
attctccatcaccgtcggatttcttctccacatcggagcatccaatctccgtcgtcctgatatgagcaatcaaccggagtcttcttcatcggatcctaaaggcccaaagaaggacttttcaactgctatcttggagcgcaagaagtctccgaaccggcttgtcattgacgaagcggtcaatgacgataactcagtcgtcgcgatgcaccctgatacaatggaaaagctgcagctgttccgcggtgataccatactgatcaaggggaagaaaagaagagatacagtttgtatcgctcttgctgatgaaacttgtgatgaaccaaaaatcagaatgaacaaggtcattagaacaaaccttagggttcggcttggagatgttgtatctgtgcaccagtgcccagatgtaaaatatggcaaacgaatccatgttcttcctctagatgacaccattgaaggtgtaaccggtgacttattcgatgcataccttaaaccctactttttggaagcataccgacccgttaggaaaggggatcattttcttgttagaggggggatgagaagtgtcgagtttaaagtgattgaaaccgacccaggagagtactgtgtcgttgctccagacactgaaatcttttgtgaaggcgagccgattaagagggatgacgaggatcggttagatgaaattggttatgatgatgtaggcggggtgcggaaacaaatggcccagatccgtgaattggttgaattaccattaagacaccctcaactcttcaaatcaattggagttaaaccacctaaaggtatcctactctatggaccgcccggttctggaaaaacacttatagcaagagctgtagccaatgaaaccggagcgttctttttctgcattaacggcccagaaattatgtcaaaattagctggagaaagtgagagtaatctcaggaaggcgtttgaggaagctgaaaagaatgcaccatcgattatttttattgatgaaattgactcgattgctcctaaaagagagaaaactaatggtgaagttgagagaaggattgtttcgcagttattaacacttatggatggattaaaatctcgtgcccatgttattgtaatgggggctactaatcgtccaaacagtattgatcctgctttgagaaggtttggtaggtttgatagggagattgatattggtgtccctgatgaagttgggcgtcttgaggttattcgtattcacacaaaaaacatgaaactttctgatgatgtcgatctggaaaggatagctaaagaaacacatggttatgttggtgctgacctggcagcactctgcactgaggctgcacttcaatgcattagagaaaaaatggatgttattgatttggaagatgaatccattgatgctgagatactgaattccatggcagtttcaaatgaacattttcagacagctcttggaacaagcaacccgtctgcattgcgtgaaactgttgtggaggttcctaatgtcagctgggaggatattggtggtcttgaaaatgttaagcgtgagctgcaagagactgtccaatatcctgtggagcacccggagaaatttgagaaatttggcatgtcaccatcaaaaggtgttcttttctatggcccgcctggatgtggcaaaacacttttagctaaagctattgctaacgagtgtcaagccaacttcattagcatcaaagggcccgaattacttacaatgtggttcggtgagagtgaagccaatgttcgtgagattttcgacaaggcccgtggatccgcaccgtgtgttctcttcttcgatgaactcgattctattgcaactcagaggggaagtagttctggggatggaggtggtgctgctgaccgggttttaaatcagttattgacagaaatggatggaatgtccgctaagaaaacggtttttataatcggagctactaatagacccgatatcattgatccagctctactccgtcccgggcggcttgatcaacttatttatattccactacctgacgaggactctcgccaccagattttcaaggcggcagtgaggaagtccccggtttccaaggatgttgatttgagagctttagctaaatacacacaaggctttagtggagccgatattacagagatatgtcaacgcgcgtgcaagtatgcaatcagagagaacattgagaaagatatagagaaggaaagaaagagaagtgcgaatcctgactctatggaagaggatgaagacgaggtagcggagatcaaggcggcccactttgaggaatccatgaaatatgcacgcagaagtgtgagtgatgctgacataaggaaataccaggcgtttgctcagacattgcagcagtcaagaggattcgggtctgagtttcgcttccctgaagcggcgtctggggcggcagctggtggtggttctgacccgtttgcggcctccgctggtggagctgatgatgatgacttatacaactagatttacataaatcatgttgtttaaaatgtacaaaagacatgaaggattatatattcatatcgtatacctgttccggatttatcgcttcatttcaatcttttcttatgaatatggtgacacacttctgttgtggaaacttgtaactacattacatgttttaaatttggatttggaa

SEQ ID NO: 7418 - DNA, 2826 bp, Orobanche aegyptiaca
tcgtgtctatatatatacatgaataacgtgtgaaaatagtattatttatttttctacaactcactgttatccctttcttctcccaaacgaaagcacatcacctatctcgaacctcagaatttaagatcgccggagatatgagtcacccagctgagtcgtctgatccgaaaagtgggaagaaggacttctctaccgctattttggagaggaaaaaggctgctaatcgtctcatcgttgatgaggcggtcaacgacgacaactccgtcgtcgccctccatccaaccaccatggaaaagctccagcttttccgtggtgacactattttgattaaggggaagaaaagaaaggacactgtgtgcattgcccttgctgatgatacatctgaagagccaaagattagaatgaacaaggttgtcaggtcaaatctgagggttcggctaggggatgttgtgtctgtgcaccagtgcccagatgttaaatatggaaaacgtgttcacatactgcccttggatgatacaatagaaggcctcactggggatctttttgatgcatatctcaaaccatactttctggaggcatatcgccctgtgaggaaaggagaccattttctagtgagaggtgggatgagaagtgtggaattcaaagtcgttgagactgacccgggggagtattgtgttgtggccccagatactgagatcttttgtgaaggggaacccgtaaggagagaggatgaggataggctggacgaggttggctatgatgatgtgggtggtgttagaaagcagatggctcagattcgtgagctggtagagttgccattgaggcatcctcagctttttaaatctattggtgtgaaacctcccaaaggaattttactctacggcccccctggttctggaaagacattgatcgctcgagctgttgctaatgaaactggtgcttttttctttttgattaatgggccagaaatcatgtctaaattggctggagagagtgaaagcaatctgcgcaaggcatttgaggaggctgagaagaatgctccatccattatttttattgatgaaatcgattcaattgcacctaagcgagagaaaacgcatggagaagttgagaggagaattgtttctcagcttttgactctaatggacgggttgaaatctcgtgctcatgtcattgttatgggggcaaccaaccggccaaacagtattgatccggctcttagaaggtttggtaggtttgacagggaaatcgatattggggttcctgatgaagtgggacgccttgaagttattaggattcataccaagaacatgaagctttctgatgatgttgatttggaaagaatagcaaaagacactcatggttatgttggtgctgaccttgcagctctctgcactgaagctgctctccagtgtattagagagaaaatggatgtgattgatttggatgatgataccattgatgctgagatactcaactccatggccgtctcaaatgagcacttccacactgctcttggcacaagcaatccttctgccttgcgggagacggttgttgaagtgcccaacgtctcttggcaagatattggaggacttgaaaatgtcaagagggagcttcaggagactgttcaatatcccgtggaacatccggagaagtttgagaaattcggtatgtcaccttcaaagggtgttcttttctatggtcctcctggatgtggtaaaactctacttgccaaggcgattgcaaatgaatgtcaagccaactttattagtgtaaaaggacctgaactgcttaccatgtggtttggagagagtgaagccaatgtccgtgaaatatttgacaaggctcgtcaatctgctccatgtgttctcttctttgacgagctcgactctattgctacccagagaggaagcagtgttggagatgctggtggtgccgctgaccgagttctgaaccagcttttgactgaaatggatggcatgaatgcgaagaagactgttttcataatcggggccactaacaggcccgacataatcgatcctgcacttcttcgtccaggtcgtcttgatcagttgatttatatccctctgccagatggagactctcgtcatcaaatcttcaaagcatgtctccgtaaatctccactttctaaagatgtcgatctgcgtgctcttgccgattacactcaaggatttagtggtgcagatattaccgaaatatgtcagcgggcttgcaaatatgctataagagagaacatcgagaaagacatggaaagggagagaaggagaagggacaatcccgactcgatggatgaggatgctgacgatgacgtgtcggaaatcaagcccgcacattttgaggagtcgatgaaatatgctcgtagaagtgtgagtgatgctgatatacgcaagtaccaggcttttgcacagaccttgcagcagtcgcgtggattcgggactgaattccgatttcctgagtcagcagctggtggggcttcaggatccaacccgttttcagcccctgtgggtggtgctgacgaagacgatttgtatagttagtgtttccagtattcagcagctcctggttttaaagatgttactgttacctaattacttgttatagtccttaagattattcctacttttgtgattgtaggatttgagtctgcattttctttggccaatttccatcttgtgatgtgtttatctattttgtacttctattgttgatcaatcagttaagagtactgttgttgaaagcctgaaactaatcctaatatactcattgtgaaataggtccgctggtattggatgttattttacaacc

SEQ ID NO: 7419 - DNA, 2452 bp, Eutrema halophilum
atttcatcaataaccatgtcaaaccaaactgaatcttccgactccaaaccatcgaagaaagatctcagcacagctattcttgagaagaagaagtcaccaaaccggctcgttgtagacgaagccatcaacgatgacaactctctcgtctctctccacccttccaccatggaaaagctcaattttttcaatggcgatacgattctcatcaagggcaagaaaaggaaagacacagtctgcattgctctttccgatgaatcatgtgaggaaccaaagatcagaatgaacaaagtcgtaaggtccagcttaagggttagactcggagacgttgtctctgttaaccaatgtccagacatcaagtatggaaaacgtgtccacatcttgccggttgatgataccatacaaggtgttaccggaaacctcttcgacgcttacttaaaaccttacttcctcgggacttaccgtccggtgaggaaaggtgatctgttcctagtgagaggaggaatgagaagtgtggagtttaaagtcatcgagattgatcctcctggtgagtattgtgtggtggctccagatacagagattttctgtgaaggtgaaccaataaagagagaagaagaagaaaggcttgatgaaatcggttatgatgatgttggtggagtcaggaaacagatggctcagattagagagcttgttgagcttcctttgagacatccacaactgttcaagaccatcggtgtaaagccaccaaagggtatcttgctttatggacctcccgggtcaggaaagactttgattgcccgtgcggtggctaacgagacaggagcgtttttcttctgtattaacggaccagagatcatgtctaagatggctggtaagagtgagagcaatttaaggaatgcatttgaggaggcagagaagaacgctccttctattatattcattgatgagattgactctattgcaccaaagagagacaagactaatggagagattgagaaaaggattgtctctcagcttctcacgcttatggacgggttgaaatctcgtgcacatgttatcgtcatgggagctacgaaccggcccaatagtatcgacccggctttgagaaggtttgggagattcgacagggagattgatattggtgtccctgatgaaaccggacgtcttgaagttgttaggatccataccaagaacatgaagctagctgaagatgtggatcttgaaagaatctccaagaacacacatggatacgttggtgctgatcttgcagctctatgcactgaagctgctcttcaatgtataagagagaagatggatgtgattgacttggaagatgactctatcgacgctgagattctcaactccatggctgtgactaatgaacacttcaacactgctcttggaaacagcaacccatccgcgcttcgtgaaaccgttgtggaggttccaaatgtgtcatgggaggatattggaggtcttgagaatgttaaaagagagctacaagagactgttcaataccctgtggagcatcccgagaagtttgaaaaattcggtatgtctccatcaaagggagttcttttctacggtccacctggttgtggaaaaacccttttagccaaagctatagccaacgagtgccaagcaaacttcatcagcgtcaagggacctgagctactcacgatgtggtttggagaaagcgaggctaacgtcagagaaatcttcgacaaagctcgtcagtccgcgccttgtgttctgttctttgacgagctagactccattgcaactcagagaggaagcagtgttggcgacgcaggaggtgcagcggatagagtcttgaatcagctcttgacggagatggatggtatgaatgcgaagaagacggtgtttatcatcggagcaactaacagacctgacattattgatccagctctgcttcgaccaggaagactagaccagctaatctacattcctttacctgatgaagattctcgtctcaacatcttcaagtcttgcttgaggaagtctcctgtttctaaagacgtggacttgaccgtgctagctaagtacactcgtggattcagtggtgcggatatcactgagatttgccagagagcttgcaagtacgccattagagagaacatcgagaatgatattgagaagcagcgtagaagtagagatggtctagaggccatggaggaagatgaagttgcggagattagaggtgctcatttcgaagagtcgatgaagtttgcaaggaggagtgtgagtgatgctgatataagaaagtatcaagcttttgctcagacgctgcaacagtcaagagggtttggaactgagttcagatttgacccaagcacgggtactggacggaccactggtggtgcagccactgatccctttgcaatttctgcagctgctgccaatgacgacgatctttacagttaggttatgattt

SEQ ID NO: 7420 - DNA, 2757 bp, Setaria italica
gttcgggtccccaaacacacgcaaatatctgtcgccgtctcgcctctctcggcagcagcaccaaccgcctcgtcgaattcgaccgccatggcgagccagggcgagccgtcgtcctccgatccgaaggggaagaaggatttctcgacggcgatcctcgagaggaagaagtcgccgaaccggctggtggtcgacgaggccaccaatgatgacaactccgtcgtcgcgttgcacccggacaccatggagcgcctccagctcttccgcggtgacactgtcctgctcaagggtaagaagagaaaggacactatctgcattgtgcttgcagatgacacgtgtgaggagccaaagatccggatgaacaaggttgtcaggaagaacttgagggtacgacttggtgatgtgatttctgtccatcaatgcccagatgtcaaatacgggaagcgtgttcacatacttccaattgatgacacggttgaaggcattaccggcaacttatttgatgccttcctgaaaccatacttccttgaagcctatcgtcccgtgaggaaatcggaccttttccttgtgaggggtggtatgagaagtgtagaattcaaagttatagagactgacccaacagagtattgtatcgttgcaccggatacagagttattctgtgaaggtgagcctattaagagggaggatgaggaaagactcgatgaggtcggctatgatgatgttggtggagttaggaagcaaatggcccaaatcagagagctggttgaactcccactgcgccacccccagcttttcaagtctattggcgtgaagccaccaaagggcatattgctgtttggaccacctggctctggcaagactcttattgctagagctgtagctaatgagacaggtgctttcttctttctgatcaatggaccggaaatcatgtcaaagcttgcaggagaaagtgagagcaatctcagaaaggcatttgaagaagctgagaagaatgcaccttccatcatttttattgatgagatagattccatagcacctaagagggagaagacccatggagaagttgagaggcgtattgtttcacagcttttgactctcatggatggcctcaagtctcgtgcacatgttattgttatgggtgccacaaaccgtccaaacagtatcgatgctgctcttagaaggtttggtaggtttgaccgtgagattgatattggtgttccggatgaagttgggcgccttgaggttctccggattcataccaaaaacatgaagctgtctgaagatgttgacttggagcacattgcaaaggatacccatggttatgttggtgctgatcttgctgccctttgtactgaggctgctcttcagtgcattcgtgagaagatggatattatagatcttgatgatgagaccatagatgctgagatactcaactctatgtctgtctcaaatgatcatttcaagactgcacttgggacgagcaacccgtctgccctgcgtgaaacagtagttgaagttccaaatgtctcttgggatgatattggtggcctggagaatgtcaagagggagcttcaagagactgttcaatatccagtggagcatccagagaaattcgagaagtttggcatgtctccctcaaagggtgttctgttttacggccctcctggctgtggaaagactttgttggccaaggcgattgctaatgagtgccaggctaacttcatcagtgtgaagggacctgagctgcttaccatgtggtttggtgagagtgaggccaatgtccgagagatctttgacaaggctaggcagtctgctccttgtgtcctcttcttcgacgagcttgactccattgctactcagagaggaagcagtgttggtgatgctggaggtgctgctgatagagtgttgaaccagctgctgactgagatggatggcatgaacgccaagaagactgttttcattatcggtgccaccaacagaccagacatcattgaccctgctttgctgaggccagggcgtctggatcagcttatctacattcctctgcctgatgagcaatccaggctccagatcttcaaagcctgcctcaggaagtctcctgtggctaaggatgttgacttgaacgcccttgccaaatacacccagggattcagcggcgcagatatcactgagatctgccagcgtgcgtgcaagtatgccatcagggagaacatcgagaaggatattgagatggagaggcgtaggaaggacgaccccgaggccatggaggaagacgaggtggatgaaattgctgagatcagggctgttcacttcgaggagtcgatgaagtatgcgcgccggagcgtgagcgacgccgacatccgcaagtaccaagccttcgcccagaccctccagcagtctcgcgggttcggcagcgagttccggttccccgaccaaccgacggcagcggcggccgaccccttcgcagcccctgcagctgcagctgacgatgatgatctatacagttaactagcagttatgctgtgacataacttatatatatgcttatatggtatgctaaactcatcgtatgcaaggcacgggagaggatgtacttactttttaagtaatgtattttgctagatacctaaatcgtgtcgtctatttgaatgcttgcctggtgccgtgctgtgtcatctacttgcatgcttgcctggtgccgtgctgtctgttattttgagatgatcaaagattgcaggacaagacacttgtctagtgaaa

SEQ ID NO: 7421 - DNA, 2803 bp, Setaria italica
aagaaagaaagctataaaggcaaactaatcccctcgcgtcctcctcagttcgggtccccaaacacacgcaaatatctgtcgccgtctcgcctctctcggcagcagcaccaaccgcctcgtcgaattcgaccgccatggcgagccagggcgagccgtcgtcctccgatccgaaggggaagaaggatttctcgacggcgatcctcgagaggaagaagtcgccgaaccggctggtggtcgacgaggccaccaatgatgacaactccgtcgtcgcgttgcacccggacaccatggagcgcctccagctcttccgcggtgacactgtcctgctcaagggtaagaagagaaaggacactatctgcattgtgcttgcagatgacacgtgtgaggagccaaagatccggatgaacaaggttgtcaggaagaacttgagggtacgacttggtgatgtgatttctgtccatcaatgcccagatgtcaaatacgggaagcgtgttcacatacttccaattgatgacacggttgaaggcattaccggcaacttatttgatgccttcctgaaaccatacttccttgaagcctatcgtcccgtgaggaaatcggaccttttccttgtgaggggtggtatgagaagtgtagaattcaaagttatagagactgacccaacagagtattgtatcgttgcaccggatacagagttattctgtgaaggtgagcctattaagagggaggatgaggaaagactcgatgaggtcggctatgatgatgttggtggagttaggaagcaaatggcccaaatcagagagctggttgaactcccactgcgccacccccagcttttcaagtctattggcgtgaagccaccaaagggcatattgctgtttggaccacctggctctggcaagactcttattgctagagctgtagctaatgagacaggtgctttcttctttctgatcaatggaccggaaatcatgtcaaagcttgcaggagaaagtgagagcaatctcagaaaggcatttgaagaagctgagaagaatgcaccttccatcatttttattgatgagatagattccatagcacctaagagggagaagacccatggagaagttgagaggcgtattgtttcacagcttttgactctcatggatggcctcaagtctcgtgcacatgttattgttatgggtgccacaaaccgtccaaacagtatcgatgctgctcttagaaggtttggtaggtttgaccgtgagattgatattggtgttccggatgaagttgggcgccttgaggttctccggattcataccaaaaacatgaagctgtctgaagatgttgacttggagcacattgcaaaggatacccatggttatgttggtgctgatcttgctgccctttgtactgaggctgctcttcagtgcattcgtgagaagatggatattatagatcttgatgatgagaccatagatgctgagatactcaactctatgtctgtctcaaatgatcatttcaagactgcacttgggacgagcaacccgtctgccctgcgtgaaacagtagttgaagttccaaatgtctcttgggatgatattggtggcctggagaatgtcaagagggagcttcaagagactgttcaatatccagtggagcatccagagaaattcgagaagtttggcatgtctccctcaaagggtgttctgttttacggccctcctggctgtggaaagactttgttggccaaggcgattgctaatgagtgccaggctaacttcatcagtgtgaagggacctgagctgcttaccatgtggtttggtgagagtgaggccaatgtccgagagatctttgacaaggctaggcagtctgctccttgtgtcctcttcttcgacgagcttgactccattgctactcagagaggaagcagtgttggtgatgctggaggtgctgctgatagagtgttgaaccagctgctgactgagatggatggcatgaacgccaagaagactgttttcattatcggtgccaccaacagaccagacatcattgaccctgctttgctgaggccagggcgtctggatcagcttatctacattcctctgcctgatgagcaatccaggctccagatcttcaaagcctgcctcaggaagtctcctgtggctaaggatgttgacttgaacgcccttgccaaatacacccagggattcagcggcgcagatatcactgagatctgccagcgtgcgtgcaagtatgccatcagggagaacatcgagaaggatattgagatggagaggcgtaggaaggacgaccccgaggccatggaggaagacgaggtggatgaaattgctgagatcagggctgttcacttcgaggagtcgatgaagtatgcgcgccggagcgtgagcgacgccgacatccgcaagtaccaagccttcgcccagaccctccagcagtctcgcgggttcggcagcgagttccggttccccgaccaaccgacggcagcggcggccgaccccttcgcagcccctgcagctgcagctgacgatgatgatctatacagttaactagcagttatgctgtgacataacttatatatatgcttatatggtatgctaaactcatcgtatgcaaggcacgggagaggatgtacttactttttaagtaatgtattttgctagatacctaaatcgtgtcgtctatttgaatgcttgcctggtgccgtgctgtgtcatctacttgcatgcttgcctggtgccgtgctgtgtctgttattttgagatgatcaaagattgcaggacaagacacttgtctagtg

SEQ ID NO: 7422 - DNA, 2988 bp, Aristolochia fimbriata
cagtgagaatttacttttcgcgtttagactttagaatacttctcttgttcgtctgcgattagcaaagtataaactacaaagaaaaaggaattattttcttcgccaacaagtaagtaatatctccttgggaaggtataaatctgtctcggccatcgacccgtctaccccatctaccactcggatcgcttccgcttcttggttctgcaatctggtgtcgtactctctgcgaaagtttgttcgacatgacgaatcaagctgaatcctccgattcgaaagggacgaagcgggacttcagtaccgcaattcttgagagaaagaaggcgccgaatcgtttggtcgttgacgaggcggtcaatgatgataattctgtggtttctttgaacccggagacaatggagaagttgcagctcttccggggagacactattctcctgaaggggaagaaaaggcgggacactgtatgtattgcgcttgctgatgatacatgcgatgaaccaaaaatcagaatgaacaaagtggtaagatcgaatcttcgggtcaggctcggtgatgtagtctctgtgcatcaatgcccagatgtgaaatatgggaagagggtgcacattctccctgtcgatgacaccgttgaaggagttactgggaacttgtttgatgcatatttgaaaccatatttcctcgaggcctacagacctgtcaggaaaggtgatctctttcttgttcgaggtggaatgagaagtgtcgagtttaaaattattgaaacggatcctactgagtattgtgtggtttctcctgacaccgagatcttctgtgagggggagcctgtgagaagggaggatgaggatcggttggatgaagtgggctatgatgatgttggtggggtcaggaagcagatggcccagattcgagaactagttgagcttccacttaggcacccccaacttttcaaatccattggtgtcaaacctccaaagggaattcttctttatggtccccctgggtctggcaagacacttattgctcgggctgtagctaatgaaacaggagcatttttcttctgtataaatggccctgagattatgagcaaattggctggagaaagtgaaagcaatcttaggaaggcttttgaagaagcagagaagaatgctccttccattatatttattgatgagattgattccatagctcctaagcgagagaagacccatggagaagtggaaagacgcattgtttctcagctcttgacacttatggacggtttaaagtcaagggcccatgtcatcgttattggggccacaaacaggccaaacagcattgacccggctcttagaaggtttggaaggtttgacagggagattgatattggagtgccagatgaggttgggcgtcttgaggttcttcgcattcacaccaaaaatatgaaactctctgaagatgttgatcttgagaagattgcgaagaacactcatgggtatgtgggagctgatcttgcagccctctgcactgaggcggcgctacagtgcatccgagaaaaaatggatgtgattgacttggaagatgaaactatagatgctgaaatacttaattcaatggctgtaactgatgagcactttaagactgctcttggcaccagcaatccttctgctcttcgtgaaactgttgttgaagtacccaatgttacctgggaagatgttggtggacttgaaaatgtcaagagagagcttcaagagactgtgcaatatcctgtggagcatccggaaaagtttgagaagtttggtatgtcaccctccaaaggagtattgttttatggccctccaggatgtgggaaaaccctactggcgaaagcaattgcaaatgagtgccagtccaacttcatcagcatcaagggcccggagcttctcactatgtggtttggagaaagtgaagccaatgtgcgtgaaatctttgacaaagctcgccaatctgcaccatgtgtgcttttctttgatgagctggactctattgcaactcagcgaggcagcagtgcgggagatgctggtggtgctgctgacagagttttgaatcagcttcttactgagatggatggaatgtcagcaaaaaagacagttttcattattggggctaccaacaggccagatataattgatccagctttgctgaggccaggacgtttagatcagctgatctacattcctctgcctgatgagagctctcgacatcagatcttcaaaacctgcttgaggaagtctcctgtttcaaaagatgttgatttgagagctctggccaagtatactcaaggttttagtggtgcagatatcacagaaatctgtcaacgtgcttgcaagtatgctataagagagaatattgaaaaggatattgagagggaaaggagaaggaacgagaacccggaggcaatggaggaagatgatgctgaggaggttgctgagataaaggccagtcactttgaagagtccatgaagtttgcaagacggagtgtcagcgatgctgacatccgcaaataccaggcattcgcgcagaccttgcagcagtcgaggggattcggaacagagtttcgctttgccgaaaggtccgaggcaccaggaggttctacagcttctgatccttttgcatccaatgctggagccgaagatgatgatttgtatagttagtatagttttacttagtgtagtcacttctataaactataaactctttcagtacactataagacaatctgttgcgcctgctaagaacaatgtaatgtgctgtggcatagaccatgtccgtgtccgtggctactggccggattttggaagattatcagagagaactaggagggagcaggcgttttatcaaactatgaactctgttttgtattgggtaagctcaaaaaagtcgccggtgtgggtttgtaatgtatagttgttgattttgtgtctcttaataccacccagcgggattgaaagcgtgattgaattagaagattattgt

SEQ ID NO: 7423 - DNA, 2632 bp, Artemisia annua
atggctgctaatcaacccgaatcatccgattctaagggcaccaagcgtgacttcagtacagcgattctggaacgtaagaaggcacctaataggctagtagttgatgaagctgttaatgacgataactctgttgtagctatacatcctgatacaatggaaaagcttcagctttttagaggcgatacaatcttactcaagggtaagaaaaggaaagacaccatctgtattgctcttgctgatgaaacatgtgaggagccaaaaatcagaatgaacaaggttgtcagggctaacctgagggttaggcttggtgatgtggtctctgttcatcaatgtgctgatgtcaagtatgggaagcgtgttcacatccttccagttgatgacacaatcgaagggatgactggcaatctctttgatgcttacttgaaaccttacttcatggaggcataccgacctgtgaggaagggtgacttctttcttgtgaggggaggaatgaggagtgttgagtttaaagttatagaaaccgaccctgctgaatattgtgtcgttgcacccgacactgagattttctgtgaaggtgagcccatcagaagggaggatgaggatagactagacgagatcggttatgatgatgttggtggggtccgcaaacagatggcacaaatccgtgagctagtggagcttccattgagacatccacagctcttcaagtcgattggtgttaaaccaccaaagggaattcttctttacgggcctcctggatctgggaagactttgatagcccgtgcagttgctaacgagactggtgctttctttttctgcatcaacggtccagaaatcatgtcaaagttggctggtgagagtgagagcaatctcagaaaagcttttgaggaagccgagaagaatgctccatccatcatctttattgatgaaatcgactcaattgctcccaagcgtgagaaaacaaacggtgaagtcgaaaggaggattgtgtcacagcttttgactctcatggacggcttaaaatctcgtgctcatgttattgtcatgggtgcaaccaaccgtcctaacagcattgacccagctttaagacgttttggtaggtttgaccgtgaaatcgatattggagttccggatgaagttggtcgtcttgaggttcttcgtatccataccaagaacatgaagctgtctgatgacgtaaacttggaaaagatttccaaggagacacatggatacgttggtgcagatcttgctgctttgtgtacagagtctgcactccaatgtatccgtgagaagatggatgtgattgatttggaagacgagaccattgatgctgaaattctcaactcaatgttcgtgactaacgagcacttccaaactgcacttaccaccagtaacccatcagctcttcgtgagacggttattgaagttcctaatgtcagttgggaagatattggtggccttgagaatgttaaaagagagctccaagagactgttcaatatccagtggagcatcctgaaaagttcgagaagtttgggatgtcaccatctagaggagttctcttctacggtccaccagggtgtgggaaaacacttttggccaaggctattgccagtgaatgccaagcaaacttcatcagtatcaagggtccagaattgcttacaatgtggttcggagagagtgaggccaatgttcgtgagatcttcgacaaggctcgtggttctgctccttgcgtcctgttttttgatgaacttgactccattgctacccagagaggaagtagtcaaggagatgctggaggtgcagccgatagagttttgaatcaacttctaactgagatggacggtatgtcagccaagaagaccgtgttcattattggtgctaccaacaggcctgatatcatcgatcctgcacttttgaggcctggtcgtcttgatcagttgatatacatccctctacctgacgagggctctcgttactcgatcttcaagtcagcattaagaaagtctccagttgccaaagatgtcgatcttcatgctcttgccaagtacacccagggtttcagtggtgctgatatcactgaaatctgccaacgtgcatgcaaatatgccattcgtgaaaacatcgaaaaggatattgagcgagaaaagagaagaagcgagaaccccgaggcaatggaggaggacgtggaagatgaggtgccagagatcaaggctgcacactttgaagagtcgatgaagtttgcgcgcaggagtgtcagcgatggtgacatccgtaagtaccaggcgtttgctcaaacactacagcagtccagagggtttggttccgagttcaagtttgcagagacgagtagtgctgctgctactggtggctcggacccttttgctgctcctgcaggcgcagccgatgatgatgatctctataactagttttccattaattttatctgcatttcgtactctttatgtcattaaaatattctctttttgaacttatgtaatttatgtaactttatggtatcgccattcataagacttatttcctaatagaagaaaaacgtttcacgaaaaaaaaaaaaaaaaacaatgtcggatctagaatagtactccgacggggatcacattctagaaaaat

SEQ ID NO: 7424 - DNA, 2727 bp, Cedrus atlantica
catatccttagaatcactagcatttgtgcagccatgtcgcacaagggagaatcttcagagccgaaaggaaccaagagggattacagcactgctattttggagcggaagaaggctgccaatcgtcttgttgtcgatgaggccattaacgatgataactccgtggtctgtctgcatccggacaccatggaaaattaacagctcttccgcggagatacaattcttatcaagggcaaaaagagaaaggatacgatttgtatcgctctcgccgacgagacgtgcgaagagcccaggattagaatgaacaaggttgtgcgttcgaatctgagggttcggctcggtgatgttgtttcggttcaccagtgccctgatgtaaagtacggcaagcgtgtacatatcctgcctattgatgacaccatcgagggagttaccgggaatttattcgatgcttatttaaagccctatttcatggaggcgtatcgccctgtaaggaaaggagaccttttccttgttagaggtggaatgcgcagtgtagagttcaaagtaattgaaacagaccctggggaatattgtgttgtttctcctgatactgagatcttttgtgagggagagcctgtaaagcgggaggatgaagatagattggatgaagttggttatgatgatgttggtggtgtaaggaggcaaatggcccagattcgtgaattggttgagcttccacttaggcatccacagctgttcaaatcaattggtgtgaagccaccaaagggtattttgctatttggaccacctggttctggaaaaactttaattgctagggcagtagccaatgaaactggtgctttctttttcttaattaatgggcctgaaatcatgtcaaagttggctggggaaagtgaaagcaatctaaggaaagcatttgaggaggctgagaagaatgccccatcgatcatttttattgatgaaattgattctatagcacccaaaagagaaaagacacatggtgaggttgagaggcgaattgtttctcaacttctgacactgatggatgggctaaaatctcgagcccatgttattgtgatcggagcaacaaaccggccaaatagtattgaccctgctcttagaaggtttggaaggtttgacagggaaattgatattggggttcctgatgaagtgggacggctggaggtccttcgtatccatacaaagaatatgaagcttgctgaagatgttgatcttgaacgaattgcaaaggatacgcatggatatgttggagctgatcttgcagctctttgcactgaggctgcgctacagtgcatcagggaaaaatggatgttattgacttagaagacgagactattgatgctgaaattcttaactctatggcagttaccaatgagcacttccagactgcgttgggctccagtaacccatctgccctgcgtgaaactgtggttgaggtgcccaatgtatcttgggaggacattggtggtttggaaaatgtcaagagggagcttcaagagactgttcaatatccagtggagcaccctgagaaatttgagaagtttggcatgtctccttcgaaaggagtgctcttctatgggccacctggttgtgggaagactctgcttgcaaaagccatcgctaacgagtgccaggccaatttcatcagtgttaaagggccagaattattaacaatgtggtttggagaaagtgaggctaatgttcgagagattttcgacaaagcccgacagtcagcgccatgtgttttgttctttgatgagcttgattctattgctacacagcgagggagtagtgtcggcgatgcaggtggtgctgcagacagagttctcaatcaattgttaacagagatggatgggatgacagccaagaaaactgttttcattattggggctacaaataggccagatatcattgatcctgcattgctaaggcccggtcggcttgaccagttactttacataccattacctgatgagagttcacgccaccagatttttaaagcttgcctgagaaagtcaccggtttccaaagatgttgatctggctgctttagcccgttatacccaaggatttagtggagctgatattacagaaatttgtcagagggcttgcaaatatgccattagagaaaacatcgagaaggatattgaacgtgaaaggaagagaaaagaaaatcctgaagctatggacgaggatgatagtgaggaggtctctgaaataaaagcagctcactttgaggagtccatgaaatttgcccgaagaagtgtcagtgacgccgatattaggaaatatcaagcatttgcacagacgctgcagcagtccagaggttttggttctgaattccgatttgcagacaggccggcggggacagcgggggctaccgcttcagatccattcactacagcagagaataaagatgacgatgacttgtatagttgataggctttgtagcattaacactgcctgactaaagtgggcacattaatcttcttctaggcgactaaagcctaatctgtgacacactgaaaagaatttaggaaggctgctctagagaaagagaagattgtcgatgctttggaaatctgctttttctttgacgcgtataaaccttttgttttaatattaattaatgtgtgtcccagtcttctaaacattttttgtccaattttcttttattattaccatatatactctctggtgaagctatgcc

SEQ ID NO: 7425 - DNA, 2741 bp, Panicum virgatum
attaacgccaccgccggccaacaacccgaaacctacctccgccgtcgtcgccgcaaccgccgccaacatggcgagccaaggggagccgtcggcctccgcttcggatccgaaggggaagaaagactactctacggcgattcttgagagaaagaagtcgccgaaccgcctggtcgttgatgaggccaccaacgacgacaactccgtcgtcgctctccacccggataccatggagaggctgcagctcttccgcggcgataccgtgctccttaagggtaagaagaggaaagacactatatgcattgtccttgcggatgaaacctgtgaggaaccaaaggttcggatgaacaaggttgtccgccagaacctgagggtgaggcttggtgatgtggtttccgtccatcagtgccaggatgtgaaatatgggaagcgtgtacacattcttccaattgatgatacagttgaaggcattacagggaacctgtttgatgtcttcttgaaaccatacttcctagaagcgtaccgtcctgtgaggaaaggagaccttttccttgtcaggggtggaatgagaagtgtggagttcaaagtaatagagactgatcctgctgagtattgcatcgttgccccagatactgaaatattttgtgatggggagcctattaagagggaggatgaggaacgccttgacgaagttggctatgatgatgtcggaggagtcagaaagcaaatggcccaaatcagggagcttgttgagcttcctctgcgccatcctcagcttttcaaatctattggtgtgaagccaccaaagggcatattgctgtatggaccacctggttctgggaagactcttattgcccgtgcggttgcaaatgagactggagcctttttctttcttatcaatggcccagagattatgtcaaagctagcaggtgagagtgagagcaatctcaggaaggcatttgaagaagcagaaaaaaatgctccatctattattttcattgatgaaattgattccattgctcccaagagagagaaaaccaatggagaagtggagcgtcgtattgtttcacagctgctgactcttatggacggactcaaagctcgttcccatgttattgttatgggtgctacaaacagaccgaacagcattgatcctgctcttcgaagatttggaaggtttgaccgggaaattgacatcggtgttcctgatgaagttggaaggcttgaggtcctccgcatccacacgaagaacatgaaacttgctgaggatgttaatttggaactcattgccaaggatacccatggatatgttggtgctgatcttgctgctctttgcactgaggctgctcttcagtgcattcgtgagaagatggacatcatagatcttgaggatgagactatagatgctgagatactgaactcgatggctgttacaaatgaccatttcaagactgcacttggaactagtaacccatctgctctccgtgaaactgttgttgaagttcctaatgtctcttgggaggatatcggtgggctggaaaacgtcaagagggagctccaggagactgtacaatatcctgttgagcacccagagaagtttgagaagtttggcatgtctccatccaaaggagttctgttctatggccctcctggttgtggtaagaccttgttggcaaaggcaattgccaatgagtgccaggccaacttcatcagtgtcaagggtcctgaattgcttaccatgtggtttggtgagagtgaagccaacgtccgtgaaattttcgacaaggctcgccaatctgctccctgtgtcctcttctttgatgaacttgactcgattgctactcagagaggtagcagtgttggtgatgctggaggtgcagctgatagagtactcaatcagctattgacagagatggacggcatgaatgctaagaaaaccgttttcattattggggctacaaacaggcctgatatcattgatccagctttgcttaggccagggcgtcttgaccagctgatctacattccactgcctgatgagcagtctaggctacagatcttcaaggcctgtctaaggaagtcccctgtggcgaaggaagtggacttgaatgctcttgctaagtacacccaagggttcagtggtgcagatatcactgaaatttgccagcgtgcagtcaaatatgccatcagagagaacattgagaaggacattgagagggaaaggcggagaaaggacaaccccgaggcaatggaggaggatgaagtggatgacattgctgaaatcaaggcagctcactttgaggagtccatgaagtatgcgcgccgcagtgtcagcgacgcagatatccgcaagtaccaggcgtttgcccagacgttgcagcagtcccgtggattcggcagtgagttccgcttctcggagcagtcaacgacagcagccaccacagctgcagctgatccttttgcatccactggtgcagccgatgatgacgatctatacagctaggtttcttgttgggttgttgctggttggttctggattgtgttcaatatcagtcgcttcagtcatctgtttaaaactaatcatacattagacacgagatgccctgcaatgatatttatgttccgtacatttggatgtagccgactctcggcttgttttaatttttcatgatatactattggccagtgtctcttggtagatgacaatttctcgttgaatgtcttagttgggttctgcagttatg

SEQ ID NO: 7426 - DNA, 2816 bp, Zostera marina
tcttctcgcgttaggtattcttcttcacatcatcttctcgcaatctaatctgctttctatttttgagatggttgctccgggagagtcgtcttcgtcggccgtggatccgaagggaaccaagagggatttctcgactgcgattcttgaaaggaagaaagctgcaaatcgtttggtggttgatgaggcggttaatgatgataattcagtggtgtcgatgaaccaggacaccatggataagttgcagatttttaggggcgacactatccttctcaagggaaagaaacgcagggacaccatctgcattgcacttgctgatgagacttgtgaggaaccaaagataaaaatgaacaaggtggttaggtccaatctaagagttagactgggtgatgttgtttctgtccatcagtgtgaggatgtgaagtatggcaagagagtccatatacttccaattgatgacagtattgagggtgtcaccggaaatttgttcgatgcatacttgaaaccttatttcttggaagcatatcgccctgtgagaaaaggtgatctttttcttgttaggggaggcatgagaagtgtggaatttaaagttattgagaccgaccctgctgagtattgtgttgtctctcctgatactgaaatattttgtgagggcgaacctgtgaaaagggaagatgaggacaatctcaatgatattggttatgatgatgtgggtggtgttagaaagcagatggctcagataagagagctagttgaacttcctctcagacaccctcaacttttcaagtcaattggtgtaaaaccaccaaaaggaatcttattgtttggaccaccaggctcagggaagacattgatagctagggcagttgcaaatgagactggtgcatttttcttttgcatcaatggacctgagattatgtcaaagcttgctggtgaaagtgagagcaatcttcgaaaggcttttgaagaagctgagaaaaatgctccatcaattatcttcattgacgagattgattctatagcacctaagcgggagaaaactcatggagaagttgaaaggcgtattgtatcccaacttctgacacttatggatggattaaaatcccgtgctcatgttattgtcatgggagctacaaatcgacccaatagcatcgaccctgctcttagaaggtttggaagatttgatagggaaattgacattggtgttcctgatgaggttggaagacttgaggttctgcgcattcacacaaagaatatgaaactttcggaagatgttgatttggaaaggattggaagggatactcatggttatgttggtgctgatcttgctgcactttgtacagaagccgcccttcagtgcattagagagaaaatggatgtgattgatttggaagatgattctattgatgctgaaatacttaattcaatggctgtcagtgatgaacacttcaagactgctcttggaaccagcaatccttcagctctgcgtgaaacagttgttgaagtgccaaacgtcagctgggaagatattggtgggttggaaaatgtcaaaagggaactgcaagagactgtccaatatcctgttgagcatcctgagaaatttgaaaagtttggcatgtcgccttctaagggagttcttttctacggtcctcctggttgtggaaagacccttcttgccaaggcaattgccaatgaatgccaggctaactttatcagtgtcaagggtcctgagcttcttaccatgtggtttggagaaagtgaagccaatgtaagagaaatctttgataaagctcgtcaatctgcaccttgtgtcctcttttttgatgagcttgactcaatagctacccagagaggtggcagtggaggagatgctggtggtgctgctgatagggtacttaatcagcttcttaccgaaatggatggaatgtctgcaaaaaagactgtttttataattggtgcaacaaacaggcctgatattattgattcagcattgctgagaccagggcgtcttgatcaactcatatatatccccctgcctgatgaagcttctcgtttcatgatctttaaagcttgcttgaggaaatctcccattgcaaaagatgttgaccttaatgcccttgccaagtacactcaagggtttagtggtgctgatattactgagatatgccagcgttcttgcaagtatgcaattagggaaaatattgagaaggatattgaaagggagaagaagagaagtgataatccagaagccatggaagaagactttgtggatgatgttgcggaaattaaagctgtacactttgaggagtctatgaaatttgcacggaggagtgtgagtgatgctgacattcgcaagtaccaggcctttgctcaaacactgcagcaatccagaggttttggaactgaattccggttcaatgagagatctgacactgatgcaccagcaactgcgggtgcctccgacccttttgcatcttctgatgttgctgctgctgatgatgatgatttatacagttagtttagttttttattgttgaaaatatattacaaaacctcatttaagcgtatgcttttggtttgtgtcgggatttaggactcatccgagtttctcagtcagaatttgagaagcacagggaagaatcgcttatatactttgaattcttgtgtaacgtttttattttcttcccttctaaattctaatcttctgttgctgcataaattatttcatgtttattaaagttagtattttggggtttttttgttgttgattgcagtaacggtacaattgtttagttattttgtatgtaataatttctgtt

SEQ ID NO: 7427 - DNA, 2421 bp, Flaveria ramosissima
aacatccccaaaatcctcaattcttcgatctaaactcaataattaatcaatcttcttcaacatcatgagcaatcaagcggaatcatccgaatctaagggcactaagcgcgactacagtaccgcgattctggaacgaaagaaggctgcgaacagactcgttgttgatgaagctgtcaacgatgataactctgttgtggccctacatcccgagacgatggagaagcttcagctcttcagaggagacactattctgattaagggaaagaaacgaaaagacactatttgtatagcgctcgctgatgacacgtgtgaagagcctaaaattagaatgaacaaggttgtgagggctaacctgcgagtcagacttggtgatgtggtctctgttcatcaatgccctgatgtcaaatatggcaaaagggttcatatcctcccagttgatgatacaattgaaggcgttactggcaatctctttgatgcatatttaaaaccatattttttggaagcatatcgtcctgtaaggaaaggcgactttttccttgtgaggggagggatgcggtctgttgaatttaaagttattgaaactgatcctgctgaatattgtgtggttgcacccgatactgagatcttctgtgaaggtgagcctgttagaagggaggatgaagatcgattagatgaaatcggttatgatgatgtgggtggagtccgtaaacagatggcacaaatccgtgagctggtggagttgccattaagacatccacagcttttcaagtcaatcggggtcaaaccacctaaaggaattcttctttacggacctcctggttcaggtaagactttgatagcccgggctgttgcaaatgaaacaggtgctttctttttttgtataaacgggccagaaatcatgtcaaagttggctggagaaagtgagagtaatcttagaaaagcttttgaggaagccgagaaaaatgctccatcgattattttcatcgatgaaatcgattcaattgctcccaaaagagaaaaaacaaatggagaagttgagagaagaattgtctcacagctgttgactctaatggatgggctgaaatcacgggcccatgttattgttatgggtgcaaccaaccgtcccaacagcattgacccggctcttaggaggttcggcaggtttgacagggaaattgatatcggtgttcctgatgaagtgggccggcttgaggtgctccgcattcataccaagaacatgaagctggctgatgatgtggacttggaaaagatatccaaggagacacatgggtatgtaggggctgacctggctgctttgtgtaccgagtctgcactccaatgtattcgtgagaagatggatgtgattgatttggaagacgagtcgattgatgctgagattcttaattcgatggcagttacaaatgagcatttccaaactgcccttggtacaagtaacccatctgctcttcgtgaaacagttgttgaggttcctaatgttagctgggaagatattggtgggcttgaaaatgttaaaagagagctccaagagaccgtacaatatccagttgaacaccctgaaaaattcgagaaatttggcatgtcaccatccaaaggagttctgttttacggcccacctgggtgtggcaaaacacttctagccaaggccatagccaatgaatgccaagccaactttatcagcatcaagggtcctgagttgctaaccatgtggtttggtgaaagtgaagctaatgttcgtgagatcttcgataaggcccgtggatccgccccttgtgtcttattttttgatgagctggactccattgctacccagagagggagtagtcaaggagatgcaggaggtgcagctgacagggttttaaatcagcttttgactgaaatggacgggatgtcagctaaaaagactgttttcatcatcggtgctactaaccggcctgatatcattgatccagcccttttgaggcctggtcgtcttgatcagctgatttacattcctctccctgatgaggaatcgcgctatcagattttcaaatcagctttaaggaaatcacctgttgcaaaagacgttgaccttcacgcacttgctaaatacactcagggattcagtggtgctgacatcaccgaaatctgccagcgtgcatgtaaatacgccattcgtgagaacattgagaaggatattgagagggagaagagaagaagtgagaacccggaggctatggaggaggacgtggaagatgaggtggcggagattaaggcggcacactttgaagaatcaatgaagtttgcacgaagaagtgtgagtgatgctgacatacgcaaataccaggcgtttgctcagacccttcagcagtctagagggtttgggtctgagtttaggttctctgaaacaagtggtgcagccgc

SEQ ID NO: 7428 - DNA, 3104 bp, Pinus taeda
cgggggggtttctcgattgctctataacgaagtttgaaattatcaatcgggcaagaaatgaccatagctcctcatgattaacctagtgtagaatcagatttacacaattcgataagggaccctgtagagacccgcgaaatctcagaggttctgttgtgtagttctctatcagtccagacgggtacgaatgccgaaaaaggaacgcccccagaagcaaaaaaaactctacatcggttcttcaagcaacaatccagggactttctatcaccaacgcgatcgccaaaaataatttaaagatttatatgagatttgcggatcagacatccatcgaatcaattacacctgtgcaacaatggcgcacaagggagaatcttcagaaccgaaaggagtcaaaagggatttcagcactgctattttggagcggaagaaggctcccaatcgccttgttgtcgatgaggctatcaacgacgataactctgtggtctgtctgcatccggacaccatggaaaaattacagctcttccgcggagacacaattcttatcaagggcaagaagagaaaggatacgatttgtatcgctctcgctgatgagacgtgcgaagagcccaggattagaatgaacaaggttgtgcgttcgaatcttagggttcgactcggcgatgttgtttcggttcatcagtgccccgatgtaaagtacggcaagcgtgtgcatatcctgcctattgatgataccatcgagggcgttactggcaatctgttcgatgcatatttaaagccctatttcatggaggcctatcgcccagtaaggaaaggagaccttttccttgttagaggtggaatgcgcagtgtagagttcaaagtaatagagacggaccctggggaatattgtgttgtttctcctgatactgagatcttttgtgagggagagcctgtgaagcgggaggatgaagatagattggatgaagttggttatgacgatgttggcggtgtaaggaggcaaatggcccagattcgtgaattggttgagcttccactgaggcacccacagctttttaaatcaattggcgttaaaccaccaaagggaattttgctctttggaccacctggttcagggaaaaccttaattgctagggcagtagccaatgaaactggtgccttctttttcttaattaatgggcccgaaattatgtcgaagttggctggagaaagtgaaagcaatctgaggaaagcctttgaggaggcagagaagaatgccccatccattatttttattgatgaaattgattcaatagcacccaaaagagaaaagacacatggtgaggttgagaggcgaattgtttctcaacttctgacactgatggatgggctaaaagctcgagcccatgttattgtgataggagcaactaaccggccaaatagtattgacccagctcttagaaggtttggaaggtttgacagggaaattgatattggggttcctgatgaagtggggcggctggaagtccttcgtatacatacaaagaatatgaagctttcggacgatgttgatcttgaacgaattgcgaaggacacacatggatatgttggagctgatcttgcagctctttgcaccgaggctgcgctacagtgcatcagggaaaaaatggatgttatagacttggaagatgagaccatcgatgctgaaatcctcaattctatggctgttacaaatgagcacttccagactgcgttgggcaccagtaacccatctgccttgcgtgaaactgttgttgaagtgcccaatgtttcttgggacgatattggtggtttggaaaatgtcaagagggagcttcaagagactgttcaatatccagtggagcaccctgagaaatttgaaaagtttggcatgtctccttccaaaggagtgctcttttacgggccaccaggttgtggtaagacgctgcttgcaaaagctattgcgaatgagtgccaggccaattttatcagtgtaaaaggcccagaattattaactatgtggtttggagaaagtgaggctaatgttcgagagattttcgacaaagcccgacagtcagcgccttgcgtcttgttttttgatgagcttgattctattgctacacagcgagggagcagtgttggcgatgcaggtggtgctgcggacagagtcctaaatcagttgttaacagagatggatgggatgacagccaagaaaactgttttcattattggggccacaaataggccagatatcattgatcctgcattgctaaggcctggtaggcttgaccagttaatttacataccattacccgatgagagttcacgcctgcaaatttttaaagcatgcctgagaaagtcaccggttgccaaggatgttgatttgactgctttagctcgttatacccaaggattcagtggagctgatattacagaaatttgtcagcgggcttgcaaatatgccattcgagaaaacatcgagcaggatattgaacgtgaaaggaagagaaaagaaaatcctgaagctatggatgaggatgatagtgaggagttgtctgaaataaaagcagctcattttgaggagtccatgaaatatgctcgaaggagtgtcagcgatgctgatatccgaaaatatcaagcatttgcacagacgctgcagcagtctagaggttttggtacggaattccgatttgcagagaggccaggtggtacagcggcagctggttcttcagaaccagcagaaaataaagaagatgatgacttgtatagttgataggtcccgtagcattaacactgcctgattattaaagtggcatgcttatcttcttttgggcaacttagcgtatttcctgatacattgaaaagaatttatggaggttgttctagagaagaccttgttcacaaggtagtcgatgctatgaaaatctgctttttctttaacgcgtagataattattgtcttaatattaatcaatgtgtgagtcttcgtagacttttttcccgtccaattatcttatctggtaacatttaaaacattgcatgtgtatgcattctttgtttatgaatattttggaggtttctgtaaatgttttgatactcatgagatcaact

SEQ ID NO: 7429 - DNA, 2712 bp, Pseudotsuga menziesii
ttgtgcagcgatggcggacaagggagaatcttcagagccgaagggaaccaagagggattacagcactgctattttggagcggaagaaggctgccaatcgccttgttgtcgatgaggccatcaacgacgataactctgtggtcagtctacatccagacaccatggaaaaattacagctgtttcgcggagatacaattctcatcaagggaaagaagagaaaggacacgatttgtatcgctctcgccgatgagacgtgcgaagagcccaggattaaaatgaacaaggtcgtgcgttcgaatctgagggttcggctaggcgatgttgtttcggtgcaccagtgccccgatgtaaagtatggcaagcgtgtgcatatcctgcctattgatgataccatcgagggcgttactgggaatttattcgatgcttatttaaagccctatttcatggaggcctatcgcccagtaaggaaaggagaccttttcctagttagaggtggaatgcgcagcgtagagttcaaagttattgagacagaccctggggaatattgtgttgtttctcctgacaccgagatcttttgtgagggagagcctgtaaagcgggaggatgaagacagattagatgaagtaggttatgatgatgttggtggtgtaaggaggcaaatggcccagattcgtgaattagttgagcttccacttaggcacccacagctcttcaaatcaattggcgtgaagccaccaaagggtattttgctatttggaccacctggttctggaaaaaccttaattgctagggcagtagccaatgaaactggtgctttctttttcttaattaatgggcctgaaattatgtcaaagttggctggagaaagtgaaagcaatctaaggaaagcgttcgaggaggctgagaagaatgccccatccattatttttattgatgaaattgattcaatagcacccaaaagagaaaaaacacatggtgaagttgagaggcgaattgtttctcaacttctgacactgatggatgggctaaaatctcgagcccatgttattgtgattggagcaacaaaccggccaaatagtattgacccagcccttagaaggtttggaaggtttgacagggaaattgatattggggttcctgatgaagtgggacggctggaggtccttcgtatccatacgaagaacatgaagctttctgaagatgttgatcttgaacgaattgcaaaggatacacatgggtacgttggagctgatcttgcagctctttgcaccgaggctgcactacagtgcatcagggaaaaaatggatgttattgacttggaagatgagaccatcgatgccgaaattcttaattctatggctgttaccaatgagcacttccaaactgcgttgggcaccagtaacccatctgccctgcgtgaaactgttgttgaggtgcccaatgtttcttgggaggacattggtggtttggaaaatgttaagagagagcttcaagagactgttcaatatccagtggagcaccctgagaaatttgaaaagtttggcatgtctccttcgaaaggagtgctcttttatgggccacctggctgtgggaagactctgcttgcaaaagccattgctaatgagtgccaagccaatttcatcagtgtaaaaggcccagaattattaacaatgtggtttggagaaagtgaggctaatgttcgagagattttcgacaaagctcgacagtcagcgccatgtgtcttgttctttgatgagcttgattctatagccacacagcgtgggagtagtgtcggcgatgcaggtggtgccgcggaccgagttctcaatcagttgttaacagagatggatgggatgtcagccaagaaaaccgttttcattattggggctacaaataggccagatatcattgatcctgcattgttaaggcctggtcggcttgatcagctaatttacataccattacctgatgagagttcacgcctccaaatttttaaagcttgcttgagaaagtcaccggtttccaagcatgttaatcttactgatttagctcgttatacccaaggatttagtggagctgatattacagaaatttgtcagcgtgcttgcaaatatgccatccgagaaaacatcgagaaggatattgaacgtgaaaggaagagaaaagaaaaccctgaagctatggaagaggatgaaaatgaggtcgctgaaataaaagcggcccactttgaggagtccatgaaatatgctcgaagaagtgtcagtgatgctgatattcgaaaatatcaagcatttgcacagacgctgcagcagtcccgaggttttggttccgaattccgatttgcagacaggccagctagtacatcagctgcggcttcagatcctttcactacagcagataataaagaagacgatgacttgtatagttgataggttctgtagcattaacattgcttggttaacgtgggcagatttatcttcttctgggtgactaaagcctgttctctgatataacgaatttgcgagggctgctctagaaaaagaaagattattcacaaagtagtcgatgctatggaaatctgctttttctttgacgtttagacaccttttctcttaatattaattaatgcgtgtccacgttttcgtaaacattctttgttccatcgtcttttaatgtcaccctgtgctctctggtaacaatgacaattttgtaa

SEQ ID NO: 7430 - DNA, 2630 bp, Hordeum vulgare
ctccttcaccggaacgaaggaaatcatccaccgctccaccgccgagacccagcggcgccggcgaacccccgatccgcccgccatggccgccccgacgccgcagggcgaggcctcctcctccgatcccaagtcgaagaaggactactcgacggccatcctcgagcggaagaagtcccccaaccgactcgtcgtcgacgaggccaccaacgacgacaactccgtcgtcgccctccaccccgacaccatggagaggctccagctcttccgcggcgacaccgtcctgctcaagggtaagaaaaggaaggatacaatctgcattgtgcttgcagatgacacttgtgaggagccaaaaatcagaatgaacaagaccgtcaggaaaaacttgcgagtgcgacttggtgatgtggtgtctgttcaccaatgcccagacgtgaaatacggcaagcgtgtgcacatacttcctattgatgacacagttgaaggcattactggaaacttgtttgatgccttcttgaaaccatacttccttgaagcttaccgtcctttaaggaagggagatcttttccttgtgaggggaggaatgagaagtgtggaattcaaagttatagagacagaccctgcagagtattgcatcgttgcacccgacactgagatattctgtgatggtgagcctgttaagagggaggatgaggagaggcttgacgatgttggctatgatgatgttggtggagttaggaagcaaatggcccagatcagagaactggttgaactcccactgcgtcaccctcagcttttcaagtctattggcgtgaagcctccaaagggcatattgctgtttggtccacctggctctggcaagacccttattgctagagctgttgccaatgaaacaggtgcattcttctttctgatcaatggcccagaaattatgtccaagttagcaggagaaagtgagagcaatctcaggaaggcatttgaagaagctgagaagaacgcaccatccatcattttcattgatgagattgattcaatagccccgaagagagagaagaccaatggagaagttgaaaggcgtattgtttcacagctgttgactcttatggatggacttaaatcccgtgcacatgttattgtcatgggtgctacaaaccgcccaaacagtatagatcctgccctcagaagatttggtaggtttgacagggagattgatattggagtccctgatgaagttgggcgccttgaggttctccggattcacaccaaaaacatgaagttggctgaagatgtggaactggaacatatttcaagagatactcatggatatgttggtgctgatcttgctgctctttgcactgaggctgctctccaatgcattcgtgagaagatggatattattgatcttgaggacgagacaatagatgctgagatactcaactctatggccgtgacaaatgaccatttcaagaccgccctgacgacaagcaatccgtctgctctccgtgaaactgttgttgaagttcccaatgtttcttgggaagatattggtggtcttgagaatgtcaaaagggagttgcaggagactgtccaataccctgtggagcatcctgagaaatttgagaagtttggcatgtctccttccaagggtgttctgttctatggtcctcctggctgtggtaaaaccttattggccaaggcaatcgcaaatgagtgtcaggctaacttcatcagtatcaagggacctgagctgcttaccatgtggtttggtgagagtgaggctaatgtgcgtgagattttcgacaaggctagggggtcagcaccatgtgtgctcttctttgatgaacttgactcgattgctacccagagaggaagcagcagtggggatgctggaggtgctgctgatagagtgctgaaccagctgctgactgagatggatggcatgaatgctaagaaaaccgtcttcatcattggtgctaccaacaggccagacatcatagaccctgccctgcttaggccagggcgtcttgatcagcttatctacatccctcttcctgatgtcgattcgaggcaccagatcttcaaagcttgcctcaggaagtctcctttggccaaggatattgatctgagtgctcttgccaagtacacccaagggttcagcggtgctgatatcactgaaatttgccagcgtgcttgcaagtatgccatcagggagaacatcgagaaggacatcgagagggagaggcggaggaaggacaaccctgaagcgatggaggaggacgaggttgatgaggttgcagagatcagggctgcccacttcgaggagtcgatgaagtatgcgcgtcgtagtgtgagtgacgccgacatccgcaagtaccaggcctttgcccagacgctgcagcagtctcgtggattcgggagcgagttccggttcgctgaccagccggctgcgggcgctgcctctgccgctgcggccgacccttttgcatccgctgcctcagcagccgatgatgatgatttatatagttaaatccttgtcctgtgctttttcgttcgtagatgtggtgctttggtatgtacacgggaaaactatgttcttaagttaatatactgtgatgcacagttaatcgttgtgc

SEQ ID NO: 7431 - DNA, 2640 bp, Pennisetum glaucum
aacgccaccgccggcaaaccaaccacccggaaccaacctccgcccgccgcagcagccggcgacatggcgagccaaggggagccgtcggcctccgcttccgatccgaaggggaagaaggactactcgacggcgatcctggagaggaagaagtcgcccaaccgcctcgtcgtcgacgaggcaaccaacgacgacaactccgtcgtcgccctgcacccggacaccatggagaggctgcagctcttccgcggcgatactgtgctcctcaagggtaaaaagaggaaagacactatttgcattgtcctcgcagatgaaacctgcgaggagcctaaggtccggatgaacaaggttgtccgccagaacctgagggtgaggcttggtgatgtggtttctgttcaccagtgccaggatgtgaaatatgggaagcgtgtacacattcttccaatagatgattcagttgaaggaattacagggaacctgtttgacgccttcttgaaaccatacttccttgaagcgtaccgtccagttaggaaaggagatcttttccttgtaaggggtggaatgcgaagtgtggagttcaaagtgattgagactgaccctgctgagtattgcattgttgcaccagatactgaaatattttgtgatggagagcctattaagagggaggatgaggaacgtcttgatgaagttggttatgatgatgttggtggagttaggaagcagatggcccaaatcagggagcttgttgagcttccactgcgccaccctcagcttttcaaatctattggtgtgaagccaccaaagggcatattgctgtatggaccacctggttctggaaagactcttattgctcgtgccgttgctaatgagactggggcctttttctttcttatcaatggtcctgagattatgtcaaagctagctggagagagtgagagcaatctcaggaaggcatttgaagaagcagagaagaatgctccatctatcattttcattgatgaaattgattccattgctcccaagagagagaagaccaacggagaagtggagcgtcgtattgtttcacagctgctgactcttatggatggactcaaagctcgttcccatgttattgttatgggtgctacaaaccggccaaacagcattgatcctgctcttcgaagatttggaaggtttgaccgggaaattgacatcggtgttcctgatgaagttggcaggctcgaggttctccgcattcacactaagaacatgaaattagctgaagatgttaatttggaactcattgccaaggatacccatggatatgttggtgctgatcttgctgctctttgcactgaggctgctcttcagtgcattcgtgagaagatggacatcattgatcttgaggatgagacgattgatgccgagatattgaactcgatggctgtcacaaatgaccatttcaagactgcacttggaacaagcaacccatctgctcttcgtgaaactgttgttgaagttcctaatgtttcttgggaggatattggtgggctggataatgtcaagagggagctccaggagactgttcaatatcctgtggagcacccagagaagttcgagaagtttggcatgtctccatccaaaggagttctgttctatggccctcctggttgtggtaagaccttgttggcaaaggcaattgccaatgagtgccaggccaacttcatcagtgtcaaggggcctgaattacttacgatgtggtttggtgagagtgaagcaaatgtccgtgaaatcttcgacaaggctcgccagtctgccccctgtgttctcttctttgatgaacttgattcaattgctactcagagaggaagcagtgtaggtgatgctgggggcgcagctgatagagtgcttaatcagcttttgacagagatggacggcatgaatgccaagaaaactgtgttcattattggtgctacaaacaggcctgatatcatcgatccagctctgcttaggccaggacgtcttgaccagctaatctacattccactgcctgatgagcagtctaggctgcagatcttcaaggcctgccttaggaagtcccctgtggcgaaagaagtggacttgaatgctcttgccaagtacacccaaggattcagtggtgcagatatcacagaaatttgccagcgtgcagttaaatatgccatcagagagaatattgagaaggatattgagagggaaaggcggagaaaggataaccctgaggcaatggaagaggacgaagtcgatgacattgctgaaatcaaggcagctcacttcgaggagtcgatgaagtatgctcggcgcagtgtcagtgacgctgatatccgcaagtaccaggcgtttgcccagactctgcagcagtctcgtgggtttggcagtgagttccgcttcgagcaatccacgactgctggtcctgcagctgcagccgatccttttgcttccacagccggagcggatgatgacgatctatacagctaggtgtcttgttgggttggttcagggtcgtgtttgatatcagtcgcatcagtcatgtgtttaaaactaatcgtactaggcacggatgttctgcaatgatatttattttccgtacatttggacgtcgccgactctcggcttttacatttt

SEQ ID NO: 7432 - DNA, 2751 bp, Ambrosia trifida
tcggctatatattgtgacaacggtttgtatctccaaagttaaaagataataataaataatcatctttctttattaacaagatatatacaaaaccattaaacaagatatatacaaaaccagaaccctctcctctcttctccactccaaacccacaacccaaaattctcgaaccttcttcaacataatccatcattctgcatcatcatgagtaaccaacctgaatcatccgattctaagggtgggaagaaagacttcagtacagcgattcttgagcgaaagaaggcacccaacagactcgttgttgatgaagctcttaatgatgacaactccgttgtttgcatgcatccagagaccatggaaaagcttcaactttttagaggcgatacgatcttgctcaaggggaagaaaaggagagatacaatatgtattgcacttgctgatgacacgtgtgaagaacctaagattaggattaataaggttgttaggtcaaacttgagggttagacttggggatgtggtttctgtgcatcaatgtgctgatgttaagtatgggaagcgtgttcatatccttccgattgacgatactattgaaggagttactgggaatttgtttgatgcttacttgaaaccttactttttggaagcataccgtccggtgaggaaaggtgactactttttggtaaggggaggaatgcgaagcgttgagtttaaagttattgagactgatcctgctgagtactgtgtggttgcgcctgataccgagatattctgtgagggtgagcctgtgagaagggaagatgaggaccggttagatgagattggttatgatgatgttggtggtgttcgtaaacagatggcgcaaatccgtgagttagtggaactcccgttaaggcatccgcagctttttaagtctattggtgttaagccgccgaagggtattttgctttatggacctcctgggtctggaaagactttgattgctcgtgctgttgctaatgaaaccggtgctttctttttctgcattaacgggccagagatcatgtcaaaaatggcgggagagagtgagagtaatttaaggaaagcgtttgaggaagctgagaaaaacgcaccatcaattatctttatcgatgagcttgattcaattgcgccaaaacgtgaaaaaacacacggtgaagttgagcgaaggatcgtttcccagttattgactttgatggacgggctgaagtctcgggcacatgtaattgtcatgggtgcaactaaccgccctaacagtattgatcctgcattgagacggtttggtagatttgacagggaaattgatattggtgtgcctgatgaaattggccgtcttgaggttctcagaatccatactaagaacatgaagctatctgatgatgtgggtttggagaaggttggaaaagatacccatgggtacgtaggtgctgacttggctgccttatgcactgaggctgcactccaatgtattagagagaaaatggatgtgattgatttggaagacgagtccattgatgcagagattttgaactccatggcagttacgaatgagcattttcagacggccctcgggacaagcaatccttctgctcttcgtgagaccgttgtggaagttcccaatgttagctgggaagacattggtggactcgagaatgttaaacgagagctacaagagaccgttcaatatcctgtggaacatcctgagaaatttgagaagtttggtatggctccatctaaaggagtcctgttctatggtccacccggttgtggtaaaacgcttctagccaaagctattgcaaatgaatgtcaggctaactttatcagcatcaagggtcctgagctgcttacaatgtggtttggtgagagtgaggccaatgttcgtgaaatttttgacaaggctcgtgggtcggctccttgtgtcctcttttttgatgaacttgattccatcgcaacccagagagggagtagtcaaggagatgctggtggtgcagctgacagagttctgaaccaacttctgactgaaatggatggaatgtctgccaagaaaacggttttcatcattggtgcaactaacaggcctgatatcattgatccagcactcttgaggcctggccgtcttgatcaactgatctacattcctttacctgatgaggagtcacgttatcagatctttaaatctgcgttaaggaagtctccaatttccaaagatgttgatctccgagctcttgccaggttcacacaaggattcagtggtgctgacatcaccgaaatctgccagcgcgcctgtaaatacgctattcgtgagaacatagaaaaggatattgagagggaaaagagaataagtgagaaccctgaagctatggaggaagacatggacgatgaggtagcggagatcaaagctgctcattttgaagaatctatgaagtttgcacgacggagtgtcagtgatgctgacataaggaaataccaggcgtttgctcaaacactgcagcagtcaagagggattggttccgagttcagattctcagagactagtgggcgtgctgccgctagtgacccgtttgccgcaccggctggtacagttgatgacgatgacctttataattaagtttggttgtaccaaataatgtctgctacttgtttctttgtgtgtttttcatatccggttactatgatattcctaggttgtatgtttacatagtaataactttgtttattgagtttgttgaaaaataaa

SEQ ID NO: 7433 - DNA, 2840 bp, Abies balsamea
agcgcagctctataaatatccgctcaaccttctacgacttttcattctctcgttcattttctcacggaagaaatttgtgcgcggatcagacatccttcgaatcactagcaatcgtgcagccatggcgggcaagggagaatcttcagagccgaaaggaatcaagagggattatagcacagctattttggagaggaagaaggctgccaatcgccttgttgtcgatgaggccatcaacgacgacaactctgtggtctgtttgcatccggacaccatggaaaaattacagctgttccgcggagatacaattcttatcaagggcaagaagagaaaggatacgatttgtattgcccttgccgacgagacgtgcgaagagcccaggattagaatgaacaaggttgtgcgttcgaatttaagggttcggctcggtgatgttgtttcggttcaccagtgcccggatgtaaagtacggcaaacgtgtgcatatcctgcctattgatgataccatcgagggcgttaccgggaatttgttcgatgcttatttaaagccctattttatggaggcctatcgcccagtaaggaaaggcgaccttttccttgttagaggtggaatgcgcagtgtagagttcaaagtaattgagacagaccctggggaatattgtgttgtatcacctgatactgagatcttttgtgagggagacccggtaaagcgcgaggatgaagatagattggacgaagtaggttatgatgatgttggtggtgtaaggaggcaaatggcccagatacgtgaattggttgagcttccactgagacacccacagctcttcaaatcaattggtgtgaagccaccaaagggtattttgctgtttggacctcctggttctggaaaaaccttaattgctagggcagtagccaatgaaactggtgctttctttttcttaattaatgggcctgaaattatgtcaaagttggctggtgaaagtgaaagcaacctaaggaaagcctttgaggaggccgagaagaatgccccatccattatttttattgatgaaattgactcaatagcacccaaaagagaaaagacacatggtgaggttgagaggcgaattgtttctcaacttctgacactgatggatgggctaaaatctcgagctcatgttattgtgattggagcaacaaaccggccaaatagtattgacccagctcttagaaggtttggaaggtttgacagggaaattgatattggggttcctgatgaagtgggacggctggaggtccttcgtatccatacaaagaatatgaagctttctgaagatgttgatcttgaacgaatcgcaaaggatacacatggatatgtcggagcagatcttgcagctctttgcactgaggctgcactacagtgcatcagagaaaaaatggacgttattgacttagaagatgagactattgatgctgaaattcttaactctatggctgttaccaatgagcacttccagactgctttgggctccagtaacccatctgccctgcgtgaaactgtggttgaggtgcccaacgtttcttgggaggacattggtggtttggaaaatgtcaagagggagcttcaagagactgttcaatatccagtggagcaccctgagaaattcgaaaagtttggcatgtctccttcaaaaggagtgctcttttatgggccacctggttgtggaaagactttgcttgcaaaggccattgctaacgagtgccaggccaatttcatcagtgtgaaagggccagaattattaacaatgtggtttggagaaagtgaggctaatgttcgagagattttcgacaaagccagacagtcagcgccatgtgtcttattttttgatgagcttgattctattgctacacagcgagggagtagtgtcggtgatgcaggtggtgccgcggacagagttctcaatcagttgttaacagagatggatgggatgacagccaagaaaactgttttcattattggggctacaaacaggccagatatcattgaccccgcgttgctaaggcctggtcggcttgaccagttaatttacataccattacctgatgagacttcacgcctccaaatttttaaatcttgtttgagaaagtcaccagtttccaaggatgtggatctggctgcattagcgcgttatacccaaggatttagtggagctgatattacagaaatttgccagcggtcttgcaaatatgcaattcgagaaaacatcgagcaggatattgaacgtgaaaggaagagaaaagaaaatcctgaagctatggatgaggatgatagtgaggagatctctgaaataaaagcggctcactttgaggagtccatgaaatatgccagaagaagtgtcagtgatgctgatattcgaaaatatcaagcatttgcacagactctgcagcagtctcgaggttttggttccgaattccgatttgcagacaggccagctactacagcgggggctgcggcatcagatccatttactacagctgataataaagaagacgatgacttgtatagttgataggttttgtagcattaacaatgcccgattaaagtgggcacatttctcttctgggcgactaaagcctattccctgacacactgaaaagaatttatgaaggctgctctcagaaagaaaagattgttaacaaggtggtcgatgctttggaaatccactttttctttgacgcgtagaaacctttgtcttaatattaattaatgtgtgtccaagtgttcgtaaacattctttgcccaaattagtcttttaatatctcaccatatgtactttctctggtaacaattacaacattgcatgt

SEQ ID NO: 7434 - DNA, 2625 bp, Ambrosia trifida
ccaagacactcggatcgtcatcttcctcacatctcttctcccaatccagactctttcaatctcaatcgccatgacggaaccctcttcttccgatccgaaagctccacaacaaccccagaagaaagacttttcaacagctatcttggagcgcaagaaatctcctaatcgccttgttgttgacgaagcggttaatgatgataactccgtcgtcgctatgcaccctgccaccatggaaaaattgcagcttttccgtggtgataccattctcatcaagggcaagaaacgaaaagacacggtctgcattgcccttgctgatgaaacatgtgaagaaccgaaaatcagaatgaacaaggttgttaggactaacctaaggattcgccttggtgatgttgtgtcagtacatcagtgtccggatgtgaagtatggaaaacgtatacacgttcttccacttgatgacaccattgaaggtgtcacgggagacttatttgatgcatttctgaaaccttatttcttggaggcatataggcctgtaaggaaaggagatcattttcttgttagaggagggatgcgcagcatcgaattcaaagtaatagaaactgatccaggggaatattgtgttgttgctccagacactgaaatcttttgtgaaggtgagccgattaagagagatgatgaggatagattggatgaggtgggctatgatgatgttggcggtgtcaggaaacaaatggcacagattcgtgaattggttgaattacctttaagacacccgcagcttttcaagtcaattggagtcaaaccccctaaaggaatcttgctctatggacctcctggttcaggaaagacactgatagccagagccgttgctaatgaaacaggagctttctttttcttaatcaacggtccagaaatcatgtcaaaattggctggagaaagtgaaagcaatctcagaaaggcgtttgaggaggctgagaagaacgccccgtcaattattttcattgatgagatagattctatagctccaaagagagagaagactaatggtgaagttgaaagaaggattgtatcacagcttttgacacttatggatggattaaaatcgcgggcccacgttattgtaatgggggccacgaatcgcccaaacagcattgatcctgctcttagacggtttggtaggttcgatagggaaattgatattggtgtcccagatgaaattggacgtcttgaggttcttcgtatccatacaaagaacatgaagctttctgatgatgttgatctggaaaagatatctaaagaaacacatggttatgttggtgctgatttggctgctctttgcactgaagctgcacttcaatgcattagagaaaaaatggatgttattgatttggaagatgaatctattgatgctgagatactcaactccatggcagtcacgaatgagcatttctctactgctcttggaactagcaatccatctgctctgcgtgagactgtcgttgaggttccaaatgttagctgggaggatattggaggccttgagaatgttaagcgtgagcttcaagagactgttcaatatccggtggagcatccagagaagtttgagaagtttggcatgtcaccatcgaaaggagttcttttctatggcccacctggatgtggtaaaacactgcttgcaaaagctattgcaaatgaatgccaagcaaatttcattagtatcaaaggacctgaattactaacaatgtggtttggggagagcgaagctaatgttcgtgagatttttgacaaagccagaggatctgcgccatgtgtccttttctttgatgaacttgactccattgcaactcagaggggtagcagttctggagatgcaggtggtgctgctgaccgggttttgaatcagctattgactgaaatggatggaatgtctgctaagaagactgttttcataatcggagccactaaccgacccgacattattgacccggctttacttcgacccgggcgtcttgatcaactaatttacattccattgccagatgaggactcacgccaccagatttttaaggctgcaatgaggaaatcccctgtttctaaagatgttgatttgagagctcttgctaggtacactcaaggatttagtggtgctgatattaccgagatatgtcaacgcgcctgcaagtatgccattagagagaacattgagaaagacatagagagggaaagaaagaggagtgagaatcctgattccatggatgaggacgaggatgatgtggcggaaataaaggcggctcactttgaggaatcaatgaagtatgcacgcagaagtgtgagtgatgctgacatcaggaagtaccaagcgtttgctcagacattgcagcagtcgagaggatttgggtctgaattccggttctcggagacatctggtggggctgctgctgctgcttctgatccgtttgctgcatctggtggtggagctgatgatgacgacctctacagttaggttttataaacaaggtgatgtttaagaaagaatagattttgcagggtctccattctgttctggcattttggtttagactggcctattgtgcattatcagtgacgggatcttgttttcatttggac

SEQ ID NO: 7435 - DNA, 2581 bp, Pseudotsuga menziesii
gggatttcagcactgctattttggagaggaagaaggctgccaatcgtcttgttgtcgatgaggccatcaacgatgataactctgtggtcagtctgcatccagacaccatggaaaaattacagctgttccgcggagatacaattctcatcaagggaaagaagagaaaggacacgatttgtattgctctcgccgatgagacgtgcgaagagcccaggattagaatgaacaaggtcgtgcgttcgaatctgagggttcggctcggtgatgttgtttcggttcaccagtgccccgatgtgaagtacggcaagcgtgtgcatatcctgcctattgatgatagcatcgagggtgttactggaaatttattcgatgcttatttaaagccctatttcatggaggcctatcgcccagtaaggaaaggagaccttttcctcgttagaggtggaatgcgcagtgtagagttcaaagtaattgagacagaccccggggaatattgtgttgtttctcctgataccgagatcttttgtgagggagagcctgtcaagcgggaggatgaagatagattggatgaaataggttatgatgatgttggaggtgtaaggaggcaaatggcccagattcgtgaattagttgagcttccacttaggcacccacaactcttcaaatcaattggtgtgaagccaccaaagggtatattgctctttggaccacctggttctggaaaaaccttaattgctagagcagtagccaatgaaactggtgctttctttttcttaattaatgggcctgaaattatgtcaaagttggctggagaaagtgaaagcaaccttagaaaggcgttcgaggaggctgagaagaatgccccatctattatttttattgatgaaatagattcaatagcacccaaaagagaaaagacacatggtgaggttgagaggcgaattgtttctcagcttctgacactgatggatgggctaaaatctcgagcccatgttattgtgatgggagcaacaaaccggccaaatagtattgacccagctcttagaaggtttggaaggtttgacagggaaattgacattggcgttcccgatgaagtgggacgactggaggtccttcgtattcatacgaagaatatgaagctttctgaagatgttgatcttgaacggattgcaaaggatacacacggatatgttggagctgatcttgcagctctttgcaccgaggctgcgctacagtgcatcagggaaaaaatggatgttattgacttagaagatgagacaatcgatgctgaaattcttaattctatggctgttaccaatgagcacttccagactgcgttgggctccagtaacccatctgcactgcgtgaaactgttgttgaggtgcccaatgtttcgtgggaggatattggtggcttggaaaatgtcaagagggagcttcaagagactgttcaatatccagtggagcatcctgagaaatttgaaaagtttggcatgtctccttcaaaaggagtgctcttttatgggccgcctggttgtgggaagactctgcttgcaaaagccattgctaatgaatgccaggccaatttcatcagtgtaaaaggcccagaattattaacaatgtggtttggagaaagtgaggctaatgttcgagaaatcttcgacaaagctcgacagtcggcgccatgtgtcttgttttttgatgagcttgattctattgctacacagcgtgggagtagtgtcggcgatgcgggcggtgctgcggacagagttcttaatcagttgttaacagagatggatggaatgtcagccaaaaaaactgttttcattatcggggctacaaataggccggatatcattgatcctgcattgctaaggcctggtcgtcttgaccagttaatttacataccattaccagatgagagttcacgtctccaaatctttaaagcttgcttgagaaagtcaccgatttctaaggatgttgacctgactgctttagcccgttatacccaagggtttagtggagctgatattacagaaatttgccagcgggcttgcaaatatgccatccgtgaaaacatcgagaaggatattgaacgggaaaggaaaataaaagaaaatcctgaagctatggaggaggatgatactgaagaggtcgctgaaataaaagcggctcactttgaggagtccatgaaatatgcccgaagaagtgtcagcgatgctgatattcgaaaatatcaagcatttgcacagacgcttcagcagtctcgcggttttggttccgaattccgatttgcagacaggccagctggtacaacggctgcggcttcagacccttttactacatcagataataaggaagatgatgacttgtatagttgataggttttgtagcattaacattgcctgattaaagtggacatatttatcttcttctaggcgactaagcctattccctgatacactgaagaatttattttaggctgctctagagaaagataagattgttcacaagggtagtctatgctatggaaatctgttttgtttttctttgaagaatttatgtaggctacaatggaaatctg

SEQ ID NO: 7436 - DNA, 4152 bp, Panicum virgatum
gccaccgccggccaacaacccgaaacctacctccgccgcggtcgccgcagccgcagccagcatggcgagccaaggggagccgtcggcctccgcttccgatgcgaaggggaagaaggactactcgacggcgatcctggagaggaagaagtcgccgaaccgcctggtcgttgatgaggccaccaacgacgacaactccgtcgtcgctctgcacccggacaccatggagaggctgcagctcttccgcggcgataccgtgctccttaagggtaagaagaggaaagacaccatttgcattgtccttgcggatgatacctgtgaggaaccaaaggttcggatgaacaaggttgtccgtcagaacctgagggtgaggcttggtgacgtggtttctgtccaccagtgccaggatgtgaaatacgggaagcgtgtacacattcttccaattgatgatacagttgaaggcattacagggaacctttttgacgtcttcttgaaaccatacttcctagaagcataccgtcctgtgaggaaaggagaccttttccttgtcaggggtggaatgagaagtgtggagttcaaagtgatagagactgatcctgctgagtactgcatcgttgccccagatactgaaatattttgtgatggggagcctattaagagggaggatgaggaacgccttgacgaagttggctatgatgatgtcggaggagtcagaaagcaaatggcccagatcagggagcttgttgagcttcctctgcgccatccccagcttttcaaatctattggtgtgaagccaccaaagggcatattgctgtatggaccacctggttccgggaagactcttattgctcgtgcggttgcaaatgagactggagcctttttctttcttatcaatggcccagagattatgtcaaagctagcatgtgagagtgagagcaatctcaggaaggcatttgaagaagcagaaaagaatgctccatctatcattttcattgatgaaattgattccattgctcccaagagagagaagaccaatggagaagtggagcgtcgtattgtttcacagctactgactcttatggacggactaaaagctcgttctcatgttattgttatgggtgctacaaaccgaccgaacagcattgatcctgctcttcgaagatttggaaggtttgaccgggaaattgacatcggggttcctgatgaagttggaaggcttgaggtcctccgcatccacacgaagaacatgaaacttgctgaggatgttaatttggagctcattgccaaggatacccatgggtatgttggtgctgatcttgctgctctttgcactgaggctgctcttcagtgcattcgtgagaagatggacatcatagatcttgaggacgagactatagatgctgagatactgaactcgatggctgttacaaatgaccatttcaagactgcacttggaacaagcaacccatccgctcttcgtgaaactgttgttgaagttcctaatgtctcttgggaggatattggtgggctggacaacgtcaagagggagctccaggagactgtccaatatcctgttgagcacccggagaagtttgagaagtttggcatgtctccatccaaaggagttctgttctatggccctcctggttgtggtaagaccttgttggcaaaggcaattgccaatgagtgccaggccaacttcatcagtgtaaagggtcctgaattgcttaccatgtggtttggtgagagtgaagccaatgtccgtgaaatttttgacaaggctcgccaatctgctccctgtgtcctcttctttgatgagcttgactcaattgctactcagagaggaagcagtgtaggtgatgctggaggtgccgctgatagagtgctcaatcagctactgacagagatggacggcatgaatgctaagaaaaccgttttcattattggggccacaaacaggcctgatatcatcgatccagctttgcttaggccagggcgtcttgaccagctgatctacattccactgcctgatgagcagtctaggctacagatcttcaaggcctgtctaaggaagtcccctgtggccaaggaagtggacttgaatgctcttgctaagtacacccaagggttcagtggtgcagatatcactgaaatttgccagcgtgcagtgaaatatgccatcagagagaacattgagaaggatattgagagggaaaggcggagaaaggacaaccctgaggcaatggaggaggatgaagtggacgacattgctgaaatcaaggcagcccactttgaggagtcgatgaagtatgcacgccgcagtgtcagcgacgctgatatccgcaagtaccaggcgtttgcccagacgctgcagcagtcccgtgggttcggcagcgagttccgcttctcagagcagtcaacaaccgccgccaccacagctgcagctgatccttttgcatccgctggtgcggccgatgatgacgatctatacagctaggtttcttgttgggttgttgctggttggttctgggttgtgtccgatatcagtcgcgtcagtcatctgtttaaaactaatcatactttagacacgagatgccctgcaattgatatttatgttccgtacatttggatgtagccgactctcggcttgttttaagatgtagccgactctcggcttgttttaatttttcatgatatactattggccaatgtctcacttggttgatgacaaaaaaaaaaaaaaagggcggccgcctcgacgtcgtccccgtcgtcatgcggcatcacgtacccgcggcgcagcgccgcccgggcggtgcgcgtgcaggtgtcgacgacggagaccgctgaggccggggcggcgccggtgaagacggagaagatctccaagaagcaggacgagggtgtggtgaccaacaagtacaggcccaaggagccctacgtggggaggtgcctgctcaacaccaggatcaccggcgacaaggcgccgggggagacgtggcacatggtcttcagcacagaaggcgagatcccttacagagaagggcagtccattggcgtcatcgccgacggcgtcgacaagaacggcaagccgcacaagctcaggctctactccatcgccagcagcgccctcggggatttcggcgactccaagaccgtgtcgctgtgcgtgaagaggctcgtgtacaccaacgatcaaggagagatcgtcaaaggagtctgctccaactacctatgtgacctgaagcccggcgctgaggtgaagatcacagggccagtcggcaaggagatgctcatgcccaaagaccccaacgcaacagtcattatgctggcgacgggtaccggtatcgcccccttccgctccttcttgtggaagatgttcttcgagaagcacgacgactacaagtacaacggcctggcctggctgttcttgggagtcccgacgagcgacaccctgctgtacaaggaggagctggagaagatgaaggagatggcgccggacaacttccggctggacttcgcggtgagccgggagcagacgaacgcggcgggggagaagatgtacatccagacgcggatggccgagtacaaggaggagctgtgggagctgctcaagaaggacaacacctacgtctacatgtgcgggctcaaggggatggagaagggcatcgacgacatcatggtcgacctcgcagccaaggacgggatcgactggattgagtacaagaagcagctcaagaagggcgagcaatggaacgtcgaagtctactaaaccatcgtgcatgcatattctcactagctagctagcaccatcttgtatatgctgcatatatagtacgtacatacaggcgcacgtcagtacatacaccacattatatccatcattttgttgtgccatgaatttgcctgcctgccttccttccttcgtatcatcctccatccatcactctactagctagtagctttttaactcagcttgcatgctgaattcaaacccatcaaaataattggctcctccgatcgaatattgttgtacatatttgtttcatggttacgttgtcgatcgatccagacctcccttagcttcactcatgtatttattatttactattggtacattttctctcctgaggctattttaattatgtttatatt

SEQ ID NO: 7437 - DNA, 2676 bp, Avena sativa
gcggaatatctctactcctcgctatctcaccgctctccgcaacaacccgggggtagagagagagagagagtcgccgaaacctagcgccgccgccggcgaccccccgaacccgccacgccatggcgaccccgaccccgcagggcgaggcctcctcctccgatccgaaatcgaagaaggacttctccacggcgatcctcgagaggaagaagtcgcccaaccgcctcgtcgtcgacgaggccaccaatgacgacaactccgtcgtcgccctccaccccgacaccatggagaagctccagctcttccgcggcgacaccgtcctcctcaagggtaagaagagaaaggacacaatctgcattgtgcttgcagatgacacatgtgaggaggcaaaggtcaggatgaacaagaccgtcaggaagaacctgagagtgaggcttagtgatgtggtgtctgttcatcagtgcccagatgtcaaatacgggaagcgtgtgcacatacttcctgttgatgacacggttgagggcattactggaaacttgtttgatgccttcttgaaaccatacttccttgaagcctaccgacctttgagaaagggtgaccttttccttgtcaggggtggaatgagaagtgtggaattcaaagttatagagactgaccctgcggagtattgtattgttgcacctgacactgagatattctgtgatggtgagcctattaagagagaggatgaggaaaggcttgatgaggttggctacgatgatgtcggtggagttaggaagcaaatggcccagatcagagaactggttgaactcccactgcgccatcctcagcttttcaagtctattggtgtgaagcctccaaagggtatattgctgtttggaccacctggctctggcaagacccttatcgctagggctgttgctaatgaaaccggggcattcttctttctgattaatggcccggaaattatgtccaagctagcaggagaaagtgagagcaatctcaggaaggcatttgaagaagctgagaagaatgcaccatcaatcattttcattgatgagattgactcaattgccccaaagagagaaaagaccaatggagaagttgaaaggcgtattgtttcacagctgttgacactcatggatgggctcaagtcgcgtgcacatgttattgttatgggcgctacaaaccgccctaacagtattgatcctgctctcagaagatttggtagatttgaccgggagattgacattggtgtccctgatgaggttgggcgcctggaagttctccggattcacaccaagaacatgaagttggcagaagatgttgaattggaacacatttcaagagacacccatgggtatgttggtgctgatctcgctgctctttgcactgaggctgctctccaatgcatccgtgagaaaatggatatcatagatcttgaggatgagaccattgatgctgagattctgaactctatggctgtgacaaacgaccatttcaagactgcattgacaacaagcaacccatctgctctccgtgaaactgttgttgaagttcccaatgtctcttgggaagatattggtggtctggagaatgtcaaaagagagctgcaggagactgtgcaataccctgtggagcatccagagaaattcgagaagtttggcatgtctccttccaagggtgttctgttctatggccctcctggctgtggtaagaccttgttggcgaaggctattgctaatgagtgccaggctaacttcatcagtatcaagggacctgagctgcttacaatgtggtttggtgagagtgaggctaatgtgcgtgagatctttgacaaggctagggggtcagcaccatgtgtcctcttctttgatgaactggactcgattgctacccagagaggaagcagcgttggggatgctggaggtgctgctgatagagtgctgaaccagctcctgactgagatggatggcatgaacgccaagaagactgtatttatcatcggtgccaccaacaggccagacatcattgaccctgccttgcttaggccagggcgtcttgatcagctcatctacatccctcttcctgatgttgagtcgaggctccagatcttcaaagcttgcctcaggaagtcccctgtggccaaggatgttgacctggatgctcttgccaagtacacccaagggttcagtggtgctgatatcactgaaatttgccagcgtgcctgcaaatatgccatcagggagaacatcgagaaggacatcgagagggagaggcggaagaaggacaaccctgaagccatggaggaagacgagactgacgagattgccgagatcagggctgcccacttcgaggagtcgatgaagtatgcccgccggagtgtgagcgacgccgacatccgcaagtaccaggccttcgcccagaccctgcagcagtctcgtgggttcggcagcgagttccggttccctgatgctccggcttcaggcaccgccgcagcagccgccgacccttttgcgtcttcggctgcagctgccgaagatgacgatttatatagttaaattatggaagtcctcttgttgtgccattaacttgccagtgacttcgttcgtatactttgtcatgctctgttttgcaagacacgggcagactatgtacctatttttaagtttatattgg

SEQ ID NO: 7438 - DNA, 2659 bp, Avena sativa
tctactcctcgctatctcaccgctctccgcaacaacccgggggtagagagagagagagagtcgccgaaacctagcgccgccgccggcgaccccccgaacccgccacgccatggcgaccccgaccccgcagggcgaggcctcctcctccgatccgaaatcgaagaaggacttctccacggcgatcctcgagaggaagaagtcgcccaaccgcctcgtcgtcgacgaggccaccaatgacgacaactccgtcgtcgccctccaccccgacaccatggagaagctccagctcttccgcggcgacaccgtcctcctcaagggtaagaagagaaaggacacaatctgcattgtgcttgcagatgacacatgtgaggaggcaaaggtcaggatgaacaagaccgtcaggaagaacctgagagtgaggcttagtgatgtggtgtctgttcatcagtgcccagatgtcaaatacgggaagcgtgtgcacatacttcctgttgatgacacggttgagggcattactggaaacttgtttgatgccttcttgaaaccatacttccttgaagcctaccgacctttgagaaagggtgaccttttccttgtcaggggtggaatgagaagtgtggaattcaaagttatagagactgaccctgcggagtattgtattgttgcacctgacactgagatattctgtgatggtgagcctattaagagagaggatgaggaaaggcttgatgaggttggctacgatgatgtcggtggagttaggaagcaaatggcccagatcagagaactggttgaactcccactgcgccatcctcagcttttcaagtctattggtgtgaagcctccaaagggtatattgctgtttggaccacctggctctggcaagacccttatcgctagggctgttgctaatgaaaccggggcattcttctttctgattaatggcccggaaattatgtccaagctagcaggagaaagtgagagcaatctcaggaaggcatttgaagaagctgagaagaatgcaccatcaatcattttcattgatgagattgactcaattgccccaaagagagaaaagaccaatggagaagttgaaaggcgtattgtttcacagctgttgacactcatggatgggctcaagtcgcgtgcacatgttattgttatgggcgctacaaaccgccctaacagtattgatcctgctctcagaagatttggtagatttgaccgggagattgacattggtgtccctgatgaggttgggcgcctggaagttctccggattcacaccaagaacatgaagttggcagaagatgttgaattggaacacatttcaagagacacccatgggtatgttggtgctgatctcgctgctctttgcactgaggctgctctccaatgcatccgtgagaaaatggatatcatagatcttgaggatgagaccattgatgctgagattctgaactctatggctgtgacaaacgaccatttcaagactgcattgacaacaagcaacccatctgctctccgtgaaactgttgttgaagttcccaatgtctcttgggaagatattggtggtctggagaatgtcaaaagagagctgcaggagactgtgcaataccctgtggagcatccagagaaattcgagaagtttggcatgtctccttccaagggtgttctgttctatggccctcctggctgtggtaagaccttgttggcaaaggctattgctaatgagtgccaggctaacttcatcagtatcaagggacctgagctgcttacaatgtggtttggtgagagtgaggctaatgtgcgtgagatctttgacaaggctagggggtcagcaccatgtgtcctcttctttgatgaactggactcgattgctacccagagaggaagcagcgttggggatgctggaggtgctgctgatagagtgctgaaccagctcctgactgagatggatggcatgaacgccaagaagactgtatttatcatcggtgccaccaacaggccagacatcattgaccctgccttgcttaggccagggcgtcttgatcagctcatctacatccctcttcctgatgttgagtcgaggctccagatcttcaaagcttgcctcaggaagtcccctgtggccaaggatgttgacctggatgctcttgccaagtacacccaagggttcagtggtgctgatatcactgaaatttgccagcgtgcctgcaaatatgccatcagggagaacatcgagaaggacatcgagagggagaggcggaagaaggacaaccctgaagccatggaggaagacgagactgacgagattgccgagatcagggctgcccactttgaggagtcgatgaagtatgcccgccggagtgtgagcgacgccgacatccgcaagtaccaggccttcgcccagaccctgcagcagtctcgtgggttcggcagcgagttccggttccctgatgctccggcttcaggcaccgccgcagcagccgccgacccttttgcgtcttcggctgcagctgccgaagatgacgatttatatagttaaattatgaaagtcctcttgttgtgccattaacttgccagtgacttcgttcgtatactttgtcatgctctgttttgcaagacacgggcagactatgtacctatttttaagttt

SEQ ID NO: 7439 - DNA, 2769 bp, Pinus pinaster
gggggggtttctcgattgctcgataaaggacccgcgaaatctcagaggttctgttacatgttacataatgaaattgcacatttgattttcatttttacactagttactagttcgtcacctgtgcaacaatggcgcacaagggagaatcttcagaaccgaaaggagtcaaaagggatttcagcactgctattttggagcggaagaaggctcccaatcgccttgttgtcgatgaggctatcaacgacgataactctgtgatctgtctgcatccggacaccatggaaaaattacagctcttccgcggagatacaattcttatcaagggcaagaagagaaaggatacgatttgtatcgctctcgctgatgagacgtgcgaagagcccaggattagaatgaacaaggttgtgcgttcgaatctgagggttcgactcggcgatgttgtttcggttcatcaatgccccgatgtaaagtacggcaagcgtgtgcatatcctgcctattgatgataccatcgagggtgttactggcaatctgttcgatgcatatttaaagccctatttcatggaggcctatcgcccagtaaggaaaggagaccttttccttgttagaggtggaatgcgcagtgtagagttcaaagtaatagagacggaccctggggaatattgtgttgtttctcctgatactgagatcttttgtgagggagagcctgtgaagcgggaggatgaagatagattggatgaagttggttatgacgatgttggcggtgtaaggaggcaaatggcccagattcgtgaattggttgagcttccactgaggcacccacagctctttaaatcaattggtgttaaaccaccaaagggaattttgctctttggaccacctggttcagggaaaaccttaattgctagggcagtagccaatgaaactggtgctttcttttcttaatcaatgggcccgaaattatgtcgaagttggctggagaaagtgaaagcaatctgaggaaagcctttgaggaggcagagaagaatgccccatccattattttattgatgaaattgattcaatagcacccaaaagagaaaagacacatggtgaggttgagaggcgaattgtttctcaacttctgacactgatggatgggctaaaatctcgagcccatgttattgtgataggagcaactaaccggccaaatagtattgacccagctcttagaaggtttggaaggtttgacagggaaattgatattggggttcctgatgaagtggggcggctggaagtccttcgtatacatacaaagaatatgaagctttcggacgatgttgatcttgaacgaattgcgaaggacacacatggatatgttggagctgatcttgcagctctttgcaccgaggctgcgctacagtgcatcagggaaaaaatggatgttatagacttggaagatgagaccatcgatgctgaaatcctcaattctatggctgttacaaatgagcacttccagactgcgttgggcaccagtaacccatctgccttacgtgaaactgttgttgaagtgcctaatgtttcttgggatgatattggtggtttggaaaatgtcaagagggagcttcaagagactgttcaatatccagtggagcaccctgagaaatttgaaaagtttggcatgtccccttcgaaaggagtgctcttttacgggccaccaggttgtggtaagacgctgcttgcaaaagctattgcgaatgagtgccaggccaattttatcagtgtaaaaggcccagaattattaactatgtggtttggagaaagtgaggctaatgttcgagagatttttgacaaagctcgacagtcagcgccttgcgtcttgttttttgatgagcttgattctattgctacacagcgagggagcagtgttggcgatgcaggtggtgctgcagacagagtcctaaatcagttgttaacagagatggatgggatgacagccaagaaaactgttttcattattggggccacaaataggccagatatcattgatcccgcattgctaaggcctggtaggcttgatcagttaatttacataccattacccgatgagagttcacgcctgcaaatttttaaagcatgcttgagaaagtcaccggttgccaaggatgttgatttgactgctttagctcgttatacccaaggattcagtggagctgatattacagaaatttgtcagcgggcttgcaaatatgccattcgagaaaacatcgagcaggatattgaacgtgaaaggaagagaaaagaaaatcctgaagctatggatgaggatgatagtgagggagtatctgaaataaaagcagctcattttgaggagtccatgaaatatgctcgaaggagtgtcagcgatgctgatattcgaaaatatcaagcatttgcacagacgctgcagcagtctcgaggttttggtacagaattccgatttgcagagaagccaggtggtacagcggcagctggttcttcagaaccatttactggagtagaaaataaagaagacgatgacttgtatagttgataggtcccgtagcattaacactgcctgattattaaagtggcatgtttatcttcttttgggcaacttagcgtatttcctgatacattgaaaagaatttatggaggttgttctagagaagaccttgttcacaaggtagtcgatgctatgaaaatctgcttcttctttaacgcgtagataactattgtcttaatatcaatcaatgtgtgagtcttcgtagac

SEQ ID NO: 7440 - DNA, 2467 bp, Flaveria ramosissima
gcgcctccgtcgaaaaaggacttctcgactgctatcttggagcgcaagaagtctccgaatcggcttgttgttgatgaggctgttaatgatgataactccgttgtcgctatgcatcctgctacgatggagaaattgcagcttttccgtggtgatacgatattgatcaagggcaagaaaagacgtgatacagtttgcattgcccttgctgatgaaacctgtgatgaaccaaagatcagaatgaacaaggttgttaggactaacctaagaattcgtcttggtgatgttgtgtcagtgcaccaatgccctgatgtcaagtatggaaaacgtatccatgttcttccacttgatgacaccattgaaggtgtcacaggagacttatttgatgcgtatctgaaaccatacttcttggaggcatacaggcccgtaaggaaaggagaccatttccttgtaagaggaggtatgcgcagcgtcgagttcaaagtaattgaaactgatccaggggaatattgtgttgttgctccagatactgaaattttctgtgagggtgagccaattaagagagatgacgaggatagattggatgaagtgggctatgatgatgtaggaggtgtcaggaaacaaatggctcaaattcgtgaattggtggaattaccattaagacaccctcaacttttcaagtcaatcggagtcaaaccccaaaaggaatcttgctctatggaccacctggttcaggaaagactctgatagccagagctgttgctaacgaaacaggagctttctttttctgcatcaatggtccagaaattatgtcaaaattggctggagaaagtgaaagcaatcttaggaaagcatttgaggaggctgagaagaacgccccatctattattttcattgatgagatagattcaattgctccaaagagagagaagactaatggtgaagttgaaaggaggattgtatcacagcttttgacacttatggatggattaaaatcgagggctcatgttattgtaattggggccacaaaccgcccaaacagcattgatcctgctctcagaagatttggtaggttcgatagggaaatcgacattggtgtcccagatgaagttgggcgtcttgaggttcttcgtatccacacaaagaacatgaagctttctgaggacgtcgatttggaaaagatatctaaggaaacacatggttatgttggtgctgatcttgctgctctttgtactgaagctgcacttcaatgcattagagaaaaaatggatgtcattgatttggaagatgaatctattgatgctgagattctgaattccatggctgtcacaaatgaacattttgctactgctcttggaactagcaatccatctgctctgcgtgaaactgttgttgaggttcccaatgttagctgggatgatattggaggccttgagaatgttaagcgtgagcttcaagagacggttcaatatccagtggagcatccagagaaatttgagaaatttggtatgtcaccatcgaaaggagttcttttctacggtccacctggatgtgggaaaacacttcttgcaaaagcaattgcaaatgaatgtcaagcaaatttcattagcatcaaaggacctgaattgctaactatgtggttcggtgagagtgaagccaatgttcgtgaaatttttgacaaagccagaggatctgctccatgtgtccttttctttgatgagcttgactccattgcaactcagagaggaagcagttctggagacgcaggtggtgctgctgaccgggttttgaaccaactcttgactgaaatggacggaatgtctgctaaaaagactgtttttataatcggagccactaatagacccgacattattgacccagcattacttcgacctgggcgtctcgatcaacttatctacattcccttaccagatgaagaatcgcgctactcgattttcaaggctgcaatgaggaaatcccctgtctctaaagatgttgatctgagagctcttgctaagtacactcaaggattcagcggggctgatattactgagatatgtcaacgggcctgcaaatatgcaattagagagaacatcgagaaagatatagagagggaaagaaagaggagtgagaatcccgactcgatggatgaggatgaggatgatgtggctgagataaaggcggctcactttgaggaatccatgaagtatgcacgcagaagtgtgagtgatgctgacatcaggaagtaccaggcgtttgctcagacattgcagcagtcgagaggatttggatctgaatttcgattcccagaagcaacatctggtggtgcagctgacccgtttgctgcttctgctggtggagctaatgatgatgacttatacagttaggttttgtaaagtattcctgaaaactgatgtcttaaggaaggaatagacttgctggaccttcttcaatttgtgggttttacatg

SEQ ID NO: 7441 - DNA, 2676 bp, Pinus pinaster
atatggtcactcacgaaattgcgaaattgtttgcggatcagacatcatggcgcacaagggagaatcttcagaaccgaaaggagtcaaaagggatttcagcactgctattttggagcggaagaaggctcccaatcgccttgttgtcgatgaggctatcaacgacgataactctgtggtctgtctgcatccggacaccatggaaaaattacagctcttccgcggagatacaattcttatcaagggcaagaagagaaaggatacgatttgtatcgctctcgctgatgagacgtgcgaagagcccaggattagaatgaacaaggttgtgcgttcgaatctgagggttcgactgggcgatgttgtttcggttcatcagtgccccgatgtaaagtacggcaagcgtgtgcatatcctgcctattgatgataccatcgagggcgttactggcaatctgttcgatgcatatttaaagccctatttcatggaggcctatcgcccagtaaggaaaggagaccttttccttgttaggggtggaatgcgcagtgtagagttcaaagtaatagagacggaccctggggaatattgtgttgtttctcctgatactgagatcttttgtgagggagagcctgtgaagcgggaggatgaagatagattggatgaagttggttatgacgatgttggcggtgtaaggaggcaaatggcccagattcgtgaattggttgagcttccactgaggcacccacagctctttaaatcaattggtgttaaaccaccaaagggaattttgctctttggaccacctggttcagggaaaaccttaattgctagggcagtagccaatgaaactggtgctttctttttcttaattaatgggcccgaaattatgtcgaagttggctggagaaagtgaaagcaatctgaggaaagccttcgaggaggcagagaagaatgccccatccattattttattgatgaaattgattcaatagcacccaaaagagaaaagacacatggtgaggttgagaggcgaattgtttctcaacttctgacactgatggatgggctaaaagctcgagcccatgttattgtgataggagcaactaaccggccaaatagtattgacccagctcttagaaggtttggaaggtttgacagggaaattgatattggggttcctgatgaagtggggcggctggaagtccttcgtatacatacaaagaatatgaagctttcggacgatgttgatcttgaacgaattgcaaaggacacacatggatatgttggagctgatcttgcagctctttgcaccgaggctgcgctacagtgcatcagggaaaaaatggatgttatagacttggaagatgagaccatcgatgctgaaatcctcaattctatggctgttacaaatgagcacttccagactgcgttgggcaccagtaacccatctgccttgcgtgaaactgttgttgaagtgcccaatgtttcttgggatgatattggtggtttggaaaatgtcaagagggagcttcaagagactgttcaatatccagtggagcaccctgagaaatttgaaaagtttggcatgtctccttccaaaggagtgctcttttacgggccaccaggttgtggtaagactctgcttgcaaaagctattgcaaatgagtgccaggccaattttatcagtgtaaaaggcccagaattattaactatgtggtttggagaaagtgaggctaatgtaagagagattttcgacaaagcccgacagtcagcgccttgcgtcttgttttttgatgagcttgattctattgctacacagcgagggagcagtgttggcgatgcaggtggtgctgcggacagagtcctaaatcagttgttaacagagatggatgggatgacagccaagaaaactgttttcattattggggccacaaataggccagatatcattgatcctgcattgctaaggcctggtaggcttgaccagttaatttacataccattacccgatgagagttcacgcctgcaaatttttaaagcatgcctgagaaagtcaccggttgccaaggatgttgatttgactgctttagctcgttatacccaaggattcagtggagctgatattacagaaatttgtcagcgggcttgcaaatatgccattcgagaaaacatcgagcaggatattgaacgtgaaaggaagagaaaagaaaatcctgaagctatggatgaggatgatagtgaggaggtgtctgaaataaaagcagctcattttgaggagagcatgaaatatgctcgaaggagtgtcagcgatgctgatatccgaaaatatcaagcatttgcacagacgctgcagcagtctcgaggttttggtacagaattccgatttgcagacaggccaggtacagcggcagctggttcttcagaaccagcagaaaataaagaagacgatgacttgtatagttgataggtcccgtagcattaacactgcctgattagtaaagtggcatgtttagcttcttttgggcaacttggcgtatttcctgatacattgaaaagaatttatggaggttgttctagagaagaccttgttcacaaggtagtcgatgctatgaaaatttgctttttctttaacgcgtagataacttttgtcttaatattaatcaatgtgtgagtcttcgtagac

SEQ ID NO: 7442 - DNA, 2698 bp, Pinus pinaster
gggtttctcgattgctcgataaaggacccgcgaaatctcagaggttctgttacatgttacataatgaaattgcacatttgattttcattttacactagttactagttcgtcacctgtgcaacaatggcgcacaagggagaatcttcagaaccgaaaggagtcaaaagggatttcagcactgctattttggagcggaagaaggctcccaatcgccttgttgtcgatgaggctatcaacgacgataactctgtgatctgtctgcatccggacaccatggaaaaattacagctcttccgcggagatacaattcttatcaagggcaagaagagaaaggatacgatttgtatcgctctcgctgatgagacgtgcgaagagcccaggattagaatgaacaaggttgtgcgttcgaatctgagggttcgactcggcgatgttgtttcggttcatcaatgccccgatgtaaagtacggcaagcgtgtgcatatcctgcctattgatgataccatcgagggtgttactggcaatctgttcgatgcatatttaaagccctatttcatggaggcctatcgcccagtaaggaaaggagaccttttccttgttagaggtggaatgcgcagtgtagagttcaaagtaatagagacggaccctggggaatattgtgttgtttctcctgatactgagatcttttgtgagggagagcctgtgaagcgggaggatgaagatagattggatgaagttggttatgacgatgttggcggtgtaaggaggcaaatggcccagattcgtgaattggttgagcttccactgaggcacccacagctctttaaatcaattggtgttaaaccaccaaagggaattttgctctttggaccacctggttcagggaaaaccttaattgctagggcagtagccaatgaaactggtgctttctttttcttaatcaatgggcccgaaattatgtcgaagttggctggagaaagtgaaagcaatctgaggaaagcctttgaggaggcagagaagaatgccccatccattattttattgatgaaattgattcaatagcaccaaagagaaaagacacatggtgaggttgagaggcgaattgtttctcaacttctgacactgatggatgggctaaaatctcgagcccatgttattgtgataggagcaactaaccggccaaatagtattgacccagctcttagaaggtttggaaggtttgacagggaaattgatattggggttcctgatgaagtggggcggctggaagtccttcgtatacatacaaagaatatgaagctttcggacgatgttgatcttgaacgaattgcgaaggacacacatggatatgttggagctgatcttgcagctctttgcaccgaggctgccctacagtgcatcagggaaaaaatggatgttatagacttggaagatgagaccatcgatgctgaaatcctcaattctatggctgttacaaatgagcacttccagactgcgttgggcaccagtaacccatctgccttgcgtgaaactgttgttgaagtgcccaatgtttcttgggatgatattggtggtttggaaaatgtcaagagggagcttcaagagactgttcaatatccagtggagcaccctgagaaatttgaaaagtttggcatgtctccttcgaaaggagtgctcttttacgggccaccgggttgtggtaagacgctgcttgcaaaagctattgcgaatgagtgccaggccaattttatcagtgtaaaaggcccagaattattaactatgtggtttggagaaagtgaggctaatgttcgagagattttcgacaaagcccgacagtcagcgccttgcgtcttgttttttgatgagcttgattctattgctacacagcgagggagcagtgttggcgatgcaggtggtgctgcggacagagtcctaaatcagttgttaacagagatggatgggatgacagccaagaaaactgttttcattattggggccacaaataggccagatatcattgatcctgcattgctaaggcctggtaggcttgaccagttaatttacataccattaccagatgagagttcacgcctgcaaatttttaaagcatgcttgagaaagtcaccggttgccaaggatgttgatttgactgctttagctcgttatacccaaggattcagtggagctgatattacagaaatttgtcagcgggcttgcaaatatgccattcgagaaaacatcgagcaggatattgaacgtgaaaggaagagaaaagaaaatcctgaagctatggatgaggatcatagtgaggaggtatctgaaataaaagcagctcattttgaggagtccatgaagtatgctcgaaggagcgtcagcgatgctgatatccgaaaatatcaagcatttgcacagacgctgcagcagtctcgaggttttggtacggaattccgatttgcagagaggccagatacagtggcagctggttcttcagaaccatttaatggaacagaaaataaagaagacgatgacttgtatagttgataggtcccgtagagcattaacactgcctgattattaaagtggcatgtttatcttcttttgggcaacttagcgtatttcctgatacattgaaaagaatttatggaggttgttctagagaagaccttgttcacaaggtagtcgatgctatgaaaatctg

SEQ ID NO: 7443 - DNA, 2691 bp, Arnica chamissonis
ctgccgttctgccattgtttctcttcgaattctccctcactctcggatttcttctccgaatcgaagcatcaatctccgtcatctcgatatgagcaatcagccggagtcttcttcatcggagccgaaaggcccaaagaaggacttttcaaccgctatcttggagcgcaagaagtctccgaatcggctcgtcgttgacgaagcggtcaatgacgataactcagtcgtcgctatgcatcctactacgatggagaagctgcagctcttccgtggtgataccatactgatcaaggggaagaaaagaagagacacagtctgcatcgcccttgctgacgaaagctgtgatgagccaaagatcagaatgaacaaggttattagaacaaaccttaggattcgactaggagatgttgtatctgtgcaccagtgcccagatgtgaagtatggtaaacgaatccatgttcttcctctggatgacaccattgaaggcgtcacaggggacctgttcgatgcatacctgaaaccctactttttggaggcatataggcctgtaagaaaaggggatcattttcttgttagaggaggtatgagaagtgtagagtttaaagtgattgagactgacccaggggagtactgtgttgttgctcccgacactgaaatcttttgtgagggagagccgattaagagggatgatgaggatcggttggatgaaattggttatgatgatgtaggcggggtccggaaacaaatggctcagattcgtgaattggttgaattgccattaagacatcctcaactttttaaatccattggagttaaaccgcctaaaggtatcttactctatggaccccctggttctggaaaaacactcatagcaagagctgtagccaatgaaactggagcattctttttctgcatcaatgggccagaaatcatgtcaaaattagctggagagagtgagagtaatcttagaaaggcgtttgaggaggctgaaaagaacgccccatcgatcatttttattgatgagattgattcaattgctcccaaaagagaaaaaactaatggtgaagttgaaaggaggattgtttcacaattactgacacttatggatggattaaaatctcgtgcacatgttattgtaatgggggccacaaatcgcccaaacagtattgatcctgctttgagaaggtttggtaggtttgatagggaaattgacattggtgttcctgatgaagttgggcgtcttgaggttattcgtattcacaccaagaacatgaagctttctgacgatgttgatttggaaaagatagctaaagaaacacatggttatgtcggtgctgatctggctgcactctgcactgaagctgcacttcaatgcattagagagaaaatggatgtcattgacttggaagatgaatctattgatgctgagatactgaattccatggcagtttccaatgatcattttcagacggctcttggaacaagcaatccatctgctttgcgtgagactgttgtggaggttcccaattgcagctgggaggatattggaggtcttgaaaatgttaagcgtgagctgcaggagactgtccaatatcccgtggagcaccctgagaaatttgagaaatttggcatgtcaccatcaaaaggtgttcttttctatggaccacccggatgtggcaagacacttctagctaaggctattgcaaacgagtgtcaagccaatttcattagtatcaaagggcccgaattgcttacaatgtggttcggtgagagtgaagccaatgttcgtgaaatctttgacaaggcccgtgggtctgcaccgtgtgtcctcttctttgatgaacttgattccattgcaactcagaggggaagtagttctggggatgcaggtggtgctgctgatcgggtgttgaatcagttattaactgaaatggatggaatgtctgccaaaaagacggttttcataatcggagccacaaatagaccggacatcattgaccctgcattactccgtccagggcggcttgatcaacttatttatatcccactaccagatgaggactcccgccaccagattttcaaggcggcaatgaggaagtctccggtttctaaggatgttgatttgagagctctagctaagtatacacaaggctttagtggggccgatattacagagatatgccaacgggcctgcaagtatgcaatcagagagaacatcgagaaagatatagagaaggaaaggaagagaagtgagaatcccgactctatggatgaggatgaagaggaggtggcagagattaaggcagcccacttcgaggaatccatgaagtatgcacgcagaagtgtgagtgatgccgacataaggaaataccaggcgtttgctcagacattgcagcagtctcgaggatttgggtcggagtttcggttcccagaagcagcatctggggcggctgctggtggtggtagttctgacccgttttccgccaccgctgggggcgctgatgatgatgatttatacaactagatttacatacatcttgttgctgaagtcgcgattcatgaaggattattatatatttatatcctataccagttgccgatgtactgctgcttttcaaacctcttgttttgaatatggttgacgctttttatgttagaacttgtaaccactttcatgtttttaaatttggatcc

SEQ ID NO: 7444 - DNA, 2834 bp, Setaria italica
tccgagtcccaaacccccgctgcaagaaagaagctataaaggaacgctaatcccctcctcggctcctccacatctcgcatcctctcgccgctgccgctgcaattaacgccaccgccggccaacaacccgaaacctacctccgccgccgcagccgccgacatggcgagccaaggggagccgtcggcctccgcttccgatccgaaggggaagaaggactactcgacggcgatcctggagaggaagaagtcgcccaaccgcctcgtcgtcgacgaggccaccaacgacgacaactccgtcgtcgcgctgcacccggacaccatggagaggctgcagctcttccgcggagacaccgtgctcctcaagggtaagaagaggaaagacactatttgcattgtccttgcggatgaaacctgtgaggagccgaaggtccggatgaacaaggttgtccgccagaacctgagggtgaggcttggtgatgtggtttctgtccaccagtgccaggatgtgaaatatgggaagcgtgtacacattcttccaattgatgatacagttgaaggcattacagggaacctgtttgatgccttcttgaaaccatacttcctggaagcataccgcccggttaggaaaggcgatcttttccttgtcaggggtggaatgcgaagtgtggagttcaaagtgatagagactgaccctgctgagtattgcatcgttgcaccagatactgaaatattttgtgatggagagcctattaagagggaggatgaggaacgtcttgacgaagttggctatgatgacgttggtggagttaggaagcagatggcccaaatcagggagcttgttgagcttccactgcgccatcctcagcttttcaaatctattggtgtgaagccaccaaagggcatattgctgtatggaccacctggttctggaaagactcttattgctcgtgctgttgcaaatgagactggagcctttttcttccttatcaatggcccagagattatgtcaaagctagcaggagagagtgagagcaatctcaggaaggcatttgaagaagcagagaagaatgctccatctatcattttcattgatgaaattgattccattgctcccaagagagagaagaccaatggagaagtggagcgtcgtattgtgtcacagctactgactcttatggatggactcaaagctcgttcccatgttattgttatgggtgctacaaaccgaccaaacagcattgatcctgctcttcgaagatttggaaggtttgaccgggaaattgacatcggtgttcctgatgaagttggaaggcttgaggttctccgcattcacactaagaacatgaaactagctgaagatgttaatttggaactcattgccaaggatacccatggatatgttggtgctgatcttgctgctctttgcactgaggctgctcttcagtgcattcgtgagaagatggacatcattgatcttgaggatgagacaattgatgctgagatattgaactcgatggctgttacaaatgaccatttcaagactgcacttggaacaagcaacccatctgctcttcgtgaaactgttgttgaagttcctaatgtctcttgggaggatattggtgggcttgataacgtcaagagggagctccaggagactgttcaataccctgtggagcacccagagaagttcgagaagtttggcatgtctccatccaaaggggttctgttctatggccctcctggttgtggtaagaccttgttggctaaggcaattgccaatgagtgccaggccaacttcatcagtgtcaagggtcctgagttgctgaccatgtggtttggtgagagtgaagccaatgtccgtgaaatcttcgacaaggctcgccagtctgccccctgtgtcctcttctttgatgaacttgactcgattgctactcagagaggaagcagtgtaggtgatgctggaggcgcagctgatagagtgcttaatcagcttttgacagagatggatggcatgaatgccaagaaaaccgtgttcattattggggctacaaacaggcctgatatcatcgatccagcactgcttaggccaggccgtcttgaccagctgatctacattccactgcccgatgagcagtctaggctccagatcttcaaggcctgccttaggaagtcccctgtggcgaaggaagtggacttgaatgctcttgccaagtacacccaagggttcagtggtgcagatatcacagaaatttgccagcgtgcagttaaatatgccatcagagagaatatcgagaaggatattgagagggaaaggcggagaaaggacaaccctgaggcaatggaggaggatgaagtcgatgacattgctgaaatcaaggcagctcactttgaggagtcaatgaagtacgcccgtcgcagtgtcagcgatgccgatatccgcaagtaccaggcgttcgcccagacattgcagcagtcccgtgggtttggcagcgagttccgcttctcggagcagtccacgaccgctggtcctgcagctgcagccgatccttttgcttccacaggcggagcggatgatgacgatctatacagctaggtgtcttgttgggttggttctgggtcgtgtttgatatcagttgtgtcagtcatgtgtttaaaactaatcgtactttagacacgggatgtcctgcaatgatatttattttccgtacatttggacgtcgccgactctcggcttttactttatcatgatacatgctgttggccatgtcgtcattggttgatgacaatctcaatgagaatatctttgctgggttctgcagttatgatttatgttca

SEQ ID NO: 7445 - DNA, 2744 bp, Lactuca sativa
attcaccctttctgttactcgcattctcctcttctccgagttcctcctcactgacggattccttctccatatcggagcacccaatctccagtcattcgatatgagcaatcagccggagtcttcttcatcggagccgaaaggcccgcctgcggcgaaaaaagacttttcaaccgctatcttggagcgcaagaagtctccgaaccggcttgtcgttgacgaagccgtcaatgacgacaactcagtcgtcgctatgcaccctaatacgatggagaagttgcagcttttccgcggtgataccatactgatcaaggggaagaaaaggagagatacagtctgcattgcccttgctgatgaaacctgtgatgaaccaaagatcagaatgaacaaagtcattcgaacaaacctaagggttcgacttggagatgttgtatctgttcaccaatgtccagatgtgaaatatgggaaacgtatccatgtccttcctctagatgacaccattgaaggtgtcacaggagacttattcgatgcttacctcaaaccctacttcttggaggcatatagacctgtaagaaagggtgatcattttcttgtgagaggaggcatgcgaagtgtggaattcaaagtaattgaaactgatccaggggagtattgtgttgttgctccagacactgaaatattctgtgagggtgaacctatcaagagagacgatgaagataggctagatgagattggttatgatgatgttggtggtgtaagaaaacaaatggctcaaattcgtgaacttgttgaattaccattacgccacccacagcttttcaaatccattggagtaaaacctccaaagggtattttactatatggccctcctggatctggaaagacactcatagcaagagcagtagccaatgaaacaggagctttctttttctgcatcaatgggcctgaaatcatgtcaaaactggctggagaaagtgagagcaacctcaggaaggcttttgaagaggctgaaaagaatgccccttcgattattttcattgatgagattgactcaattgcccctaaaagagagaagactaatggtgaagttgaaaggaggattgtttcacagctgttgacacttatggatggattaaaatcacgtgcacatgttattgtaatgggagctacaaatcgccctaatagcattgaccctgctttaagaaggtttgggagattcgatagggaaattgacattggtgtccctgatgaaattgggcgtcttgaggttattcgtatccacactaagaacatgaaactctctgatgatgttgatttggaaaagatagctaaagaaacacacgggtatgtcggtgctgacctggcagctctctgtactgaagctgcactacaatgcattagaaaaaaaatggatgtgattgatttggaagatgattccattgatgctgagattctgaattccatggctgtttcaaatgaacatttccagactgctcttggaacaagcaatccctctgccttgcgtgaaactgttgtggaagttcctaattgcagctgggatgatattggaggtcttgagaatgttaagcgtgagcttcaagagactgttcaataccctgtggagcaccctgagaaatttgagaaatttgggatgtcaccctcgaaaggagttcttttctatggcccacctggatgtggaaagacacttttagccaaggctattgctaatgaatgtcaagctaactttatcagcattaaaggacctgaattgcttactatgtggtttggtgaaagtgaagccaatgttcgtgagatttttgataaggctagaggatctgcaccctgtgtccttttctttgatgaacttgattccattgcaactcagaggggaagtagttccggggatgcaggaggagctgcagatcgtgttctgaaccaactgctgacagaaatggacggaatgtcagcaaaaaagacggttttcataatcggagccaccaacagaccggacataatcgaccctgcactgcttcgtccagggcggctcgatcaactgatttatatcccactacctgacgaggattcccgccaccagattttcaaggcggcaatgcgcaaatcccccgtttccaaagatgtcgatttaagagccctcgccaaatacactcaaggctttagcggtgctgacatcaccgaaatttgccagcgtgcctgcaagtatgcaatccgagagaacatcgagaaagatatagagagggaaagaaagaggagtgagaatccagactccatggatgaggatgaagatgaggtggcagagattaaggctgcacattttgaggagtctatgaaatatgcgcgtagaagtgtgagtgatgcggatattagaaagtatcaagcgtttgctcagacattgcaacagtccagagggtttggctcggagttccggttccctgaagcggctggagcggcggcagctggtggttctgacccgtttgcggcggcggctggtggtggtggagatgatgatgacttatacagttagatttttatataaattatgctaaagtcatgtgactggcatttgatttcagtttcggttgttgattctctgttctattttggatgttttgttatggatgtttaacacttactgttgtttacaatttgcctttcaaacttgggattcaacttgtttgaattttgattgtttgtttgtttttaattttattaaggtgtatgacttagcg

SEQ ID NO: 7446 - DNA, 2889 bp, Picea glauca
  misc_feature (1576)..(1576): n is a, c, g, or t
  misc_feature (2852)..(2853): n is a, c, g, or t
  misc_feature (2886)..(2888): n is a, c, g, or t
ctgtcacattttctcacagacgaatttcgtgtgcggatcagacatccctcgaataacaaacgctcgtgcagccatggcgcacaagggagaatcttcagaaccgaaaggaaccaagagggattacagcactgctattttggagcggaagaaggctgcgaatcgccttgttgttgatgaggccatcaatgacgataactccgtggtctgtctgcatccggacaccatggaaaaattacagctgttccgcggagatacaattcttatcaagggtaaaaagagaaaggatacgatttgtatcgctctcgctgatgagacgtgcgaagagcccaggattagaatgaacaaggtcgtgcgttcgaatctgagggttcggctcggtgatgttgtttcggttcaccagtgccccgatgtaaagtatggcaagcgtgtgcatatcctgcctatggatgataccatcgagggcgttaccgggaatttgttcgatgcttatttaaagccctatttcatggaggcctatcgcccagtaaggaaaggagaccttttccttgttagaggtggaatgcgcagtatagagttcaaagtaattgagacggaccctggggaatattgtgttgtttctcctgatactgagatcttttgtgagggagagcctataaagagggatgatgaagatagattggatgaagtaggttatgatgatgttggtggtgtaaggaggcaaatggcccagattcgtgaattggttgagcttccacttagacacccacagctcttcaaatcaattggtgtgaagccaccaaagggaattttgctctttggaccacctggttctggaaaaaccttaattgcaagggcagttgcaaatgaaactggtgctttctttttcttaattaatgggcctgaaattatgtcaaagttggctggggaaagtgaaagcaatctaaggaaagcctttgaggaggctgagaagaatgccccatccattatttttattgatgaaattgattcaatagcacccaaaagagaaaagacacatggtgaagttgagaggcgaattgtttctcaacttctgacactgatggatgggcttaaatctcgagcccatgttattgtgattggagcaacaaaccggccaaatagtattgacccagctcttagaaggtttggaaggtttgacagggaaattgatattggtgttcctgatgaagtgggacggctggaagtccttcgtatccatacaaagaatatgaagctttctgaagatgttgatcttgaacgaattgcaaaggatacacatggatatgttggagctgatctcgcagctctttgcaccgaggctgcgctacagtgcatcagggaaaaaatggatgttattgacttagaagacgagactatcgatgctgaaatcctcaattctatgtctgttaccaatgagcacttccagactgcgttgggctccagtaacccatctgccttgcgtgaaactgttgtcgaggtgcccaatgtttcttgggaggacattggtggtttggaaaatgtcaagagggagcttcaagagactgttcaatatccagtngagcaccctgagaaatttgaaaagtttggcatgtctccttcaaaaggtgtgctcttttatgggccaccaggttgtggaaagactctgcttgcaaaagctattgctaatgagtgccaggccaatttcatcagtgtaaaaggcccagaattattaaccatgtggtttggagaaagtgaggctaatgttcgagagattttcgacaaagcccgacagtcagcgccatgtgtcttgttctttgacgagcttgattctattgctacacagcgagggagtagtgtcggcgatgcaggtggtgctgcggacagagttctcaatcagttgttaacagagatggatgggatgacagccaagaaaactgttttcatcattggggctacaaataggccagatatcattgatcctgcattgctaaggcctggtcggcttgaccagttaatttacataccattacccgatgagagttcacgcctccaaatttttaaagcttgcttgagaaagtcaccggtatccaaggacgttgatctgactgctttagcccgttatacccaaggatttagtggagctgatattacagaaatttgtcagcgggcttgcaaatatgccattcgagaaaacattgagcaggatattgaacgtgaaaggaagagaaaagataatcctgaagctatggatgaggatgatagtgaggaggtatctgaaataaaagcggctcactttgaggagtccatgaaatatgcccgaaggagtgtcagcgatgctgatatccgaaaatatcaagcatttgcacagacgctgcaacagtctcgaggttttggttccgaattccgatttgcagacaggccagctactacaccgggggctggggcttcagatccatttactacagaagatactaaagaagacgatgacttgtatagttgataggttttgtagcatttaatactgcctgattaaagtggccacatttatcttcttctgggcgactaaagcctattccccgatacactgaaatgaatttatgaaggcttctctagagaaagaagagattgttcactaggggtagttgatgctatggaaatctgttttttctttgacgcgtagataccttttgtcttaatattaattaatgcgtgtgcaagtctttgtagaagtttttttgttcaattgtctctgataacaattaggacattgtaagtggcagtgatctttgtttttattttacacccataaatatactttagagtcagatatttgatatgaatatcttagaagttannctaaatgttgtgatactaaacatgatctcctannna

SEQ ID NO: 7447 - DNA, 2626 bp, Taxus baccata
ttcgcagcaatggctcacaagggagaatcatcagaaccgaagggaaccaaaagagacttcagcactgcaattttagaccgaaagaaggcggcgaatcggctggtggtggacgaagccattaacgatgacaactccgtggtctgtctgcacccggacaccatggaaaaattacagttgttccgtggagacaccatccttattaagggtaaaaagaggaaggatactatttgtattgctctggcggacgagacatgcgaagagcccaagatacgaatgaacaaggtcgtgcgttcgaatctcaggattcgtttgggagacgtggtttctgttcaccaatgtcccgatgttaagtacggcaagcgcgtccatattcttcccattgacgataccatcgagggcgtcaccgggaatttgtttgatgcctatctaaaaccctatttcttggaagcttatcgtccagtaagaaaaggagatcttttccttgtcagaggtggaatgcgtagtatagagttcaaagtaattgagacagaccctggggaatattgtgttgtttctcccgatacagaaattttctgtgagggcgagccggtaaagcgtgaggatgaagatagattggatgaaataggttatgatgatgttggaggtgtacggaaacaaatggctcagattcgtgaattggtagaactaccacttcggcatccacagctctttaaatcaataggtgtgaagccccctaagggtattcttctttatggaccacctggttctgggaaaactttaattgccagagcagttgctaatgagacgggtgcgttctttttctgtatcaatggacctgaaattatgtcaaagttggctggagaaagtgaaagcaatcttcggaaggcttttgaggaggccgagaagaatgccccctccattatatttattgatgaaattgattccatagctcccaagagggaaaaaacccatggtgaagttgagagaagaattgtttctcaacttctcacacttatggatgggctaaaatctcgtgcccatgttattgtgattgaagcaacaaaccgaccaaacagtattgatccaactctgagaaggtttggaaggtttgatagagaaattgatattggtgttccagatgaagtgggcaggttggaagtgctccgcatccatacaaagaatatgaagctctctgatgatgttgatcttgaaaggattgcaaaagatacacatggatatgttggagcagatcttgcagctttgtgtactgaggctgcactacaatgtattagggaaaaaatggatgtcattgacttggaagatgagacaatagatgctgaaattcttaattcaatggctgtcactaatgagcattgtcagactgcattgggctccagtaatccatctgctctgcgtgaaactgttgttgaagtgccaaatgtcacttgggaagatattggcggattggaaaatgtcaagagggagcttcaagagactgttcaatatccagtggagcatcctgagaaatttgaaaaatttggcatgtctccttcaaaaggagtgctcttttatgggccaccaggttgtggaaagacattgcttgcaaaagccattgctaatgaatgtcaggccaattttatcagtgtgaaaggcccagaattattaacaatgtggtttggagagagtgaagctaatgtaagagaaatttttgacaaagctagaggttcagctccttgcgtactgttctttgacgagcttgattctattgccacacagcatggcagcagtgttggggatgctggtggtgcagcagacagggtgcttaatcagttggtgactgagatggatggtatgacagctaagaaaactgttttcattattggggctacaaacaggcctgatatcattgatcctgcactgttaaggcctggtcgacttgatcagttgatctatattcctttgcctgatgaaagctcacgataccaaattttcaaatcctgtctgagaaagtcacccgtttcaaaggatgttgacctaatggcacttgctcgatatacccaaggattcagtggagctgatattacagagatctgtcaacgggcttgcaagtatgctattagagaaaatattgagaaggatattgaacgtgaaaggaaaagaagtgagaatcctgaggcaatggatgaagatgatagtgatgaggtgtctgaaatcaaagcagctcatttcgaggaatccatgaaatatgcccgaagaagtgtgagtgatgctgatattcgtaagtaccaagcatttgcacaaacactgcagcaatctcgaggctttggttctgaatttcgatttccagacagacctgttggtaccgcagttggggcgacagatgcttttgctacagaagataataaagatgatgatgacttatacagttaaatagattttgtacataagtgtcatctttataaagtggcaaatgtcatctgctttagcaggaaccttcctctcacaactagccagtactattaaatgtggctcggctatgcttgtatgagtttaatatttatatgttatctgaactttatgcattaacatgtcttcttttctcctttttccaaagaactaatagaac

SEQ ID NO: 7448 - DNA, 2794 bp, Populus trichocarpa
gctcgacactgaagttagcgtgtcggtccctgttttccatatcgaagatagactccacctcctgactgttgtcaatatataaatatacaaaataaacacctctcttcaatttatcctctgctagctctcaactctcaaagtcaatggccgatccaagctctagtcagccctctccttccacagaccctaagaaagattattcgactgcaattttggagcgaaagaagtctcccaatcgacttgttattgacgaggccatcaatgatgataactctgtggtggctatgcatcctgctaccatggaaaagcttcagttttttcgtggtgacactgtgctaattaagggaaagaagcgaaaagacactgtttgcattgttcttgctgatgaacaatgtgaggaaccgaaaatcagattgaacaaagttgtcagggctaatcttagagtccgccttggagatgttgtgtctgtccatcaatgtcctgatgtgaagtatgggaagcgagttcatatccttcctattgatgacactatcgagggtgttactggaagtctttttgatgcatatttaaagccatatttcttggaatcgtaccgccctgtaagaaaaggtgaccttttccttgtcaggggtggcatgcgcagtgttgagttcaaagtaattgagacagaccctggtgaatactgtgttgtggcaccagacaccgagatcttttgtgaaggagagcccatcaaacgtgaggatgaggagaggttgaatgaagtgggctatgatgatgttggtggtgttaggaaacagatggctcagattcgtgagctagttgaacttcctcttaggcacccacagcttttcaaatcaattggtgttaaaccaccaaaaggtatcttgctgtatgggccacctgggtctggtaaaactctgattgcaagagctgttgctaatgagacaggtgcattcttctttttgattaatggtcctgagataatgtcaaagctggctggtgagagtgaaagcaacttgaggaaggcatttgaggaagctgaaaagaatgctccatccataatttttattgatgagttagattctattgctcccaagagggaaaagactcacggtgaagtggagaggcgtatagtttcacagcttttgactttaatggatggcctcaagtcacgggcacatgtgattgttatgggagctaccaataggcccaatagcattgacccagctttgaggagatttgggagatttgatcgagagattgacattggtgtgcctgatgaagttggacggttggaggtccttagaattcatactaaaaatatgaaacttgctgaagatgttgatcttgaaagagttgcaaaagatacccatggttatgttggtgctgatcttgcagctctttgtactgaggctgctcttcagtgtattagggagaaaatggatgttattgatttagaggatgagacagttgatgccgaggtgttaaactcaatggctgtgactaatgaccacttccaaactgcattgggaacttcaaatccatctgcgttgcgcgaaacagttgtggaggttcctaacgtctcatgggaggatattggtggattagagaatattaaaagagagcttcaagagactgtccaatatcccgtggagcatcctgagaagtttgagaaatttggcatgtcaccttctaaaggtgttctcttttatggacctcctggctgtggtaaaaccctacttgcaaaggcaattgctaatgaatgccaggccaacttcataagtgtcaagggtcctgagctgctaactatgtggtttggagaaagtgaagcaaatgtgcgggagatatttgacaaagcacggcagtcagctccttgtgtacttttctttgatgaacttgattccattgctactcagcggggcaactcttctggagatgctgggggagctgcagatagagtcttgaatcaacttctgacagaaatggatggcatgacggcaaagaaaacagtttttatcattggtgcaacaaacaggccagatattatcgacccagcattgctcaggcctgggcgtctggaccagttgatttatatacctcttcctgatgaggcttcccgtcttcagatatttaaagcatgtttgcgcaagtcacctgtttctagggatgttgacctggcagctcttgcacgatatactcatggatttagtggtgctgatatcactgaaatttgtcaacgtgcctgcaaatatgccattagagaaaatattgagaaggatattgagaaggagaaaaggaagcaagacaatcctgaagcaatggaagaagatgatgtggatgaggtcccagaaataacggcagcacattttgaggagtcaatgaaatttgcacgtcgaagtgtcagtgatgcagacatcaggaagtaccagctctttgctcagaccttacagcaatctcgtggatttggtactgagttccggtttccagaccgtgctgagaatgtggcaggtgaaggagccactgatccatttgctccagcaactattgctgccgaggaggatgatctatacagctgaactgaaaccggtgcaagttcttagcgttctcacttatgtaaatatctaacacataacggcaatacatgccatattagtatgctttttatttgccaaggaatttaagttttatgttttgtgcaccctgcggattatgtaagaattttatgataatcagcccaatatgggttggatcttgccatgaggtgaaaataaaggtcctgtgcattgtgcttaat

SEQ ID NO: 7449 - DNA, 2872 bp, Ambrosia trifida
gttaaaagataataataaataatcatctttctttattaacaagatatatacaaaaccattaacaagatatatacaaaaccagaaccctctcctctcttctccactccaaacccacaacccaaaattctcgaaccttcttacctttcaccactctttaacataatccatcattctgcatcatcatgaataaccaacctgaatcatccgattctaagggtgggaagaaagacttcagtacagcgattcttgagcgaaagaaggcacccaacagactcgttgttgatgaagctcttaatgatgacaactccgttgtttgcatgcatccagagaccatggaaaagcttcaactttttagaggcgatacgatcttgcttaaggggaagaaaaggagggatacaatatgtattgcacttgctgatgacacgtgtgaagaacctaagattaggattaataaggttgttaggtcaaacttgagggttagacttggggatgtggtttctgtgcatcagtgtgctgatgttaagtatgggaagcgtgttcatatccttccgattgacgatactattgaaggagttactgggaatttgtttgatgcttacttgaaaccttactttttggaagcataccgcccggtgaggaaaggtgactactttttggtaaggggaggaatgcgaagcgttgagtttaaagttattgagactgatcctgctgagtactgtgtggttgcgcctgatactgagatattctgtgagggtgagcctgtgaggagggaagatgaggaccggttagatgagattggttatgatgatgttggtggtgttcgtaaacagatggcgcaaatccgtgagttagtggaactcccgttaaggcatccgcagctttttaagtctattggtgttaagccgccgaagggtattctgctttatggacctcctgggtctggaaagactttgattgctcgtgctgttgctaatgaaaccggtgctttctttttctgcattaacgggccagagatcatgtcaaaaatggcgggagagagtgagagtaatttaaggaaagcgtttgaggaagctgagaaaaacgcaccatcaattatctttatcgatgagcttgattcaattgcgccaaaacgtgaaaaaacacacggggaagttgagcgaaggatcgtttctcagttattgactttgatggacgggctgaagtctcgggcacatgtaattgttatgggtgcaactaaccgccctaacagtatcgatcctgcattgagacggtttggtagatttgacagggaaattgatattggtgtgcctgatgaagttggccggcttgaggttctcagaatccatactaagaacatgaagctctctgatgatgtggatttggagaaggttgcaaaagatacacatgggtatgtaggtgctgacttggcagctttatgcactgaggctgcactccaatgtattagagagaaaatggatgtgattgatttggaagacgagtccattgatgcagagattttgaactccatggcagttacgaatgagcattttcagacggccctcgggacaagcaatccttctgctcttcgtgagaccgttgtggaagttcccaatgttagctgggaagacattggtggactcgagaatgttaaacgagagctacaagagaccgttcaatatcctgtggaacatcctgagaaatttgagaagtttggtatggctccatctaaaggagtcctgttctatggtccacccggttgtggtaaaactcttctagccaaagctattgcaaatgaatgtcaggctaactttatcagcatcaagggtcctgagctgcttacaatgtggtttggtgagagtgaggccaatgttcgtgaaatttcgacaaggctcgtggatctgctccttgtgtcctcttttttgatgaacttgattccatcgcaacccagagagggagtagtcaaggagatgctggcggtgcagctgacagagttctgaaccaacttctgactgaaatggatggaatgtctgccaagaaaacggttttcatcattggtgcaaccaacaggcctgatatcattgatccggcacttttgaggcctggccgtcttgatcaactgatctacattcctttacctgatgaggagtcacgttatcagatctttaaatctgcattaaggaagtcaccaatttccaaagatgttgatctccgagctcttgccaggttcacacaaggattcagtggtgctgacatcaccgaaatctgccagcgcgcttgtaaatacgctattcgtgagaacatagagaaggatatcgagagggaaaagagaataagtgagaaccctgaagctatggaggaagacatggacgatgaggtagcggagatcaaagctgctcattttgaagaatctatgaagtttgcacgacggagtgtcagtgatgctgacataaggaaataccaggcgtttgctcaaacactgcagcagtcgagagggattggttccgagttcagattctcagagactagtgggcgtactgctgctagtgacccgtttgccgcaccggctggtacagttgatgatgatgacctttataattaggttgtaccaaataatgtctactacttgtttctttgtttggttttcatatcctggttactatgatatttctaggttgtgtgtttacatagtaacaacttggttttgagtttgtgaaaaaataactagtgatgtgaggtaatgtatatacttaaaataaatatcgtattttcagttagttcagttatgtcgatttatgaatcattagtttttttattcgttttgctttgtagaaattgttgaaagtggagtatgaaaattctgtcttgttgtccg

SEQ ID NO: 7450 - DNA, 2720 bp, Distylium racemosum
gatgaattgactctctatgtgaattgcggagcaacttagatctgcttgtccaggcctcttctgttgcattccttccaccttcattatctgcattggaaatttcctatcaactctgaaagaatggctgcttcaggaccgggggaatcttcggaaccgaaggggaccaagaaagattttagcactgcaatattggagcgtaagaagtctccgaatcgattagttgtggatgaggctataaatgatgacaattcagttgtggctcttaattcacaaacaatggaaaccctgcagctctttcgtggtgatactattcttatcaagggtaaaaagagaaaggatacaatttgcattgttctggctgatgatacctgtgaggagcataagatcagaatgaacaaagttgtcagatcaaatctgagagtaagattaggggatgttgtctctgttcatcagtgtccagatgttaagtatgggaagagagtccatattttacctatagatgatacagttgagggagttacaggaaacctgtttgatgtgtacttgaaaccttatttcttggaggcctatcgcccagtaaggaaaggggaccttttccttgtacgaggtggaatgcgaagtgtcgaatttaaagttattgagacagatcctggtgaatattgtgttgtttctccggacactgaaattttctgtgaaggagaaccaataaagcgtgaagatgaagagagattggatgatattggctatgatgatgtgggtggtttaaggaagcaaatggcacaaatcagggaattagttgaactaccacttcgacatccacagcttttcaaatccattggtgttaaacctccaaagggtattctgctttatggtcctcctggttcagggaaaaccttgattgctagggcggtcgcaaacgaaacaggagctttctttttttaattaatggtcctgaaattatgtcaaaacttgcgggggagagtgaaagcaacctcagaaaagcttttgaggaggcagaaaagaatgctccttctataatttttattgatgagattgactctatagctccaaagagggaaaaacaaacggtgaagtagagagacgcattgtatctcagcttttgacattgatggatggcctaaaatctagagctcatgtaattgttatgggagcaacgaataggcctaacagcattgatcctgcactcagaaggtttggtaggtttgatcgtgagattgatattggtgttccagatgaaattggccgattggaggtgcttcgaattcacacaaaaaatatgaagcttgctgaagatgttgatcttgaacatattgcaaaagatacacatggttatgttggcgctgatcttgcagctctttgcactgaggctgcactgcagtgtataagggaaaaaatggatgtgatagacttagaagatgaaacaattgatgctgaggttctgaattcgatggctgttacaaatgagcactttcagactgcattgggcaccagcaacccctctgctcttcgagagactgttgttgaggtaccgaatgtttcctgggaggatattggtggtctggaaaatatcaagagagaacttcaggagactgtgcaataccctgtggagcatccagagaaatttgaaaagtttggtatgtctccttcgaaaggtgtcctattttatggacccccgggatgtggtaagacactactggcaaaagccattgccagcgagtgtcaggcaaactttatcagtattaagggcccagaactgctgacaatgtggtttggagagagtgaagccaatgttcgtgatgtttttgataaggccaggcagtcggcaccttgtgtcctgttttttgatgaactcgattcaattgctactcagcgtggtagtagttctggagatgctgggggtgcagcagacagagttctgaaccagttgctgactgaaatggatggaatgactgcaaagaaaactgttttcattattggggccacaaatcggcctgatattattgatcctgctttgctaaggcctggtcggcttgaccagttaatatacatacccttgcctgatgaagcttcgcgattgcaaattttcaaagcttgtctgcgaaagtctcctgtttcaaaagatgttgatattgcaactcttgctcgctatacgcatggtttcagtggagctgatatcactgaaatttgtcagcgtgcctgcaaatatgctattagagagcacattgaaaaggacattgaacgagaaaagaagagaagagaaaaccctgaagctatggacgaagatgaatctgatgtggcagaaataaaggcagctcattttgaggaagcaatgaaatatgctcgaagaagtgttagtgatgcagatatccgtaaatatcaagcttttgctcaaacattacaacagtctcgaggatttgggtctgaattccgttttgcagataggccagctaccactacaggtggtacaggcaacactgacgcttttgtctgtggcaggagctggtgatgaggatgatcttttacagttaaaagtaaaactgtaattgctcaaacactaaattgttcagcaatgtgtttagcaatttgtacattacaaagtacattgcatccattgggttaaccatttgtaatttaaaaaattaggcaattggatgtattgttttgtaagtcttgaaattatcattttatcttgaagttta

SEQ ID NO: 7451 - DNA, 2447 bp, Flaveria ramosissima
ccctcgcttccaatctcacaaattctctccaaatcctcgctccacaaatctcaaatcttcgtttcacataatctgcaccatgagtgatcaacctgaatcatccgactctaaggggacgaagagggactttagtaccgcgattcttgagcgaaaaaaggcggcgaatagactcgttgttgatgaagccatcaacgatgataactctgttgtatctctgcacccggagaccatggaaaagcttcaactattcagaggagatacaatcttgattaagggaaagaaaaggagagatacaatctgtatcgctcttgctgatgacacctgtgaagaaccaaagattaggatgaataaggttgtcaggtcaaacctgagggttcgacttggggatgtggtttcagtgcatcagtgtcctgatgttaagtacgggaagcgtgttcacatccttccaattgatgacaccattgagggggtcactggaaatctgtttgatgcttacttgaaaccttacttcctggaagcataccgccctgtgaggaagggtgactactttttggtaaggggaggaatgagaagtgttgagttcaaagttatcgagactgatcctgctgagtactgtgtagttgcacctgacactgagatcttctgtgagggtgagcctgtgagaagggaagatgaggaccggttagatgaggttggttatgatgacgttggtggtgttcgcaaacagatggcacaaatccgtgagttggttgaactcccattaaggcatccacagctcttcaagtctatcggtgttaaaccaccgaagggtattctgctttatgggcctcctgggtctggaaagactttgatagcccgtgctgttgctaatgagaccggtgctttctttttctgcattaatgggccagagatcatgtcaaaaatggctggagagagcgagagcaatttaaggaaagcatttgaggaagctgagaaaaacgcgccttccatcatcttcattgatgagattgattcaattgcgccaaaacgtgaaaaaacacacggtgaagttgaaagaaggatcgtttcccagttgttgactttaatggacgggctgaaatccagggcacatgtaattgttatgggtgcaaccaatcgccctaacagtattgatcctgcattgagacggtttggtagatttgaccgggaaattgatattggtgtgcctgatgaagttggtcgtcttgaggttcttaggattcatactaagaacatgaagctatctgatgatgtggatttggagaaggttgcaaaagatacacatgggtatgtaggtgccgacttggcagccttatgtactgaggctgcactgcaatgcatcagagagaaaatggatgtgattgatttggaggatgaatccattgatgctgagatcctgaactccatggcagttacaaatgagcattttcagacagcccttggtaccagcaatccatctgctcttcgtgagactgttgtggaagtgcccaatgttagctgggaagacattggtggacttgagaatgttaaaagagagctacaagagactgttcaatatccagtggaacatcctgagaaatttgagaagtttggtatggctccatctaaaggagttcttttctatggtccacccggttgtggtaaaactcttctagccaaagctattgcaaatgaatgtcaagctaactttatcagcatcaagggtcctgagttgcttacaatgtggtttggtgagagtgaggccaatgttcgtgaaatttttgacaaggctcgtgggtctgctccttgtgttctcttttttgatgaacttgattccattgcaacccagagagggagcagtcaaggagatgctggtggtgcagctgacagagttctgaaccaacttttgactgaaatggatggaatgtctgccaagaaaacagttttcatcattggtgcaaccaacaggcccgatatcattgatccagctcttttgaggcccgggcgtcttgatcaactgatttacattcccttacctgatgaggagtctcgttaccagatctttaaatctgccttaaggaaatccccaatttctaaagatgttgatctacgagctcttgccaagtacacacaaggtttcagtggtgctgatatcactgaaatatgtcagcgcgcctgcaaatacgccattcgtgagaacatagaaaaagatattgagagggaaaagagaagaagtgagaaccctgaagctatggaggaagatgttgaggatgaggtcgcggagattaaagctgctcactttgaagaatccatgaagtttgcacgaaggagtgttagtgatgctgacataaggaaataccaggcgtttgctcaaacactgcagcagtcaagagggattggttctgagtttagattctcagagaccagtggacgtgcagccgctagtgacc

SEQ ID NO: 7452 - DNA, 2685 bp, Arnica chamissonis
ccaaatccgggttttcaatcaatcgtcgttcgccatgacaaaccagacggaatcctcttcttccgacgcgaaaggtccggcgccgcagaaaaaggacttctcaactgctatcttggagcgcaagaagtctcccaatcggcttgttgttgacgaagctgtcaatgacgataactccgtcgtcgctatgcatcctgctacaatggagaagttgcagcttttccgtggtgataccatactgatcaagggcaagaaacgaagagacacagtctgcattgcccttgctgatgaaacatgtgatgaacccaaaatcagaatgaacaaggttattaggactaacctaagaattcgccttggtgatgttgtgtcagtacatcagtgtccagatgtcaagtacggaaaacgtatacacgttcttccgcttgatgacaccattgaaggtgtcaccggagacttatttgatacatttctgaaaccatacttcttggaggcatatagacccgtaaggaaaggagatcattttcttgttagaggaggaatgcgcagcatcgaattcaaagtaatagaaactgatccaggggagtattgtgttgttgctccagacactgaaatcttttgtgaaggtgagccaattaagagagatgatgaggatagattggatgaggtgggctatgatgatgtaggcggtgtcaggaaacaaatggcacagattcgtgaattggtggaattaccattgagacaccctcaactattcaaatcaattggagtcaaaccccctaaaggaatcttgctctatggacctcctggttcaggaaagacgctgatagccagagccgttgctaatgaaaccggagctttctttttttgcatcaacggcccagaaattatgtcaaaattggcaggagaaagtgaaagcaatctcagaaaggcgtttgaggaggctgagaagaacgctccatcaattattttcattgatgagatagattcaatagctcctaagagagagaagactaatggtgaagttgaaagaaggattgtttcacagcttttgacacttatggatggattaaaatcgcgggcccatgttattgtaatgggggctacaaatcgcccaaacagcattgatcctgctcttagacggtttggtaggtttgatagggaaattgatattggtgtcccggatgaggttggacgtcttgaagttcttcgtatccatacaaagaacatgaagctttctgatgatgttgatatggaaaagatatctaaagaaacacatggttacgtcggtgctgatctggcagctctttgcaccgaagctgcacttcaatgcattagagaaaaaatggatgttattgatttggaagatgaatctattgatgctgagatacttaattctatggcagtcacaaatgaacatttctctactgctcttggaactagcaatccgtctgccctgcgtgagactgtcgttgaggttccaaatgttagctggcaggatatcggaggccttgagaatgttaagcgtgagcttcaagagacggttcaatacccggtggaacatccagagaaatttgagaaatttggtatgtcaccctcaaaaggagttcttttctatggtccacctggatgtgggaaaacactgctggcaaaagctattgcaaatgaatgccaggcaaatttcattagcattaaaggacctgaattactaacaatgtggttcggggagagtgaagctaatgttcgggagatttttgacaaagccagaggatctgcgccatgtgtccttttctttgatgaacttgactccattgcaactcagagaggaagcagttctggagatgcaggtggtgctgctgaccgggttttgaatcaactattgactgaaatggatggaatgtctgctaaaaagactgttttcataattggagccactaaccgacctgacattattgacccggctttacttcgacccgggcgtcttgatcaactaatttacattccgttaccagatgaggactcacgctaccagattttcaaggccgcaatgaggaaatcccctgtttctaaagatgttgatttgagtgctcttgctaagtacactcaaggatttagtggtgctgatattactgagatatgtcaacgcgcttgcaagtatgcaattagagagaacattgagaaagacatagagagggaaagaaagaggagtgagaatcctgattctatggatgaggatgctgatgatgatgtggcggagataaaggcggcacattttgaggaatcaatgaagtatgcacgcagaagtgtgagcgatgctgacattaggaaataccaggcgtttgctcagacattgcagcagtcaagaggatttgggtctgagtttcgattctcagagacatctggcggggctgctgcatctgatccgtttgctgcttctgctggtggagccgatgatgacgacttatacagttaggtttttaaaaagtctgttttaagaaagaaatagacttgcaacttgtgcactcctgttctggcattttggtttctctcaaagaagacttgtgcattatcaagtgatggaatcatttgaacatgtgtttgtttttgtatggtttaactttatgcttttgttttgttggaaattactcatgtaaactccccctatgcttataaaaatcatcttagtaatac

SEQ ID NO: 7453 - DNA, 2682 bp, Podocarpus macrophillus
gaaccaaaagggattacagcactgcgattcttgagcggaagaaggcgcccaatcgcctcgtagtcgatgaagctgtcaatgatgataactctgttgtttccctacatccagacaccatggaaaaattgcaattgttccgtggtgataccattcttattaagggaaagaagaggaaggatacgatatgtatcgccctggccgatgagacgtgcgatgagcccaagataaggatgaacaaggtggtgcgatcgaatcttcgggttcggctgggagacgtggtgtccgtacaccagtgcccggatgttaaatatggcagacgggtgcacatccttccaatcgatgacaccatcgagggtcttacagggaatttgttcgatgcctttttgaaaccgtatttcttggaagcttatcgtcctgtaagaaaaggtgatctttttcttgtgagaggtggaatgcggagtgtggagttcaaagtaattgagactgaccctggggaatattgtgttgtttctcctgatactgaaattttctgcgagggagagcctgtaaaacgtgaagatgaagataggttggatgaaataggttatgatgatgttggtggtgtgagaaaacaaatggcacagattagggaattggtagaacttccacttagacacccacagctttttaaatcgattggtgtgaagcccccaaagggtattctgctttatggcccacctggttctggaaagaccttaattgctagggcagtagcaaatgagaccggtgctttctttttctgtatcaatgggcctgagataatgtcaaaattggctggagaaagtgaaagcaatctcaggaaagcatttgaagaggcggagaagaatgcaccatcaattatttttattgatgaaattgattccattgctccgaagagagaaaagacccatggtgaggttgagaggagaattgtttctcaacttctcacactaatggatggacttaaatctcgtgctcatgtcattgtgattggagcaacaaaccggccaaacagtattgatcctgctctcagaaggtttggaaggtttgacagagaaattgatattggtgttcctgatgaagtgggtagactggaggtgctccgaatccataccaagaatatgaagctttctgatgatgttgatcttgaaaggattgcaaaggatacacatggatatgttggggcggatcttgcagctttgtgcacggaagctgccctccaatgtatcagggaaaaaatggatgttattgacttagaagatgaaaccattgatgcagaaattcttaactcaatggctgttactaatgagcacttccagacggcattgggtgccagtaatccgtctgcactgcgtgaaactgttgttgaagtgcccaatgtctcttgggaagatatcggtggtttggataatgtcaagagggagcttcaagagactgttcaatatccggtggagcaccctgagaagtttgaaaaatttggaatgtctccatcaaaaggagtgctgttttatgggccacctggttgtgggaagactttacttgctaaagccatcgctaatgaatgccaggccaatttcatcagtgtaaaaggacctgaattgttaacaatgtggttcggagagagtgaggcaaatgtaagagaaatttttgacaaagccagacagtcagctccatgtgtcctgttctttgatgaacttgactctattgctacacagcgtggaagcagtgttggtgatgctggtggtgctgcagacagagtccttaatcagttacttacagaaatggatggtatgacagcgaagaaaactgtttttattattggagccacaaataggccagatatcattgaccctgcattgctaaggcctggtcgtctcgatcagttgatctatatacctttacctgatgaggcgtcccgctaccaaattttcaagtcttgcctgagaaagtcgcctgtatcaaaggatgttgatctcatggctcttgcccgttatactcatggattcagtggagctgatatcacagagatttgtcagcgggcttgcaaatatgctatcagggaaaatattgagaaggacattgaacatgaaaggaaaaggagagacaatcccgaggctatggaagaggatgatagcgatgaggtatcagaaataaaaccagctcattttgaggaagcaatgaaatatgcccgaagaagtgtcagtgacgctgatattaggaaatatcaagcatttgcacagacacttcagcaatctcgaggtttcggttctgagtttcgatttcctgacagaccagccggtacagctggtgctggagcttcggatgcatttgttacagcagataataaagatgaggatgatttgtacagttaaagagtcatcatcttcatcatgggcagatgctataagcttttttgcattggccctttctttgacaaattggacttgaccttcaattgtatttgttaactggtctcaataggctagctttggatactttaatttatcaaatgcgcttgactaaatatatggcaattaagagtatttatgaaatccataaatatatatgtcagtgaagagtatttacgaaatcagtaatgttacatgtaaaagttcagtttaatttcattttaatttatcaggtgcttgactaaagatatatggc

SEQ ID NO: 7454 - DNA, 2653 bp, Artemisia annua
taaccgacctgtctttggtaacaagaaaacttcatcacactatatatacaaaactcaaaaaatctctcaaacccataaacacgatggctgatcatgctgaatcatctgaccctaagggtgctaaacgtgattttagtactgcaatattagagcgaaaaaaggcgccaaatagactggtggttgatgaggcaattaacgatgataattctgtcgtggctatgcatactactactatggaaaagcttcagctttttcgaggcgatacgatcttgatcaagggcaagaaaaggagagatacaatatgtattgcacttgctgatgatacttgtgacgaaccaaagattaggatgaataaggttgtcaggtcaaatcttagggttaggcttggtgatgtggtttctattcatcagtgtcctgatgttaaatacgggaagcgtgttcatattcttcctattgatgatactatagagggtgttaccgggaacttgtttgatgcttacttaaagccgtactttctggaagcgtaccgtcctgtgaggaagggagatttctttctggttaggggtggaatgaggagtgttgagtttaaggttattgagacggaacctgccgagtattgtgtggttgctccggataccgagatattttgtgagggtgaccctgtgattagggaagacgaggatcggttagatgaggttggttatgatgatgttggtggtgttcgtaaacaaatggcgcagattcgtgagttggtggagctgccattaaggcatccacagctctttaagtctattggtgttaagccgccaaagggtattctgctttacggacctcctggttctggtaagactttgatagcccgtgcagttgccaatgaaaccggtgctttctttttctgcatcaatgggccagagattatgtcaaagatggctggagagagtgagagcaacctcaggaaagcgttcgaggaagcagagaagaatgcgccatcgatcatcttcattgatgagcttgattcgattgctcccaagcgtgagaagacacatggagaagttgaaaggagaattgtttctcaactattgactctaatggacgggcttaaagcccgtgctcatgttattgtcatcggcgcaaccaatcgtcctaacagtattgatgctgctttgaggaggtttggcagatttgacagggagatcgatattggcgttcctgatgaagttggccgtcttgaggttcttcgtattcatactaagaatatgaagcttgctgaggatgttgatttggaaaaggctgctaaagagacacatgggtatgttggtgctgatttggctgctttatgcactgaagcagcactccaatgcatcagagagaagatggatgtcattgatttggaagacgagtccattgatgcagagattcttaattccatggcagtgtcgaatgaacactttcagacagcgcttaccactagcaacccttctgctcttcgtgagacagttgtggaagtgcccaatgtcagttgggaagatattggtggtcttgagaatgttaaacgagagcttcaggagactgttcaatatcccgtggaacatcctgagaaatttgagaagtttggcatggctccatccagaggtgttctcttttatggtccacctggttgtggtaaaactcttcttgctaaggctattgcgagtgaatgccaggccaacttcattagcatcaaaggtcctgaattgcttaccatgtggtttggtgagagtgaggccaatgttcgtgaaattttcgacaaggctcgcgggtctgctccttgtgtcctcttcttcgatgaactcgactccattgcaacacagagagggggcagtcaaggtgatgcgggaggtgcagctgatagagttctgaaccaacttttgactgagatggatggaatgactgccaagaagactgtcttcataattggtgctaccaacaggcctgatatcattgatcctgcactcttgaggcctggtcgtcttgatcagttgatatacatccctctcccagacgaggagtcacgttatcaaatcttcaaatctgctttgaggaagtccccacttgctaaaggcgtagacctgcgagctcttgcaaagtacactcagggtttcagtggtgctgatatcactgagatatgccagcgtgcttgcaagtacgccattcgtgagaacatagagaaagatattgagaaggaaaggagaaaaagcgagaatccagaagctatggaggaggatacggaagacgaggtacccgagattaaagctgctcactttgaagagtcgatgaaatttgcacgaaggagtgtgagtgacgctgacattcgcaaataccaggtctttgctcaaacactgcaacagtctagggggattggctctgaattcaggttctcagaggcgagtggccgtgctgctgctagtgacccttttgcagccccagctggtgcagctgatgatgatgacctttataattaggcttacaataaaactgtagttacggcttgttctatatttctagtaataaaggttcgtagttattgtgtaatatatgttaacttaacggtggttttgttttatagtaacttcgacattgtgtatttgtgttctgagtttgtagtaaaataagt

SEQ ID NO: 7455 - DNA, 2651 bp, Fragaria vesca
aagttgaacaactattgactgcgaaaaagctcagaggtgacagtaatggcggatccgagctcgtccggcgctaattcggcccagccctcttctactgacccgaaagctaagaaggatttttccacggcgattttggagcggaagaagtctcctaatcggcttgtagttgatgaagctatcaatgatgataattctgtggtgtccttgcaccctgctaccatggaaaaacttcagtttttccggggagacactgtgctaataaaggggaagaaacggaaagatacagtttgtattgttcttgctgatgaacaatgtgacgaaccaaggatcagaatgaacaaagttgtaagggctaatcttagggtgcgtcttggagatgttgtgtcagttcacacttgtccggatgtcaagtatgggaagcgggttcacatccttccaattgatgatacaattgaaggcgtatctggaaacttgtttgatgcatatttgaagccatacttcttggaatcttaccggcctgtgaggaagggtgaccttttcctggtcaggggtgggatgcgaagtgttgagttcaaggtcattgacacagaccctggtgaatactgtgttgttgctcccgatactgagattttctgtgagggagaacctgtgaagcgtgaggatgaggaaaaattgaatgaggtgggttatgatgatgttggaggtgttaggaaacaaatggctcagatacgtgaattagtagagttacctcttagacacccacagcttttcaagtccattggagtgaaaccaccaaaaggtattctgctttatggaccaccggggtctgggaaaactctgattgcaagggctgtagctaatgaaactggagcattcttctttttgattaatgggcctgaaataatgtcaaagttagctggtgagagtgaaagcaatctgaggaaggcatttgaagaagctgaaaagaatgccccatcaatcatttttattgatgagttagattccattgctccaaagagggagaagactcagggtgaagtggaaaggcgtatcgtttcgcaacttctgactttgatggatggcctcaagtcccgtgcacatgtcattgtcatggcagcaacaaataggccaaacagcattgacccggctctgaggaggtttggaagatttgatagagagattgacattggtgtaccagatgaaattggaagattggaagttttgagaatccatacaaagaacatgaaacttgcagaagatgttgatctcgaacgagtttcaaaggacacccatggttatgtcggcgctgatcttgccgcactctgtactgaggctgcacttcagtgtatccgtgagaaaatggatgttattgacttagaagatgaggaaattgatgccgaggtgctgaattctatggctgtgaccaatgaacacttccagactgcattgggtgcttcaaatccttcagcattgcgtgaaactgttgtggaggtacctaatgtctcatgggatgcaattggaggattggataatgtcaaaagagaacttcaagagactgttcaatacccagtggagcatccagagaagtttgagaaatttggcatgtcaccttctaaaggtgttctcttttatgggccaccaggctgtggtaaaactcttcttgcaaaggcaattgccaatgaatgccaggctaatttcattagtatcaaaggccctgagttgctaacaatgtggtttggagaaagtgaggcaaatgtccgtgagatatttgacaaagctcgccaatctgctccttgtgttcttttctttgatgagctggactcaattgcaactcagcgtggaggttctgtaggagatgctggtggtgcagcagatagagtcttgaaccaacttctaactgaaatggatggaatgagtgctaagaaaacagtttttatcattggagcaacaaataggccagacattattgacccagcattgctcaggcctggacggcttgaccagctcatctatatcccactcccagatgaagcttcccgtcttcagattttcaaagcatgtttgaggaagtcacccgtcaatagggatgttgaccttgcagttcttgcacgtcatacccacggtttcagtggtgctgatatcactgagatatgccagcgtgcctgcaaatatgccatcagagaaaatattgagaaggatattgaaaaggagagaagaaaggcggagaatccagaagcaatggaggaggatgacattgatgaggttccagaaataaagccagcacactttgaggagtctatgaaatttgcccgcagaagtgttagtgatgcagacatcaggaagtaccaggcattcgctcagactctgcaacaatctcgtgggattgggtctgatttccggttcccccaaacaggcaacactgcaggagcagctgcagacccctttgcttcagcttcagctgctgcagacgacgatgatctgtacagctgagctgaaagcaatgaatgtggtcgtctagttgacgccttgacggtgacatgctttggttgttgtatattgctgtgaaagaaaggcaccaatactcttctaaggattatcttcgtactttctatgtagttatctatcttctctataacatgggtgtttcaaag

SEQ ID NO: 7456 - DNA, 2889 bp, Vitis vinifera
tccgggtcaaataaggatttgggtctgacttcttctataaatttggggcaattcttggatcctccagatcgagttgaacccagaaaccctatagcctgagcggttgaagacagcgatggcggatccaagctcctcaggcccttcctcttctccggaagtgaaaagtgttaagaaggatttttctactgcaattttggaacgtaagaagtcacccaatcgtctcgttgtcgatgaagcggtgaatgatgacaattctgtggtttccatgaaccctgcaacaatggaaaagcttcagttctttcgaggagacactgttctaatcaagggaaagaaacgaaaagacacagtgtgcattgttcttgttgatgaacaatgcgaagaaccaaagatcagaatgaacaaagttgtacgagccaatcttagggtacgccttggagatgttgtttctgtccatcagtgtcctgatgtgaagtacggaaagcgagttcacatcctcccaattgatgatacaattgagggtgtgactggcaacctgtttgatgcatatttaaaaccatatttcttggaatcctatcggcctgttaggaagggtgaccttttcctggtcagaggagggatgcgaagtgttgaattcaaagtaattgaaacagatcctggtgaatattgtgttgttgcaccagatactgagatcttctgtgagggagaacccatcaaacgtgaagatgaggagagattgaatgaagttggctatgatgatgttggtggtgtaaggaagcagatggcccagatccgtgagctggtagaacttccccttaggcacccacagcttttcaaatctattggggtgaagccaccaaaaggcattttgctctatgggccacctgggtctggaaaaaccctaattgcaagagctgtagctaatgagactggtgcatttttcttcctgataaatggacctgaaataatgtcaaagttggctggtgaaagtgaaagtaacttgaggaaggcatttgaggaagcagaaaagaatgccccatccatcattttcattgatgagctagattctattgctccaaagagggaaaagacacatggtgaagtggagaggcgtattgtatcccagctgttgactctaatggatggccttaagaccagggctcacgtgattgtcattggtgctaccaacaggccaaatagcattgaccctgcattaaggagatttgggagatttgatagagagattgacattggtgtaccagatgaggttggcaggctggaagtccttcgaatccacacaaagaatatgaaactttctgatgatgttgatcttgaaagagttgcaaaagatacacatggttatgttggtgcagatcttgctgctctttgcacagaagctgctcttcagtgtatcagggagaaaatggatgtgattgacttggaggatgagacaattgatgctgaggtgttgaattccatggctgtgactaatgaacacttccaaactgcactggggtcttccaatccatcggccttgcgtgaaacagttgtggaggttccaaatgtgtcatgggaggacattggtgggttggacaatgttaaaagagagcttcaggagactgtccaatatccagtggagcatcctgagaagttcgagaaatttggcatgtcaccttctaaaggtgtgctcttctatggacctcctggctgtggtaaaaccctacttgcgaaggcaattgcaaatgaatgccaggccaacttcataagtgttaaaggacctgagttgctgaccatgtggtttggagaaagtgaggcaaatgtgcgggagatatttgacaaggcacggcagtcagcaccgtgtgtactcttctttgatgaacttgattcaattgcaactcagcgtggcagttctgtaggggatgctggtggtgctgctgacagagtcttgaatcaacttctgacagaaatggatggaatgactgcaaagaagactgttttcatcataggagcaacaaacaggcctgacattattgacccagcattgctcaggcctggacgtttggaccagttgatttacattccactaccagatgaggcttcccgtctgcaaatattcaaagcatgcttaaggaagtcaccagtctctagggatgttgacctagtagctcttgcacggtatactcatggttttagtggtgcagatatcactgaaatttgtcaacggtcctgcaaatatgccattagagaaaatattgagaaggatattgagagggagagaaagaagacagagaaccctgaggcgatggaagaagatgatgttgatgatgtccctgagattaaagcagcacactttgaggagtctatgaaatttgcacgccgaagtgtcagtgatgcagatatcaggaagtaccagctctttgctcagactctacagcaatcgcggggatttggatctgagtttcggtttccagatcagcccaacaatgccacagcagcatcaacagctgcagacccattctcctcagcagctgctgctggagatgatgatgacctgtacagctgatgtgtttatttttcagagacactggtgcaatatcaagctgacgatcagttgtagaacttgttttttgctgtttcttttttatatctaagaattttatctccttttgtatgcctaggctctaatggtggctaaatacatgaatgaatagctacataacttagttacggggataggaggattaatacattttcatttgagccttttgattttgccccacatatttgattctttttgggagtgggtcttgcccattgattaggcagtttggattggtaaatgctgaacctcaatggccactctgcttgacaggcgtttcaattgagtcattg

SEQ ID NO: 7457 - DNA, 2716 bp, Festuca arundinacea
  misc_feature (14)..(14): n is a, c, g, or t
  misc_feature (42)..(42): n is a, c, g, or t
  misc_feature (459)..(459): n is a, c, g, or t
  misc_feature (522)..(522): n is a, c, g, or t
  misc_feature (2148)..(2148): n is a, c, g, or t
  misc_feature (2160)..(2160): n is a, c, g, or t
ggcacgaggggaanaatatctctgctcgctaccgtctcccancgctctccgcaacaaccacccggaggcgccgaaacctagccgcgccgccgccggcgaccctcgaacatggcgaccccgaccccgcagggcgaggcctcctcctccgatccgaaggcggcgaagaaggactactcgacggcgatcctcgagaggaagaagtcgcccaacaggctcgtcgtcgacgaggccaccaatgacgacaactccgtcgtcgccctccacccggacaccatggagcgcctccagctcttccgcggcgacaccgtcctcctcaagggtaagaagagaaaggacacaatctgcattgtgcttgcagatgacacttgtgaggagccaaaggtcagaatgaacaaaaccgtcaggaagaacttgagagtgagacttggcgacgtggtgtctgtccatcaatgcccagangtcaaatacgggaagcgtgtgcacatacttcctattgatgacacggttgaaggcattactggnaacttgtttgatgccttcttgaagccatacttccttgaagcttatcgtcctttgagaaagggagaccttttccttgtgaggggtggaatgaggagtgtggaattcaaagttatagagactgaccctgcagagtattgcatcgttgcacctgacacagagatattctgtgatggtgagcctattaagagggaggacgaggaaaggctcgacgaggttggctatgatgatgttggtggagttaggaagcaaatggcccagatcagagaactggttgaactcccactgcgtcatcctcagctcttcaagtctattggtgtgaagcctcctaagggcatattgctgtttggaccacctggctctggcaaaacccttatcgctagagctgttgctaatgaaactggtgcattcttctttctgattaatggcccagaaattatgtccaagctagcaggagaaagtgagagcaatctgaggaaggcatttgaagaagctgagaagaatgcaccatcaatcattttcattgatgagatcgattcgattgccccaaagagagaaaagaccaatggagaggttgagaggcgtattgtttcacagctgttgactcttatggatgggctcaagtcccgtgcacatgttattgttatgggtgctacaaaccgcccaaacagtattgatcctgccctcagaagatttggtagatttgatcgggagattgacattggtgtccctgatgaagtcgggcgcctagaagttcttcggattcacaccaaaaacatgaagttggctgaagatgttgaactggaacacatttcaagagacacccatgggtatgttggttctgatctcgctgctctttgcactgaggccgctctccagtgcattcgtgagaaaatggatattatagatctcgatgatgagaccattgatgctgagattctgaactcgatggctgtgacaaatgatcatttcaagactgcattaacaacaagcaacccatctgctctccgtgaaactgttgttgaagttcccaatgtctcttgggaagatattggtggtctggagaatgtcaagagggagttgcaggagactgtccaataccctgtggagcatccagagaaattcgagaagtttggcatgtctccttccaaaggtgttttgttctacggccctcctggctgtggtaaaaccctgttggcgaaggcaattgctaatgagtgccaggctaacttcatcagtatcaagggacctgagctgcttaccatgtggtttggagagagtgaggctaatgtgcgtgagatctttgacaaggctagggggtcagcgccatgtgtcctcttctttgatgagcttgactcgattgctacccagagaggaagcagtgttggggatgctggaggtgctgctgatagagtgctcaaccagctcctgactgagatggatggcatgaacgccaagaaaacggtgttcatcatcggtgccaccaacaggcctgacatcattgaccctgcgttgcttaggccagggcgtcttgatcagcttatctacatccctcttcctgatgttgagtcgaggctccagatcttcaaggcttgcctcaggaagtcccctgtggccaaggatgttganctggacgctctngccaagtacacccaagggttcagtggtgctgatatcactgaaatttgccagcgttcttgcaaatatgccatcagggagaacatcgaaaaggacatcgaaagggagaggcggaagaaggacaaccctgaagccatggaggaagacgagactgatgagattgctgagatcagggctgctcacttcgaggagtcgatgaagtatgcgcgccggagtgtgagcgacgccgacatccggaagtaccaagcctttgcccagaccctgcaacaatctcgtggattcggcagcgagttccggttccctgacgctccggcttcaggtgcagccgctgctgcagacccttttgcgtccacggccgctgcggcggaggatgatgatttatatagctagatcctgttgctgtaccattaacttaccgatgatttcctttccttcatatacttgttatgtgtatgcaagacacggtaagttgatattgggatgcagtgataatctgctggttatttgctctgtcgtcttgaatttgtttctactcttaatgaaaaaaacaagatatatc

SEQ ID NO: 7458 - DNA, 2779 bp, Sequoia sempervirens
ctactccaaacaatcaatatttactccgcagcgatggctcacaagggagaatcgtcagaagcgaaaggaacgaaagggatttcagcacagcaattttagagcgaaagaaggcggcgaatcggctggttgtggacgaagccattaacgatgataactcggttgtttgcctgcacccagaaaccatggaaaaattgcaattgttccgtggagacacaatccttattaagggaaagaaaaggaaggatacgatctgtattgctctggcagacgagacctgcgaggagcccaagattagaatgaacaaggtcgtgcggtcgaatctgagggttcgtttgggagacgttgtttctgttcaccaatgtcccgacgtcaaatacggcaagcgcgtccatattcttcccattgatgataccatcgagggcgtcactgggaatttgtttgatgcctatttaaagccctatttcttggaagcttatcgcccagtgagaaaaggtgatcttttccttgtaagaggtggaatgcgtagtgtggagttcaaggtaattgagacagaccctggggagtattgtgttgtttctccagatacagaaattttctgtgagggggagcccgtaaagcgggaggatgaagatagattagatgaaataggttatgatgatgttggtggtgtacggaaacaaatggctcagatccgtgaattggtagaacttcctctcagacacccacaactcttcaaatcaattggtgtgaaacccccaaagggtattctgctttatgggccacctggttctgggaaaaccttaattgccagggcagttgcaaatgaaaccggtgccttctttttctgtatcaatggacctgaaatcatgtcaaagctggctggagaaagcgaaagcaatctccggaaggcttttgaggaggctgagaagaatgcaccttccattatatttattgatgaaattgattccatagctcccaagagggaaaaaacccacggtgaagttgagaggagaattgtttctcaacttcttacacttatggatggacttaagtctcgtgctcatgttattgtgattggagcaactaaccgaccaaatagtattgacccagcactcagaaggtttggaaggttcgatagggaaattgacattggggttccggatgaagtaggcaggttggaagtgcttcgtatccatacgaagaatatgaagctctctgatgatgttgatctcgaaaggattgctaaggatactcatggatatgttggagcagatcttgcagctttgtgcactgaggctgcacttcagtgtattagggaaaaaatggatgtcattgacttagaagatgagacaatagatgctgagattctaaattcaatggccgtgactaatgagcacttccagactgcattgggctctagcaacccatccgctctccgtgaaactgtggttgaagttccaaatgtcacttggcaagatattggagggttggaaaatgtcaagagggagcttcaagagactgttcaatatccagtggagcatcctgagaaatttgaaaaatttggaatgtctccttcaaaaggagtgctattttatgggccaccgggttgtggaaagacattgcttgcaaaagccattgctaatgaatgccaggccaatttcatcagtgtgaagggccccgaattgttaacaatgtggtttggagagagtgaggctaatgtgagagaaatttttgataaagccagagggtcagctccttgtgtcctgttttttgatgagcttgattctattgctacgcagcgtggaagtagtgctggggatgctggtggtgctgcagacagagtccttaatcagctgttgacggagatggatggtatgaccgccaagaaaacagttttcattattggtgctacaaacaggcctgatatcatcgatcctgcattgttaaggcctggccgacttgaccagctgatttatattcccttacctgatgagtcctcacgttatcaaatcttcaaatcttgcttgagaaagtcacccgtatcaaaggatgtagacctaatggcactggcccgttatacccaaggattcagtggagccgatatcactgagatttgtcagagggcttgcaagtatgctattagagaaaatattgagaaggatattgaacgtgaacgaaaaagagccgagaatcctgaggcaatggatgaggatgatagcgatgaggtagctgaaataaaagctgctcattttgaggagtctatgaaatatgcccgaagaagtgtcagtgatgctgatattcggaagtatcaagcctttgcacaaacactacagcaatctcgaggctttggttccgagtttcgatttccagacagacctgctggtactgctgctggggcttcggatgtatttgctacagcagataataaagatgacgatgacttatacagttaggaaacttcgtacacaactgtcatcttaatgaagagacaaatgtgtgttctagcagggaccttccgctgacaactagccaatgctattaaatttggctcggctttgcttgtatgagtttaatattcgtatgttctaaactttatttaatttagcagccctttagtagaggactgaatactcttttagtaacttgtaagtttttagagcaaaatcaactttatggcaaagaaagttactcagctatggaaaccttcgttcaactggtagataatgttatggaaactttgctttttctttatgctgttataaaatattttttactagaa

SEQ ID NO: 7459 - DNA, 2645 bp, Cucumis sativus
gatttccgaaccttttgtttggaaataggaacaatactaaacgggatttttccactgcaattttggaacggaagaaatctccaaatcgcttagttgttgatgaggctataaatgatgataactctgtcgtttcattgcatcctgccaccatggaaaagttgcagttctttagaggagatactattttattaaaggggaagaagcggagagatacagtgtgtattgtacttgccgatgaacaatgcgaagagtcaaaaatcagaatgaataaaattgtaagaggtaatctcagagttcgtcttggagacattgtatctgtccatcagtgtcctgacgtgaagtatggaaatcgggttcatatcctccctattgacgatacaatagagggtgttactggcaacctctttgatgcatatttgaaaccttacttcttggaagcatatcgaccggtaaggaagggtgacctgttcttagtccggggtggaatgagaagtgttgagttcaaggtcatagaaacggaccctggtgaatactgtgttgttgcacctgataccgagatcttctgtgagggagaacctgtcaaacgtgaggatgaggagagattaaacgaagttggatatgatgatgttggaggtgtcaggaagcaaatggctcagatacgtgaattagtcgaattacctcttaggcacccacaactcttcaaatcaattggtgtaaagcctccaaaagggatattgctatatgggcctcctgggtctggaaaaactcttatagcaagagctgttgctaacgagacaggtgcattcttctttcttattaatgggccggaaataatgtcaaagttagctggtgagagcgaaagtaatctgaggaaggcatttgaggaagctgaaaagaatgccccctcgattatatttattgatgagcttgattccattgctccaaagagggagaaaacgcatggagaagtggaaagacgtattgtgtcccaacttcttaccttgatggatggcctgaagactcgagcacatgttattattatcggagcaactaatagacccaattcaattgaccctgctttgaggagattcggaagatttgatcgggagattgatattggtgtacctgatgaagtaggacgattggaagttcttagtatccatacaaagaacatgaaacttgcagaggatgttgatcttgagagagttgcaagggatacacatggttatgttggtgctgacctagccgctctttgcactgaagcagcactccagtgtattagggagaaaatggatgtcatcgacttggaagatgaaacaatagatgctgaggttttgaattccatggctgtatccaatgaacacttccaaactgctttagggtcttctaatccatcagccttgcgggaaactgttgtggaggttccaaatgtgtcgtgggatgatattggtgggttggaaaacgttaaaagagagctccaggagactgtccaatacccagtggagcatcctgagaagtttgaaaaattcggcatgtcaccatctaaaggtgttctcttttatggtccccctggctgtggtaaaacgctacttgctaaggcaattgccaatgaatgccaggcaaactttataagtgtgaaaggaccggagttgctgacaatgtggtttggtgaaagtgaggcaaacgtgagagagatatttgacaaggctcgtcagtcagctccttgtgtactattttttgatgagctcgattctatagcaactcagcgtggtagttctgttggagatgctggtggtgcagcagacagagtcttgaaccaacttcttacagaaatggatggcatgactgcaaagaagactgtgttcataattggggcaacaaacaggccagacattatcgaccccgcactgctaaggccgggacgtctagaccaattaatatacattccgctccctgacgagtcttctcgtcttcaaatcttcaaagcttgtctgcgaaagtcaccagtggcgaaagatgtcaatctgtcagctcttgcagggtatacccatggcttcagtggagctgatatcactgaaatatgtcagcgtgcctgcaaatatgccattagagaaaatatcgagaaggatctcgaaagggagagaaagcagggtgaaaactcagaagccatggaagaagacgagatcgatgatgtctcagagattaaggcagcacattttgaggaatcaatgaagtatgctcgccgaagtgtgagcgatgcagacatcaggaagtatcagctctttgctcagaccctacagcaatctcgtggaattggttctgagtttcggttccctgatcgaaacgacaatgtggcagcaggagctgccgacccctatgcttccaccatgggtgctggagatgatgatgatctttatagctgaagtgaaaaccatccagggcagtagttcgtttggtttttcttctgtaaacgagcttttagtgctttttatgggtttccttctcttgaaatgtagttgttaagtgaagaagacttgtgttgttgtagacacttccttagaaaggtctttctatgtaaataagggaatatggaacacatcatgacttccgagtagacatctcttggttctgaaatctggaaataa

SEQ ID NO: 7460 - DNA, 2808 bp, Hordeum vulgare
tctcgcaagaaagagtctttatagctaaactaatcccctccggcctcatcacttcgcctgctgcccagcgacccggagagagagacgcaggcgccgaaacctagcgacgccgccgacgacccccggatccgccggccatggcgacccccaacccgccgccccagcagggcgagccctcctcctccgccgatcccaaggccaagaaggactactcgacggcgatcctcgagcggaagaagagccccaaccgcctcgtcgtcgacgaggccaccaatgacgacaactccgtcgtcgccctccaccccgacaccatggagaggctccagctcttccgcggcgacaccgtcctcctcaagggtaaaaagaggaaagacacaatctgcattgttcttgctgatgacacatgtgatgagccgaaggtcagaatgaacaaaaccgtcaggaaaaacttgagagtgagacttggtgatgtggtgtctgttcaccaatgccctgatgtcaaatacgggaagcgtgtgcacatacttcctattgatgacacagttgaagggattacaggaaacttgtttgacgccttcttgaaaccatatttccttgaagcttaccgtcctttgagaaagggagatcttttcctcgtgagaggtggaatgagaagtgtggagttcaaagttatagagactgacccagcagagtattgcattgttgcaccagacactgagatattctgtgatggtgagcctgttaagagggaggacgaggaaaggcttgatgatgttggctacgatgatgttggtggagtcaggaagcaaatggcccagatcagagaactggttgaactcccactgcgtcaccctcaacttttcaagtctattggtgtgaagcctcccaagggcatactgctgtttggacctcctggctctggcaagactcttattgcgagggctgttgccaatgaaacaggcgcattcttctttctgattaatggcccagaaattatgtccaagttggcaggagaaagtgagagcaacctcagaaaggcatttgaagaagcagagaagaatgcaccatcaatcatcttcattgatgagattgattcaatagccccaaagagagagaagaccaatggagaagttgaaaggcgtattgtttctcagctgttgactcttatggacggtcttaaatcccgtgcacatgttattgttatgggtgctacaaaccgcccaaacagtattgatcctgctctcagaagatttggtaggtttgatcgtgagattgacattggagtccctgatgaagttgggcgccttgaagttctcaggattcacaccaaaaacatgaagttggctgaagatgttgaactggaacacatttcacgagacacccatggttatgttggtgctgatcttgctgctctttgtaccgaggctgctctccagtgcattcgtgagaagatggacattatagatcttgaggatgagaccatagatgctgagatactgaattccatggctgttacaaacgaccatttcaagactgcactaacaacaagcaacccatctgctctccgtgaaactgttgttgaagttcccaatgtctcttgggaagatattggtggtctggaaaatgtcaaacgggagctgcaggagactgtccagtaccctgtggagcatccagagaaattcgagaagtttggcatgtccccttccaaaggtgttctgttctatggccctcctggatgtggtaaaaccttgttggccaaggcaattgcaaatgagtgccaggctaacttcatcagtatcaagggacctgagctgcttaccatgtggtttggtgagagtgaggctaatgtgcgtgagatctttgacaaggctagggggtcagcaccatgtgtcctcttctttgatgagcttgactctattgctacccagagaggaagcagtgttggggatgctggaggtgccgctgatagagtgctgaaccagctgctgactgagatggatggcatgaacgccaagaagactgtcttcatcattggtgctaccaacaggccagacatcatcgaccctgcccttcttaggccagggcgtcttgatcagcttatctacatccctcttcctgatgtcgactcgaggcaccagatcttcaaagcttgcctcaggaagtctcctttggccaaggatattgatctcagtgctctggccaagtacacccaaggattcagcggtgctgatatcaccgaaatttgccagcgtgcttgcaagtacgccatcagggagaacattgagaaggacatcgagagggagaggcggaggaaggacaaccccgaagcaatggaggaggatgaggtggacgaggtggctgagatcagagctgcccacttcgaggagtcgatgaagtatgcccgccggagtgtgagcgacgccgacatccgcaagtaccaggcctttgcccagactctgcagcagtcccgtggattcggcagcgagttccggttccctgatcagccggccgcgggcaccgcctccgccgctgctgccgatccttttgcatccgctgcagcagcagctgaagatgacgacttatatagctaaatcctcctcgttgttgtggccttaacttacccgtgatttccttcgtatactgttatgttttgctctggtatgcaagacacggtcaaactatgtacttaaaattattattgggatgcactgatattcgttacctgccggttatttgcagctgtatcttttcatctgtcatcccgtgttgctttgcacttgtatgctgtgtttaaatccctaatatcag

SEQ ID NO: 7461 - DNA, 2589 bp, Podocarpus macrophillus
gtttggagaatggcggcgtcaggacccggagaatcctcctctgtctcagacccgaaggggaacaagaaagacttcagtactgctatattggagcggaagaagtctccaaaccgtttggttgtggatgaagctgtaaatgatgacaattcggttgtggctcttaatccacaaacaatggaaaccctgcagctctttcgggtgatacaatacttattaagggtaaaaagagaaaggatacaatctgcattgttctggctgatgatacctgtgaagagcataagataagaatgaacaaagtggttaggtcgaatctgagagtaagattaggtgatgtggtgtctgttcatcaatgcccagatgttaagtatgggaagcgagtacatattttacctatcgatgacactgttgagggagttacaggaaacctttttgatgtttacctgaaaccttattttttggaggcctatcgtccagtgagaaaaggagaccttttccttgtgcgaggaggaatgagaagtgtggaatttaaagtcattgagacagatcctggtgaatattgtgttgtttctcctgacactgaaatattttgtgaaggagagccaataaagcgtgaagatgaagaaagattggatgaagttggctatgatgatgtgggtggtctacggaagcaaatggcacagatcagggaattaattgaattaccacttcgtcacccacaacttttcaaatctataggtgttaaacctccaaaaggtatattgctttatggtcctcctggttcaggaaaaaccttgattgctaaggcagttgccaatgagacgggagcattctttttcttaattaatggtcctgaaatcatgtcaaaacttgctggtgagagtgaaagcaatctgagaaaggcttttgaggaagctgaaaagaatgccccttctatcattttcattgatgagattgattccatagctccaaagagggagaaaacgaatggtgaagtagagaggcgcattgtatctcaacttttgactttgatggatggcctgaaatctcgagcacatgtcattgtcatgggtgcaacaaataggccaaacagcattgatcctgcactgagaaggtttggtaggtttgatcgtgagattgacattggtgttccagatgaaataggtagaatggaggtgcttcgcatccacactaaaaacatgaagcttgctgaagatgttgatcttgagcgtatctcgaaagaaacacatggtttgttggggctgatcttgctgctctttgcactgaagctgcattacaatgcattagggaaaaaatggatgtgatcgacttggaagatgaaacaattgatgctgaagttctgaattcaatggctgtaacaaatgaacattttcagactgcactgggcacaagcaatccctctgctctccgggagactgttgtggaggtgccaaatgtttcttgggaggatattggtggtctggaaaatgttaagagagagcttcaggagaccgtgcaatatcctgtggagcatccagagaaattcgagaaatttggcatgtctccttcgaaaggtgtcctattttatggaccccctggttgtggtaagacactacttgcaaaggctattgcgaatgaatgccaggcgaattttatcagtataaaggggccagaattgctaacaatgtggtttggagaaagtgaagcaaatgttcgtgatgtttttgataaagccaggcaatcagcaccttgtgtcttgttttttgatgagcttgattcaattgctactcagcgtggtagtagtgttggagatgctggtggagctgcagacagggttctgaaccagttgctgactgaaatggatggcatgactgctaagaaaactgttttcattattggggccacaaatcggcctgacattattgatcctgctttgttaagacctggtcgccttgaccaattgatatatatacccctacctgatgaagcttcacgttttcaaatttttaaagcatgtttgcggaagtcgcctatttcaaaagatgttgatattgcagttcttgctcgttacacgcatggtttcagtggagctgatatcactgaaatttgtcagcgtgcctgcaaatatgctattagagaacatattgaaaaggacatcgaaagggagaggaaacagagagaaaaccctgaagctatggatgaagatgaatctgatgtggcagaaataaaggcatctcattttgaagaagctatgaaatatgctcgaagaagtgtcagtgatgcagatatccgtaaatatcaggcttttgctcaaacattacagcagtctagaggttttgggtcagagttccgatttgctgataggccagctgctacaacaggtggaacagttaccgcagaagcttttgctgcaacaggagctggtgatgatgatgatctttacagttaactctcacctgctttagcacttatttgctgtgagctatagagagatcaatgttagaggctcagtcctatgcgcatagtgtgttttcaaattgcaatcttcttgctcactgtccaaatgctggtacttgataacattaattagtc

SEQ ID NO: 7462 - DNA, 3025 bp, Pinus taeda
ttaaattttaatcgtcgcaattgatgcatgggctttattcagaagacattggctttagcgttggtcgctcggagtggtgggtgaaagctggaaggggaggccatctgatacgaaccatcagatctcattcatttctgcggagatcttctgcgtctttctcttctctgtggttgttccctttctatcatttcatcctttaaaatctacgatggcgagcttaatacctggagaatcatctgaagggaagggaacaaagaaagactttagcactgcaatacttgagcgtaagaagtctcctaatcggttagttgtggatgaagccataaatgacgataattcggttgtggctcttaattcgaaaacaatggaaacattgcagcttttccggggtgataccattcttgttaagggtaaaaagagaaaggatactgtttgcattgttctggctgatgatacctgtgaagagcataagatcagaatgaacaaagttgctaggtcaaatctaagagtaagattaggggatgtagtatctgttcatcagtgcccagatgttaagtatgggaagcgtgtgcacattcttcctatagatgacacaatcgaaggtgttacaggaaacttgttcgatgtgtacttgaagccttacttcttggaagcctatcgcccagtaagaaaaggagacctttttctagtacgaggaggaatgagaagtgtagaatttaaaatcattgagacagatcctggtgagtattgtgttgtttctccagatactgaaattttttgtgagggagagccaataaaacgagaagacgaagacagattggatgacgttggctatgatgatgttggtggtgtaaggaaacaaatggcacagatcagagaactagttgaattaccactaaggcatccacaacttttcaaatccattggtgttaagccacctaagggtattttgctttatggtcctcctggttcaggaaaaaccttgattgctagggcagtggcaaatgagactggagctttcttttttctaattaatggtcctgaaattatgtcaaagcttgctggagaaagtgaaagcaatcttagaaaggcttttgaagaagcagagaagaatgccccttctatcattttcattgacgaaattgactccatagctccaaagagggagaaaacaaatggtgaagtagagaggcgcattgtatctcaattattaacattgatggatggtctaaaatctcgatctcatgtgattgtcatgggagcaacaaataggcctaacagcattgatccagcgcttagaaggtttggtaggtttgatcgtgaaattgacattggggttccagatgaagttggtcgactggaagttcttcgcatccacacaaagaatatgaagcttgctgaagatgttgatcttgaacgtatttcgaagaatacacatgggtatgttggggcagatcttgcagctctttgcactgaggctgcactgcattgtattagggaaaaaatggatgtcattgacttggaagatgaaactattgatgcggaagttctgaattctatggctgttacaaatgagcactttcaggctgcactgggctctagtaacccttctgccttgcgtgagactgttgtggaggtgccaaatgtttcttgggaggatattgggggtctggaaaatgtcaaaagagagcttcaggagactgtgcaatatccggtggaacatccagagaaatttgagaagtttggtatgtctccctctaaaggtgttctattctatggacctcctggttgtggtaagacgctgctggcaaaggccattgccaatgagtgtcaggccaactttatcagtgtgaaaggcccagagctcctaacaatgtggtttggagaaagtgaagccaatgtgcgcgatatttttgataaggctaggcagtcagcaccttgtgtcctttttttgatgagcttgattcgattgctacccagcgtggtagtagtgcgggagatgctgggggtgcagcagacagagttttgaatcagttgctgactgagatggatggcatgtctgccaagaaaactgttttcattattggagctacaaatcgccctgacattattgattcggctttattacgacctggtcgccttgatcaattaatatacatacccttacctgatgaagcttcccgctttcaaatctttaaagcatgtttgcggaagtcacctgttgcaaaggatgttgaaattgcgactcttgctcaatacacacaaggatttagtggagctgatattactgaaatttgtcagcgtgcttgcaaatatgccattagagaacatattgagatggacattgaaagggaaaggaaaagaaaggaaaacccggaagccatggatgaagatgaaactgaagttgcagaaataaaggcagctcattttgaggaatcaatgaaatatgcccgaaggagtgttagtgatgcagatatacgtaaatatcaagcatttgctcaaacattacagcaatctcgaggttttgggtcagaattccggttcacagatcagactactactaccacaggtagtgcaggcaccacagatgctcttgttacacaacgtgctgttgatgatgatgatctgtacagttgaaatggtgaattacacgatcacaaaattatagggttgtaacattttgactcaagtttcagaatgtttggtatttgtgatcttggtgtatactcttggcatccatttcatacgtccttcaccccattgtcacacacttccatgcatccattgatctgtcacttcgtgattaatttggatttaccatttatttattttcaaattggcagctggatgcatttttacgtttattcaaataaatgcacaaggttgacattacaaaattgatgatgcttttctttttctctgaagttgatatctattaatcacctggcaccataaattggtctaattgctatgctggcattctaatggcatctagcctggttttgtgtgtgagaatggacttatt

SEQ ID NO: 7463 - DNA, 2981 bp, Citrus clementina
tttccatataccaaacagagactgcctcttcacttagctctctctataatagatagaatctatatatatatatatatatttgtgcaatcgatctatctctagctcacaaagttcttagcattggatttggaacccgaaatcaaaacagggacaatttgctgaagaaattcaaaatcccaataaatggctgatcctagctcatctgcgcctcgaccagcttcttcctctgacccgaaaagtagtaagaaagattattcaactgctattctggaccgcaagaagtctcccaaccgtcttgtcgttgatgaagcaatcaatgatgataattctgttatcaccatgcatcctaacactatggaaaaacttcagtttttccgaggtgacactgtcttagtaaaggggaagaagcgaaaagacacagtttgtgttgttcttagtgatgaactatgtgaagagtcgaaagtcagagtgaacaaagttgtacgatctaatcttagagttcgtcttggagatgtagtatctgttcatccatgccccgatgtgaaatatggaaggcgtgttcacatccttcccattgatgatacgatcgagggtgtaactggaaacttatttgatgcatatttgaagccttatttcatggaatcttaccggccagttaggaaaggcgacctttttctagtcaggggtggaatgagaagtgttgaatttaaagtaattgagacggaccctggtgaatattgtgttgttgcaccggatactgagatcttctgtgagggcgaacctgtcaaacgtgaggatgaggagagattaaatgaagtaggctatgatgatgttggtggtgttagaaagcaaatggctcaaatccgtgagcttgtagaacttcctcttagacaccctcagcttttcaaatcaattggtgtgaagcccccaaaaggtatcttgctttatgggccacctgggtctggaaaaaccctgattgcaagggctgttgctaatgagacaggtgcctttttctttttgattaatggccctgaaataatgtcaaagttagctggtgaaagtgaaagcaatttaaggaaggcatttgaagaagctgaaaagaatgcaccatctataatatttatcgatgaattagattccattgctccaaagagggagaagacacatggtgaagtggagaggcgtatagtatcccaacttctaactttgatggatggcctcaagtcccgggcccatgtgattgttatgggagctactaataggccgaatagcattgaccctgctcttaggagatttggaagatttgatcgtgagattgacataggtgtacccgatgaagttggaagattggaaattcttaggatccacacaaaaaacatgaaacttgctgaagatgttgatcttgaaagagttgcaaaagatacccacggttatgttggttcagatcttgctgctctctgtacagaggctgcccttcagtgtattagggagaaaatggatgtcatcgacttagaggatgagactattgacgccgaggtgttgaattcaatggctgtaacaaatgagcacttccaaactgcattggggacatcaaatccttcggccttacgtgaaactgttgtggaggttcctaatgtctcatgggaggatattggtgggttggataatgttaagagagagcttcaagagactgttcaatacccagtggagcatcctgaaaagttcgagaaatttggcatgtcaccttctaaaggtgttctcttctatggacctcctggctgcggcaaaacccttcttgcaaaagctattgctaacgagtgtcaagcaaacttcataagcgtcaaaggacctgagctgctgacaatgtggtttggagagagtgaggcaaatgtaagggaaatctttgacaaggcacgacagtcagctccatgtgtgctattctttgatgaacttgattctattgctactcagcgtggcagttctactggagatgctggcggtgctgcggatagagtactgaatcaacttctaactgaaatggatgggatgaatgccaaaaaaacagttttcatcataggcgccaccaaccggcctgacatcatcgatccagcgttgttgaggcctgggcgtttggaccaattgatttatatacccctgccagatgaggcttcccgtcttcagatatttaaagcttgtttacggaagtcacccatctctcccgatgttgacctatcagctcttgcacgttatactcatggtttcagtggtgccgatatcactgaagtatgtcagcgtgcctgcaaatatgcaattcgagaaaatattgaaaaggatattgagagggagaggaggaagatggagaaccctgaagcaatggaagaagatgaggtcgatgatgtcgatgagattaaggcagtacactttgaggaatcaatgaaatatgcccgccggagtgtcagtgatgcagacatccggaaataccagctctttgcacagaccttgcaacaatctcgtgggtttgggtccgaattccggtttgcagatcgtaccgagagtgccgccgctggggctgcagatccattctcttctgccgctgctgctgatgatgatgatctatacaactgaactaaaaccgacgaaagttgaagacactgcagtaaatggaacatctagtgccatgggaatattaattattaattaattattgcctaggaacactagtgtatactactttcgtgttgactcagtttcatgctttttgttatgtgaaatttcatagtattaacttaacataatgtatcaatgggtgttgaaattttcctatttcaaatttagaatcttaataccaaccagactattaatgtgttaggtgtttcgcctcctagaagtgattatagcattctcatagttcatgttactaacttgctcctaccgtcatgatgaatgagcccgtgttctcgtgacggtcgtcgcatgtctga

SEQ ID NO: 7464 - DNA, 2380 bp, Ambrosia trifida
atcccattaatattattgataacaaattcttcttccctcaatcttcattaccatgagtaaccagcctgaatcctctacatccgatccgaaagcgtcgaagaaggacttttcgactgctatcttggagcgcaagaaatctcccaatcgtcttgttgttgacgaggctgtcaatgacgataactccgtcgtcgctatgcaccctgctaccatggagaaattgcagctctttcgtggcgatactattttgatcaagggcaagaaaagaaaggatacagtttgcattgcccttgctgatgaaacatgtgatgaaccaaagataagaatgaacaaggttgttaggactaacctaagaattcggcttggtgatgttgtgtcagtgcaccaatgcccagatgtcaagtatggtaaacgtatccatgttcttccacttgatgacaccattgaaggtgtcacaggagacttatttgatgcctatctgaaaccatactttttggaggcatataggcctgttaggaaaggagaccatttccttgttagaggaggtatgcgcagcgtcgaatttaaggtaattgagactgatccaggggagtattgtgttgttgctccagacaccgaaatattctgtgagggtgagccaattaagagagatgacgaggacagattggatgaggtgggctatgatgatgttggaggcgtcaggaaacaaatggctcagattcgtgaattggtggagttaccgttaagacaccctcaacttttcaagtcaattggagtcaagcctcctaaaggaatcttgctctatggaccacctggttcaggaaagacactgatagccagagccgttgctaatgaaaccggagctttctttttctgcatcaatggtcctgaaattatgtcaaagttagctggagaaagtgaaagcaatctcaggaaagcatttgaggaggctgagaagaacgcgccgtcaattattttcattgatgagatagattcgattgcgccaaagagagagaagactaatggtgaagttgaaaggaggattgtatcacagcttttgacacttatggatggattaaaatcgcgagcccatgttattgtaatgggggcaacaaaccggccaaatagcattgaccctgctctcagaagatttggtaggttcgatagggaaatcgacattggtgtcccagatgaagttgggcgtcttgaggttcttcgtatccacacaaagaacatgaagctttctgaggatgttgatttggaaaagatatcaaaagaaacacatggttatgttggtgctgatcttgctgctctttgcactgaagctgcacttcaatgcattagagagaaaatggatgttattgatttggaagatgattctattgatgctgagatactgaattccatggctgtcaccaatgaacatttctctactgctcttggaactagcaatccatctgctctgcgtgaaactgttgttgaagttcccaatgttagctgggatgatattggagggctcgagaatgttaagcgtgagcttcaagagacggttcaatatccagtggagcatccagagaaatttgagaaatttggtatgtcaccgtctaaaggagttcttttctacggtccacctggatgtgggaaaacacttctggcaaaagctattgcaaatgaatgtcaagctaatttcattagtatcaaaggacccgaattgctaacgatgtggttcggtgaaagtgaagctaatgttcgtgaaatttttgacaaggccagaggatctgctccatgtgtccttttctttgatgaactcgactccattgcaactcagagaggaagcagttctggagatgcaggtggtgctgctgaccgtgttctgaatcaactgttgactgaaatggatggaatgtctgccaaaaagacggttttcataattggagccactaacagacccgacattattgatccagcattacttcgacctggacgtcttgatcaacttatttacattccactaccagatgaagaatcacgttactcgatcttcaaggctgcaatgaggaaatcccctgtttctaaagatgttgatttgagagctcttgctaagtacactcaaggatttagtggggcggatattactgaaatatgtcaacgggcctgcaagtatgcaattagggagaacatcgagaaagatatagagaaggaaagaaagaggagtgagaatcccgactctatggatgaggatgatgacgatgatgtggctgagataaaggcggctcactttgaggaatccatgaagtatgcacgcagaagtgtgagcgatgctgacattaggaagtaccaggcgtttgcgcagacattgcagcagtcgagaggattcggatct

SEQ ID NO: 7465 - DNA, 2993 bp, Citrus sinensis
tttccatataccaaacagagactgcctcttcacttagctctctctataatagatagaatctatatatatatatatatatatatatatatatttgtgcaatcgatctatctctagctcacaaagttcttagcattggatttggaacccgaaatcaaaacagggacaatttgctggagaaattcaaaatcccaataaatggctgatcctagctcatctgcgcctcgaccagcttcttcctctgacccgaaaagtagtaagaaagattattcaactgctattctggaccgcaagaagtctcccaaccgtcttgtcgttgatgaagcaatcaatgatgataattctgttatcaccatgcatcctaacactatggaaaaacttcagtttttccgaggcgacactgtcttagtaaaggggaagaagcgaaaagacacagtttgcgttgttcttagtgatgaactatgtgaagcgtcgaaagtcagagtgaacaaagttgtacgatctaatcttagagttcgtcttggagatgtagtatctgttcatccatgccccgacgtgaaatatggaaggcgtgttcacatccttcccattgatgatacgatcgagggtgtaactggaaacttatttgatgcatatttgaagccttatttcatggaatcttaccggccagttcggaaaggcgacctttttctagtcaggggtggaatgagaagtgttgaatttaaagtaattgagacggaccctggtgaatattgtgttgttgcaccggatactgagatcttctgtgagggcgaacctgtcaaacgtgaggatgaggagagattaaatgaagtaggctatgatgatgttggtggtgttagaaagcaaatggctcaaatccgtgagcttgtagaacttcctctgagacaccctcagcttttcaaatcaattggtgtgaagcccccaaaaggtatcttgctttatgggccacctgggtctggaaaaaccctgattgcaagggctgttgctaatgagacaggtgcctttttctttttgattaatggccctgaaataatgtcaaagttagctggtgaaagtgaaagcaatttaaggaaggcatttgaagaagctgaaaagaatgcaccatctataatatttatcgatgaattagattccattgctccaaagagggagaagacacatggtgaagtggagaggcgtatagtatcccaacttctaactttgatggatggcctcaagtcccgggcccatgtgattgttatgggagctactaataggccgaatagcattgaccctgctcttaggagatttggaagatttgatcgtgagattgacataggtgtaccagatgaagttggaagattggaaattcttaggatccacacaaaaaacatgaaacttgctgaagatgttgatcttgaaagagttgcaaaagatacccacggttatgttggttcagatcttgctgctctctgtacagaggctgcccttcagtgtattagggagaaaatggatgtcatcgacttagaggatgagactattgacgccgaggtgttgaattcaatggctgtaacaaatgagcacttccaaactgcattggggacgtcaaatccttcggccttacgtgaaactgttgtggaggttcctaatgtctcatgggaggatattggtgggttggataatgttaagagagagcttcaagagactgttcaatacccagtggagcatcctgaaaagttcgagaaatttggcatgtcaccttctaaaggtgttctcttctatggacctcctggctgcggcaaaacccttcttgcaaaagctattgctaacgagtgtcaagcaaacttcataagcgtcaaaggacctgagctgctgacaatgtggtttggagagagtgaggcaaatgtaagggaaatctttgacaaggcacgacagtcagctccatgtgtgctattctttgatgaacttgattctattgctactcagcgtggcagttctactggagatgctggcggtgctgcggatagagtactgaatcaacttctaactgaaatggatgggatgaatgccaaaaaaacagttttcatcataggcgccaccaaccggcctgacatcatcgatccagcgttgttgaggcctgggcgtttggaccaattgatttatatacccctgccagatgaggcttcccgtcttcagatatttaaagcttgtttacggaagtcacccatctctcccgatgttgacctatcagctcttgcacgttatactcatggtttcagtggtgccgatatcactgaagtatgtcagcgtgcctgcaaatatgcaattcgagaaaatattgaaaaggatattgagagggagaggaggaagatggagaaccctgaagcaatggaagaagatgaggtcgatgatgtcgatgagattaaggcagtacactttgaggaatcaatgaaatatgcccgccggagtgtcagtgatgcagacatccggaaataccagctctttgcacagaccttgcaacaatctcgtgggtttgggtccgaattccggtttgcagatcgtaccgagagtgccgccgctggggctgcagatccattctcttctgccgctgctgctgatgatgatgatctatacaactgaactaaaaccgacgaaagttgaagacactgcagtaaatggaacatctagtgccatgggaatattaattattaattaattattgcctaggaacactagtgtatactactttcgtgttgactcagtttcatgctttttgttatgtgaaatttcatagtattaacttaacataatgtatcaatgggtgttgaaattttcctatttcaaatttagaatcttaataccaaccagactattaatgtgttaggtgtttcgcctcctagaagtgattatagcattctcatagttcatgttactaacttgctcctaccgtcatgatgaatgagcccgtgttctcgtgacggtcgtcgcatgtctga

SEQ ID NO: 7466 - DNA, 2852 bp, Citrullus lanatus
accgatggtctgaaaacttgcagaaacccttgtggtattcaaaacacaaaaggctgaaacaatgactgacccaacaggttcatcggcttcagataagggccacgaaccctcttcttcatcggaccagaaaagtactaaacgggatttttccactgcaattttggaacgcaagaagtctccaaatcgtttagttgttgatgaggctataaatgacgataactctgtggtttctttgcatcctgctaccatggaaaagctacagttctttagaggagatactattttattaaagggaaagaagcggagagatacggtgtgtattgtacttgctgatgaacaatgcgaagagtcaaaaatcagaatgaataaaattgtacgagccaatctcagagttcgtcttggagatgttgtatctgtccatcagtgtcctgatgtgaagtatggaaagcggattcatgtcctccctgttgatgatacaattgagggtgttactggcaacctatttgatgcatatttgaaaccttatttcttggaagcatatcgaccggtaaggaagggtgacctgttcttagtccggggtggaatgagaagtgttgagttcaaggtcatagaaacagaccctggtgaatactgtgttgttgcacctgataccgagattttctgtgagggagagccaatcaaacgtgaggatgaggagagattaaatgaagttggatatgatgatgttggaggtgtcaggaagcaaatggctcagattcgtgaactagtggaattaccacttagacacccacaactcttcaaatcaattggtgtaaagcctccaaaaggaatattgctatatgggcctcctggatctggaaagactcttatagcaagagctgttgctaatgagacaggtgcattcttctttctgattaatgggccagaaataatgtcaaagttagctggtgagagtgaaagtaatctgaggaaggcatttgaggaagctgaaaagaatgccccctcaattatatttattgatgagcttgattccattgcaccaaagagggagaaaacacatggagaagtggaaaggcgtatcgtgtcccaacttcttaccttgatggacggcctcaagactcgagcacatgttattgttattggagcaactaatagacccaacagcattgaccctgctttgaggagatttggaagatttgatcgggagattgatattggtgtaccagatgaagtaggacgattggaagtccttaggatccatacaaagaacatgaaactttcagaggatgttgatcttgagagagttgcaagggatacccatggttatgttggtgccgatcttgccgctctttgtactgaagcagcactccagtgtattcgggagaaaatggatgtcatcgacttggaagatgaaacaatagatgctgaggttttgaattccatggctgtaaccaatgaacatttccaaactgctttagggtcttctaatccatcggccttgcgggaaactgttgtggaggttccaaacgtgtcatgggatgatattggagggttggaaaatgttaaaagagagctccaggagactgtccaatacccagtggagcatcctgagaagtttgaaaaatttggcatgtcaccatctaaaggtgttctcttttatggtccccctggctgtggtaaaacgctacttgctaaggcaattgccaacgaatgccaggccaactttataagtgtgaaaggacctgagttgctgacgatgtggtttggtgaaagtgaggcaaatgtgagagagatatttgacaaggctcgtcagtcggctccttgtgtactatttttcgatgaactcgattctatagcaactcagcgcggtagttctgttggagatgctggtggtgcagcagatagagtcttgaaccaacttcttacagaaatggatggcatgactgcaaagaagactgtgtttataattggggcaacaaacaggccagacattatagaccccgcactgctgaggccaggacgtctggaccaattaatatacatcccactccctgacgagtcttctcgtcttcaaattttcaaagcatgtctgcgaaagtcgccagtgggaaaagatgtcaatctaacagctcttgcacggtacactcatggctttagtggagctgatatcactgaaatatgtcagcgtgcctgcaaatatgccattagagaaaatattgagaaggatctcgaaagggagagaaagcaaaatgaaaactcggaagccatggaagaagacgacatcgatgaagtctcggagataaaggcagcacattttgaggagtcaatgaagtatgctcgccgaagtgtcagcgatgcagacatcaggaagtaccagctctttgctcagaccctacagcaatctcgtgggattggttccgagtttcggttccctgatcgaacggacaatgtagcatcaggagctgccgacccatttgcttccaccatggctgctggagatgatgatgatctttacagctgaagtgaccagtcagtgcagggggagtttgtatggctttttcttgtgtaaacgactttttagtgctttttatgggttttcttctctttaaatgtagtggttaagtgatgagacttgtgttgtagatactttttagaaaggcctttctgtgtaaacaagggaatgttgaacacatcatgacatctgagtagacagtctctttgctgtgaattctggaaataaaattttaaacgttaaattgttaaaggcccaacaaatttggaaggaagaaaaaaaaaaaaaaaaaaaaaaaaaacagtacatctgcttagagataaagataaaaattatattt

SEQ ID NO: 7467 - DNA, 4572 bp, Brachypodium distachyon
aagaagaaactacagtataaactaatcccctcgcctccctcctgggctcctcgcttcgcccggcggaactgcggaagaagaatatctacccgtttccgcctcccaccgctctcgacaactacagccccggaaggaggccgaaacctagcgccgccgacctcggaaatcccgccagccatggcgacctcgcctacccagggcgagccgtcctcctccgatccgaagtcgaagaaggactactcgacggcgatcctcgagaggaagaagtcgccgaaccggctggtggtcgacgaggccaccaatgacgacaactccgtcctcgcgctgcacccggagaccatggagaggctccagctcttccgcggggacactgtcctgcttaagggtaagaagagaaaggacacaatctgcatcgtgcttgcggatgacacatgtgaggagccaaagatccggatgaacaaaactgttaggaagaacttgagagtgcgacttggtgatgtggtgtctgttcatcaatgcccagatgtcaaatacgggaagcgtgtgcacatacttcctattgacgacacggttgaaggcatcaccggaaacttgtttgatgctttcttgaaaccatacttccttgaagcttaccgtcctttgagaaaaggagaccttttccttgtgaggggtggaatgaggagtgtggaattcaaagttatagagactgatcccgcagagtattgcattgttgcgcctgacacggagatattctgtgatggtgagcctatcaagagagaagacgaggaaaggctagacgaggttggctatgatgatgttggtggagttaggaaacaaatggcccagatcagagagctggtcgaactcccactgcgccatccccaacttttcaagtctattggtgttaagccaccaaagggcatattgctgtacggaccacctggctctggcaagaccctaattgctagagctgtcgctaatgaaacaggtgcattcttctttctgattaatggcccagaaatcatgtcgaagctagcaggagaaagtgagagtaatctcagaaaggcattcgaagaagctgagaagaatgcaccagccatcatcttcattgatgagattgattcaatagccccaaagagagaaaagacgaatggagaagttgaaaggcgtattgtttcacagctgttgactcttatggatggtctgaaatcccgtgctcatgttattgttatgggtgctacaaatcggccaaacagcattgatcctgcgcttaggagatttggcaggtttgaccgggagattgacattggtgttcctgatgaagttgggcgccttgaagttcttcgtattcacactaaaaacatgaagctagctgaagacgtcgagctggaacatatttcaaaagacacccatgggtttgttggtgcagatttagctgccctttgcactgaggctgccctccagtgcattcgtgagaagatggatattattgatctcgaggatgagaccatagatgctgaaatactgaactctatggctgttacaaacgaccacttcaagactgcactaacgaccagcaacccatctgctctccgtgaaactgttgttgaagttccaaatgtctcttgggaagatattggtggtctggagaatgtcaaaagggagttgcaggagactgtccagtatcctgtggagcatccagagaaatttgagaagtttggcatgtctccttccaaaggtgttctgttctatggtcctcccggctgtggtaaaacattgttggccaaggcaattgcaaacgagtgccaggctaacttcatcagtgtcaaaggacctgagctgctcaccatgtggtttggtgagagtgaggctaatgtgcgtgagatttttgacaaggctagggggtcagcaccatgtgtcctcttctttgatgagcttgattcaattgctacccagaggaagaagtcgccgaaccggctggtggtcgacgaggcaacgaacgacgacaactccgtcgtcgccctgcacccggacaccatggagaggctccagctcttccgtggcgacactgtcctgctcaagggtaagaagagaaaggacacaatctgcattgtgcttgcagatgaaacatgtgaagagccaaaggtccgaatgaacaaaaccgtcaggaagaacttgagagttcgacttggtgatgtggtatctgttcatcaatgcccagatgtcaaatacgggaagcgtgtgcacatacttcctattgatgacacggttgaaggcattactggaaacttgttcgatgctttcttgaaaccatacttccttgaagcttatcgtcctttgaggaaaggagaccttttccttgtgaggggtggaatgaggagtgtggaattcaaagttatagagactgatcctgctgagtattgcatcgttgcacctgacactgagatattctgcgatggtgagcctatcaaaagggaagacgaggaacggcttgatgaggtcggctatgatgatgttggtggagttcggaaacaaatggcccagatcagagagctggtcgaactcccactgcgccatccccaacttttcaagtctattggtgttaagccaccaaagggcatattgctgtttggaccacctggctctggcaagacccttattgctagagctgtcgctaatgaaactggagcattcttctttctgattaatggccctgaaattatgtccaagctagcaggcgagagtgagagcaatctcaggaaggcttttgaagaagccgagaagaatgcaccagctatcatcttcattgatgagattgattcaattgcccccaagagagaaaagaccaatggagaagttgagaggcgtattgtttcacagctgttgactcttatggatgggcttaaatcccgtgctcatgttattgttatgggcgctacgaatcgcccaaacagtattgatcctgctcttaggaggtttggtaggtttgaccgggagattgacatcggtgtccctgatgaagttgggcgcctcgaagttctccggattcacacaaaaaacatgaagttagctgaagatgttgaactggaacatatttccaaagacacccatggttatgttggtgctgatcttgctgccctttgcactgaggctgctctccagtgcattcgcgagaagatggatattatagatctcgaggatgagaccattgatgccgagatactaaactctatggctgttacaaatgaccacttcaagactgcactgacgacaagcaacccatccgctcttcgtgaaacagttgttgaagttccaaatgtctcttgggaagatattggtggtctggagaatgtcaaacgggagttgcaggagactgtccaatatcctgttgagcatccagagaaattcgagaagtttggcatgtctccttccaaaggtgttctgttctatggtcctccaggctgtggtaaaacattgttggccaaggcaattgctaatgagtgccaggctaacttcatcagtgtcaaaggacctgagctgctcaccatgtggtttggtgagagtgaggctaatgtccgtgagatttttgacaaggctagggggtctgcaccatgtgtcctcttctttgatgagcttgattcgatcgctacccagagaggcagcagtgttggggatgctggaggtgcggctgatagagtgctgaaccagctgctgactgagatggatggcatgaacgcaaagaaaactgtatttatcatcggtgctacgaacaggccagacatcatagaccctgccttgctcaggccagggcgtcttgatcagcttatctacatccctcttcctgatgttgagtccaggctccagatcttcaaagcatgcctcaggaagtctcctgtggccaaggatgtggacttgaatgctcttgccaaatacacacaagggttcagtggtgccgacatcacagaaatttgtcagcgtgcttgcaaatatgccatcagggagaatattgaaaaggacattgaaatggagaggcggaggaaagacaaccctgaagccatggaggaagatgaggcggatgagatcgccgagatcagggctgctcactttgaggagtcgatgaagtacgcccgccggagtgtgagcgatgccgacatccgcaagtaccaggcctttgcccagacgctccaacaatcacgtggatttggcagcgagttccggttcccagatcagcccgctgccggcgctgccgccgccgccgacccctttgcatccgctgccgcagcagctgaagatgatgatttatatagctaaactaaaccctctttgttgtgctcgttagcttcctgtggtttcgttgatatactgttcatgttacggtctcttttgttacacgggagaacaatgtatcggtatgcactggtaatcttattatctgccaattgtttgctcttctgctgctgttgtattttgttctgtgagcgtgggaacgtaggcttgttagccatttggtacaggtagatcgccgaccacatgaaatatgtgtacactttccctgttagaactccttggacc

SEQ ID NO: 7468 - DNA, 2498 bp, Selaginella moellendorffii
gggtcatttcaagggtaggtagccatggcggtgaccgattcaagctcgagcaaggcagagtcttcggatccgaagggttcgaagcgagactattccactgccatcctggagcgcaagaaagccccaaataggctcgttgtcgacgaagcaaccaacgatgacaactcggttgtggctctgcatccagagaccatggaaaagctacagctgttcaggggggataccgtgctcatcaagggcaagaagcgcaaagacactgtctgtattgttctggcagacgacagctgcgaggagcctaaaatccgtatgaacaaggtggtccgaacaaacttgcgggtgaggctcggtgatgtggtttctgtgcatcaatgcgcggatgtcaagtatgggaagcgagttcatatccttcccgtcgacgatacaatcgaggggctcactgggaatctgtttgatgcgtacctcaagccatactttttggaagcttaccggcctgtccgcaaggctgatctcttccttgtgcgcggtggcatgaggagtgtggagttcaaggttgtagagactgatcccggcgagtattgcatagttgcaccggacacggaaatcttctgcgagggcgatcctatcaagcgcgaggatgaggagaggcttgatgaagttggttacgatgatgttggtggggtgcggaagcagatggcccaaatacgtgagttggtggagcttcccctcaggcacccgcagctgttcaagtcgattggtgtcaagcctcccaagggaatcctgctctacgggcctccagggtctggcaagaccttgattgccagggccgtggcaaatgaaacgggggcctttttctttctcatcaatggtcctgagatcatgtcgaagctggctggggagagcgaaagtaacttgcgcaaggcgtttgaagaggcggagaagaacgctccatcgatcatattcattgacgagatagattcgattgcacctaagagggagaaaacgcaaggagaagtagagcgccgaatcgtgtcccagctgctgactctgatggacggtttgaagagcagatcccacgttattgtcatgggagcaactaacaggcctaacagcatcgacccggctctgaggaggtttggtcgttttgatcgggagatagatatcggtgttcccgacgaggttggccggttggaagttctccgcatccataccaagaacatgaagctcgcggaagacgtggatttggagaaaatttctcacaatacgcacggcttcgttggcgcggaccttgctgccctatgcaccgaggcggccctgcagtgcatccgtgaaaagatggacgtgattgatcttgaagacgagactatcgatgccgaagttctcagctcaatggccgtaacgaacgagcactttcagacagctttgggaacgagcaacccttctgcactccgtgagacggtggttgaagtgcctaatgtttcctgggaagacattggtggtcttgagaacgtcaagagggagcttcaagagactgtgcaatatccagttgagcatccggagaagtttgagaagtttgggatgtcgccgtccaagggagtcttgttctatgggcctcctggatgtggaaagaccttgcttgcgaaagcaatcgcaaacgaatgtcaggcaaacttcattagtgtcaagggtccagagctgctaaccatgtggtttggggagagcgaggccaatgttcgcgacgtgtttgacaaagctaggcaatcagctccttgcgtgctcttcttcgacgagctagattccattgcgacacaacgtggtagcagcgttggtgacgcaggtggtgcagccgatagagttttgaatcagctgctgactgaaatggatgggatgaacgctaagaagacggtgttcattattggtgcgacaaacagacccgacattattgatcctgctctacttcgtcccggtcgactggatcaacttatctacattcctcttccggatgaggcatccaggctgaagatcttccaagccgcgcttcgcaagtcgccgctgtccaaggatgtggacctcgaggctcttgggaggtatactcaaggtttcagtggagctgacatcaccgagatctgccagcgtgcttgcaagtatgccatcagggagaacatagaacaggacattgagaaggagaggaggagagcagacaacccagaggctatggacgaggacgaagttgatgaaatagcggagatcaggcccgctcactttgaggaggctatgaagttcgcgcgaagaagtgtgagcgacgccgacatccggaagtaccaggcgtttgcccagactctgcagcagtctcggggatttggatccgagtttcgtttcccagaccgtccagcagctgcaggcggcgactctgcttttgccactgctgctgcagaagacgatgacctctacaactgatggaaaaattctcgtgaacgaagtgatgatttgtgagtggaaaa

SEQ ID NO: 7469 - DNA, 2783 bp, Physcomitrella patens
tgaagatctcgcgtcggagtaggtctcggctccgagttcgtccgctgcccccatttcaattgtgttcgcaacgcagcgcaccgctgtttgggctgggtcgatgcctagtattttgtagatcggagggaggggagtaacttctatttaatttggaaaacgacatcgaaaacggtcgatcttccctggagaacgaattgaagttgtgagattcggccatggcgactcccgcggctggacctgctgggaaatcctcggatcccaagccaaagaaagacttttccaccgctattttggagcgcaagaaggctccgaaccgtttggttgtcgatgaggctgtgaatgatgataattcggtggtagcattaagtatggagactatggaaaagttgcagctatttcgtggggacaccgtgctgatcaagggtaagaaacgcaaagatactgtgtgcattgtcttatcagatgacacctgcgatgagcataaaatacgcatgaacaaggtggtaagggccaatcttcgggtgcgccttggagatgtggtatcagttcaccaatgtccggatgttaaatatggtaaacggattcatgtactgccgtttgatgactcaatcgagggtgtgactggaaacctattcgatgcttacttgaagccttactttttggaagcttacagaccagtccgcaaaggtgatttattcttggtgcgaggaggtatgaggagtgtggaatttaaagttgttgagacagaccctgcagagtactgcatcgttgctcctgatacagaaatcttttgcgaaggcgagcctttgaggcgtgaggatgaggaaagattagatgaagttgggtatgatgacgtgggtggagtccgcaagcagatggcacagatccgtgaattggtagagttacctttgcggcatccgcagcttttcaagtccattggtgttaagccgcctaagggtattcttttatttggtcctcctggttccggaaagacgttgattgccagagctgtggccaatgaaactggggcattctttttcctcatcaatggccctgaaatcatgtccaagctggctggtgagagcgagagtaatctaaggaaggcttttgaggaggcggagaaaaatgcgccatccattatttttattgatgagattgactccattgcacccaagagagaaaagactcaaggggaggtggaaaggcgaattgtatcgcagttattaaccctcatggatgggttaaaatcccgtgcccatgtcattgttatgggagctaccaaccgcccaaacagtattgaccctgcacttcgacgtttcggccggtttgatcgtgaaattgatattggggtcccggatgaagttggtcggttggaagttattcgtattcacactaagaatatgaagcttgctgaggatgttgatttggagagaatcgctcacgacactcatggatttgttggtgctgatttggcggcactctgcacagaagcagcactgcaatgtattcgtgagaagatggatgtgatagatttagaagatgatacaattgatgcggaagtgctaaactctatggctgtaacgaatgaacatttccaaaccgcacttggtattagcaatccatctgctcttcgagagacagtggttgaggtaccgaatactacctgggaagacattggaggtctggagaatgttaagcgggagctccaagagactgtgcaatatccagttgagcatcctgagaagtttgagaagtttggaatgtcgccgtctaagggtgtattgttctatggtccgcctgggtgtggaaagacgctgctcgccaaggcaattgccaatgaatgtcaagccaattttatcagtgtgaaggggcccgagctgttgaccatgtggttcggtgagagtgaagcgaatgtgcgagatgtatttgacaaggctcgtcagtcagctccttgtgttctctttttcgatgagcttgactcgatcgccaatcagcgtggcagcagtcagggtgatgctggtggtgctgcggatcgtgtcttaaaccagctgcttacagagatggatggtatgaacgccaaaaagacggtgttcatcattggggcaactaatagacctgatattatagactctgcacttctcagacctggacgtttggatcagctcatttacattcccctaccagatgaagcctctcgcttgaggattttccaggcagctttaaggaagtctcctctagccaaggaggtggatttggaagccctggccaggtacacacaaggtttcagtggggcagatatcactgaaatctgccagcgcgcttgcaagtacgccattcgtgaaaacatcgaaaaggacattgagagggaaaagaggagagcggagaatcctgaagccatggaagaagatgaggtagaagaagtagcgcagatcaaggcatctcacttcgaagaagcaatgaaatatgctcgtcgtagtgtgagtgatgctgacatccggaaataccaagcatttgctcagactcttcagcagtcgcgtggatttggatcagagtttcgatttccagatcgcccagctgctgctggagcaccgagtgccgcggaagctccttcggcctttggtactgatgctgcagatgaggatgatttgtacagctagacctgcgaataattcatggtttttccagtcggtttgtaggtcttgttggtacaaattttgtccacattttcttcgtgtccttcccaatgctgaatgagaaatttattaaccttgtttaagtgttga

SEQ ID NO: 7470 - DNA, 2346 bp, Flaveria ramosissima
gaagaaggacttttcgactgctatcttggagcgcaagaagtctccgaatcgccttgttgttgacgaagctgtcaatgatgataactccgtcgtcgctatgcaccctgctacaatggagaagctgcagcttttccgtggtgatactatactcatcaagggcaagaaacgaaaagacacagtctgcatcgcccttgctgatgaaacatgcgatgaacccaaaatcagaatgaataaggttattaggactaacctaagaattcgccttggtgatgttgtgtcagtacatcagtgtcctgatgtcaagtacggaaaacgtatacatgttcttccacttgatgacaccgttgaaggtgtcacaggagacttatttgatacatatctgaaaccttacttcttggaggcatatagacctgtaagaaaaggagatcatttcctttgtagaggagggatgcgcagcatcgaattcaaagtaattgaaaccgatccaggggaatattgtgttgttgctccagacaccgaaatcttttgtgaaggcgagccaatcaagagagatgatgaggatcgattggatgaggtgggctatgatgatgtaggaggtgtcagaaaacaaatggcacagattcgtgaattggtggaattaccattaagacaccctcaacttttcaagtccattggagtcaaaccacccaaaggaattttgctctatggcccacctggttcaggaaagacactgatagcgagagctgtagctaatgaaactggagctttctttttttgcatcaacggtccagaaatcatgtcaaaattggctggagaaagtgaaagcaatctcagaaaggctttcgaggaggctgagaagaacgccccatcaattattttcattgatgagatagactcaatagctccaaagagagagaaaactaatggtgaagtcgaaagaaggattgtatcacagcttctgacacttatggatggactaaaatcgcgagcccatgttattgtaattggggccacaaatcgcccaaacagcattgaccctgctcttaggcgttttggtaggtttgatagggaaattgatattggtgttccagatgaagtgggacgtcttgaggttcttcgtattcatacaaagaatatgaagctttctgatgatgttgatttggagaagatatctaaagaaacacatggttatgttggtgctgatttggctgctctttgcactgaagctgcacttcaatgcatcagagaaaaaatggatgttattgatttggaagatgaatctattgatgctgagatactcaattccatggcagtcacaaatgaacatttctctactgctcttggaactagcaatccatctgctctgcgtgagactgttgttgaggttccaaatgttagctgggaggatattggaggccttgagaatgttaagcgtgagcttcaagagactgttcaatatccagtggagcatccagagaaattcgagaaatttggtatgtcaccatcaaaaggagttcttttctacggtccacctggatgtgggaaaacactgctggcaaaagctattgcaaatgaatgtcaagcaaacttcattagcatcaaaggacctgagttactaacaatgtggtttggggagagtgaagctaatgttcgtgagatttttgacaaagccagaggatcagcaccatgtgtcctttctttgatgaacttgactctattgcaactcagagaggaagcagttctggagatgcaggtggtgctgctgatcgtgttttgaatcaactattgactgaaatggatggaatgtctgctaaaaagactgtttttataattggagccactaaccgacctgacattattgacccggctttacttcggcctgggcgtcttgatcaattaatttacattccattaccagatgaagattcacgttaccagattttcaaggctgcaatgaggaaatcccctgtttctaaagatgttgatttgagagctcttgctaagtacactcaaggattcagtggtgccgatattactgagatttgtcaacgcgcctgcaagtatgcaattagagagaacattgagaaagacatagagagggaaaaaaagaggagtgagaaccctgattccatggatgaggatgaggatgatgtggcggagataaaggcagctcactttgaggaatcaatgaagtatgcacgcagaagtgtgagtgatgctgacattaggaaatatcaagcgtttgctcagacattgcaacagtcgagaggatttgggtctgagttccggttctcagagacatctggtggtgctgctgcggcatctgatcctatttgctgcttctgc

SEQ ID NO: 7471 - DNA, 2822 bp, Momordica charantia
acgcagagtcgccattacggtccggggtaccggtattggttcttgataagttgcagaagcccttgtggtgctcaagaaaaaaaggctgaaaaacgatgacagacccaacgggctcatcagcttcagataaggtccaggcatcctcttcttcttcaccggaccagaaaagcactaaacgggatttttccactgcaattttggaacgcaagaagtctcccaatcgtttagttgttgatgaggctatcaatgatgataactctgtggtttctttgcatcctgctaccatggaaaagctgcagttctttagaggagatactattttattgaaggggaagaagcggagagatacagtgtgtgttgttcttgctgatgaacaatgtgaagagccaaaaatcagaatgaataaaattgtacgagccaatcttagagttcgtcttggagatgtcgtgtctgtccatcagtgtcctgatgtgaagtatggaaaacgggttcacgtcctccccattgatgatacaatagagggtgttactggcaacctatttgatgcatatttgaaaccttatttcttggaagcatatcgaccggtgaggaagggtgacctatttttagtcaggggtggaatgagaactgttgaattcaaggtcatagagacagaccctggtgaatactgtgttgttgcacctgatactgagatcttctgtgagggagagcccataaaacgcgaggatgaggagagattaaatgaagttggatatgatgacgttgggggtgtccggaagcaaatggctcagattcgtgaactagttgaattaccacttagacacccacaactcttcaaatcaattggtgtaaagcctccaaaagggatattgctatatgggcctcctggatccggaaaaactcttatagcaagagctgttgctaatgagactggtgcatttttctttctaattaatgggccagaaataatgtcgaagttagctggtgagagtgaaagcaatctgaggaaggcttttgaggaagctgaaaagaatgccccctcaattatctttattgatgaacttgattccattgctccaaagagggagaaaacacatggagaagtggaaagacgtattgtttcccaacttctgaccttgatggatggcctcaagactcgagcacacgttattgttattggagctaccaatagacctaatagcattgaccctgctttgaggaggtttggaagatttgatcgggagatcgatattggtgtacctgatgaaataggacgattggaagtccttaggatccatacaaagaacatgaaacttgcagaggatgtcgatcttgagagagttgcaagggacacccatggttacgttggtgcagatcttgctgctctctgcactgaagcagcactccagtgtattcgggagaaaatggatgtcattgatttggaggatgaaacaattgatgctgaggtattgaattccatggccgtaaccaatgagcatttccaaactgctttagggtcttcgaatccttcagctttgcgcgaaactgttgtggaggttccgaacgtttcgtgggatgatattggtgggttggacaatgttaaaagagagctccaggagactgtccaatatccagtggagcatcctgagaagtttgaaaaatttggcatgtcaccatctaaaggtgttctcttttatgggccccctggctgtggtaaaacgctgcttgctaaggcaattgccaatgaatgccaagccaactttataagtgtgaaaggacctgagttgctgacaatgtggtttggtgaaagtgaggcaaatgtgagagagatattcgacaaggctcggcagtcggctccttgtgtactattttttgatgaacttgattccatagcaactcagcgtggtagttctgttggagatgctggtggtgcagcagatagagtcttgaaccaacttcttacagaaatggatggcatgactgcaaagaagaccgtgttcataattggggcaacaaacaggccagacattatagaccccgccctgcttaggcccggacgtctggaccaattaatatacatcccgctccctgacgaggcttctcgtcttcagatcttcaaagcatgtctgcgaaagtcaccagtgtcgaaagatgtcgatctatcagctctttcccggtacacccatggctttagtggagccgatatcactgaaatatgtcagcgtgcctgcaaatatgccattagagaaaatattgagaaggatctcgagaaggagagaaagaaaagagaaaacccagaagccatggaagaagacgacgacatcgacgaagtctcagagataaaggcagcacatttcgaggagtcgatgaagtttgctcgtcgaagtgtcagtgatgcagacatcaggaagtaccagctctttgctcagaccctacaacaatctcgcggaattggatctgaatttcggttccccgaccgaactgataacattgcagctgacccgttttcttctgccatagctggagatgatgatgatgatctttacaactgaagtggaaaccagtcagtgcaatggtttgtaagggcctttcttctctaaacaaccctttcaagtgctttcttctcttgaaatgtagttgtgttttcttttcttcttgctagtgaatggttgtgttgtacatattgcaaggattgatcgtagagaaataaaggaatgtggaacatcagactggacagtctcttcgctgtgaaatctatatataaaactaaaaatattcaagacggtaacaaatttgaaaaaagcagtacatatttatgagag

SEQ ID NO: 7472 - DNA, 2439 bp, Manihot esculenta
atggcgtattcaagctttagccagccatcctcttcctctggccctggtaagagggattattcaactgcaatgtcggagcgaaagatgtctcccaaccgtcttgttgttgatgaggccattaatgatgacaattctatggtctctatgcatccagctaccatgaaaaagcttcaattttttcgaggagacactgtgctaattaagggaaaaaagagaagagacacggtttgcattgttctggctgatgaacaatgtgaagaatcgaaaatcagaataaacaaagttgtcagagccaatcttagattacacattggagacgtagtgtctgttcatcagtgtccggacgtgaagtatgggaagcgggttcacatccttccaattgatgacactattgagggtgtcgctggcaatttgtttgatgcatatttgaaagcatatttcttggaaagttaccggcctgtaaggaagggtgacctttttctagtcaggggtggtatgcgaagtgttgaattcaaagtgattgagacagatcctggtgaatattgtgttgttgcaccagacactgaaatcttctgtgaaggagagcctatcaagcgtgaggatgaagagagattgaatgaagtgggctatgacgatgttggtggtgtcaggaagcaaatggctcaaattcgtgaacttgtagaacttcctcttagacacccacagcttttcaaatcaattggtgtgaagcctccaaaaggtattttactatatgggcctcctgggtctgggaaaactctgattgcaagagctgtggcaaatgagacaggtgcattcttctttttaattaatggccctgagataatgtcaaagttggctggtgagagtgagggcaacttgagaaaggcatttgaggaagctgaaaagaatgctccatccataatctttatagatgagattgattctattgctccaaagagggagaagactcatggtgaggtggagaggcgtatagtttcacaacttttaacgttaatggatggccttaagagccgggcccatgtgattgttatgggagcaactaataggcccaacagcattgatccagctttgaggagatttgggagattcgatagagagattgacattggagtgccagatgaagttgggcgtttggaagtccttagaatccacacaaaaaatatgaaacttgctgaagatgttaatcttgaacgagttgcaaaagatacccatggttatgttggtgcagatcttgctgctctctgcactgaggctgctcttcagtgtattagggagaaaatggacggcattgacttggaggatgatactattgatgttgaggtgttaaattcaatggctgtgaccaatgaacacttccagactgctttgggatcttcaaatccatcagccttaagagaaacagttgtagaggttcctaatgtttcatgggatgacattggtggattggaaaatgttaaaaaagagcttcaagagactgtccaatatcctgtggaacatcctgacaagtttgagaaatttggcatgtcaccttctaaaggtgttctcttttatgggccacctggctgtggtaaaactttacttgcaaaagcaatcgctaatgaatgccaagccaacttcataagcgttaaaggtccagagctgctgactatgtggttcggagaaagtgaagcaaatgtgcgagaaatatttgacaaagcacgacagtctgctccgtgtgtacttttttttgacgaacttgattccattgcaacccagcgtggcagctctgttggtgatgctgggggtgctgcagatagagtcttgaaccaacttctgacagaaatggatggcatgacagctaagaagacggtctttatcattggcgcgacaaacagacctgatatcattgatccagcattgcttaggcctggtcgtttggaccaactgatttatatccctctaccagatgaagcctcccgctttcagatatttaaagcatgtttacgcaagtcacctgtctctaggaatgttgacctggcggctctggcacgatacactcatggtttcagcggcgctgatataactgaaatttgccagcgggcttgcaaatatgctattagagaaaatattgagaaggatattgagagggacaaaagaaaccaagagaaccctgaggccatggaagaagatggtgttgatgttgtctccgagataaaggctgctcattttgaggaatcgatgaaatatgcccgccgaagtgttagtgatgcagacatcaggaagtaccagctctttgctcagactctacagcaatctcgtggatttgggactgaatttaggttttcagaccgtactgagactgctgaagctggaggagcttcagatccgtttgcttcagcaaccactgctggggatgatgatgatttgtatagctaaacc

SEQ ID NO: 7473 - DNA, 2991 bp, Eucalyptus grandis
cccgcacctcgtcctaatctccagttctcgtcctctcccgaagctcgcctgcgagaagtcgaactcctcccgtggagagcagagagcagctgtaaggcagcagaggcatggcggatcctggagcgagccttccctcttcttctcttgacggtggtaagaaggactactccactgccattctggagcataagaagtctcctaatcgtctgattgtggatgaagcgatcaatgatgacaattctgtcgtttccatgcacccttccacgatggagaagcttcagttattcagaggagatacagttttgcttaagggcaagaagaggagagacacagtttgtgttgtgcttgctgatgaacaatgcgaagaaccaaaaattcggatgaacaaagttgttcgggctaacctcaaggtgcgccttggagacatcatatctgtacatcaatgtcctgatgtaaagtatggaaggaagattcatattcttccgatcgatgataccattgagggagtgactggcaacttgtttgatgcatttttgaagccctatttcttggaatcttatcgccctgtgaggaaaggtgatcttttccttgttagaggtggtatgagaagtgttgaatttaaggtaatagagacggaccctggcgaatactgtattgttgcaccagatactgagatcttctgtgaaggagagcccatcaaacgggaggaagaggagagactgactgaagtgggctacgacgatgttggtggagtgaggaaacaaatggctcagatacgtgagcttgtagaacttcctcttagacatccacagctgttcaagtccattggagtgaaaccccccaagggtatcttgctttatgggccacctggatctggaaaaacattgattgcaagagctgtagctaatgaaactggtgcattcttcttcttaatcaatggacctgaaattatgtcaaaactagctggtgagagtgaaagcaatttgaggaaggcttttgaggaagctgaaaagaatgctccagcaatcatttttattgatgaactagactccattgcgccaaagagggaaaaaacacatggtgaagtcgaaaggcggattgtttctcaacttctgaccctgatggatggtcttaagagcagggcacatgtgattgtcattggagctaccaatagacccaatagcattgaccctgctttgagaagattcggaagatttgatcgggaaattgatattggtgtaccagatgaggttgggaggttggaaattctcagaatccatacaaagaacatgaagcttgcggatgacgttgatctagaaagagtggcaaaagatacccatggttatgttggtgccgatcttgctgctctttgcactgaggctgctcttcaatgtatccgtgagaaaatggatgtgattgatctggaggacgaaaccattgatgctgaagttctgaactcgatggctgtgacaaatgaacacttcaaaactgctctggtagcttccaatccttcagccttgcgagagacggttgtggaagttccaaatgtctcctgggatgatattggtggtctggataatgtcaaaagagaacttcaagagactgtccaatacccagtggagcatcctgagaaatttgagaaatttggcatgtcgccttcgaagggtgttctcttttatggtccgcctggttgtggaaagacacttctagcaaaagcaattgctaatgaatgccaggcaaattttatcagtgttaaaggtcccgaactgctgacaatgtggtttggagaaagtgaagcaaatgtgagagagatttttgacaaggcgaggcaatctgctccttgtgttcttttctttgatgaacttgattccattgcaactcagcgtggaagctctactggtgatgctggtggtgctgcagatagggttctgaatcagcttctaacagaaatggatggaatgacagcgaaaaaaacagtattcattataggggcaacaaataggccagatatcattgacccagcattgctcagacctggacgattggaccaattaatttatattcctctgcctgatgaggcttctcgtctccagattttcaaagcatgcttgaggaagtcccctgtctctagagatgtcgacttggcagctcttgcccgttatactcacggtttcagtggtgccgatatcatagaaatatgtcagcgtgcttgcaagtatgctattagggaaaatatcgagaaggatatcgaaagagagagacgggagagagagaaccctgaagcaatggaggaggatattgccgacgatgtttctgaaattaaggcagcacactttgaggagttgatgaaatatgcgcgtcgaagtgtcagtgatgcggacatcaggaaataccaactctttgctcagactctgcagcaatcccgtggttttggatccgagttccggttccctgaccgtcctgagaatgccgctgcaggacgagctttcgacccctttgcttctgccaatgctgctggagatgatgatgatctgtacagctgagctttagacaaatgcaagtacctgctgctccagtttctccagttgtaaaacttgtatgtgggcagagctacttcttatgcgccatgtcagtgtgcaccctctttcatgataaactaggagcacggatctgaggcctcgcatggcatctataacagtgagtaatacgtacttttttcgcttttttttttcagaactggggttgctaatctgtgtcatggattgtaactcttggtgggtttatatttttcttaaatgtaaatagtaagtaaatgggaggtttttccttcccttaaccatgtagcctgtgaccaacacttggaaaaggtgtggcttttctttctttctgtataataaataaagtggcccttttgccaaagggaatgcggcgagaaacagggctttatggtacatgccactctttttgctaagatcctttgaaacgttcacg

SEQ ID NO: 7474 - DNA, 2819 bp, Physcomitrella patens
gtttgttatcagggtttcagcttctacttcatcgtctgcgactgcgatttgcgtcgcaacatacctcatcgcatcgcagattgaccttgcttgatatttggtgtgtaccacatcggaggattactggatctctacgttctgatttggaggaaacggtgcgccggacgattgattgtttctgtttggagagtgagttgaagtcttgcgattccgccatggcgactcccgcagctgaacatgctggggaatcgtcggatcccaagccagcttctaaaaaggacttttccactgctattttggagcgtaaaaaggctccgaaccgcctgattgttgatgaggctgtaaatgatgataattctgttgtagctttaaacatggagatcatggaaaagcttcagctttttcgtggagatactgtgctgatcaagggcaagaaacgcaaagatactgtgtgcatcgtcttagcagacgatacctgtgacgagcctaagattcggatgaataaggtggtgagggccaatctacgagtacgccttggagatgtggtttcagttcatcaatgtgcagatgtcaaatatggcaagcgaattcatgttcttccgtttgatgactcgatcgagggtgtgactggaaacctatttgatgcctatctgaagccctactttttggaggcttacaggccagttcgcaaaggcgatttgtttctggtacgaggaggcatgagaagcgtggagtttaaggttgtggaaacagatcctgcagagtactgcatcgttgctcctgatacagagatcttttgcgaaggcgagcctttgaggcgtgaggatgaggaaagattggatgaggttggttatgacgatgtgggtggagtccgcaagcagatggcccagattcgtgaacttgtagagttgcctctgcgtcatcctcagcttttcaagtccattggagtaaagcctcctaagggcatccttttgtttggtcctcctggttcgggaaagacattgattgctagagctgtggccaatgaaactggggcattttttttcctcatcaatggtcctgaaatcatgtcaaagttggctggtgagagcgagagtaatttgaggaaggcttttgaggaggcagagaagaatgcgccatcaatcattttcattgatgagattgattctattgcacccaagagggagaaaacccaaggcgaagtagaaaggcgaatagtatctcagttgttaactctcatggacgggttgaaatctcgtgctcatgtcattgttatgggagctaccaaccggccgaatagtattgatccagcactacgccgttttggtcggttcgatcgtgaaattgacatcggggtccctgatgaagttggccggcttgaagtcgttcgtattcacactaagaatatgaagcttgctgaggatgttgatctggagaaaatagctcatgatactcatgggtttgttggtgctgatttggcggcattatgcacagaagcagcgctgcaatgcattcgggagaagatggatgtaatagacctggaagacgaaacaatcgatgccgaagtgcttaactctatggctgtaacgaatgagcatttccagactgcactgggtatcagcaatccgtctgcccttcgggagacagtggttgaggtgccgaatactacctgggaggacattgggggtctggagaatgtcaagcgggagcttcaggagactgtgcaatatccagtggagcatcctgaaaagtttgagaaatttggaatgtcgccttctaagggtgtgttgttctatggtccgcctggatgtggaaagacgctcctcgccaaggcaatcgccaatgagtgccaggccaattttattagtgtgaagggacctgagcttttgaccatgtggtttggcgagagcgaagcgaacgtacgagatgtatttgacaaggctcgccagtcagctccttgtgtcctcttttttgatgagctagattctatcgccaatcagcgtggcagtagtcaaggcgatggtggtggcgctgctgatcgcgtcttgaaccagttgcttacagagatggatggtatgaacgcgaaaaagacggtgttcatcattggtgcaaccaataggcctgatattatagactctgcactacttaggcctggacgtttggatcagctcatttatattcctctaccagatgaagcttctcgcttgagaattttccaagcagctttaaggaagagtcctttggccaaggaggtggatttggaagccctggccaggtacacacaaggtttcagtggtgcggatatcactgaaatctgtcagcgcgcttgcaagtacgccattcgtgaaaacattgagaaggatattgagagggaaaagagaatggcagagaatcccgaagctatggaagaagacgaggtagaagaagttgcgcagatcaaggcatcccactttgaagaagcaatgaaatatgctcgccgaagtgtaagtgatgctgacatccgcaagtaccaagcgtttgctcagactctgcagcagtcgcgtggattcggatcggagtttcgattcccagatcgtgcagttggtgcaggagcaccaagcgctgccgacactactccgggatttggtgtagcagctgcagctgatgatgatgatttgtatagctagatctgtgaatgaattgagctgcttccagacagttttcatgttcagttggtacaaattttgcacagattccactcgcctccaatgcgaaatgagaatttttatcactttgttccaatcttggtaatttgttattaatttgttaaaatttgtaaa

SEQ ID NO: 7475 - DNA, 2589 bp, Ambrosia trifida
tgggaaaaggacttcagtacagcgattcttgaagcgaaagaaggcacccaacagactcgttgttgatgaagctgttaatgatgacaactccgttgtttgcatgcatccagagactatggaaaagcttcaactttttagaggcgatacgatcttgcttaaggggaagaaaaggagagatacaatatgtattgcacttgctgatgatacttgtgaagaacctaagattaggattaataaggttgtcaggtcaaatttgagggttagacttggggatgtggtttcggtgcatcagtgtgctgatgttaagtatgggaagcgcgttcatatccttccgattgacgataccatcgaaggagttactgggaatttgtttgatgcttacttgaaaccttactttttggaagcataccgcccggtgaggaaaggtgacttctttttggtaaggggaggaatgcgaagcgttgagtttaaagttattgagactgatcctgctgagtactgtgtggttgcacctgataccgagatattctgtgagggtgagcctgtgagaagggaggatgaggaccggttagatgagattggttacgatgatgttggtggtgttcgtaaacagatggcgcaaatccgtgagttagtggaacttccgttaaggcatccgcagcttttcaagtctattggtgttaagccaccaaagggtattctgctttatgggccgcctgggtctggaaagactttgattgcccgtgctgttgcgaatgaaaccggtgctttctttttttgtatcaatgggccagagatcatgtcgaaaatggcgggagagagtgaaagcaatttaaggaaggcatttgaggaagctgagaaaaacgcaccatcgattatctttatcgatgagcttgattcaattgcgccaaaacgtgaaaaaacacacggtgaagttgagcgaaggatcgtttcccagttattgactttgatggacgggctgaagtctcgggcacatgtaattgtcatgggtgcaactaaccgccctaacagtattgatcctgcattgagacggtttggtagatttgacagggaaattgatattggtgtgcctgatgaaattggccgtcttgaggttctcagaatccatactaagaacatgaagctatctgatgatgtggatttggagaaggttggaaaagatacccatgggtacgtaggtgctgacttggctgccttatgcactgaggctgcactccaatgtattagagagaaaatggatgtgattgatttggaagacgagtccattgatgcagagattttgaactctatggcagttacgaatgagcattttcagaccgccctcgggaccagcaatccttctgctcttcgtgagaccgttgtggaagttcccaatgttagctgggaagacattggaggactcgagaatgttaaacgagagctacaagagaccgttcaatatcctgtggaacatcctgagaaatttgagaagtttggtatggctccatctaaaggagtcctgttctatggtccacccggttgtggtaaaacgcttctagccaaagctattgcaaatgaatgtcaggctaactttataagtatcaagggtcctgagctgcttacaatgtggtttggtgagagtgaggccaatgttcgtgaaattttcgacaaggctcgtgggtctgctccttgtgtcctcttttttgatgaacttgattccatcgcaacccagagagggagtagtcaaggagatgctggcggtgcagctgacagagttctgaaccaacttctgactgaaatggatggaatgtctgccaagaaaacggttttcatcattggtgcaaccaacaggcctgatatcattgatccggcacttttgaggcctggccgtcttgatcaactgatatacattcctttacctgatgaggagtcacgttatcagatctttaaatctgcgttaaggaagtcaccaatttccaaagatgttgatctccgagctcttgccaggttcacacaaggattcagtggtgctgacatcaccgaaatctgccagcgcgcctgtaaatacgctattcgtgagaacatagagaaggatattgagagggaaaagagaataagcgagaaccctgaagctatggaggaagacatggacgatgaggtagcggagatcaaagctgctcattttgaagaatctatgaagtttgcacgacggagtgtcagtgatgctgacataaggaaataccaggcgtttgctcaaacactgcagcagtcaagagggattggttccgagttcagattctcagagactagtggacgtgctgccgctagtgacccgtttgctgcaccggctggtacagttgatgacgatgacctttataattaagtttggttgtaccaaataatgtctactacttgtttctttgtgtgcttttcatatcccggttactatgatattcctaggttgtatgtttacatagtaataactttgtttatgagtttgtgaaaaaataactagtaatgtgaagtaatgtatatacttaaaataaatatcgtattttcagttagttcagttatgtcgattatgaatca

SEQ ID NO: 7476 - DNA, 2267 bp, Brassica napus
ttgagggttagacttggagatgttatctctgttcaccagtgccctgatgtcaagtacggacagcgtgtgcatatcttgcctgttgatgataccgttgaaggagtcactggaaacctctttgatgcttacctcaaaccttatttcttggaggcataccgccccgtgaggaagggagatctcttcctagtcagaggaggaatgaggagtgtggagttcaaggttattgagacggatcctgctgagtactgtgtggtggctccggacactgagattttctgtgagggtgagccagtcaagagggaggatgaagaaaggcttgatgaagtgggttatgatgatgttggtggcgtcaggaagcagatggctcagatcagggagcttgttgagcttcccttgaggcatccacagctgttcaagtcgattggtgtgaagccaccgaagggaattcttctttacggaccacctgggtctggaaagactctgattgctcgtgccgtggctaacgaaactggtgcctttttcttctgtatcaatggtcctgagattatgtctaagctggctggtgagagtgagagcaacctcaggaaagcgtttgaggaggctgagaagaacgcgccttcgattatatttattgatgagattgactctattgcaccgaaaagagagaagactaatggagaggttgagaggaggattgtgtctcagctccttacgctgatggatgggcttaaatctcgtgctcatgttattgtcatgggagcaaccaatcgccccaacagtattgatccagctttgagaaggtttggaagatttgatagggagattgatattggtgttcctgacgagattggacgtcttgaagttctcaggatccacacaaagaacatgaagcttgctgaagatgtggatcttgagaggatctcaaaggacacacacggttatgttggtgctgatcttgcagctctgtgcacagaagctgccctgcaatgtatcagggagaagatggatgtgattgatctggaagatgactccatagatgctgaaatcctcaactccatggcagtgaccaatgaacacttccacactgctctcggaaacagcaacccatctgcacttcgtgaaactgttgtggaggttccaaatgtttcttgggatgacattggaggtcttgagaatgtcaagagagagctccaggagactgtccaataccctgtggagcacccagagaagtttgagaagttcggtatgtctccatcaaagggagtccttttctacggtcctcctggatgcggtaaaacccttttggccaaagctatagccaacgagtgccaagccaacttcatcagcgtcaaaggtcctgagcttctcaccatgtggtttggtgagagtgaagcgaacgtccgtgaaatctttgacaaagcacgccagtctgctccatgtgttctcttctttgacgagctcgactccattgccactcagagaggaggtggaggcggaggtgatgccggcggcgcagcggacagagtcctgaaccagcttttgaccgagatggatgggatgaacgctaagaagaccgtcttcatcatcggagcgaccaacagacccgacattatcgactctgctcttcttcgaccaggaaggctcgaccagctcatttacattccgctcccggacgaggactcgcgtctcaatatcttcaaggcctgcttgaggaaatcacccgttgctaaagatgttgacatcaacgctctggctaagtacacgcaggggttcagtggtgctgatatcactgagatttgccagagggcttgcaaatacgccatcagagaaaacattgagaaggacattgaaaaggagaagaggaggagcgagaaccctgaggccatggaggaagatggagtggatgaagtgtctgagatcaaagctgcacactttgaggagtcgatgaagtatgcgcgcaggagtgtgagtgatgcagacatcaggaagtaccaagcgtttgctcagacgctgcagcagtctagagggtttggttctgagttcaggttcgagactaatgctgctggttcaggtgcaaccactggagtcgctgatccttttgccacctcggcagctgctgctgcggacgatgatgatctctacaattagtgtgatcaaatttattatcctttttatttaagttttcaatcggattctctctctactttcaaccttatgtttcttaaaaaagttatcggaattatgttcattgcttttaattaatgtac

SEQ ID NO: 7477 - DNA, 2371 bp, Flaveria ramosissima
tctccgaatcggcttgttgttgtatgagctgttaatgatgataactccgtcgtcgctatgcatcctgctaccatggagaaattgcagcttttccgtggtgatacgattttgatcaagggcaagaaacgacgtgatacggtttgcattgcccttgctgatgaaacgtgtgatgaaccaaagatcagaatgaacaaggttgttaggactaacctaagaattcggcttggtgatgttgtgtcagtgcaccaatgcccagatgtcaagtatggaaaacgtatccatgttcttccacttgatgacaccattgaaggtgtcacaggagacttatttgatgcatatctgaaaccatacttcttggaggcatataggcccgtaaggaaaggagaccatttccttgttagaggaggtatgcgcagcgtcgagtttaaagtaattgaaactgatccaggggaatactgtgttgttgccccagatactgaaattttctgtgagggcgagccaattaagagagatgacgaggatagattggatgaagtgggctatgatgatgtaggaggtgtcaggaaacaaatggctcagatccgtgaattggtggaattaccattaagacaccccaacttttcaagtcaattggagtcaaacccccaaaaggaatcttgctctatggaccacctggttcaggaaagacactgatagccagagccgttgctaatgaaacaggagctttctttttctgcataaatggtccagaaattatgtcaaagttggctggagaaagtgaaagcaatctcaggaaagcatttgaggaggccgagaagaatgccccatctattattttcattgatgagatagattcaattgctccaaagagagagaagactaacggtgaagttgaaaggaggattgtatcacagcttttgacacttatggatggattaaaatcgcgggcccatgttattgtaattggggccacaaaccgccctaacagcattgatcctgctctcagaagatttggtaggtttgatagggaaattgacattggtgtcccagatgaagttgggcgtcttgaggttcttcgtatccacacaaagaacatgaaactttctgaggatgttgatttggaaaagatatctaaagaaacacatggttatgttggtgctgatcttgctgctctttgcactgaagctgcacttcaatgcattagagaaaagatggatgttattgatttggaagatgaatctattgatgctgagatactgaattccatggctgtcacaaatgaacatttcgctactgctcttggaactagcaatccatctgctctgcgtgaaactgttgttgaggttcctaatgttagctgggatgatattggaggccttgagaatgttaagcgtgagcttcaagagacggttcaatatccagtggagcatccagagaaattcgagaaatttggtatgtcaccatcaaaaggagttcttttctacggtccgcctggatgtgggaaaacacttcttgcaaaagctattgcaaatgaatgtcaagcaaatttcatcagcatcaaaggacctgaattactgactatgtggttcggtgagagtgaagccaacgttcgtgaaatttttgacaaagccagaggatctgctccatgtgtccttttctttgatgagcttgactccattgcaactcagagaggaagcagttctggagatgcaggtggtgctgcagaccgtgttctgaaccaactcttgactgaaatggacggaatgtctgctaagaagacagtcttcataatcggagccactaacaggcccgatattattgacccagcattacttcgacccgggcgtctcgatcaacttatctacattccattaccagatgaagaatcgcgctactcgattttcaaggctgcaatgagaaaatcccctgtttctaaagatgttgatttgagagctcttgctaagtacactcaaggattcagtggggctgatattactgagatatgtcaacgggcctgcaagtatgcaattagagagaacatcgagaaagatatagagagggaacgaaagaggagtgagaatcccgactccatggatgaggatgaggatgacgtggctgagataaaggcggctcactttgaggaatcgatgaagtatgcacgcagaagtgtgagcgatgctgacatcaggaagtaccaggcgtttgctcagacactgcagcagtcgagaggatttggatctgaatttcgattcccagaagcaacatctggtggtggtgcggctgacccgtttgctgcttctgctggtggagctaatgatgatgacttatacagttaggatttgtaaagtattcctgaaaactctaacttacg

SEQ ID NO: 7478 - DNA, 2481 bp, Tropaeolum majus
ggtctcccttcatcctgagaccatggagaagcttcaactcttccgaggcgatacaatcctgattagggaaaaagaggaaagataccatctgcattgcccttgctgatgacacgtgtgatgaaccaaaaatcagaatgaataaggttgtgagatctaacttgagggttagggcttggagatgttgtctctgtgcaccaatgccctgatgtcaaatatggaaagcgtgtgcatatattgccaatagatgacaccattgaaggggttactggaaatctctttgatgcctacttgaaaccttacttcctggaggcatataggccagtgaggaaaggtgatctcttcctcgttagaggcggcatgagaagtgtggagttcaaagttattgagactgatccttcggagtactgtgttgttgctccagacacagagatattctgtgagggagagcctgtgaggagggaggatgaagatagattggatgagataggttatgtatgatgttggtggtgtccgaaaacagatggcacagataagagaactggttgaacttccattgagacatccacaactattcaagtctattggtgtgaagccaccaaaaggaattctactttatgggccacctgggtctgggaaaactctgattgctcgtgctgttgctaatgaaactggtgctttcttcttctgtatcaatggacctgagataatgtccaaattagctggagagagtgaaagtaatctcaggaaagcatttgaggaagcggaaaagaatgcaccatccattatattcattgacgagatcgattcgattgctcctaagagggagaaaacacatggagaagttgaaaggaggattgtttcccagcttttgactcttatggatggattgaaatcacgtgcccatgttattgtaatgggggccacaaatcgtcctaacagtattgatcccgcacttagaaggtttggaagatttgatagggagatagatattggtgttcccgatgaaatcgggcggcttgaggttctacggattcatacaaagaacatgaagctggctgaagatgttgatttaaaaagaatttcaaaagacacacatggttatgttggtgccgatcttgctgctttatgtacagaggctgcacttcaatgcatcagggagaagatggatgtgattgacttggaagatgagtccatagatgctgagatactcaactctatggcagtttctaatgagcacttccatactgctcttggaacaagcaatccatctgctctgcgtgaaactgttgttgaggtgcctaatgtcagttggcaagatatcgggggtcttgagaatgttaaaagagaactccaagagactgtccaataccctgttgagcatcctgaaaagtttgagaagtttgggatgtcaccctcaaaaggagttcttttctacggccctcctggatgtggaaagacacttcttgccaaagctattgctaatgaatgtcaggcaaacttcatcagtattaagggtcctgagttacttacaatgtggtttggagagagtgaggcaaatgttcgagaaattttcgataaggcacgtggatctgctccttgtgtcctgttctttgatgaacttgactccatcgccacccagagaggaagcagtgtaggagatgccggaggtgctgctgatagagttttgaaccagcttctaacagaaatggatggcatgtctgctaagaaaacagttttcattattggcgctaccaacagacctgatattatagatcctgcactattacgtccaggtcgtctcgaccagttgatctatattcccctccctgatgaagaatcccgctttcaaattttcaagtcttgcttaaggaaatccccagtcgccaaagatgttgacctcagagcgcttgcaaaatacactcaaggcttcagtggtgctgatattacagagatctgtcagcgtgcctgcaaatacgccattagagagaacattgagaaagatatcgaaagggaaaggaggagaagtgagaatcctgaggccatggaggaggacgttgacgatgaagtggcggagataaaggctgcacattttgaggaatcaatgaagttcgctaggaggagtgtgagtgatgcggacatcaggaagtaccaggcgtttgctcaaacgttacagcagtctagaggttttggatccgaattcaggtttagtgaaactggaagtggaactacaactactgcagctgctgatccctttgcagcttcagctggcggtgcggacgaagatgatctttacaattaagtctccttttttttttagctttaaaaatatgtgtacaatgttgttatggtgcaaactttagttgtcctgtaaaagaggcctggtgccttgagtgatgttgcgacatttccccggagccgtggctacatgtaagtttaaacatagtctgctttctattttgcaaaggttatccaatgagtttt

SEQ ID NO: 7479 - DNA, 2874 bp, Ricinus communis
cttctctactagtagaaaaactcctcatctcatcgctgaggaacttgtctctctttgcaggttttctttttttctataaatatctcaaaaaggctctctataaacgccagcttatttatagtctcaagctcattcattcattagacgcacaacttgaaatctcaaatacagaagaaatctctgttatgatcaatggccgatcaaggctctagccagccctcttcttctagtgacccgaagagcggcaagaaagattactcaactgcaattttggagagaaagaagtctcctaaccgtcttgttgttgatgaggctattaatgatgacaattctgtggtctctatgcatcctgataccatggaaacgcttcaactttttagaggagacactgtgctaattaagggaaaaaagagaaaagacacagtttgcattgttcttgctgatgaacaatgtgaacaacccaaaatcagaatgaacaaagttgtcagagctaatcttagagtacggcttggtgacgtggtgtctgttcatcagtgccctgatgtgaaatatgggaagcgcgttcacatccttccaattgatgatactattgaaggggttactggcaatatttttgatgcatatttaaagccatatttcttggaatcttatcgtccggtgaggaagggcgatcttttcctagtcaggggtggtatgcgcagtgttgaatttaaagtgatcgagacagaccccggtgaatactgtgttgttgcacccgacactgaaatattttgtgaaggagagccaatcaagcgtgaggatgaggagagattgaatgaagtcggttatgatgatgttggtggagttaggaagcaaatggctcagattcgagaactagttgaacttcctcttaggcacccacagctcttcaagtcaattggtgtgaagcctccaaaaggtattttgctctatggaccacctggttctggaaaaacactcattgcaagagcggtagctaatgagacaggtgcattcttctttttgattaatggccctgagatcatgtcaaagttggccggtgagagtgagagcaacttgaggaaggcatttgaggaagctgaaaagaatgctccgtctattatctttattgatgagattgactctatagctccaaaaagggaaaagactcatggtgaagtggagagacgtatagtgtcacaacttctgacattaatggatggccttaaatctcgggcacatgtaattgtcatgggtgctaccaataggccaaacagcattgacccagctctgaggagatttggaagatttgatcgtgagattgacattggtgtgccagatgaagttggacgtttggaagtcctcaggattcatacaaaaaatatgaaacttgctgaagaggttgatctagaaagagttgcaaaagatacccatggttatgttggtgcagatcttgctgccctttgcacagaggctgctcttcagtgtattagggagaaaatggatgtcatcgacttggaggatgaaacaattgatgctgaggtgttaaattcaatggctgtgaccaatgaacacttccagactgcattgggaacatcaaatccatcagccttacgtgaaacagtgagtacaatgagacatgtaaacttgattttcaatgctaagacggttcaatatcctgtggaacatccggagaagtttgagaaatttggcatgtcaccttccaaaggtgttctcttctatggaccccctggttgtggtaaaaccttgcttgcaaaagcaattgctaatgagtgccaggccaactttattagtgtcaaaggtcctgagctgctgactatgtggtttggagaaagtgaagcaaatgtgcgggaaatatttgacaaagcacggcaatctgctccttgtgtgcttttcttcgatgaactcgattccattgcaacgcagcgtggcagctctgttggagatgctgggggtgctgcagatagagtcttaaatcaattgctgacagaaatggatggaatgacagccaagaagacagttttcatcattggggcaacaaacagaccagatattattgacccagcattgcttaggcctggtcgcttggaccaattgatttatattcctctacctgatgaagcttcccgccttcaaatatttaaagcttgtttgcgcaagtcaccggtttctagggatgttgaactagcagctcttgcacgatatactcatggtttcagtggtgctgatattactgaaatttgtcagcgtgcttgcaaatatgctattagagaaaacattgagaaggacattgagagggagaaaaggaagcaggagaaccctgaggcgatggaagaagatgatgtcgatgaggtccctgagataaagcctgctcactttgaggaatccatgaagtatgcccgcagaagtgttagtgacgccgacatcaggaagtatcagctctttgctcagacgctacagcaatcgcgtgggtttgggacggagtttcggttttcagatcggacagagaatactgcagcagctggaggagcttcagatccatttgcttcagctaccactgctggtgatgacgatgatctctataactaaactaagaagccgtaccaactgctgcggattctgcagttttccagctctatgcaactttaggggacttgatatattagaatatttgctgcagacttgttaacattatcatggttcataggttaaatatgttataattttgcaatttaagtactggacatgagatggattaatcatgagtggaaagaaaagccctttattttgcccctattattggtttcatgtgaaaataatctaatgagcaccgatactaaaacttcatctgtgacc

SEQ ID NO: 7480 - DNA, 3052 bp, Ceratodon purpureus
cttcaccctcatcggttgcgagaccgacctcgtcctgttgctctctctctctctctctctctcactttcttaattgcaccgtcgcatcgtcgcaccgccctcgctgctgtaaaacccccgctgctgtctcggatcggggaggagcttttcatttccctttcaggacgccatccgcatcgcttgtttctgctgccgggactaggagcgcgacttgacgactttgtgcttcggccatggcgactcccccgtctgcgcatcccggggaaccctcggatcccaagccagccgcaaagaaagatttttctactgccattctggagcgtaagaaagctcccaatcgtttggttgttgacgaagctgtgaatgatgataactccgtggtagctctgaatatggagactatggagaagctgcagctctttcgcggagacactgtgctgattaagggcaagaaacgcaaagacaccgtctgtattgtcctagcagacgacacttgtgacgaacctaagatccgaatgaacaaggtggtgagggccaatcttcgggtgcgcctcggggatgtggtgtcagttcaccagtgtgcagatgttaaatacggcaagcgtatccatgttctcccgttcgatgactcgattgagggagtgacaggaaacctcttcgatgcgtacttgaaaccctatttcatggaagcctacaggccagtccgcaagggcgatttgtttctggtgcgaggtggcatgcggagcgtggagttcaaagtagtagagaccgaccctgcagaatactgcatcgttgctcctgacacagagatattctgcgagggcgagcctttgaggcgtgaggacgaggagagactagatgaggttggttacgacgatgtgggtggagtccggaagcagatggcacagatccgtgagctggtggagttgcctctgcggcaccctcagctgttcaagtcgattggagtgaagcctccgaagggtatcctgctgttcggtcctcctggttcaggaaagacattgattgcgagggccgtggcgaacgaaacgggagcgttctttttcctgatcaacggtcctgagatcatgtcaaagttggctggcgagagcgagagtaacttgagaaaggcatttgaggaggcagaaaagaacgccccatcgatcattttcatcgacgaaatcgactccattgcaccgaagagggagaagactcaaggcgaggtggaaaggcgaattgtgtcccagctgctgacgctgatggacgggctgaagtctcgtgcccatgttattgttatgggggctaccaaccggccgaacagcattgacccagcactacgtcggtttgggcggtttgaccgtgagattgatatcggggttccggacgaagttgggcgtttggaagtcgttcgtattcacacgaagaacatgaagctttcagaggatgtcgatctggagaggattgcccatgatactcatgggttcgtgggtgccgatttggcggccctatgcacggaagctgccctgcagtgtatccgtgagaagatggacgtgatcgacttggaggacgactcgatcgacgcagaggtgctgaattctatggccgtgacgaacgagcacttccagaccgctctgggcatcagcaatccttctgcacttcgggagacagtggtggaggtgccgaataccacgtgggaggacatcggagggctggagaatgtcaagcgggagctccaagagactgtgcaatacccggtggagcatccggagaagttcgagaagtttggaatgtcgccatcgaagggtgtgctgttctacggtccacctggatgtggaaagacgcttttggcgaaggctatcgcgaacgaatgtcaggcgaatttcatcagtgtgaagggaccagagctgctgacgatgtggtttggtgagagcgaagccaacgtgcgggatgtgttcgacaaggctcggcagtcggccccttgtgtgctgttcttcgacgagctggactcgatcgccaaccagcgtggcagcagccagggtgatgccggtggtgccgccgatcgcgtcttgaaccagttgttgacggagatggacggtatgaatgcgaagaagacggtgttcatcatcggtgcaacgaacaggcctgacatcatcgattctgcactcctgaggcccggacgtctggatcaactgatttacatcccactaccggatgaagcttctcggctgagaatcttccaggctgccttgaggaagtcgcctctggcgaaggaggtggatttggaggccctggcgaggtacacacagggtttcagtggtgcagatatcacggagatctgtcaacgtgcttcgaagtatgccattcgcgaggatattgagaaggacattgagagggagaagagaaggtcagagaatccggaagccatggaagaggatgaggcggaagaggtggccgagatcaaggcacgtcacttcgaggaagccatgaagtttgctcggcgcagtgtgagcgatgctgacatccgcaagtaccaagctttcgctcagactctacagcagtctcgtggattcgggtcggagttccggttcccagaccggccagtcgctcccgggggagttccacatgccgcggaagctgctccggcgtttggcgccgccgcagacgacgatgatttgtataactaggcctgtgaatgtttagtggtgctccgagacacgggctgtaggacccgtgagtacacatttgtacacagttcccctccttatctctccccaaagtacttgaatgagaaacagatttccacctgggtgtggtgttgaaattttgttggcgattattttgggcggtgcagacttgtaatcaattgatccctgacgaggattttaccccccttaacgaagcggttatttgtggtcgcaaaaaatgttagattttattcagaagccggaatggttattgtgatccttgaaactagaaatacttgatgggtgaatgtacggacggaacgcggggtggttgcgtcaatgttccgctgctgtgtcatggggtttcatcg

SEQ ID NO: 7481 - DNA, 2584 bp, Solanum lycopersicum
atggcggacccgaaatcttccacttccgactcgaaaaacaataaaaaggattttgctacggcaattttggagaggaagagatctcctaaccgccttattgttgatgaggctataaatgatgataattcagtggtatctatgcaccctgctaaaatggaagagctccagctgtttagaggagatactgtattgctaaagggtaaaaaacggaaggacactgtttgtgttgtccttgcggatgagcaatgtgaagaacataaggtcagattgaacaaagtcgttcgggcgaaccttcggattcgtcttggggatgttgtatctgtgcaccagtgtcctgatgttaagtatgcgaagcgtgttcatattcttcctattgatgatacaattgaaggcatgactggcaacctgtttgatgcctacttgaagccatacttcttggagtcttaccgccctgtgagaaagggcgatctctttgtagtcagaggtggcatgcgcagtgttgagtttaaagtggttgagacggagcctggagaatattgtgttgtagcacctgatacagagatcttttgtgagggagaaccaatcaagcgtgaagaggaggagagactaaatgaagttggatatgatgatgttgggggtatgaggaagcaaatggctcagatccgtgagctggttgaactccctctgaggcatccgcagttgttcaagtcgattggtgtgaaaccaccaaaaggtattcttctctatggtccccccggatcggggaaaaccctgattggaagagctgtggcaaatgagacgggtgcctttttctttttgattaatgggcctgaaattatgtccaaattggctggtgagagtgagggtaacttgaggaaggcatttgaggaagccgaaaagaatgcgccatctattatatttattgatgagttagactcgattgctccaaagagagaaaagacacatggtgaagttgagcggcgaatagtttcccaacttctgacattaatggatggactcaagtctcgatcacatgtgattgtcatgggggctaccaacagaccaaacagtattgatcctgctctcaggagatttggaagatttgatcgggagattgacattggcgtaccagatgaaatagggaggctggagatcctacgtattcatactaaaaacatgaagctcgatgataatgttgatctagagagggttgcaagagacacacatggttatgtcggagctgatcttgctgccttgtgcactgaggctgcactgcagtgtatcagggagaaaatggatgttattgacttggaggatgagaccattgatgctgaagtgttgaattcaatggctgtgactaatgagcattttcaaactgctctgggtgcttcaaatccatcagcactaagagaaacggtagtggaggttcccaatacatcttgggaggatattggggggctggaaaatgtcaagcgggaacttcaagagactgttcagtacccggtcgagcatcctgaaaagtttgagaagtttggaatgtcaccctccaaaggggtacttttctatggaccacctggttgtggcaaaactttactggccaaggctatcgcaaatgagtgtcaggctaactttataagtgtgaaaggaccggagttgcttacgatgtggtttggagaaagtgaagcgaatgttcgggaaatatttgacaaggcacggcaatctgctccatgtgtactgttctttgatgaactcgattccattgctacgcagagaggaaattcggtgggagatgctggtggtgctgctgatagagtactcaatcaattgttgacggagatggatggaatgacagcaaaaaaaacagttttcattattggggcaacaaataggccagacattattgaccctgcattgctcagaccaggtcgtcttgaccaattaatttacatccccctcccggatgaagcttctcgtcttcaaatcttcaaagcatgcttgcgtaagtcccctgtcgcaaaggacgtggatctgtcagctctagcacggtatacacatggttttagtggtgcagacataaccgagatttgtcagcgagcatgcaaatatgccattagggaaaacattgaaatggatattgagagagagaggaagaggagcttgaaccctgaagccatggatgaagatgacaccgatgaagtggctgaaataaaggctgcacactttgaggagtccatgaaatatgctcgaagaagtgtgagtgatgctgacattaggaagtaccagctttttgctcaaacattacaacaatcacgcggacttggaactgagttcaaatttgctgagcatgcagctaatgctacaccaaccggggcaacagccgacccatttgcttctgttaatgctgctggagacgaggatgatttgtacagttaataagtgtaaacactgagcacaaggatgctggggatgctggaaaacggaatgttagtgtaagtagaataactaggtatgttaccatgttgcaacttttgtgttaaaagaaatttcgcctgtggatgttatgtaatgtactaatcttataggc

SEQ ID NO: 7482 - DNA, 3480 bp, Physcomitrella patens
ttgcaaaggaagagaaagctgctgctgcctctacatcaccgcctaccgcagaggaggaggctccctccactctacatccccgcctcacccttccaattctccaccgtgtcccaccgatctcttgccccgctcatgaactcgatccgggaggatacatgactgttgctacccgaccttgatttgggagaaatctacatttgaatcagttgtgtctgtgagagggagaacaagcgagagtaggaaagcgagtttgtgattttggccatggcgactcccgcggccgcgcatcccggggaaccctcggaccccaagccatcttcaaaaaaggatttttctactgctatcttggagcgcaagaaggctcctaatcgtttgattgttgacgaagctgtgaacgatgataactctgtggtagcattaaacatggagaccatggaaaagctgcagctttttcgtggagacactgtgctgattaagggcaagaaacgcaaggacactgtgtgtattgtgttagctgatgacacttgtgatgaacctaagatacggatgaacaaggtggtgagagccaatcttcgggttcgcctaggagatgtggtgtcagttcaccaatgtgcagacgtgaaatatggaaaacgtatccatgtccttccatttgatgattcaattgaaggagttactggaaaccttttcgacgcttacttgaagccatacttcctggaagcttacaggccagttcgcaaaggtgatttattcctggtgcggggaggtatgaggagcgtggagtttaaagttgtagaaacagaccctgcagaatattgcattgttgcgcccgatactgaaatcttttgcgagggcgagcctttgaggcgcgaggacgaggaaagattagatgaagttggttatgatgatgtgggtggagttcgcaagcagatggcgcagatccgcgagctcgtagagttgcctctacgacatcctcaactctttaagtccattggtgtaaagcctcccaagggtattttgttgtttggtcctcctggttcaggaaagacattgatcgctagggcggtagccaacgaaaccggagctttctttttccttattaacggtcctgagatcatgtcaaagttagctggtgagagcgagagtaatttgagaaaagcttttgaggaggcagagaaaaatgcgccgtccatcattttcattgatgaaatcgactctattgcaccgaagagggaaaagactcaaggcgaggtggaaaggcgaattgtgtcccagttgttgacacttatggatggcttaaagtcacgtgcccatgtcattgtcatgggagctaccaaccgtccgaacagtattgaccccgctctacgtcgttttggacggtttgatcgtgagatcgatatcggtgttccagacgaagttggccgactagaggtagttcgtatccatacgaagaacatgaagctggccgaggatgtcaacctggagaggattgctcatgacactcatgggtttgttggagctgatttagctgcactatgtacagaagcagcactacaatgtattcgtgagaagatggatgtgatagacttggaagatgaaacaattgatgctgaagtgcttaattctatggctgtaactaatgagcattttcagactgctcttggcatcagtaacccctctgcacttcgggaaaccgtggtggaggtgcccaataccacctgggaagacattggaggtctggagaatgttaagcgggagctacaagagactgtgcaatatccagtggagcatcctgagaagtttgagaaatttggaatgtcaccatcaaagggagtgttgttttatggtccacctggatgtggaaagacgcttcttgccaaggcaattgcgaacgagtgccaagctaattttatcagtgtgaagggaccagagttgttgaccatgtggtttggtgagagtgaagcaaacgtgcgcgatgtgtttgataaggctcgccagtcagctccttgtgtccttttctttgatgagctggactcgatcgcaaatcagcgtggcagtagtcaaggggatgccggtggtgcagctgatcgtgtcttgaatcagttgctcacagagatggatggtatgaatgctaaaaaaacggtattcattattggtgcgacgaacagacctgatattattgattccgctcttctccgacctggacgtttggatcaacttatttatattccactaccagatgaagcttctcgtttgagaatcttccaggccgctttgagaaagtcgcctatagcgaaagaagtggatttgcaggctttggcgaagtttacacaaggttttagcggtgcagatataactgaaatttgccagcgtgcctccaagtacgctattcgtgaggacattgagaaggacattgaaagggagaagagaagggctgagaatcctgaagccatggaagaagacgaggtggaagaagttgcacaaatcaaagctcgtcatttcgaggaagccatgaagtttgctcgccgcagtgtgagcgatgctgacattcgcaaatatcaagcatttgcccagactcttcagcaatcacgtgggtttgggtcggagtttcgattcgcagatcgccctgccgctgccactggagcaccctatgccgcagaaaccactccggcatttggtggtgctgcagatgacgatgatttgtataactagaactgtgaatgtttcagtgacgggctgtaggcccttggtacacatttgtacacagcttcttctcttcattcaagtacttgaatgagaaaattttattcaccttagttgggtgttgaagttttttcgccaattattttgggcggtgctgacttctaatcgatggactcgtttaagagatttttaagccgagttctcctcctaaattactgtggatggaagttggcttccacgttggtgatgctagttacagcagttgctgcaacagatttcgtcgtctgttcaatctgctcgttactatctgcagttcatctcctggtcaacgtgtttggtgaggtggaagtgttgacagtaatcactgggctgttggactgccctaagttttaatttcaagccattccaaccattcataatcaagagttaaaaattgaacgacgcaacaagcctctcctcctctcccttgaaggttgataacgagaatggaatattctgtggtcttgtgggcttcatggtgtgtttttatgtcgcaatatagaaagaagacaaggttctctatcatagcgtgcttatttgattctctttgaactgggacgatcactaatctacaaaagggggtataatttgttttcataaaaagcttgcggagagtctataatctagacccatacctaatgatacagcaagtccttatcctttctacaatttaaggtgtctcttgacatgtagggtaagcttacccagatctttggtttaactcatctggtcattagt

SEQ ID NO: 7483 - DNA, 2709 bp, Lotus japonicus
gatgaatctcattgattgattgtgtttttgttgttgttggggttttcaggaagggaacgaagagggattttagcactgcgattctggagcggaagaaggcgccgaatcggcttgttgttgatgaggctgttaatgatgacaactccgtcgtcgctcttcatcccgcgaccatggagaagctccagctcttccgtggcgataccatcttgattaagggaaagaaaaggaaagatacaatctgtattgcacttgctgatgaaacatgtgaagaaccaaaaataagaatgaacaaggttgtgagaagcaaccttagggttaggcttggagatgttgtttcggtgcaccaatgtgctgatgtcaagtatggaaagcgcgtccacattcttcctgtggatgacactattgaaggagtgacgggaaatctctttgatgcgtacttaaaaccttatttcttggaggcttatcgaccagtgaggaagggagacctcttccttgtaagagggggtatgagaagtgtagaattcaaggttattgaaactgagccttctgagtactgtgttgtcgccccagacacagagatcttctgtgaaggagagcctgttaaaagggaggatgagaatcgattagatgaggttggttatgatgatgttggtggcgtgagaaagcagatggcacagatcagggaactggtggaactgccactgaggcacccacagttattcaagtctattggtgttaagccaccaaaaggaatccttctgtatggaccccctggatctggcaagactttgattgctagagctgttgcaaatgaaactggtgctttctttttctgcatcaatggccctgagatcatgtcaaaactggctggtgagagcgagagcaacctcaggaaggctttcgaggaagcggagaagaatgcaccctcaatcatcttcattgatgagatagattcaatagctccaaagagggagaagactcatggagaagttgagagacgcattgtttctcagctcttgacactcatggatgggcttaaatctcgggcccatgtaattgtcattggagccacaaatcgccccaacagcattgaccctgcccttaggagatttggaaggtttgatcgggagatagatattggcgtacccgatgaagtcgggcgccttgaggttcttcgaattcatacaaagaacatgaagcttgctgaagatgttgatttggaaaagatttctaagaacacacatggctatgttggtgctgatctagctgcgttgtgtactgaagctgcacttcagtgcatcagggaaaaaatggatgtgattgacttggaagatgaggaaattgatgctgaaatattgaactctatggctgtaacaaatgaacatttccagactgctcttggatcaagcaatccttctgctctccgtgaaacagttgttgaagtgcccaatgtcagctgggaggatattggtggtcttgaaaatgttaagagggaactccaagagactgttcaatatccagtggaacaccctgagaagtttgagaaatttggaatgtcaccttcgaagggagttcttttctatggtccccctgggtgtggtaaaacactattggctaaagctattgccaatgaatgccaggcaaacttcatcagtgtcaaaggtcctgagctactcactatgtggtttggagaaagtgaggctaatgtgagggaaatttttgacaaggctcgtggttctgctccatgtgtcctattcttcgatgagcttgactctattgcaactcagagaggtagtagtgttggagatgctggtggtgctgctgacagggtgttgaaccaactgcttactgaaatggatgggatgtcagcaaagaaaactgtgttcatcattggggccactaatcgaccagacattatagacccagctcttttgcgtccaggtcgtctagaccagttgatatatatccccctcccagacgaggattcgcgccatcagatatttaaagcttgcttgagaaaatccccagtctcaaaagatgttgatattagagctcttgcaaagtacactcaaggcttcagtggtgctgatattactgagatttgccagcgtgcttgcaaatatgccattagagagaacattgagaaggacattgagagagagaggaggagaagcgagaaccccgaggccatggaagaggatgttgatgatgaggtggctgaaatcaaggcagctcattttgaagaatcaatgaagtatgcacgaaggagtgtaagcgatgctgacattcggaagtaccagtcatttgcccaaacattgcagcagtctagagggtttggatctgagtttaggtttgcagattccacctctggtggcggtgctggtgctggtgctgcatctgatccatttgcagctgctggtggggctgatgaagatgatctttacagttagatcaacttgtatgatcgttgtttgttcacgaatcccagtgctcgcttattttatgtacttctcattttgtgtctgaagtctctaaaagcttcctttggattattatcatcattgctttgtgaaaggcatttgtttatattggcaaacattaggtgcgagcctcttcgaaacttggaaggattttttttctaagtttttttgtataactgtgctgcccactcccaaattgccaacattttatatgaacaaaactttaccg

SEQ ID NO: 7484 - DNA, 2667 bp, Mimulus guttatus
aaaaaaacactacaaagttctcaggcataataataataataataataataataataataataataataagcaaagtgcaaaacctcggagttctactactttccgacaaccgccatggctgatccaagctctgctcacaccaccgactcgaagagtagcaaacgggactattccacagtgatactggaacggaaaaaatcccctaatcgactcattgtggacgaatccattaacgacgacaattcagtggtctcgatgcatccaaccaaaatggaagaacttcagctctttcgaggagatactatcttgatcagggggaaaagacgaaaagacacggtttgcattgttcttgccgatgaacaatgcgaagagcaaaaaataagaatgaataaagtcgtccgagcaaatctgagagtacgtctaaccgatatggtgtccgtgcatcaatgtccggatgtcaaatacggaaagcgtgttcatatacttcccattgatgactcgatcgagggtctcaccggcaacttattcgatgcttatttaaagccttatttcatggacgcgtaccgtccggtgagaaaaggcgatctcttccaagttcgaggcggcatgcgaagcgtcgaattcaaaatcgtcgaaaccgaccccggcgaatactgcgtagttgcccccgacaccgaaatattctgcgagggagagccaatcaaccgcgaagatgaagaaagactcaacgaagtcgggtacgatgatgtcggcggtgtaagaaagcaaatggctcagatccgtgagctagtcgagctccctttaagacaccctcaactcttcaaatccatcggcgtgaaacccccaaaaggaatccttctctacgggccccccggttcgggtaaaaccctaatcgcaaaagccgttgcaaacgaaacgggtgcatttttctttttgatcaacgggccggaaataatgtcgaaattggcgggagagagcgagagcaacttgaggaaggcgtttgaggaggcggagaagaacgcaccctcgattatttttatcgacgagttggattcgattgctccgaagagagagaagacgcacggtgaggtggagaggaggatcgtttctcagcttcttacgttgatggacgggcttaagtcgcgcgcacatgtcattgttatgggggctactaatagaccaaatagtatcgatccggctttgaggaggttcgggaggttcgatcgggaaattgatattggtgtgccggatgaagtcgggaggcttgaagtgttgcgtattcataccaagaatatgaaacttgcggacgatgttgatcttgaaagagttggcaaagatacacacggttacgtcggtgctgatctggcggccctttgcaccgaagctgctcttcaatgcatcagagagaaaatggatgtaatcgacttggaagacgagacaattgatgctgaagtattgaattcaatggccgtgacaaacgaacacttcataaccgcattgggcgcctcaaatccatcggccttacgtgaaacagttgtggaggttcccaatgtttcgtggcaggatatcggcggattggacaatgtcaaacgagagcttcaagagactgtacaatatcctgttgagcatccggagaagttcgagaaattcggaatgtcgccttcgaaaggggttttgttttacgggccgcctggttgtggcaaaactttactggcaaaagcaattgctaacgagtgccaagccaatttcataagtgtgaaaggtcccgagttgctcactatgtggttcggagagagcgaggcgaacgttcgagaaattttcgacaaggcccgacaatcggctccgtgcgtgctcttcttcgacgaactcgattcaattgccactcagagaggaagttcggtgggagatgcgggtggggccgcagatagagttctcaatcaacttcttacggaaatggatggaatgacggcgaaaaagacggtttttattataggtgcaacaaatagaccggatattatcgaccctgctttgcttaggccaggccgtttggaccagttgatttacatcccgcttcccgatgaaacttctcgccttcaaatattcaaagcttgtctgaggaagtctccattggctaaagaagtcgatctaacagctcttgcgagacacacgcatggatttagtggtgccgatatcaccgagatatgccaacgtgcttgcaagtttgccatccgagaagatatcgaaaaggatatcgagaaagaaaaaaagaagagagagagtccggaggctatggaagaagatgacgtggaccatgtaccggagataaaggcggcccacttcgaggagtcgatgaaatttgctcggaggagtgtgagtgatgccgatattagaaagtaccagctctttgcacagacgctccagcagtctcgtggtatcgggtccgaattccggtttgcggatcgggcggatacttcagctgctgggcgggtcgacccgttttcgtctgcggggggtgggtcggtggacgacgacgacgacttgtacggttgatcagtttcaatgtagctatatatgtatgtatggtgtggtgagctttgtgtgtaccctttggagcaacatgtgttgtatataaataaataaatacttggctcgacttatataacaaaa

SEQ ID NO: 7485 - DNA, 3051 bp, Physcomitrella patens
aaaagagaaatggggtgtaggacaagagaagcttcaccccagtttcggagggtgtgttgctcttgtagctgagagctctcggtggcctgcaacctgaccttcgttccgaaacgggttacattcaacaaggtcgaaggaggccttacagaccacgcaactgccgaactcactcgtttgagtcgacttaatctcttggaaccgactggaaggcaagattcaatatctagtttgtgcgttagaaggttgcgagagaagacggggttggaatttacgaagagggcagtggagaccgagaggttgtgcaaagatggccgcttctggatctggcacgaagtctgaggatgttcctccagctccggaagggaaagggacaaagagggacttcacaactgcaattcttgagcggaaaaaggctaccaaccgcttggttgttgatgaggcagtgaacgatgacaactctgttgttgctctcaacacagagacgatggacaaattgcagctctttagaggtgacacagtgctcatcaaaggcaagaaacggaaggacaccgtttgcattgtgttggcggatgagacttgcgaggagccaaaaatccggatgaacaaggtcgttcgagccaaccttcgcgtgcgccttggcgatgtcgtctctgtgcaccagtgtgctgacgtgaagtatggaaagcgcattcacgttttacctttggacgattcagttgagggtgttaccggcaacatctttgatgcgtatcttaaaccttactttatggaggcataccgaccagtacggaaaggagacctgttcctcgttcgcggagggatgaggagcatagagttcaaagtcattgagactgacccagctgaatactgtatagtggcacccgacactgaaatattctgcgagggcgagcctgtgaagcgggaagatgaagaacgcctaaatgaggtcgggtacgatgatgttggaggagtccgtcgccagatggcacagatcagagagcttgttgaacttcccttacgccacccccagctcttcaagtctattggagtgaagccaccgaaaggaatccttctttttggtcctcctggatctggaaagactctcattgcaagagctgtggcgaatgaaactggagcttttttctttctcatcaacgggcctgagattatgtcaaagctggcgggagagagtgagagcaacctcaggaaagcttttgaggaggccgaaaagaatgcgccagccattattttcattgatgagattgattctattgctcctaagagggagaagactcaaggagaggttgagcggagaattgtgtctcagttgttaacactgatggatggtttgaagtcccgtgcgcatgtcattgtgatgggcgccaccaaccgccccaacagtatagatcctgccctacgtagatttggccgattcgatcgcgaaatcgacattggagtccccgacgaagtaggccgtttggaggtgttgcgtattcatagcaaaaacatgaagctagctgaagatgttgatctcgagaaagtcgcaaaggagacacatggttttgtcggagcagatcttgcagctttggctaccgaagcagctctccagtgtatcagggagaaaatggatgttattgacttagaggaggattccattgatgctgaaattctcaattccatggcggtcacaaatgagcacttccaaactgcactgggtacaagcaatccttctgcacttcgagagacggttgtggaggtgcccaatgtcacctgggaagatgtcggtggtctcgataacgtcaagcgggagctccaagagactgtgcaatatcctgtggagcatccagagaagttcgagaagtttggtatgtcaccttccaagggagtgctcttttatggaccacctggatgtggtaagacgatgctcgcaaaggctattgctaacgagtgccaagccaatttcatcagtgtcaaaggtcctgagcttttgaccatgtggtttggagagagcgaggctaatgtccgcgaaatctttgacaaggcccgaggttcagctccttgtgtgctcttctttgacgaactcgactctattgctactcaaagaggaggcagcggcggtgacgctggtggtgcagcagatcgtgtgctcaaccagctgctcacagagatggacggcatgaatgctaagaaaacggtcttcattatcggcgctactaaccggcctgatatcatcgattctgccctgctgcgaccaggacgattggaccagctgatctacatcccactccccgatgaagcttccaggcttcggatttttcaagcatgcttgcgcaaatcacctattgctaaggaagtcgacctggaggctcttgcccgtcacactcagggtttcagtggtgctgatattaccgagatttgtcagcgagcttgcaaatatgcaatccgtgaaaatattgagaaggatattgagaaggaaaagaagagggcagagaatcctgaagcaatggaagaagacgagactgatgaagtgtcagagattaaagctgctcactttgaggagtctatgaaattcgctcgcaggagtgtgagtgatgccgacatccgcaagtaccaagcttttgcccaaacgttgcaacagtctagaggcttcggttcagagttccgtttcccagaccgacctgccacagctcctggaaccactgccagtgctgctgtaggtggagagtctgcgtttgctgcagctgcagctgatgaagacgatttgtataattaggagattcagttgccagtccataagtagagggagctggggagtcaagggttttagtagttaacatttgtttgtacagacgaatattgagggcaggtggcattttttcctcggttctcctgcctggctgctttctttacccaatggggtgcgaattcaaggcaggaacttgattcccagattttcactcttttggatttgtgtgtttagataagtaggcactgtgtgaattccattgattgcatcattaatctttatcaaagggtacagtgttcagaaat

SEQ ID NO: 7486 - DNA, 3052 bp, Ceratodon purpureus
cgacgccaggagcggacactccctctctcctataaatcatctcgggcgtcggactccccgactatcccgaaagatttgatctctcccggcttcggaggagacgaggacactcaggagagcctttgattgattcaggagaggctagagcccgtcttggttgctccgctccactctccagctgcctcgtttgttggtttgttggttggttggtcagttgtgttggaagggagtcacacgtttgcacttgggttgtggcgagatggctgcttctgggtctggaagtaagcccgagacggagcctgcccctgttcctgaagggaaggggacgaagcgggactttactactgcaatcttggagaggaagaaggctccgaaccgtttggttgtggatgaggcggtgaatgacgacaactccgtggttgctcttaacacggagacgatggataagttgcagttgttcaggggtgatacggtgctgattaagggcaagaagcgaaaggatacagtttgtattgttttggcggacgagacttgcgatgagcccaagatccggatgaacaaggtggttcggtcgaaccttcgagttcgcctcggtgatgtcgtctctgtgcaccagtgtgctgacgtgaagtatggaaagcgtatccatgttctacccttggacgattcaatcgagggtgttactggcaacatcttcgatgcttatctcaaaccctactttatggaggcataccggccagtgcggaaaggtgacctctttcttgttcggggaggaatgagaagcattgaattcaaggtaattgagaccgatccggctgagtactgtatcgtggcacctgacacagaaatcttttgtgagggtgagcctgtgaggcgtgacgatgaggatcggttgaatgaggtgggttacgatgacgtaggaggagtacgtcgccaaatggcacagatcagagagcttgttgagcttccattgcgacacccacaactttttaagtccattggagtgaagccaccgaagggtatccttctctttgggcctcctggttcaggaaagacgctcattgcacgagctgtggctaatgagacaggggcctttttcttccttatcaatggacctgaaatcatgtcaaagcttgcaggagagagtgagagcaacttgaggaaagcatttgaggaggctgagaaaaacgcaccagcgatcattttcattgatgagatcgactcgattgctcccaagagggagaaaactcagggagaggttgaacgaaggattgtgtctcagttactgacactgatggacggcttgaagtctcgtgctcacgtgattgtgatgggtgctaccaatcgccccaacagtattgaccctgctctgcgtagatttggacgatttgatcgtgaaattgatattggagtacctgacgaagttggacgtctcgaggtgatgcgtattcacaccaagaacatgaagcttgctgaagatgttgatttggagaaggttgcaaaagagactcatggttttgtaggagcggatttggcagccctggccactgaagcagcacttcagtgcattagggagaagatggacgtgattgacctggaggaagattctatcgatgctgaaatcctcaattctatggcagttactaatgaacacttccaaactgcgttgggtacaagcaacccatctgcacttcgggagactgtcgtggaagtgccaaatgtcacatgggaggatgttggtggtcttgagaatgttaagcgggagctccaagagactgtgcaatatccagtggagcatcctgagaagtttgagaagtttggtatgtcgccttccaagggagtgttgttctatgggccaccaggatgtggtaaaacaatgcttgcgaaggccattgccaacgaatgccaagccaatttcatcagtgtgaaaggtcctgagcttttgactatgtggtttggcgagagcgaggccaatgtacgagaaatctttgataaggcccgaggatcagctccatgtgtgctcttctttgacgagctcgactctattgccacccagagagggagcagtggtggtgatgctggcggtgcagccgatcgcgtcctcaaccagctgctcacagagatggacggcatgaacgcgaagaaaacagtcttcatcattggcgccactaaccgacctgacatcattgattccgcacttctgcgacccggacgtctggatcagctcatttacatcccacttccagacgaagcctccaggctccgaatcttccaagcatgcttgcgcaagtcgcccattgccaaggaggttgacctggaggctcttgcccgccacactcagggcttcagtggtgcagatattactgaaatttgtcagcgagcctgcaaatatgctattcgtgaaaacatcgaaaaggatatcgagaaggaaaagaagagggctgagaatccagaagcgatggaagaagacgacactgatgaagtatctgaaatcaaggcagcccattttgaagaatctatgaagtttgctcgaaggtccgtaagcgacgctgatatccgcaagtaccaagcgtttgcacagacgttacaacaatctagaggctttggctccgagtttcgtttcccagatcgaccagccaccgccactggggctgcttccacagctgctgcaggtggggagtctgcgtttgctgcagcagcagctgatgaagacgacttgtataattaggatttaattcgcccgcttgaagcgtcgacagtgccatcaggaacgttctagtagctgggaaaaggttttaggggtagttagcatttgtttgtacagacgaatatgcatccattcagggcaggtggcattttttttccagttcccctgcctggctgctgtccctcccccaattcgggatgccaagaagtataggcagcaacttgattcccagattgatctcttttggtcctagttctgtgaagtcactatgttgatgcaaataccagtattttttgaggtcccgatcacttgttattacactaatatctacaccaaatttttgaa

SEQ ID NO: 7487 - DNA, 2928 bp, Cirsium arvense
tcatgacgagtaatcaactgaatcatccgatgccaaggggacgaagcgtgacttcagtaccgccattctggagcggaagaaggcggcgaacaggctcgtcgtcgatgaagccactaatgatgataactccgttgttgccttacatcctgagactatggaaaagcttcagctattcagaggcgacactatcttgatcaagggaaagaaaaggaaagatacaatctgtattgctcttgctgatgacacttgtgatgaaccaaagattaggatgaataaggttgtcagatctaacttgagggttaggcttggtgacgtggtctctgttcatcaatgtgctgatgttaaatacgggaagcgtgttcacattctccccgttgatgacacaattgaaggcgttactgggaacctctttgatgcttacttaaaaccatacttcatggaggcataccggccagtgagaaagggtgacttctttcttgtaaggggaggaatgcgaagtgtagagttcaaggttattgagactgatcctccagagtattgtgtagttgcccctgatacagaaatcttctgtgaaggtgagcctgtgagaagggaagatgaggatcgtttggatgagatcggttatgatgacgtcggtggtgttcgcaaacaaatggctcagattcgtgagctagtagagctgccattaagacatccacaactctttaagtcaattggggttaagcccccaaagggaattctgctttatggtcctcctggatccgggaagactttgatagcccgtgcagtcgctaacgaaactggtgctttcttcttctgtatcaacggtccagaaattatgtcgaaattggctggagaaagtgagagcaatttaaggaaggcttttgaggaagcagagaagaatgctccttccatcatctttatagatgagattgattcaattgctcctaaacgtgagaagacacatggagaagttgaaaggaggattgtttcacagcttttgactctaatggatggactgaaatcccgagctcatgttattgttatgggtgccactaatcgtcctaatagcattgaccctgcccttaggagattcggtagatttgatagggaaatcgatattggtgtgcctgatgaaatcggccgtcttgaggttcttcgtatccataccaagaacatgaagctgtctgaagacgttgatttggagaagatttcgaaagagacgcatgggtacgtgggtgctgatttggcagctttgtgtaccgaggctgcactccaatgcatccgagagaaaatggacgtgattgatttggaagatgagtccattgatgccgagatactcaattccatggcggttacaaacgagcactttgcgaccgctcttggtacaagcaacccgtctgctcttcgtgagactgttgttgaagtaccgaatgtcagttgggaagatatcggaggacttgagaatgttaaaagagaactacaggagactgtacagtatccagtcgaacatcctgagaagttcgagaagtttggtatgtcgccatctaaaggggttctcttctatggtccaccgggttgtggaaaaactcttcttgccaaggctattgccaatgaatgccaggctaatttcatcagcatcaagggtcctgaattgcttaccatgtggtttggtgaaagtgaagctaacgttcgtgagattttcgacaaggcccgtggatctgctccttgtgttctgtttttcgatgaactcgactccattgctacacagagagggagtagtcagggagatgctggaggtgcagcggatagagtgctgaatcaacttctgactgagatggatggtatgtcggccaaaaagacggttttcatcattggtgctactaacaggccagatattatagatccagcacttttgaggcctggtcgactggatcagttgatttacatccctctccccgatgaggaatcccgctatcaaatcttcaaatcggctttgaggaaatctccggttgccaaagacgtagatctgaatgcgctagccaaatacacccagggattcagtggtgctgatatcactgaaatctgtcagcgtgcctgcaagtacgccattcgtgaaaacatagagaaagatatcgagagggagaagagaagaagtgaaaacccggaggctatggaggaggacgtggaggatgaggtggcggagatcaaggcggcacattttgaggaatcgatgaagtttgcacgcaggagtgtgagtgatgctgatattaggaagtatcaggcgtttgctcaaacgttgcaacagtctagagggtttggttctgagttcaggtttgcagagactagcggagctagggcggctactggtggttcggacccttttgctgtggctccaggtgcagcggatgaagatgatctgtataactaataaatcgtagatggcatactctttcctttttatctggttaaagcaataccttcttttgaagtcttttgtaattcatacgacttgatacctttgtttcatgagcctggtttttaagactttctggaaccagtttaaaccagcaccatggttgttagatttgaaacaatgtattcgtactgacctatgtcttctaaatatatgccatggctaaacaaagtatctgaaaaagaaaaaagtaccgactgcgactctgcgttcagattttcaggaacaagaaatcaagtgtttgatgattggttgggttatggtgtgtgcaccctgactcacaacttcgcccgtcgataagacaagccattaaagtacttaactctgaagcttcgttaccgatactcccctcaaatatgccggtggcattaaatttggcaccttcagtgtcttcataatatggtgtccattccgacgtccgtctctaaccgatagcgatattgatctctcat

SEQ ID NO: 7488 - DNA, 2436 bp, Prunus persica
tcttctgcttcttcgttacgatgaccaacaaagctgatcaatcttcggacactgggggttcaaagaaggacttcactacggcaatccttgaccgcaagaaggctgtgaatcgccttgttgtggatgaagatatccatggcgacaactctgtcgtcacgctccacccagagtctatggagaggctccagctatttcgtggggacacaatcttgatcaagggaaagaaaaggaaggacacagtctgcattgtagttgctgatgacaaatgtgaggaaccaaagataaggatgaacaaggttgtcaggagcaacctacgggttaggcttggagatgtcgtttctgtttaccaatgcgctgatgtcaagtatggaaaccgtgttcacgtactccctgtggatgacagtatccaaggggtgactggaaatctgtttgatacatatttgagaccttattttttcgaggcctaccgacccgtgaggacgggtgatctcttccttgtgagaggagggatgaggagtgtggagttcaaggttgtcgaaactgaccctcctgagtactgcgtggtggctcccgacaccgaaatcttctgtgacggggagcctgtgagaagggaggatgaggagaggtcattagatgaggttggatatgatgatgttggtggagtaaggaaacagatggctcaaattcgcgagtcggtggagctgccgctgaggcatcctcagctgtttaagataattggtgtgaaaccaccaaagggtattctgttgtatggacctcctggaactggtaagactctaattgcccgtgctgtggctaatgagactggggcattctttttctgcatcaatggaccagaaatcatgtcgaaactggctggggagagtgaaagcaacctcaggaaagcttttcaggaagcagagaagaacgcaccatcaatcatctttattgatgagatcgattcaattgctcccaagagagacaagacaaatggagaagttgagaggaggattgtttcccaactcttgacactcatggatggactaaaatcccgtgcgcatgtaattgttatcggggctacaaatcgtccaaatagcattgatccagctctcagaaggtttggaagatttgatagggaaatagatattggtgtgccagatgaagttgggcgtcttgaggttctgcgtattcataccaggaacatgaagcttgctgaagaagttaatttagaaaagatagctaaggacacacatggttatgttggtgctgatctagctgctttgtgtactgaggctgcacttcaatgcatcagagagaagatggacgtgattgacttagaagatgaggaaatagatgccgagatacttaattcaatggcagttacaaacgagcacttgcagacggctcttggcacgagcaacccatccgctcttcgtgaaacagttgttgaggtgccgaatgttagttggaaagatatcggaggtctcgagaatgtcaagagggaacttcaagagacggttcaatatccagtggagcatcctgagaaatttgagaaatttggaatgtcaccctcaaagggagttcttttctatggccctcctggatgtggtaaaactcttctcgccaaagctattgccaatgagtgtcaagcaaacttcatcagtgtcaagggacctgaattgcttacaatgtggtttggagagagtgaggccaatgtacgtgaaattttcgacaaggcccgtggatctgctccatgtgtcctgttctttgatgaacttgattccattgctacacagagaggtagcagcgtaggcgatgctgggggtgctgctgatagggtactgaaccaactccttacggaaatggatggaatgtctgcaaagaaaactgttttcgtcattggggccaccaacagacctgacattatagaccctgcacttctacgtccaggccgtctggatcagttgatttacatccctctccctgacgaagaatctcgccatcaaatattcaggtcttgcttgaggaaatctcctgtttccaaagatgtggacattagagcccttgccaagtacaccctaggatttagtggtgctgatataacagaaatatgccagcgtgcgtgcaaatatgccattagagaaaacattgagaaggatattgtgagggataggaggaaaaatgagaaccctgaggctatggaggaggatgttgatgatgaagtagcagagatcatggcagctcatttcgaggaatccatgaagtatgctcgtaggagtgttagtgatgctgatatccgtaaataccagacattttctcagacattgcagcagtcaagagggttgggaacagaattcaggtttgcagacagagctgctggatatgacccttctgcaactgcgtctgctggggctgatggagatgacttatacagttagg

SEQ ID NO: 7489 - DNA, 2418 bp, Glycine max
gaaatgtgaaaagaaggattattccacatcaatattagaacgcaagaagtctcctaaccgacttgttgttgatgaagcaattaatgatgataattccgtggttactttgcaccctgaaacaatggagaagcttcattttttccggggggacactgttctgataaagggaaagaagcgaagggacacaatttgtgttgttcttgctgatgaacaatgtgatgaaccaaaaataaggatgaataaggttgttcgggctaatcttagagtgcgacttggcgatgttgtctctgtccatcaatgtccagatgtgaagtacgggaaacgagttcacatccttccaatcgatgacaccattgagggtgtaactggcaacttgtttgatgcatatttgaagccatactttatggagtcataccggccagtgaggaaaggggacttgttccttgttcggggtgggatgcgcagtgttgaattcaaggtaatagagactgatcctggtgaatactgtgttgtggcacctgatgctgaaatcttctgtgagggagagccaatcaagcgggaagatgaagagagactaaatgaaattggctatgatgatgtcggtggtgttaggaaacaaatggctcaaattcgtgagctggtagaacttccacttagacatccgcagctcttcaaatcaattggagttaagcccccaaaaggaatcttgctttatggaccacctggttcaggaaagactctgattgcaagagcagttgctaatgagactggtgcattcttttttttgattaatggaccagaaatcatgtcgaagctggccggtgagagtgaaagcaatctgaggaaggcatttgaagaagctgaaaagaattccccttctatcatttttattgatgaattagactcgattgctccaaagagagaaaagacacatggtgaagtggagaggcgtatcgtttcacaacttttgactcttatggatggcctcaagagccgatcacacgttgtcgttattggagccacaaataggccaaatagtattgatcccgctttgagaaggtttggaaggtttgatcgggagattgacattggtgtaccagatgaagttggaaggttggaggttcttagaattcatacaaagaacatgaaactttcagacaatgttgatcttgaaaaagttggcagagatactcatggttatgttggatcagatcttgctgctctttgcacagaggctgcactacagtgtatccgggagaaaatggatgtgattgacttagaggatgaaacaattgatgctgaggtgttgaattccatggctgtgaccaatgaacactttcaaactgccttaagttcttcaaacccatctgccctgcgtgaaacggttgtggaggttccaaatgtttcctgggatgatattggaggcttagagaatgtcaagagggagcttcaggagactgttcaatacccagtggaacatcctgagaagtttgagaaatttggcatgtcaccttccaaaggtgttctcttttatggacctcctggctgtggtaaaaccctgcttgcaaaagcaattgctaatgagtgccaagccaactttataagtgttaagggacctgagttgctgacaatgtggtttggtgaaagtgaggcaaatgttcgcgagatatttgacaaggctcggcagtcagctccatgcgtgcttttctttgatgaacttgactctattgcaactcagcgaggcagttctgtaggggatgctggtggtgctgcagatagggtgttgaaccaactgttaacagaaatggatggtatgacagctaagaaaacagttttcatcattggggcaacaaacagaccagacattatagaccctgcattgctcaggccgggacgtctggatcaattgatttacatccctttaccggacgaaagttcacgtcttcaaatcttcaaggcatgcttgaggaagtcaccgatctcaaaggatgttgaccttgcagctcttgcccgttttactcatggattcagtggtgcagacatcactgaaatttgtcaacgagcgtgcaaatatgccattagggaagatattgaaaaggatattgagaaggagagaagaaaaagagaaaaccctgaagccatggaagaagatgacactgatgaggtccctgagataaagcctgcccactttgaagagtctatgaagtttgctcgccggagtgtcagcgacgctgacatcaggaaataccagctctttgctcagaccttgcaacagtctcggggattcggatccgagtttcggtttccagatcgaaacgagaacactgcagcagatgcctcagaccctttctcatctgttacagctgagggagatgatgatttgtacagttagtagccatgtgagttgagtaatgcggt

SEQ ID NO: 7490 - DNA, 2486 bp, Triphysaria pusilla
caaatcggctcgtcgtcgatgagtcggtcgaagatgataactccgccgtcgccctccacccaactaccatggaaaagctccagcttttccgaggagatactgttttgctgaaggggaagaaacgaaaggatactgtgtgtattgcgctctccaatgaggcatgtgaagagtcgaagatcaggatgaacaaggttgtccggacaaatctgaggcttcgtttaggggatgttgtatctgtacaccagtgcccagatgttaaatacggaaagcgcgttcacatattgcccttggatgatacaatagaaggtctcaccggggatcttttcgacgtgtatctcaaaccttacttctctgaggcatatcgccctgtgaggaaaggggaccatttcctagtgagaggagggatgagaagtgtggaattcaaagttgttgagactgacccgggggagtattgtgttgtggccccagataccgagatcttttgtgaaggggaacctgtgaggagagaggatgaggacaggctggacgagattggctatgatgatgtgggtggtgttagaaagcagatggcacagattcgtgaactggtagagttgccactaaggcatcctcagctcttcaaatctattggtgtcaaacctcccaaagggattttactctatggccccccaggttctggaaagacattgattgctcgagctgttgcgaatgaaaccggtgcttttttctttttgatcaatggacctgaaatcatgtctaaaatggctggagagagtgagagcaatttgagaaaggcatttgaggaagccgagaagaatgctcctgctattatctttatcgatgaaatagattcgattgcgcctaagcgggacaaaacaaatggcgaagttgagaggaggattgtttctcaacttttgactctcatggatgggttgaaatctcgcgcccatgtcattgttatgggtgcaactaacaggccaaacagcattgatccagctcttagaaggtttggtaggtttgacagggaaatcgatattggtgtccctgatgaagttggccgtcttgaagttcttaggattcatacaaagaacatgaagctttctgaggatgttgatttggaaagaatatcaaaggacacccatggctatgttggtgctgacctcgcagctctctgtactgaagctgctctacagtgcatcagagagaaaatggatgtcattgatttagaggatgatactattgacgctgagatactgaactctatgtctgtctcaaatgagcacttccacactgctcttgggacaagcaatccttctgctttgcgtgagacggttgttgaagtgcccaatgtctcatgggaagatattggagggcttgaaactgtcaagagggaacttcaagagactgttcaatatcctgtggaacatccggagaagtttgaaaaattcggtatgtcaccctcaaagggtgttctcttctacggtcctcctggatgtggtaaaactctacttgccaaggcaattgcaaatgaatgtcaggccaactttattagtataaaaggacctgaactactcaccatgtggttcggagagagtgaagccaatgtccgtgaaatattcgacaaggctcgacaatctgctccatgtgttctcttctttgatgagctcgactctattgcaactcagagaggaagcagtggtggagatgccggtggtgcagctgaccgtgttctgaaccagcttttgactgaaatggatggcatgaatgcgaaaaagactgttttcataatcggggccacaaacagacccgacattatcgatcctgcacttcttcgtccaggtcgtcttgatcagttgatttatattcctcttccagatgaagattctcgtcatcaaatcttcaaagcatgcctccgcaaatctccactttcgaaagatattgatttgcgtgctcttgccaagtacactcaaggtttcagtggggcagatatcacagaaatttgccagcgatcctgcaaatatgccattagagagaatatagagaaagacatcgaaaaggagaggaaaagaaacgctaatcccgactccatggatgaggatgctgatgatgaagtgtcggaaatcaaggctgcacatttcgaggagtcgatgaaatatgctcgtagaagtgtgagtgatgctgatatacgcaagtaccaggcttttgcgcagaccttgcagcagtctcgtgggtttggaacagaattccggtttgctgagtcagcaggtgggggaggagcatcaggatccgacccatttgcggcgcctgctactggagctgctgatgaagacgatttgtattcttagtcttccaaaattctcagtttttcaatttccagcacaaacaattttatttaattatgcacttgttttgtttgaactagaaattgttatgcacctatatttattatatttgacaagttttattcgaaaaaaaaaaaaaaaaaa

SEQ ID NO: 7491 - DNA, 2827 bp, Glycine max
gtatgaactaagagcttataacagctccgtttagattacacagtactgtgagtttagactatactagaagagcatcatatacccttttgcacacaaactaaaagaaaagaataatcatcattcatcaccaccaccaagtaaaagctttcactgaactgaaccatggcggatccaacctcatctaaccctgataaggatcaatcctctacggaaccgaaaagtgaaaagaaggattattccacagcaatattagaacgcaagaagtctcctaaccgacttgttgttgatgaagcaattaatgatgaaaattctgtggttactttgcaccctgaaacaatggagaagcttcagtttttccggggtgacactgttctgataaagggaaagaagcgaagggacacaatttgtgttgttcttgctgatgaacaatgtgatgaaccaaaaataagaatgaataaggttgttcgggctaatcttagagtgagacttggagatgttgtctctgtccatcaatgtcccgatgtaaagtacgggaaacgagttcacatccttccaattgatgacaccattgagggtgtaactggcaacttgtttgatgcatatctgaagccttactttatggagtcataccggccagtgaggaaaggtgacttgttccttgttcggggtgggatgcgcagcattgaattcaagctaatagagactgaccctggtgaatactgtgttgtggcacctgatactgaaatcttctgcgagggagagccaatcaaacgggaagatgaagaaagactaaatgatgttggctatgatgatgttggtggtgttagaaaacaaatggctcaaattcgtgagctggtagaacttccacttagacatcctcagctcttcaaatcaattggagttaagcccccaaaaggaatcttgctttatggaccacctggttcaggaaagactctgattgcgagagcagttgctaatgagactggtgcattcttctttttgattaatggaccagaaatcatgtcgaagctggccggtgagagtgaaagcaatctgaggaaggcatttgaagaagctgaaaagaattccccttctatcatttttattgatgaattagactcgattgctccaaagagagaaaagacacatggtgaagtggagaggcgtatcgtttcacaacttttgactcttatggatggcctcaagacccgatcacatgttatcgttattggagccacaaataggcctaatagtattgatcctgctttgagaaggtttggaaggtttgatcgtgagattgacattggtgtaccggatgaagttggaaggttggaggttcttagaattcatacaaagaacatgaaactttcagacaatgttgatcttgaaaaagttgccagagacacccatggttatgttggagcagatcttgctgctctttgcacagaggctgcattacagtgtatccgggagaaaatggatgtgattgacttagaggatgaaacaatcgatgctgaggtgttgaattccatggctgtgactaatgaacactttcaaactgctttaagttcttcaaacccatctgctctgcgtgaaacagttgtggaggttccaaatgtttcctgggatgatattggaggcttagagaatgtcaagagggagcttcaggagactgttcaatacccagtggaacatcctgagaagtttgagaaatttggcatgtcaccttccaaaggtgttctcttttatggacctcctggctgtggtaaaaccctgcttgcaaaagcaattgctaatgagtgccaggccaactttataagtgttaagggacctgagttgctgacaatgtggtttggtgaaagtgaggcaaatgttcgcgagatatttgacaaggctcggcagtcagctccatgtgtgcttttcttcgacgaacttgactctattgcaactcaacgaggcagttctgtaggggacgctggtggtgctgccgatagggtgttgaaccaactcttaacagaaatggatggtatgacagctaagaaaacagttttcatcataggggcaacaaacagaccagacattatagaccctgcattgctcaggcccggacgtctggatcaattgatttacatccctttaccggatgaaagttcacgtcttcaaatcttcaaggcatgcttgaggaagtcaccaatctcaaaggatgttgacctatcagctcttgcccgttttactcatggattcagtggtgcagacattacagaaatttgtcaacgagcgtgcaaatatgccattagggaagatattgaaaagggtattgagaaggagagaagaaaaagagagaatcctgaagccatggaagaagatgacactgatgaggtccctgagataaagcctgcccactttgaggagtctatgaagtttgctcgccggagtgtcagcgacgcagacataaggaaataccaactctttgctcagaccttgcaacagtctcggggatttggatctgagtttcggtttccagatcaaaatgagaacactgcagcaggtgcctcagaccctttctcatctgttacagctgagggagatgatgatttgtacagttagtagccatgtgagttgagtaatgtggttgattttcactatttctgcaatgacttgtagcaaatatcatgatagttttggttttgctgagggtcaatgtttctgtttcatgttaaacgagcagtctatgatgttctttttggtaagttaagactgatatatgtaacatagtcaaacctgtatgtttgtgtgtatataatttggcttttatgatctaatctca

SEQ ID NO: 7492 - DNA, 2650 bp, Vinca minor
tacctactcttcatataaaaatttctacttttataggaacttcggaagcacaaaagtaaactacatatagcaacagacccttttcgaaatcgatacagagaatctctgaaaaaatggcagatccgacagctggttcatcttcctctgctcctgactcgaaaagcaacaagagggattattccactgcaatcttggagcgaaagaagtctcctaatagactaattgttgatgaggccctaaatgatgacaattcagtggttgcaatgcaccctgcgaaaatggaggctctcaatctctttcgaggcgacactatcttggttaagggaaagaaaagaaaggacacggtttgcattgttcttgctgatgaacaatgtgaagaagagaaaatccgcatgaataaagttattcgaggtaatctcagagtacgtctttctgatgttgtatcagtgcatcaatgtcctgatgttaagtatggaaaacgagtacacatccttccaatggatgactcgatcgagggtcttacgggcaatctgtttgatgcgtatttgaaaccatatttcctcgaatcttataggcctgtgaggaagggtgatctcttccaagttagaggggaatgcgaagtgttgagtttaaggtggttgagacggatcctggagagtactgcgttgtttcaccagatacagagatattctgtgagggtgaacccatcaagcgtgatgacgaggagaaactgaatgaagttggatatgatgatgttggcggtgtcagaaagcaaatggcccaaatccgtgaactcgtggaacttcctttgaggcaccctcaactttttaaggccattggtgttaagccaccaaaaggcattttgctctatggacctcctggttctggtaagaccctgattgcaagagctgtagccaatgaaaccggtgcatttttcttcttgatcaatggacctgaaattatgtcgaaaatggctggcgaaagtgaaagtaacttgaggaaagcatttgaagaagctgaaaagaatgcaccagcaatcatattcattgacgagcttgattcaattgctccaaaaagggagaagacacacggtgaggttgagaggcgtatagtatcccagcttctgacgcttatggacggccttaaggctcgatcccatgtcattgtcatgggagcgacaaatagacctaatagtattgatcctgctctcaggagatttggtaggtttgatcgagaaattgatattggtgtaccagatgaagtgggcaggttggaagttctccgaattcataccaaaaacatgaaacttgctgaagatgttgatcttgaaagggttgcgaaagatacacatggttatgtaggtgctgaccttgctgctctgtgcacagaggctgcccttcagtgtattagggagaaaatggatcttattgaccttgaggatgagacgattgatgcagagatattgaattcgatggctgtgaccaatgaacacttccaaacagcactcgtcacttctaatccatcggcccttcgtgaaacagttgtcgaggtaccaaacgtttcatgggaggatattggtggattggataatatcaagcgggagcttcaggagactgttcaatacccggttgagcacccggagaagtttgaaaagtttggcatgtcgccatctaaaggtgttcttttctatggtcctcctggctgtgggaaaacattgcttgctaaagctatcgctaatgagtgtcaagccaatttcattagtgttaagggcccggaattgctgactatgtggttcggagaaagtgaggcaaatgttcgcgagatatttgacaaggcaagacaatctgccccttgtgtgcttttctttgacgaattggattccattgctactcagcgcggaaatagtgcgggagacgctggcggtgctgcagacagggttcttaatcaactcttaaccgaaatggatggaatgaacgccaagaaaacggttttcattatcggggcaaccaataggccagatataattgaccctgctttactaaggcctggacgtttagatcagttgatttatatcccgcttccagatgaagcttcgcgtcttcagattttcagggcatgtttgaggaagtccccggttgcccaaaacgtcgaccttgcagctctagcgcgtcacactcatggatttagcggtgcagatattactgaaatctgtcaacgcgcttgcaaatatgccatcagagagaacattgagcaggatattgagaaggaaagaaagaaggcggaaaatcctgaagccatggaagaagacaatgcaaatgatgaggtggccgagatcaaggctgcacactttgaggagtctatgaaatttgcgcgtagaagtgttagtgatgcggacataagaaagtatcagatgtttgctcaaacattacagcaatcgcgtggttttggaacagaatttaaatttgcagaacgagccgagaatccaactgcagctgcagatccttttgcatctgctcctactgctaatgatgatgatgatttatatgcctgagtttgtcctacttttagagctttaagttaatagcatgtatatattatgcttgtcaagtttgaaaagtttgttttccttaaataaaggtgaagttaaata

SEQ ID NO: 7493 - DNA, 3141 bp, Physcomitrella patens
aacctcacgtttgcttcgattcgaagggtctcgccgtcaattcgcaccgcttccgctgatatttagcagtgcttgtgccctgattcgcattgcgagcggagaagcttctggcactccctttgactgtggaggaaaaccgcattggaatcggttgtttctccaaggagagagtgagatcggcagtggaaggaaggaaggaaggattgcggattgaacatggcgactcccgcggcttcacaccccggcgaatcttcggatccgttacgatctcgcaccttcaagccagttgcaaagaaagatttttctactgctattcttgagcgtaagaaggctcctaaccgcttggttgttgacgaggctgtgaacgatgataattccgtggtagcactaaacatggaaactatggaaaagttgcagctttttcgtggagacactgtactgattaagggtaagaaacgcaaggacactgtgtgtattgtgttggctgatgacacttgtgatgaacctaaaatacgaatgaacaaggtggtaagggccaatcttcgggtgcgcctaggagacgttgtgtcagttcaccaatgcgctgatgttaaatatggaaaacaaatccatgtccttccatttgatgactcgatcgaaggagttactggaaacctttttgacgcttacttaaagccatacttcttggaagcttacagaccagttcgcaaaggtgatttgttcctggtgcggggaggcatgaggagcgtggagtttaaagttgtggaaacagatcctgtagagtattgcattgttgcccctgatactgaaattttctgcgagggcgaacctttgaggcgtgaggacgaggaaagactagacgaagttgggtatgatgatgtgggtggagttcgcaagcagatggcacaaatccgtgaactcgtggagttgcctctgaggcatcctcaactctttaagtcgattggagtaaagcctcccaagggtatcttgttatttggtcctcctggttcagggaagacattgattgccagagctgtagccaacgaaactggagctttctttttcctgataaatggtccagaaattatgtcaaagttagcgggtgagagcgagagtaatttgagaaaggcttttgaggaggcagagaaaaatgcaccatccattatttttattgatgaaatcgactctattgcaccgaagagggagaagactcaaggagaggtggaaaggcgaattgtatctcagttgttgactcttatggatggattgaagtcccgtgcccatgttatcgtgatgggtgctaccaatcgtccgaacagtattgacccagcacttcgtcgctttggccgttttgatcgtgaaattgatattggtgttccagatgaagttggtcggttggaagttgttcgtattcatactaagaacatgaagcttgcagataatgcaaatctggagagtattgcccatgatactcatgggtttgtcggtgctgatttagctgcattatgtaccgaagcagcgcttcagtgtattcgtgagaagatggatgtgatagatttggaagatgacaccattgatgcagaagtgcttaattctatggctgtaactaatgagcatttccagaccgctcttggcatcagtaacccctctgctcttcgggaaactgtggtggaggtgcccaatactacctgggccgacattggaggcctggagaatgttaagcgggagcttcaagagactgtgcaatatccagtggagcatccggagaaatttgagaaatttggaatgtccccatcaaagggtgtgttgttctatggtccacctggatgtggaaagactcttctcgccaaggcaatcgccaatgaatgtcaagcaaatttcatcagtgtaaaggggccagaactattgaccatgtggtttggtgagagtgaagcaaacgtacgcgatgtgtttgacaaggctcgccagtcggccccttgtgtcctcttctttgatgagctagactcgattgccaatcagcgtggtagcagtcaaggtgatgctggtggagctgctgatcgtgtcttgaatcagctgcttactgagatggatggaatgaacgcaaaaaagactgtatttattattggtgcgactaacaggcctgatattatagattctgcactcctcaggcctgggcgtctggatcaacttatttatattcccctaccagatgaagcttctcgtttgagaatcttccaggctactttgaggaagtcacctgtagccaaggaggtggatttgcaggccctagcgaagttcactcaaggtttcagtggtgcagatattactgaaatttgtcaacgtgcttccaagtacgctattcgtgaagatattgagaaggacattgagagggaaaagaggagggcagagaatcctgaagccatggaagaagatgtagtggaagaacctgctcagattaaagcacgccacttcgaggaatccatgaagtttgctcgccgcagtgtgagcgatgctgacattcgcaagtaccaatcatttgctcagactttgcagcaatcccgtgggtttggatccgaatttcgatttgctgatcgcccagccgccgctgctggagcacctcatgctgcagaaactacaacatttggtgcttctgcagatgacgatgatttgtataactagatctgtgaatgttcggtgctcctccaagaagcggcctttagacccttaggcacatatttgtacacagtttcttcttatcccttccctcaagtacttgaatgagaaaatttattcaacttagtgtgattcataaactttgttgccaatcatttttgggcggtgcagacttgtgatgtatctactccggaagagattttgaactagagtgatcttcgtaaaacactttcgactgagattgggctttcatattgttcttactatttatgtcagagcagttgctgcacctaatggtggattaactcaatctgctagcgtccacttggaaaacatctccttgttaatagaagtttggggatgtgcaaatcttagtgtttagccaatagggagtttgatttaaccaacattcactcatggactatttgaacaatttgttgtgggaaaataaagaattgcagtcttggt

SEQ ID NO: 7494 - DNA, 2901 bp, Ceratodon purpureus
gggcatggtgagtggtgagggttggggggcgccttcattgcctcacttgaatgcactggcccgctcccacgagacttgcaccgcacgcaccctcaagagagaacacagcagtgagcccacgacacagccagggaaaggcgacgcagggacgcagggacgcagggacggaggaggaggaccaggaccaggaccaggactaacttaggacgaggacgagggctgtggaaggaagggtctcccagcttcaactgactccgctacatactctgttacagcttcttcttctgttgtctcctgctcctgctcctgctgctgcccctgctgctgctgctgcacgtatactacactccacccccaattgcacccgcttccccctctcaccctgcctgccaccccgcatcccagatcggggaggttgtgcctcgcggcttttcatttcccctcatcacgctatccgccatcttgtttctgctgccgcccaccaggacctttcacttgaccactttgtgcttcggccatggcgactcccccgtctgcgcatcccggggaaccctcggatcccaagccagctgggaagaaggatttttccactgccattttggagcgcaaaaaggctcctaatcgtttggttgtcgacgaagccgtgaatgatgataactccgtggtagcgttgaacatggagaccatggaaaagctgcagctatttcgcggagacactgtgctgattaagggcaagaaacgcaaagacactgtctgtattgtcctagcagacgacacttgtgacgaacctaagatccgaatgaacaaggtggtgagggccaatcttcgggtgcgcctcggggatgtggtgtcagtgcaccagtgtgcagatgttaaatacggcaagcgcatccatgttctcccgttcgatgactcgatcgagggagttacaggaagcctttttgacgcgtatttgaagccctatttcatggaagcctacaggccagtccgcaagggcgatttgtttctggtgcgaggtggcatgcggagcgtggagttcaaagtagtagagaccgaccctgcagaatactgcatcgttgctcctgacacagagatattctgcgagggcgagcctttgaggcgtgaggacgaggagagactagatgaggttggttacgacgatgtgggtggagtccggaagcagatggcacagatccgtgagctggtggagttgcctctgcggcaccctcagctgttcaagtcgattggagtgaagcctccgaagggtatcctgctgttcggtcctcctggttcaggaaagacattgattgcgagggccgtggcgaacgaaacgggagcgttctttttcctgatcaacggtcctgagatcatgtcaaagttggctggcgagagcgagagtaacttgagaaaggcatttgaggaggcagaaaagaacgccccatcgatcattttcatcgacgaaatcgactccattgcaccgaagagggagaagactcaaggcgaggtggaaaggcgaattgtgtcccagctgctgacgctgatggacgggctgaagtctcgtgcccatgttattgttatgggggctaccaaccggccgaacagcattgacccagcactacgtcggtttgggcggtttgaccgtgagattgatatcggggttccggacgaagttgggcgtttggaagtcgttcgtattcacacgaagaacatgaagctttcagaggatgtcgatctggagaggattgcccatgatactcatgggttcgtgggtgccgatttggcggccctatgcacggaagctgccctgcagtgtatccgtgagaagatggacgtgatcgacttggaggacgactcgatcgacgcagaggtgctgaattctatggccgtgacgaacgagcacttccagaccgctctgggcatcagcaatccttctgcacttcgggagacagtggtggaggtgccgaataccacgtgggaggacatcggagggctggagaatgtcaagcgggagctccaagagactgtgcaatacccggtggagcatccggagaagttcgagaagtttggaatgtcgccatcgaagggtgtgctgttctacggtccacctggatgtggaaagacgctttttggcgaaggctatcgcgaacgaatgtcaggcgaatttcatcagtgtgaagggaccagagctgctgacgatgtggtttggtgagagcgaagccaacgtgcgggatgtgttcgacaaggctcggcagtcggccccttgtgtgctgttcttcgacgagctggactcgatcgccaaccagcgtggcagcagccagggtgatgccggtggtgccgccgatcgcgtcttgaaccagttgttgacggagatggacggtatgaatgcgaagaagacggtgttcatcatcggtgcaacgaacaggcctgacatcatcgattctgcactcctgaggcccgacgtctggatcaactgatttacatcccactaccggatgaagcttctcggctgagaatcttccaggctgccttgaggaagtcgcctctggcgaaggaggtggatttggaggccctggcgaggtacacacagggtttcagtggtgcagatatcacggagatctgtcaacgtgcttcgaagtatgccattcgcgaggatattgagaaggacattgagagggagaagagaaggtcagagaatccggaagccatggaagaggatgaggcggaagaggtggccgagatcaaggcacgtcaggtcgaggagcatgaagttgctcggcgcagtgtgagcgatgctgacatccgcaagtaccaagctttcgctcagactctacagcagtctcgtggattcgggtcggagttccggttcccagaccggccagtcgctcccgggggagttccaca

SEQ ID NO: 7495 - DNA, 2428 bp, Citrus clementina
gatcccaatcaatggctgctgattctaagaaagattactcaactgctattctggagagcaagaagaagtctcccaaccgtcttgtcattgatgaagcaatcaatgatgataactctgttatcacaatgcatcccaacacgatggacaagcttcagtttttccaaggcgacactgtgttagtaaaggggaagaagcgaaaggacaccgtttgcattgttcttggtgacgaacaatgcgaagagtcgaaagtcggaatgaacagagttgtacgatctaatctcagagttcgccttggagatctagtgtccgtccatgcgtgccctgatgtgaaatacggaaggcgtgttcacatccttcccattgatgatacaatcgagggtgttactggaagcttatttgatgcgtatttgaagtcctacttcacgggatcttaccggcctgttcggaaaggtgaccttttcctagtcaggggaggaatgcggagtgttgagtttaaagtaattgagacagaccctggtgaatactgtatcgttgcaccggatactgagatcttctgtgagggcgagcctgtcaaacgtgaggatgaggaggagagattgaacgaagtaggctatgatgatgttggtggtgtgagaaagcaaatggctcaaatccgcgagcttgtagaacttcctctcagacaccctcagctcttcaaatcaattggtgtgaagccccctaagggtatcttgctttatgggccacctgggactggaaaaaccctgattgcaagagccgttgctaatgagactggcgcattcttctttttgattaatggcccggaaattatgtcgaagttagctggtgagagtgaaagcaatctaaggaaggcattcgaggaagctgaaaagaatgccccatctataatatttattgatgaaatagattccattgctccaaagagggagaagacaaatggtgaagtggagaggcgtatagtatcccaacttctaactttgatggatggcctcaagtcccgggcacatgtggttgttatgggagctactaataggccgaacagcattgaccccgctctcaggagattcggacgatttgatcgagagattgacattggtgtacctgatgaagttggaaggttggaagtttttaggatccacacaaaaaacatgaaacttgctgaagatgttgatcttgaaagagttgcaagagatacacatggttatgttggtgcagatcttgctgctctctgtacagaggctgcactccagtgtatcagggagaaaatggatgtcatcgacttggaggatgagactattgatgctgaggtgttgaattcaatggctgtgactaatgagcacttccgaactgcattggagatgtccaatccttcggccttgcgtgaaactgttgtggaggttcctaatgtctcatgggaggatattggtgggttggaaaccgttaagagagagcttcaagagactgttcaatacccagtggagcatcctgaaaagtttgagaaatttggcttgtcaccttctaaaggtgttctcttctatggacctcctggctgtggtaaaacccttcttgcaaaagctattgctaatgagtgtcaggcaaactttgtaagtgtcaaaggacctgagctgctgacaatgtggtttggagagagtgaggcaaacgtgagagaaatctttgacaaggctcgacagtcagctccatgtgtgctattcttcgatgaacttgattcgattgctactcagcgtggcgcttctgttggagatgctggcggcgccgcagatagagtgttgaatcaacttttaactgaaatggatggtatgaatgccaagaaaacagttttcatcataggcgctaccaacaggcctgacgtcattgacccagcattgttgaggccagggcgtctggaccaattgatttatatacccctgccagatgaggcttcccgtcttcagatatttaaagcttgtttacggaagtcacccatctctcctgatgttgacctatcagctcttgcacgttatactcatggtttcagtggcgccgatattactgagatatgtcagcgtgcctgcaaatatgctattcgagagaacattgagaaggacattgagagggagagaagcgggaagaggaagagggagaatcctgaagcaatggaagtagatgacgtcgatgagattacggcagcacactttgaggaatcaatgaaatatgcccgcaggagtgtcagtgatgcagacatccgaaaataccagctctttgcacagactttgcaacaatctcgtggatttggatccgatttccggttcccagatcgaaccgagagtgccaccgcaggggctgctgactttttctcttctgccattgctgatgatgatgatctatacaactgaattagaaccgatgaaag

SEQ ID NO: 7496 - DNA, 2738 bp, Physcomitrella patens
atggcctcttctggttctggcacgaagcctgaggatgttcctcctgctccggaagggagggggacaaagagagactttacatctgcaatccttgaacgtaagaaagctgccaatcgtttgattgtggatgaggctgtgaacgatgacaactctgtcgttgctcttaacacagagaccatggacaagttgcagcttttcagaggcgacacagtcctggtcaaaggcaagaaacggaaagacactgtttgcattgtgttggcggatgagacctgcgaggagccaaagattcggatgaacaaagtcgttcgggctaaccttcgagtgcgcctcggcgatgtcgtttctgtgcaccagtgtgccgatgtgaagtatggaaagcgtatccacgttctacctttggacgattcagtcgaaggcgttaccggcaacatctttgatgcctatctcaaaccttactttatggaagcataccgaccagtacgtaaaggggacctgttcctggttcgtggaggaatgaggagcatagaattcaaaattatcgaaaccgatccagctgaatactgtatcgtggcacccgacacggaaattttctgcgagggtgagcctgtgaggagggaggatgaggagcgcttgaatgaggtcggttacgatgatgtcggaggagtccgtcgccagatggcacagatcagagagcttgttgaacttccactgcgccacccccagcttttcaagtctattggagtgaagccaccgaaaggaatccttctgtttggtcctcctggatctgggaagactctaatcgcaagagctgtggctaacgaaactggagcgttcttctttcttatcaatggacctgaaattatgtcaaagctagcgggagagagtgagagcaacctcaggaaagcttttgaggaggccgagaagaatgctccagccatcattttcattgatgagatcgattccattgcccccaagagggagaaaactcaaggagaggtggagcggagaattgtctctcagttgctgacactgatggacggtttgaagtctcgtgcacatgtgattgtaatgggcgctaccaaccgccctaacagtatcgatcctgccttacgtaggtttggccgatttgatcgcgaaatcgacattggagtacctgacgaagtcggtcgactggaggtgttgcgtattcacagcaaaaatatgaagcttgctgaagacgtcgatcttgagaaagttgcaaaggagactcatggttttgtcggagcagatttggcagcgttggccaccgaagctgcactccagtgtattagagagaagatggatgtaattgacctggaggaagattccattgatgctgaaatccttaattctatggcagttacaaacgagcacttccagactgcgttgggtacaagcaatccttctgcactacgagagacagttgttgaggtgcccaatgtcacctgggaagatgtcggtggccttgataatgttaaacgggagctccaagagactgtgcaatatccagtggagcaccccgaaaagtttgagaagtttggtatgtcaccctccaagggagtcctcttttatggaccacctggatgtggtaagacaatgcttgcaaaggctattgccaacgagtgtcaagctaatttcatcagtgttaaaggtcctgagcttttgactatgtggttcggagagagcgaggccaatgtacgagaaatttttgacaaggcccgaggatcagctccttgtgtgctcttcttcgacgagctcgactccattgctactcaaagaggaagcagcggcggtgacgccggtggtgcagcagatcgtgtactcaaccagctgctcacagagatggacggcatgaatgcaaagaaaacggtcttcattataggtgctacgaatcgacctgatattattgactctgccctattgcgaccgggaagattggaccaactgatctacatcccacttcctgatgaagcttccaggttacggatcttccaagcatgtttgcgcaaatcgcccattgctaaggaagtcgatctggaggcacttgctcgccacactacgggcttcagtggtgctgatatcaccgaaatttgtcaacgggcttgtaaatacgcaattcgtgaaaatattgaaaaagatattgaaaaggaaaaaaagagagctgagaacccagaagcaatggaagaggatgataccgatgaagtgtcagagatcaaagcagcgcactttgaagagtccatgaaattcgctcgcaggagtgttagtgatgccgacatccgcaagtaccaagcttttgcccaaacgttgcaacaatctagaggcattggttcagagttccgttttccagaacgaccagccactgcttccgggactgctgcaaatggtgctgcagggacggtgtctgcgtttgctggaggagcaactgacgaagacgacttgtataattaaggattctatctgccacaacgcttcaggaaatcgttatagggtgagctggggtttgagttttaggatattaggagtagttaatatttgtttgtacaaatgaatatgcatccagtgcgagtggcagttttttcccggtccccctgcctgaatgctgtgtcgaccagttcgggttgggaattaaacgctgcaattcgattcacagttttatactcgaggtcgtttgtatatgttgagctgctcaatcttaaggttgattcatattttcatggctt

SEQ ID NO: 7497 - DNA, 2207 bp, Brassica napus
atgttatctctgttcatcaatgccctgatgtcaagtacggacagcgtgtgcacatcttgcctgttgatgacaccgttgaaggagtcactggaaacctctttgatgcttacctcaaaccttatttcctggaggcataccgtccggtgcggaagggcgatctcttcctagtgagaggaggaatgaggagtgtggagttcaaggttattgagacggatcctgctgagtactgtgttgttgctccggacactgagattttctgtgagggtgagccagtcaagagggaggatgaagaaaggcttgatgaagtgggttatgatgatgttggtggagtcaggaagcagatggctcagatcagggagcttgttgagcttcccttgaggcacccacagctgttcaagtcgattggtgttaagccaccgaagggaattttgctttatggaccacctgggtctggaaagactttgatcgctcgtgctgttgctaatgaaactggtgcctttttcttctgtatcaatgggcctgagatcatgtccaagctggctggtgagagtgagagcaacctcaggaaagcgtttgaggaggctgagaagaacgctccttcgatcatattcattgatgagattgactctattgcaccgaaaagggagaagacgaatggagaggttgagaggaggattgtgtctcagctccttacgctaatggatgggctgaaatctcgtgctcatgttattgttatgggagcaactaatcgtcccaacagtattgacccggctttgagaaggtttggaagatttgatagggagattgatattggtgttcctgatgagattggacgtcttgaagttctcaggatccacacaaagaacatgaagcttgctgaagatgttgatctagagaggatctcaaaggacacacacggttatgtcggtgctgatcttgcagctctgtgcactgaagctgccctgcaatgcatcagggagaagatggatgtgattgatttggaagatgactccatagatgctgaaatcctcaattccatggcagtgaccaatgaacacttccacactgctctcggcaacagcaacccatctgcacttcgtgaaactgttgtggaggttcctaatgtttcttgggatgacattggaggtcttgagaatgtcaagagagagctccaggagactgtccaatacccagttgagcacccagagaagtttgagaaattcggtatgtctccgtcaaagggagtccttttctacggtcctcctggatgtggtaaaactcttttggccaaagctatagccaacgagtgccaagcaaacttcatcagtgtcaaaggtcccgagcttctcactatgtggtttggagagagtgaagccaacgtccgtgaaatctttgacaaggcccgtcagtctgctccatgtgttctcttctttgacgagctcgactccattgcgactcagagaggaggtggaagcggaggtgatggtggcggcgcagcagatagagtcctgaaccagcttttgactgagatggatggaatgaacgccaagaagaccgtcttcatcatcggagcaaccaacagacccgacattattgattctgctcttctccgtccaggaaggctcgaccagctcatttacattccactgccagatgaggattcccgtctcaatatcttcaaggcctgcttgaggaagtcacctatcgctaaagatgtggacatcaacgctctcgctaagtacacacagggattcagtggtgctgatatcactgagatttgccagagggcttgcaagtacgccatcagagaaaacattgagaaggacattgaaaaggagaagaggaggagcgagaacccagaagccatggaggaagatatggatgaagtatcagagatcaaagctgcacacttcgaggagtcgatgaagtatgcacgcaggagtgtgagcgatgcagatatcaggaagtaccaagcctttgctcagacgctgcagcagtctagagggtttggttccgagttcaggttcgagactaatgctggttcaggtgcaaccactggagtcgctgatccttttgccacgtctgctgctgctgctgctgcggacgatgatgatctctacaattaagtgatcaagtttatcatactttgttatttaaattttcagtcggattctctctactacttctggataccttgtgtttctttt

SEQ ID NO: 7498 - DNA, 2537 bp, Gnetum gnemon
ggagaaattgcagttcttccgcggagacacgattcttattaagggtaagaaaaggaaagacacgatttgcattgctctggcagacgagacgtgcgaggaaccgaagattagaatgaacaaggtcgtgagatcgaatctaagagttcgtctgggtgatgtggtgtcggtgcatcagtgtcctgatgtcaagtacggcaagcgcgttcatattctccccatcgacgacaccatcgagggtgtcaccggcaatctgtttgatgcttatctcaagccttacttcctggaagcatatcgtccagtgaggaaaggagatctattcttggtacgtggtggaatgcggagtgttgagttcaaggtcatagaaacagatcctggagagtactgtgtggtgtctccggatactgaaatcttctgtgagggagaacccatcaagagagaagatgagaacagacttgatgaagttggttatgatgatgtgggtggtgtccgtaaacagatggcccaaatccgtgagctggttgagctgcccctcaggcatcctcagctgtttaaatccattggtgtcaagccccccaaaggtattctcttgtatggtccacctggttctggaaaaaccttgattgctcgagcagttgccaatgaaactggggcctttttcttcctgataaatggtcctgaaatcatgtcaaagcttgctggtgaaagtgagagtaatttgagaaaggcatttgaagaggctgagaaaaatgccccatctatcattttcattgatgaaattgattcaattgcacccaagagggaaaaaactcacggtgaggttgaaaggagaattgtttcccaacttttaactttgatggatgggctaaagtctcgagcacacgttattgtgattggagcaacaaaccgacccaacagtattgatccagctctcagaagatttggtagatttgatagagaaattgacattggtgtccctgatgaggtgggtcgtcttgaggtgctccgtatacataccaagaatatgaagcttgctgaagatgtggatcttgaaaggattgcaaaggatacacatggatatgttggggccgatcttgctgctctatgcacagaggctgctctccagtgtatccgagagaagatggatgtgattgatctggaggacgaaaccattgatgctgaaattctcaattccatggcagtgacaaatgagcacttccaaacggctttaggctcaagcaacccatctgctcttcgtgaaacagtggttgaggtgcctaacgttagttgggaagatattggtggtttggataatgtcaagagagagcttcaggagactgtccaataccctgttgagcatccagagaagtttgaaaagtttggaatgtcgccctcaaaaggagtgctattctacgggcctcctggttgtggaaaaactcttcttgcaaaagctatagctaacgagtgccaagccaattttattagtgtcaagggtccagagttgctgacaatgtggtttggtgaatctgaggcaaacgtcagagagatatttgacaaggcgcggcagtctgccccatgtgtattatttttcgatgagcttgattcaattgcaacacagagaggaagcagtgttggggatgctggcggtgctgctgatagagtgttgaatcagctattgacagagatggatggaatgaatgcaaagaaaactgtctttataatcggggcaaccaacaggcctgacatcattgatcctgctctgctgagacctggacgacttgatcaattgatctacattcccctgccagacgaagcatcacgttaccaaatctttaaggcttgcctaaggaagtctcctgtagccaaggatgttgatcttacggcacttgctcgctatactaatgggttcagtggtgctgatatcactgaaatttgccagcgggcatgcaaatatgctatcagggaaaatattgaaaaggatattgagcgtgaaaggaaaagaagagaaaatccagaagctatggatgaggatgtcaccgaggacgttgctgagattaaagcagttcattttgaggagtctatgaaatatgctcgacgaagtgttagtgatgctgatattagaaagtaccaagcatttgcacagaccttgcaacagtcccggggatttggatcagagttccgatttgacaggcctccctctgctggggctaccacagctgccgatccatttgcaagctctgaaaacaaagatgatgatgatttgtatagttaagcattgtagtgtgtcaaaattccaggatgttgagctgaatctgcattagtttcatggcacaaccttgtgcaaatggttgtggatatgagctttacttttttttttttagggtttagctcttggaattcgatatttatgagggatatgttttcactcaaactttatgaaaatcagtgcagcatgatgttttcctcaaatggaaaacgttctggttatgatgattttggaagatcattcaccttatttatgttacaaaaaataagactcg

SEQ ID NO: 7499 - DNA, 2521 bp, Amsonia hubrichtii
cttcccctctcctacgtacctctccctatatataccccaaaatcaccaccgcttcctgctagaaatctgttttctgagagcaggaaagcatatataggaacggacccttgtacaattcaagtagagaatcgctgaacaatggcagaaccaagtgcagctgcagagcatggccaaccttctgactcgaaaagtaacaagagggattactctactgcaatcttggagaggaagaagtcccctaatagacttattgttgacgaggccataaatgatgacaattcagttgtttcaatgcaccctgctaaaatggaagcactccagctctttcgaggtgacactattttgattaagggaaagaaaagaaaggacacagtttgcatagttcttgctgatgaacaatgtgaagaagagaaaatccgtatgaacaaagttgttcgttctaacctcagagtacgtctagctgatgttgtatcagtgcatcaatgtcctgatgttaagtatggaaaacgagtccacatccttccaattgatgacacaatcgagggtcttacaggcaatctatttgatgtgtatttgaaaccatacttctttgaatcttacagacctgtgaggaagggtgatctcttccaagttagaggtggcatgcgtagtattgaatttaaggtggttgagacggatcctggggaatactgcgttgtggcaccagatacagagatattctgtgaaggggaacctgtcaagcgtgaagatgaagaaaaactgaatgaagttggatatgatgatgttggtggtgtcaggaagcaaatggcccagatccgtgagctggtggaacttcctttgaggcatcctcagctttttaaggcaattggtgtgaagccaccaaaaggaattttgctttatggacctcctggttctggaaagaccctgattgcaagagctgtagccaatgagactggtgtatttttcttcttgatcaatggccccgaaataatgtcaaaaatggctggtgaaagtgaaagtaacttgaggaaagcatttgaagaagctgaaaagaatgcaccagcaatcatatttattgacgaacttgattcaattgctccaaaaagagagaaaacacatggtgaagtcgagaggcgtatagtttctcagcttctgaccctgatggatggccttaaggctcgatctcatgtcattgttatgggagccacaaatagacccaatagcattgaccctgctctgaggagatttgggagattcgatcgagaaattgacatcggtgtaccagatgaagtaggaaggttggaagtcctccgaatccatacaaaaaatatgaaacttgctgaagatgttgatcttgaaagagttgcaaaagatacacatggctatgtaggtgctgatcttgctgccctgtgcacagagtctgctcttcagtgtattagagagaaaatggatcttattgaccttgaggatgagacaattgatgcagagatattgaattcgatggctgtgaccaatgaacacttccaaacagccctgggtacttcaaatccatcagccctacgtgaaacggttgtggaggttcctaacgtttcatgggaggatattggcggtctagataacgtcaagcgggagcttcaggaaactgttcaatacccagttgagcacccagagaagtttgaaaagtttggcatgtcaccatctaaaggtgttcttttctatgggcctcctggctgtgggaaaacattgctcgctaaagccattgccaatgaatgtcaagccaatttcattagtgttaaggggccagagttgctgaccatgtggtttggagaaagtgaggcaaatgtccgtgaaatatttgacaaggcacggcagtctgccccttgtgtgcttttctttgatgaattggattcaattgctacacagcgtggaagtagtgttggagatgctggtggtgctgcagatagagttcttaatcaactcttgactgaaatggatggaatgaacgctaagaaaacagttttcattattggagcaactaacaggccagacattattgacccggcattgctcaggcctggacgtctagatcagttgatttacatcccacttccagatgatgcttcacgtcttcagattttcaaggcatgtttgaggaagtccccagtctccaaggatgttgacctagcagctcttgcacgtcatactcatggatttagtggcgcagatattaccgaaatttgtcaacgtgcctgcaaatatgccatcagagagaatattgagaaggatattgagaaggaaagaaagaaggcagaaaatcctgaagccatggaagaagatgacacagatgaggtagccgagctaaagcctgcacactttgaggagtctatgaaatttgcacggcgaagtgtcagcgatgcagacatcaggaagtatcagctctttgctcaaacattacagcaatcgcgtggttttgggacagaatttaggtttgcagagcgcactgagaatacagcagcaggtg

SEQ ID NO: 7500 - DNA, 2396 bp, Citrus sinensis
gattactcaactgctattctggagagcaagaagaagtctcccaaccgtcttgtcattgatgaagcaatcaatgatgataactctgttatcacaatgcatcccaacacgatggacaagcttcagtttttccaaggcgacactgtgttagtaaaggggaagaagcgaaaggacaccgtttgcattgttcttggtgacgaacaatgcgaagagtcgaaagtcggaatgaacagagttgtacgatctaatctcagagttcgccttggagatctagtgtccgtccatgcgtgccctgatgtgaaatacggaaggcgtgttcacatccttcccattgatgatacaatcgagggtgttactggaagcttatttgatgcgtatttgaagtcctacttcacgggatcttaccggcctgttcggaaaggtgaccttttcctagtcaggggaggagtgcggagtgttgagtttaaagtaattgagacagaccctggtgaatactgtatcgttgcaccggatactgagatcttctgtgagggcgagcctgtcaaacgtgaggatgaggaggagagattgaacgaagtaggctatgatgatgttggtggtgtgagaaagcaaatggctcaaatccgcgagcttgtagaacttcctctcagacaccctcagctcttcaaatcaattggtgtgaagccccctaagggtatcttgctttatgggccacctgggactggaaaaaccctgattgcaagagccgttgctaatgagactggcgcattcttctttttgattaatggcccggaaattatgtcgaagttagctggtgagagtgaaagcaatctaaggaaggcattcgaggaagctgaaaagaatgccccatctataatatttattgatgaaatagattccattgctccaaagagggagaagacaaatggtgaagtggagaggcgtatagtatcccaacttctaactttgatggatggcctcaagtcccgggcacatgtggttgttatgggagctactaataggccgaacagcattgaccccgctctcaggagattcggacgatttgatcgagagattgacattggtgtacctgatgaagttggaaggttggaagtttttaggatccacacaaaaaacatgaaacttgctgaagatgttgatcttgaaagagttgcaagagatacacatggttatgttggtgcagatcttgctgctctctgtacagaggctgcactccagtgtatcagggagaaaatggatgtcatcgacttggaggatgagactattgatgctgaggtgttgaattcaatggctgtgactaatgagcacttccgaactgcattggagatgtccaatccttcggccttgcgtgaaactgttgtggaggttcctaatgtctcatgggaggatattggtgggttggaaaccgttaagagagagcttcaagagactgttcaatacccagtggagcatcctgaaaagtttgagaaatttggcttgtcaccttctaaaggtgttctcttctatggacctcctggctgtggtaaaacccttcttgcaaaagctattgctaatgagtgtcaggcaaactttgtaagtgtcaaaggacctgagctgctgacaatgtggtttggagagagtgaggcaaacgtgagagaaatctttgacaaggctcgacagtcagctccatgtgtgctattcttcgatgaacttgattcgattgctactcagcgtggcgcttctgttggagatgctggcggcgccgcagatagagtgttgaatcaacttttaactgaaatggatggtatgaatgccaagaaaacagttttcatcataggcgctaccaacaggcctgacgtcattgacccagcattgttgaggccagggcgtctggaccaattgatttatatacccctgccagatgaggcttcccgtcttcagatatttaaagcttgtttacggaagtcacccatctctcctgatgttgacctatcagctcttgcacgttatactcatggtttcagtggcgccgatattactgagatatgtcagcgtgcctgcaaatatgctattcgagagaacattgagaaggacattgagagggagagaagcgggaagaggaagagggagaatcctgaagcaatggaagtagatgacgtcgatgagattacggcagcacactttgaggaatcaatgaaatatgcccgcaggagtgtcagtgatgcagacatccgaaaataccagctctttgcacagactttgcaacaatctcgtggatttggatccgatttccggttcccagatcgaaccgagagtgccaccgcaggggctgctgactttttctcttctgccattgctgatgatgatgatctatacaactgaattagaaccgatgaaag

SEQ ID NO: 7501 - DNA, 2439 bp, Fragaria vesca
aacgcacacatttctgtggattgacaactcacaaagtcaccatgacgaaccaatctgaaggaacaaataagagggactttagcacggccattctcaaccgcaagaaggctccaaaccgccttattgtggatgaagctgtggaggatgataactccgtcgtccaactccacccggagaccatggagaagctccagctctttcgtggcgatacggtcctgatcaagggaaagaagaggagagatacaatttgtattgctttagctgatgattcctgtgaaggaccaaagataaggatgaacaaggttgtgaggaacaacctaagggttaggctaggtgatgttgtttccattcaccagtgcgctgatgtcaagtatggaaagcgtgtccacattctcccaatagatgataccattgaaggcatgactggaaatctgtttgatgtctacttgaggccttatttccaagaggactaccgcccggtgaggaaaagtgaccttttcctagtcagaggaggaatgaggagtgtagagtttaaggttgttgagactgacccggctgagtactgtgtggttgctccagacaccgaaatcttctgcgagggtgaacctgttagaagggaggatgaggagagattagatgaggtagggtatgatgatatcggtggtgttaggaaacagatggctcagattcgcgaattggttgagctgcctctgaggcatcctcagttgtttaaatcgattggtgtcaagccaccaaagggtattcttctctatggtcctcctggaaccggcaagagctgttgctaatgaaaccggggcgttctttttatgtatcaatggaccagaaatcatgtccaagatggctggagagagtgagagcaacctcaggaaagctttcgaggaagcagagaagaatgcgccatcaatcatatttattgatgagattgattcaattgctcccaagagagagaagactaatggggaaattgaaaggaggattgtttcccagctgttgacacttatggatggccttaagtctcgagcacatgtgattgtgatggcagctactaatcgtccaaacagcattgatcctgctcttagaagatttggaagatttgatagggaaatagacattggtgttccagatgaagtcgggcgtcttgaggtcctccgcattcatagcaagaacatgaagcttgctgaagatgtcgatttggaaagggttgccaaggatactcatggctatgttggtgctgacctagctgctttagctactgaggctgcacttcaatgcatccgagagaagatggatgtgattgacttggaagacgagaccatagatgctgagatactcaactcaatggcagtgacaaacgaacacttcaagactgcccttggatcaagcaacccttctgctcttcgtgaaacggtagttgaagttcccaatgtctcttgggatgcaattggaggcctcgaaaaggttaagagagaacttcaagagactgttcaatatcctgttgagcatccggagaaatttgagaaattcggtatgtcaccttcaaaaggagttctcttctatggccctcctggatgcggtaaaactctttttggccaaggctattgctaatgagtgtcaggctaatttcatcagcatcaagggacctgagttgctcaccatgtggtttggagagagtgaggccaatgtaagagaaattttcgacaaggctcgtgcatctgctccatgtgtcctcttcttcgatgagcttgactccattgctactaaaagaggtagcagtgtaggtgattctggaggtgattctggaggtgctgatagggttttgaaccaactgcttacagaaatggatggagtgtctgcgaagaaaacagtcttcattattggggcaaccaacagacctgacatcatagaccctgcacttcttcgtccaggacgtctggatcagttgctttacatccctctccctgatgaggaatctcgccatcaaatattcaaggcttgcttgaggaaatctccggtttccaaagatgtggacctcaatgttcttgccaagaacacacaaggtttcagtggtgctgatatcacagaaatatgccggcgtgcttgcaaatatgccatcagagaaaacattgagaaagatatggagagggagaggaggagaagtgaaaaccctgagattatggaagatgatgaggatgaagtagctgagatcaccaaagctcattttgaggaatcaatgaggtatgctcgcaggagtgttagtgatgctgacatccgcaagtaccagtcttttgcaactacattgcaccaggcaagagggttgggagaggagttcaagttccccactggttcaggggctgctgttggatctgatccgtttgcaactactaatgctggtgaagctaatgatgatctttacgatta

SEQ ID NO: 7502 - DNA, 2874 bp, Picea glauca
  misc_feature (193)..(193): n is a, c, g, or t
  misc_feature (210)..(210): n is a, c, g, or t
  misc_feature (727)..(727): n is a, c, g, or t
gaaaaatacattggccctggtgctggtcgctggtagtggtgggcgaaaataggaaggggaggccactgatacataccatcagatctctcattcattcattggaaatcttcttctgcgacctcgtctcctctgtgcttgtcctttttctatcattgcatcctttgaaatctacaatggcgacctcaatacctgnagaatcatctgaaggangggaacaaagaaagactttagtactgcaatacttgagcgtaagaagtctcctaatcgattagttgtggatgaagccataaatgatgataattcagtggtggctcttaattcgaaaacaatggaaacattgcagcttttccggggtgataccatccttattaagggtaaaaagagaaaggatacagtttgcattgctctggctgatgatacctgtgaagagcataagatcagaatgaacaaagttgttaggtcaaatctaagagtaagattaggggatgtagtatctgttcatcagtgcccagatgtgaagtatgggaagcgtgtgcatattcttcctatagatgacacaatcgaaggtgttacaggaaacttgttcgatgtgtacttgaagtcttacttcttggaagcctatcgcccagtaagaaaaggagacctttttctcgtacgaggaggcatgagaagtgtggaatttaaaatcattgagacagatcctggtgaatattgtgttgtttctccngacactgaaattttttgtgagggagagccaataaaacgagaagatgaagacaggttggatgaagtcggctatgatgatgttggtggtgtaaggaaacaaatggcacaaatcagggaactagttgaattacccctacggcatccacaacttttcaaatccattggtgttaagccccctaagggcattttactttatggtcctcctggttcaggaaaaactttgattgctagggcagtggcaaataagactggagctttctttttcctaattaatggtcctgaaattatgtcaaaacttgctggagaaagtgaaagtaatcttagaaaggcttttgaagaagcagagaagaatgctccctctatcatattcatcgacgaaattgactccatagctccaaagagggagaaaacaaatggtgaagtagagaggcgcattgtatctcaactcttgacattgatggatggtctaaaatctcgagctcatgtgattgtcatgggagcaacaaataggcctaacagcattgatccagcacttagaaggtttggtaggtttgatcgtgaaattgacattggggttccagatgaagttggtcgactggaggttcttcgcatccacacaaagaatatgaagcttgctgaagatgttgatcttgaacgtatttcaaagaatacacacggttatgttggggcagatcttgcagctctttgcaccgaggctgcactacaatgtattagggaaaaaatggatgtcatcgacttggaagatgaaacaattgatgcggaagttctgaattctatggctgttacaaatgagcactttcaggctgcactgggctctagtaacccttctgccctgcgtgagactgttgtggaggtgccaaatatttcttgggaggatattgggggtctggaaaatgtcaaaagagagcttcaggagactgtgcaatatccggtggaacatccggagaaattcgagaagtttggtatgtctccctctaaaggtgtcctcttctatggacctcctggttgtggtaagacgcttcttgcaaaggccattgccaatgagtgtcaggccaacttcatcagcgtgaaaggtccagagctcttgacaatgtggtttggagaaagtgaagccaatgtgcgtgatatttttgataaggccaggcagtcagcaccttgtgtcctattttttgatgagcttgattcaattgctacccagcgtggtagtagtgtgggagatgctgggggtgcggcagacagagttttgaatcagttgctgactgagatggatggcatgactgccaagaaaactgttttcattattggggctacaaatcggcctgacattattgattcggctttattacgacctggtcgccttgatcaattaatatacatacctttacctgatgaagcttcccgctttcaaatctttaaagcatgtttgcggaagtcacctgttgcaaaggatgttgaaattgcaactcttgctcaatacacacagggatttagtggagctgatatcactgaaatttgtcagcgtgcttgcaagtacgctattagagagcatattgaaatggacattgaaagggagaagaaaagaaaggaaaaccctgaagccatggatgaagatgaaactggagttgcagaaataaaggcagctcattttgaggaatcaatgaaatatgcccgacggagtgttagtgatgcagatatacgtaaatatcaagcatttgctcaaacattacagcagtctcgaggttttgggtcggaattccggttcacagatcgggctgctactactacaggcagtgcaggcaccacagatgcttttgctacacaaactgctgttgatgacgatgatctgtacagttgaaatggtgaattacgtgatcaaaaaattatagggtttataacattttgagccagtatccggtgcttagcattttgacaccacacttctgattcatctcccaagtttcagaatgtttggtatttgtgaccttggtgtgcactcttggcatccattgatcagtcactttgtgatttgtttggacttatcctttaattttttcaaattggcagctggatgcatttttacatttattcaaatgaatgcacataaggttgagattacaaaaaaaaaaa

SEQ ID NO: 7503 - DNA, 2475 bp, Malus domestica
atggcgcctctgagtccctctgctcctgatcgttctcagccctcttcgtcttcggacccgaaaagcaacaagaaagatttttcgactgctattttggaacgaaagaagtctcctaatcgacttgttgtcgatgaagctgtcaatgatgataattctgtgatttccttgcaccctgctgcaatggagaagcttcagtttttccgtggagacactgttttaattaagggcaagaaaaggagagacacaatttgcattattattgccgatgatgaatgcgaggaaccgaaaatcagaatgaacaaagttgtgagagctaatcttagggttcgcctcggagatgttgtgtctgttcatccctgcccttatgtcaagtatggaaagaaggttcacatccttccaatcgatgatacaattgaaggagtgacaggaagcttattcgatgcatatttgaagccatacttcgttgattcttaccggcctatgaggaagggtgatcttttcctggttcggggcatgatgcgaagcgttgagttcaaggtcatggagacagaccctgctgagtattgcattgttgcaccggatactgagattttctgtgagggagagcctgtcaaacgtgaggacgaggaaagactagaggatgtgggatatgatgatgttggaggtgttagaaagcaaatggcccagatacgggagttagtagaactgcctcttagacatccgcagctcttcaaatcgattggagttaaacccccgaagggcattttactctatgggccacccgggactggaaaaactttgattgcaagggctgtagcgaatgagactggagcgttctttgttttgatcaatggacctgaaataatgtccaagatggcaggtgaaagtgaaagcaacttgaggaaggtgtttgaggaagccgaaaagaatgcaccctcaatcatttttattgatgagatagattctattgctccaaagagagaaaagacccacggtgaagtggaaaggcgtatagtttcccagctcctgactttaatggacggccttaagtcccgtgcgcatgtcattgtcatgggagcaacgaataggccaaacagcatcgaccctgctctgaggagatttggaagattcgatagagagattgacattggtgtgccggatgaagttggaagattggaagttttacgaatccatacaaagaggatgaaacttgcagatgatgttgatctcgaaagagttgcaaaagatacccatggttttgttggtgcagatcttgctgctctctgcacagaggccgcacttcagtgcatccgcgaaaaaatggatgttattgatttggaagacgaaacgattgatgctgaggtgttgaattcgatggctgtgacgaatgaacactttcagacctcattgtcctctacaaatccttctgccttgcgcgaaactgttgtggaggtaccaaatgtttcgtgggatgccattggtgggttggacaacgtcaaaagagaacttcaagagactgtttcaatccccgtggagcatccagagatgtttgagaaatttggcatgtcgccttctaaaggcgttctcttttatggaccgcctggctgtgggaaaacccttctcgccaaggcaattgccagcgaatgtcaggccaacttcatcagtatcaaaggacccgagttgctaacaatgtggtttggagaaagtgaggccaatgtgcgcgagatatttgacaaggctcgccaatctgctccttgtgttctcttctttgatgagctagactcgattgcaactcagcgtggaaattctgtgggagatgccggtggtgctggagacagagtcttgaaccaacttctaactgaaatggatggaatgaatgcaaagaaaaccgtctttatcattggggcaacaaacaggccagatattattgacccggcattgctcaggcctggacgtcttgaccaacttatctacatcccactcccagatgaggcttcgcgccttcagatttttaaagcatgtttgcgcaagtcccccatctctaaggatattgacctagcagctcttgcccgttatacgcacggttttagtggtgcagatatcactgagatatgtcaacgtgcctgcaaatatgccatcagagaagacattgagaaggatattgagagggaaagaagaaagaatgctaaccccgaagccatggaagaagatgaaattgatgaggtagccgagatcaagccagcacactttgaggaatcgatgaaatatgcccgaagaagtgtgagtgatgcggacatcaagaagtaccagctatttgctcagactttgcagcaatctcgtgggtttggatccgaatttcgatttcctgctcaacagacagagaacaatgcaggagaagctgctctatccccattttcttcagccgcagttgctggagaggaagctgatctctatgattgagaactacaccaatgc

SEQ ID NO: 7504 - DNA, 2603 bp, Helianthus annuus
cgctatgcaccctgccactatggagaaattgcagcttaaccgcggtgagaccattcgcatcaagggaaagaaacgaaaagacacagtctgcattgcccttgctgatgaaacatgtgatgaaccgaaaatcagaatgaacaaggttgttaggactaacttaagaatccgtctcggtgatgttgtgtcagtacatcagtgtccagatgtcaagtatggaaaacgcatacacgttcttccacttgatgacaccatcgaaggtgtcacgggagacttatttgttacatttctgaaaccttacttcttggaggcatatagacctgtaaggaaaggggatcattttctcgttagaggagggatgcgcagcatcgaattcaaagtaatcgaaactgatccaggggaatattgtgttgtcgctcccgacactgagatcttttgtgaaggtgagccgattaagagagacgacgaggatagattggatgaggtgggctatgatgatgtaggcggtgtcaggaaacaaatggcacagattcgtgaattggtggaactaccgttaagacacccgcaacttttcaagtcaataggagtcaaacccccgaaaggaatcttgctctatggacctcctggttccggaaagacactgatagcaagagccgttgctaacgaaaccggagctttctttttcttaatcaacggtccagaaatcatgtcgaaattggctggagaaagtgaaagcaatctccgaaaggcgtttgaggaggccgagaagaacgcgccatcgattattttcattgatgagatagattctatagctccgaagagagagaagactaacggtgaagttgaaagaaggattgtgtcacagcttttgacacttatggatgggttaaaatcgcgggcacatgttattgtaatgggggccacaaatcgcccgaacagcattgatcctgctcttagacggtttggtaggttcgatagggaaattgatattggtgtcccggatgaagttggacgtcttgaggttcttcgtatccatacaaagaacatgaagctttctgaagatgttgatttggaaaagatatctaaagaaacacatggttatgttggtgctgatttggctgctctttgcactgaagcagcacttcaatgcattagagaaaaaatggatgttatcgatttggaagatgaatctattgacgctgagatactcaactctatggcagtcacaaatgaacatttctctactgctcttggaactagcaacccgtctgctctgcgtgagaccgttgttgaggttccaaatgttagctgggaggatattggaggccttgagaatgttaagcgtgagcttcaagagacggtgcaatatccagtggagcatccagagaagttcgagaaatttggcatgtcaccatcgaaaggagttcttttctacggtcctcctggatgtggtaaaacactgctggcaaaagctattgcaaatgaatgccaagcaaatttcattagtatcaaaggacctgaactactaacaatgtggttcggggagagtgaagctaatgttcgcgagattttcgacaaagccagaggatctgcgccatgtgtccttttctttgatgaacttgactccattgcaactcagaggggaagcagttctggagatgcaggtggtgctgctgaccgggttttgaatcaactattgactgaaatggacggaatgtctgctaaaaagactgttttcataattggagctacgaaccgacctgacattattgacccggctttacttcgacccgggcgtcttgatcaactaatttacattccactgccagatgaggactcacgttatgcgatttttaaggctgcaatgaggaaatcccctgtttccaaagatgttgatttgagagcacttgctaggtacactcaagggtttagtggtgctgatattactgagatatgtcaacgcgcctgcaagtatgcgatcagagagaacattgaaaaagatatagagagggaaagaaagaggagtgagaatcctgattccatggatgaggatgatgatgatgtggcggagataaaggcggctcattttgaggaatcaatgaagtatgcacgcagaagtgtgagtgacgctgacatcaggaagtaccaggcgtttgctcagacattgcagcagtcgagaggatttgggtctgaattccggttctcggagacgtctggtggggctgctaatgcgtctgatccgtttgctgcttctggtggtggagctgatgatgacgacctatacagttaggttttattataaacaaggtgatgttttaagaaagaaatagactttgaggatttccgttctgttctggcaatttggtttctcttgatgggagagagaagaagacttattgtgcattatcaagtgatggaatcttgttttcatttgaacatgtgtttatgtatggtttaactttatactcttgctttgttggcaaatactacatttgatgtttcaactaaattttttgggttttcaagctcatatgacttgagcctaaagttgcatgcatggtcatttccagaagcagcaaacggatcagacgcattagcagccccac

SEQ ID NO: 7505 - DNA, 2829 bp, Helianthus annuus
tcctcctccttcctctgcggttactcggagaacgttggagatcatgttactcatccaatcagatgattttaattctgaatttcagcttaatttgagtataataagtttatgttgcttttgattttgtagctaattaggtctgtggatatgaaatgttagggcttgttgaatttttatgcaattgaattgtgatttacggtaaaattatgtgacatgtagtttaattataggtgaaaaccagtatcttgaatgcagggtttgagatttctaggttttcagaattgaatgtttattatgaactgctagtgtttgtcaaatttttatgcaattaaatggtgaattatggtaaattcatgtcacatgttgtttagttgtaggttaaaaccagtatgcttaggtattgaaaaacttggttgaaggggaagaaaaggaaagatacggtatgtatcgcgcttgctgacgaaagttgtgaagagccaaagattagaatgaacaaggttattagaacaaacctccgggttcggctcggtgatgttgtatcggtgcaccagtgtccggatgtgaagtacgggaaacggattcacgtgcttccattagacgacaccattgaaggtgtcacaggggacttgtttgatgcgtatctaaaaccttactttttggaggcgtatagacccgtaagaaaaggggatcattttcttgttagaggaggtatgagaagcgtagagtttaaagtaatcgaaaccgacccaggggagtactgcgttgttgcaccgaataccgaaattttttgtgagggtgagccgatcaagcgggatgatgaggatcggttggatgaaatcggttacgatgacgttggtggggtccggaaacaaatggctcagattcgtgaactggtcgagttgccgttacgacaccctcaactgttcaaatcaatcggagttaaaccccctaaaggtatcttactctacggaccccccggttcgggcaaaacactcatcgcaagagccgtagctaacgaaaccggagcattctttttctgtatcaacgggccggaaattatgtcgaagttagctggagagagtgagagtaatcttcggaaggcatttgaggaggctgaaaagaacgccccatcgattatttttattgatgagattgattcgattgctcccaaacgggaaaaaactaacggtgaagttgaaaggaggattgtttcacagttactgacgcttatggatggcttaaaatcacgtgcacatgttattgtaatgggggctacgaatcggccgaacagtattgatcctgctttgagacggtttggtaggttcgatagagaaattgacattggtgtccctgatgaagttgggcgtcttgaggttgttcgtattcacacgaagaacatgaaactttctgatgatgttgatttggaaaagatagctaaagaaacacatggttatgtcggtgctgatctggctgcactctgcaccgaagctgcactacaatgcatcagagagaaaatggatgttatcgacttggaagacgactctattgatgctgagatactgaactcaatggcagtaacaaacgagcattttcagacagctcttggaacaagcaatccctctgctttgcgcgagactgttgtggaggttcccaatgtcagctgggaggatattggaggtcttgaaaatgttaagcgttagctgcaggagactgtccaatatcccgtggagcatccggagaaattcgagaaatttggcatgtcaccatcaaaaggtgttcttttctatggcccacctgggtgcggcaagacacttctagctaaggctattgcaaacgagtgtcaagccaacttcattagcatcaaagggcccgagttgcttacaatgtggtttggtgagagtgaagccaatgttcgtgagatctttgataaggcccgtgggtctgcaccgtgtgtcctcttcttcgatgaactcgattctattgcaacccagaggggaagtagttctggagatgcaggcggtgcagctgatcgcgtgttgaatcagttattaacggaaatggacggaatgtctgccaaaaagacggttttcataatcggagccacgaatagacccgacatcattgaccctgcgttactccgtccagggcgtcttgatcaacttatttatatcccgctaccagatgaagattcacgccaccagattttcaaggcggcaatgaggaagtctccggtttccaaggatgttgatttgagagctttagctaaatatacacaaggctttagtggggccgatattacagagatatgtcagcgtgcctgcaagtatgcaatccgagagaacatcgagaaggatatagagaaggaaaggaagagaagtgcgaatcccgactctatggatgaggatgaagatgaggtggcggagattaaggctgcccacttcgaggaatccatgaaatatgcacgcagaagtgtgagtgatgctgatataaggaagtaccaggcgtttgctcagacgttgcagcagtctcgagggtttgggtcggaattccggttccctgaagcggcatctggagctggtggcggtggatctgacccgtttgctgcctctgctggtggagctgatgatgatgacttgtacagctagatttacgtaaatcatgttgctgaagtcaagattcattagggattatgtatttatatgctattataccaattgccgattcattgctggttttcaaacctattgttctgttgttggaacatgtattcacgtttcatgttataagtttggatttggcattctcgtttcagttgaactcttttgtttc

SEQ ID NO: 7506 - DNA, 2409 bp, Tripterygium wilfordii
taccattctcatcaagggtaagaaacggaaggatacaatatgtattgctcttgctgatgactcatgtgagcagccaaggatcagaatgaacaaggttgttagatcaaatctaagggttcgactaggagatgttgtatctgtgcaccaatgcccggatgttaagtatggaaatcgtgttcacatattgccaattgacgatacaatagaaggtgttactgggaacctgtttgatgcatatctgaaaccgtacttcttagagtcttatcgacctgtgaggaaaggagacctattccttgttagaggagggatgagaagtgtggagttcaaagtgattgaaactgaccctggagagtattgtgtggttgcacccgacactgaaatattctgcgagggagagcctgtgagaagggaggatgaggatagattggatgaaatagggtatgacgatgttggtggtgttcgcaaacagatggcccagattcgtgagctagtggagctgccattaaggcatcctcaactttttaaatcaattggtgtaaaaccaccaaaaggaattctattgtatggacctccaggttctggtaagacattgatagccagggctgttgctaatgaaactggtgctttcttcttttgtattaatggcccagagataatgtccaaattggctggtgagagtgaaagcaatctcaggaaggcatttgaagaagctgagaagaatgccccttccatcatctttattgatgagcttgattcaatcgctcccaagcgtgagaaaacccatggtgaagttgaaaggcggattgtttcacagcttttgactcttatggatggactgaaatcgcgagcccatgttattgttattggtgctacaaaccgaccgaacagtattgatcctgctctgagaaggtttggtaggttcgacagggaaattgacattggagttccagatgaagttgggcgtcttgaagttcttcgcatccataccaagaacatgaagctttctgataatgtggatttagaaagaatcggaaaagatactcatggatatgttggtgctgaccttgctgctttatgcactgaagctgctctgcagtgcatcagagaaaagatggatgtgattgacttggaggatgaaaccattgatgctgagatactaaattccatggctgttacaaatgatcacttccagattgctcttggaacaagcaatccatctgcattgcgtgaaacagtcgtcgaagtgcccaatgtcagctgggaggatattggtggtctcacgaacgtgaagagggaacttcaagagactgttcagtaccctgtggagcatccagaaaagtttgagaagtttggaatgtcaccatcaaaaggggtcctattctatggtccgcctggatgtgggaaaactttgctggcaaaggcaattgcaaatgaatgtcaggctaacttcatcagtgtgaaaggccctgaactgctcaccatgtggttcggtgagagtgaagctaatgtccgagaaatatttgacaaggctcgacaatctgcaccatgtgttcttttctttgatgagcttgactctattgcaactcagaggggaagcagtgttggggatgcagggggtgccgcagatcgagtcttaaaccagcttctgactgaaatggatggcatgtcagccaaaaagactgtttttatcattggggccacgaacagacctgatattattgaccctgcacttttgcggccagggcgtcttgatcaattaatttatatccctcttccagacgaggagtcacgattacaaattttcaaagcctgcttgagaaaatcacctgtctcgaaagatgttgatttggggacactggctaaatatactcaaggcttcagtggagctgatatcacggagatatgtcagcgagcatgcaaatatgctataagagagaatatagagaaggatatcgaaatggagaggaggagaagtgagaatcctgaatctatggacgaggacaccgaggaagaagtggcagagatcaaggctgctcatttcgaggaatcaatgaagtttgctcgtagaagcgtcagtgatgctgatatacgcaaataccaggcttttgcacagacgctgcagcagtccaggggatttggaactgaatttaggtttccagaaacagggtctggcgctgcagcagctgctgatccgttttcaacttctgctgctgctggggctgatgaagatgatttgtatagttaagtttctatcttctatttaagtttgtcatcctaataatatgggacctctgtaggagtaacttttttcccacttgggacatggctctcctggtcaattactgtaattatttttagacttttccaactccagggttcagtgtttgctactgaattttatattttacg

SEQ ID NO: 7507 - DNA, 2438 bp, Medicago truncatula
ggaatttgtttgataatattgaagtttttggtttgaatttcaggaaatctggggctgggaagaaggacttctccaccgcgattctggaacgtaagaaggcgccaaatcggcttgtcgtggacgaggctgttaacggtgataactctattgtcgccatgcaccctcaaaccatggaaaagttagggcttttccgaggcgatactatcctcatcaagggaaagaaaaggaaggatagtgtttgtattgctcttggtgatgatacctgtgaagagcctaggattaggatgaacaaagttgtgaggtcgaatttgcgagttcggcttggagatgttgtgtctgtgcatcagtgtactgatgtcaagtatggtaaacgtgtgcacattctgcctattgatgatacaattgaaggtctcactggaaatctctttgatgctttcttgaaaccctatttcgtggaagcttatcgtcccgtcagaaaaggagatctatttcttgtgcggggagggatgagaagtgtagagtttaaggtcattgaaactgatcctggtgagtactgtacggttgctccagacactgagatcttctgtgagggggaacctgtgaaaagagatgatgaagaaagacttgatgaagttggttatgatgatgtgggtggtgttaggaagcaaatggcacagattcgcgagttggtcgagcttccacttaggcatccacaactttttaagtcaattggtgcgaaagcacctaaaggaattttgctttctggacccccaggtaccggaaagacattaatagcaagagctattgctaatgaaactggagctttcttcttttgtattaatggaccagagattatgtccaaactggctggagagagtgaaagcaatcttaggaaagcgtttgaagaagcagaaaagaatgcaccatccatcatctttattgatgaaattgattctattgcacccaagcgggacaagacaaatggtgaagtagaaagaaggattgtttcacaacttctgactcttatggatgggctaaaatcccgtgctcatgttattgtcatgggggccactaatcgccccaatagcattgacccggcattgagaaggtttggtagatttgatagggaaatcgatattggtgttccagatgaaattgggcgacttgaagtccttcgcatacataccaaaaacatgaagctctcatatgatgttgatttggagagaatttcaaaaaatactcatgggtatgttggtgctgaccttgctgctctttgcactgaagctgctctacaatgcattagggagaagatggacgtcattgacttagaggatgagactattgatgctgaaatactaaattccatggcagttacaaatgagcatttgcatactgcacttggaacaagcaacccatcagctctacgcgaaactgttgttgaggtgcctaatgtcagctgggaggacatcggaggccttgagaatgtcaagcgtgaactgcaagagactgttcaatatccggttgagcacccggaaaagtttgagaagtttgggatgtcaccatccaaaggagttctcttctatggtcctccgggatgtggaaaaactttgttagccaaagcaattgctaatgaatgtcaagctaacttcatcagtataaaaggcccagagttgcttacaatgtggtttggtgaaagtgaggccaatgttagggaaatatttgacaaggctagacaatcagctccatgtgtcctcttttttgatgagcttgactccattgccactcagagagggagcagtgttggggatgctggtggcgccgctgatagagtgctaaatcaacttctgacagaaatggatggcatgtctgccaaaaagactgtgttcattattggggcaactaacagacctgacatcattgatccagcacttcttcggccaggccgtctagatcagttgatctatattcctctacctgatgaggattcccgtcattcgatcttcaagtcttgcttgagaaagtcaccgatcgcgaaaaatgttgatttgggagcattggctaggcatactcaaggttttagtggtgcagacattacagaaatatgccagcgagcatgcaaatatgctataagagaaaacatagagaaggacatagagcaagagaggaagaggaaggaaaaccctgagggcatggatgaagacttggtagacgaaatagttgcagagattaaagctgctcattttgaggagtccatgaagtatgcacgtaggagtgtcagtgatgctgatatacgcaaatatcaagcatttgctcagactctacaacaatcaaggggatttggaagtgaatttagattttcaaataccgcaactagtgctattgtatctgaccaccttacaactactactggaggggcagatgaagatgatctatatagt

SEQ ID NO: 7508 - DNA, 2300 bp, Pteridium aquilinum
ccgttctcattaagggaaagaagcgaaaagatactgtctgcattgttcttgcagatgatacttgcgatgagcacaagattaaaatgaacaaagtagtgagagcaaacttgcgggtacgattgggtgatgtgatctccatccaccagtgtcctgatgtgaaatatgggaagcgcgtccacattcttcctattgatgatacgattgaaggagttactggaaacttatttgatgcttacttgaaaccttacttcctggaggcttaccggcctgtgaggaaaggagatcttttcttggttcgtggtggaatgcgcagtgtagagttcaaagtgatagagacagatccagcagagtactgcattgttgctccagatactgagatattctgtgaaggggacccgattcgcagggaagacgaggaaagacttgatgaagttggttatgatgatgttggtggtgtccgtaagcaaatggctcaaatcagggagcttgttgagcttccgctccgtcatccccagctttttaagtccattggtgtgaagcctcctaaaggaattctcctttttggccccccaggttctggcaaaactctgattgccagggcagtggcaaatgaaacaggtgctttctttttcctgattaatggtcctgaaatcatgtctaagctggctggtgaaagcgagagcaacttgcggaaagcatttgaggaggcagagaagaatgccccctcaattatatttatagatgagatagattccattgctcccaagagggaaaagaccaatggtgaagtggagcgccgaattgtgtcacaactactgaccttgatggatggtttgaagtctcgatcccatgtcattgtaatgggagctacaaataggcctaacagcattgatcctgcactgagacggtttggaaggtttgatagggaaattgacattggggtacccgatgaggtgggccgtttggaggtgctgcgaatccacacgaagaacatgaagctttcagaggatgttgatctggagaggatcgcaaaagatactcatggttttgtgggagcagacttggcagcattgtgcaccgaagctgcattacaatgcatcagggaaaagatggatgtcattgatttagaagatgagactatagatgctgaagtcctcaactccatggctgtcaccaatgagcacttccagaccgccctaggaatcagcaatccatcagctttacgggaaactgttgtcgaagtacctaatgtttcttgggaagacattggtgggctggataatgtcaaacgagagcttcaggagacggtgcagtatccagtcgagcatccagaaaagttcgaaaagtttgggatgtctccatccaagggtgtactgttttatggacctcctggctgtgggaaaactttgctcgctaaagctattgcaaacgagtgtcaagcaaactttatcagtgtgaagggtccggagttgttgacgatgtggtttggtgaaagtgaggccaatgtgcgagatgtgtttgacaaggctagacagtctgctccttgtgtgctattctttgatgagctcgactccattgctacccagcgtggaagtagtgttggcgatgctggtggtgctgcagatcgggtactgaaccagcttttgacagaaatggatggaatgactgcgaagaagactgtttttataattggagccacaaataggcccgacattattgatccagctttgcttcgtcctggtagattagatcaattgatctacattcccctgccagatgaagggtcacgtctgaagattttccaagcgtgtcttcggaaatcacctgttgccaaagatgttgatttaagtgctttagctcgttacactcaaggttttagtggagcagacattaccgagatatgtcagcgggcttgtaaatatgcaatcagggagaacattgagaaggatattgaactcgagaaaaagagaaaagagaaccctgaagctatggaagaggatgaagttgatgaaatttctgagattaaagcagctcactttgaagagtccatgaagtatgcgcgcaggagtgttggagatgcggacattcgaaagtaccaggcgtttgcacagactctgcagcaatcacgtggctttggttctgagtttcgttttccagatcgtcctgctactgcagcggcagcaggtggtacagatacctttggccaggctgctgcagctgatgatgatgatctatacaactgaggataattgttgcactggggtgtttgtgccaaagatggcttggaggccttgccggca

SEQ ID NO: 7509 - DNA, 2471 bp, Tropaeolum majus
cattgcccttgctgatgacacatgtgatgaaccaaaaatcagaatgaacaaggttgtgaggtctaacttgagggtcaggcttggggatgttgtttctgtgcaccaatgccctgatgttaaatacggaaagcgtgtgcacatattgccagttgatgataccattgaaggtgttactgggaatctgtttgatgcatacctgaaaccttatttcctggagtcgtatagacctgtgaggaagggtgatcttttccttgtgagaggaggcatgagaagtgttgagttcaaagttattgagactgatccctctgagtactgtgtcgttgctccagacacagaaatattctgtgagggagaaccagtgaggagggaggatgaagatagattggatgaggttggttatgatgatgtcggtggtgttagaaaacagatggcacaaattcgtgaactggtggaacttccattaaggcatccccaactattcaagtctattggtgtgaaaccacctaaaggaattctactttacggacctccaggatctggaaaaactctgattgcacgtgctgttgccaatgaaactggtgctttcttctttgcatcaatggaccagagattatgtccaaattggctggtgagagtgagagtaatctcaggaaagcctttgaggaagcagagaaaaatgcgccgtccattattttcattgatgaaattgattcaattgctcctaagagagagaagacaaatggagaagttgaaaggaggattgtctctcagctattgacacttatggatggactgaaatcgcgtgcacatgtaatcgttatgggggcaacaaatcgtcctaacagtattgaccctgctctccgaaggtttgggagatttgatagggaaatagatatcggagttcctgatgaaattgggagacttgaggttcttcgtattcatacaaagaacatgaagcttgctgaagatgttgatttggaaaaaatatccaaggaaacacatggttatgttggtgctgatctcgcagccctatgtaccgaggctgcacttcagtgcattagggagaagatggatgtcattgacttggaagatgactcgatagatgctgagatcctcaattccatggcagtcacaaatgaacactttcagactgcacttggaactagcaatccatctgctctacgtgaaactgttgtcgaggtgcctaatgtcagttggcaagatattggcggtctcgagaatgtcaaaagagagcttcaagagactgtccaatatcctgttgaacatccggaaaaattcgaaaaatttgggatgtcgccttcgaagggggtccttttctatggccctcctggatgtgggaagacacttctggccaaagctattgccaatgaatgccaggccaacttcatcagtattaagggtcctgaattgctcactatgtggttcggagagagtgaagcaaatgttcgagaaatttttgataaagcccgtggatctgcaccttgtgtccttttctttgatgaacttgactcaattgctacccagagaggaagcagttcaggagatgctggtggtgctgctgatagggttttgaaccagcttctgacagaaatggatggcatgtctgccaagaaaactgttttcatcattggggctactaacagacccgatattattgatcctgcacttcttcgtccaggccgtcttgatcaactcatctatatacccctcccagacgaggaatctagataccaaattttcaagtcttgcttgaggaaatccccagtctccaaagatgttgaccttagagctcttgcaaaatacacccaaggcttcagtggtgctgatatcactgaaatatgccagcgttcctgcaaatacgcaatcagggagaacattgagaaggatattgagaaggagaggaagagaggggagaatcctgaggctatggaggaggatggtgaggatgaagtatccgaaatcaaggcagcacatttcgaggaatcaatgaagtatgctcggagaagtgtgagtgatgcagacattcgcaagtaccaggcgtttgctcaaacattacagcagtcgagaggttttggatctgaattcaggttttcggaagttggaagtggagctgctgctgctggtggtgcgtctgatccatttgcagcgtccgcaggtgggggtgatgaagatgacctttacagttaaaatatgttggatcacaacctattttatctgttattttacgtaaagaccgagatgtttacatttaagatgctagatttgtactcttctaaacgttatattatttagtaactagcagtttcttttgttcgcaagcaatcaagtttcgcgtaaaccgtatacgttttcattttagagttggtttgcatgaggaatattggtgtttagctttactacaataaaatgttattgtaattgctgaaagttcaattggcgctgctgcctgg

SEQ ID NO: 7510 - DNA, 3700 bp, Chlamydomonas reinhardtii
gtggatttcaagctttgaagcgaaaaacgggagacttacttgaggctccatgcactcgcgtttcgatttaggggcccgcgtctacactcatcgaggcttcattctgctgtagtcgttaaagccacacggtaacttgtctataccagtacttttgcgagttacccctgtgacactttgtcgcttcttgaatcttactcctcccagagccagttgctctaggaccccgcacaaatggctgatgccagcacgtccgcggacgctagcaagaaggatgccaacaagaaggacttcagcacggccattatggaccgtaagaagagccccaaccgcctcattgtggaggaggcggtgaacgacgacaactcggtggtcgccctgcaccctaagaccatggagaagctgcagctgttccgcggcgacacggtgctcctgaagggcaagaagcggaaggacacggtgtgcatcgtgctgtcggatgacacggttgatgagaacaagatccgtatgaacaaggttgttcgcaagaaccttcgtgtgcgcctggcggacatcgtgtccgtgcaccagtgcaccgacgtcaagtacggcaagcgcatccacgtgctgcccatcgacgacaccattgagggcatcagcggcaacctttttgacgcctacctgaagccctacttcctggaggcctaccgccccgtgcgcaagggcgacaccttcctggcccgcggcggcatgcgcagcgtggagttcaaggtggtggagaccgaccccgccgagtactgcattgtggcgcccgacaccgagatcttctgcgagggcgagcccatcaagcgcgaggacgaggagaagctggacgaggtgggctacgacgacattggcggtgtgcgcaagcagctggcccagatccgtgagctggtggagctgccgctgcgccacccgcagctgttcaagaccattggtgtcaagccgcccaagggcatcctgctgtacggcccgcccggcagtggcaagacgctgattgcccgtgccgtggccaatgagacgggcgccttcttcgtggtggtcaacggcccggagatcatgtccaagctggcgggagagtcggagagcaacctgcgcaaggtgttccaggaggctgagaagaacgcgccctccatcatcttcatcgatgaggtggactccatcgcgcccaagcgtgagaagacccagggtgaggtggagcgccgcatcgtgtcgcagctgctgacgctgatggacggcctgaagagccgcgcgcacgtgatcgtgatcgccgccaccaaccgccccaactccatcgaccccgcgctgcgccgcttcggccgcttcgaccgcgagattgacatcggcgtgccggatgagaccggccgcctggaggtcatgcgcatccacaccaagaacatgaagctggacgaggacgtgaacctggaggccatcagccgcgacacgcacggctacgtgggcgccgaccttgcggcgctgtgcacggaggcggcgctgcagtgcatccgcgagaagatggacgtgattgacctggaggacgagcagattgacgccgaggtgctcaacagcatggcggtcacgcaggaccacttcaagaccgccctgggcatgagcaaccccagcgcgctgcgcgagacggtggtggaggtgcccaacgtgagctgggacgccatcggtggcctggagaacgtcaagcgcgagctgcaggagctgatccagtacccggtggagcaccccgagaagtttgagaagttcggcatgtcgccctccaagggtgtgttgttctacggcccgcccggctgcggcaagacgctgctggccaaggccatcgccaacgagtgccaggccaacttcatctccgtcaagggccccgagctgctgaccatgtggttcggcgagtcggaggccaatgtgcgtgagatcttcgacaaggcccgcggctccgcgccgtgcgtgctcttcttcgacgagttggactccatcgcggtgcagcgcggctcctccgccggcgacgccggcggcgccgccgaccgcgtgctgaaccagctgctgacggagatggacggcatgaacagcaagaagacggtgttcatcatcggcgccaccaaccgccccgacatcatcgaccccgcgctgctgcgccccggccgcctggaccagctcatctacatcccgctgccggacgagggctcgcgccgccagatcttcaaggcctgccttcgcaagtcgcccatcgcgcccgacgtggacttcgacacgctggtgaagttcactcacggcttctccggcgccgacatgactgagatctgccagcgcgcctgcaagtcggccattcgcgaggacatcgagaagaacattgagcgcgagcgccggcgagctgagaaccccgacgccatgatggaggacgagcccgacccggtgccctgcattaccaaggcgcacttcgaggaggcgatgaagtacgcccgccgctccgtgagcgacgccgacatccgcaagtaccaggcctttgcgcagacgctgcagcagagccgcggctttggaaccgacttccgcttccccgacggccccggcggcgcccccgctgccgccggcgccgcgcccgccgctgccgcccccgccttcgcgcaaagcgcggcggccgcggacgacgatgacctgtacaactaaagcgccacgcttctaacacgtgcgcaaacacgcgggagcgtgttacgcatgtgtgtggcatgatgcgcgtctggaggtgacgcagcagtccgttaatgaaggcatgcggacgagcgggggctattggccaagggttctcgaggtgcgcacgcgcgcacctgcattccgcggcgcgctgtgcagcgagctgagtttgtgttgtagacacagctgccgggtcccgattgatgtggctgccggacaggggggggtcctacgatttgcgggcccaggtccattgcggagtgttgttttgacgtgactgacccgactagacgatgtggttattcgtgctgatcgtacctgacgtgtttggcatttgttccatgagaggctctgtcggcctccttccggaatccggattcagtgcgttgtttgtgcgttcaaggagtcgctgtgccggtacgcaactaggcattagaaagagagtggtgccgtaatgggctctgcatgctgtgggcggatgtcgccttgagcgaccgggtcgcctgaaagcttgcactgcattgttgcatgcttagggaaggggtacagagccggggaaagaagaaaggcatgagtcgtcacgcgggtatggggcgggctgtaggcaggttggcaacaacgtttctctctaaacttcatcgaactctctcacgtgtggcgtgtgcatctcccccgcgtgagcgggacgtgtgcggtgtggtcgtgcgcgacggggccgtgtagggtgccggtagaccagtgctgcggactgttgcgtacgtacgcgtagacaggcgagagggagaggggtgcattgactccagcggggagtggccgttgcgcaggttgcggtgtcacggctagcattgcggctcgcaactcgtaggaccgagtcgcgacaagcctgctacggctgttgcggcaggagccgggcggacatgttgccgcagacggcgccgcggcgctgtggggcaactcccaccgcagctgtgtaacacttggattccgctca

SEQ ID NO: 7511 - DNA, 2727 bp, Solanum phureja
ctcgtatgttctattttataaaaattaaataagtagatgcttttatgtttctgtgatcacaagtttgatttactgaatttgatgatctttctaattgtttcaattttaggaaaaacaataaaaaagattttgctactgcaattttggagaggaagaaatctcctaaccgccttattgttgatgaggccataaatgatgataattcagtggtatctatgcaccctgctaaaatggaagagctccagttgtttagaggagatactgtattgctaaagggtaaaaaacggaaggacactgtttgtgtagtccttgcggatgagcaatgtgaagaacataagatcagattgaacaaagtcgttcgggcgaaccttcggattcgtcttggggatgttgtatctgtgcaccagtgtcctgatgttaagtatgcgaagcgtgttcatattcttccaattgatgatacaattgaggggatgactggcaacctgtttgatgcctacttgaagccatacttcttggagtcttaccgccctgtgaggaagggcgatctctttgtagtcagaggtggcatgcgaagtgttgaatttaaagtggttgagacagaacctggagaatattgtgttgttgcacctgatacagagatcttttgtgagggagaaccaatcaagcgtgaagacgaggagagactaaatgaagttggatatgatgatgttgggggtatgaggaagcaaatggctcagattcgtgagctggttgaactccctctgaggcatccacagttgttcaagtcaattggtgtgaaaccaccgaaaggtattctcctgtatggtcctccaggatcggggaaaaccctgattggaagagcggtggcaaatgagactggtgcctttttctttttgattaatgggcctgaaattatgtccaaattggctggtgagagtgagggtaacttgaggaaggcatttgaggaagccgaaaagaatgcgccgtctattatatttattgatgagttagactcgattgctccaaagagagaaaagacacatggtgaagttgagcggcgaatagtttcccaacttttgacattaatggatgggctcaagtctcgatcacatgtggttgtcatgggggctaccaacagaccaaacagtattgatcctgctctcaggagatttggaagatttgatcgggagattgacattggcgtaccagatgaaatagggcggctggagatcctacggattcatactaaaaacatgaagcttgatgataatgttgatctagagagggttgcaagagatacacatggttatgtcggagctgatcttgctgccttgtgcactgaggctgcgctgcagtgtatcagggagaaaatggatgttattgacttggaggatgagaccattgatgctgaagtgttgaattcaatggctgtgactaatgagcattttcaagctgctctgggtgcttcaaatccatcagcactacgagaaacggtagtggaggttcccaatacctcttgggaggatattgggggactggaaaatgtcaagcgggaacttcaagagactgttcagtatccggttgagcatcctgagaagtttgagaagtttggaatgtcaccctctaaaggggtacttttctatggaccacctggttgtggcaaaactttactggccaaagctattgcaaatgagtgtcaggctaactttattagtgtgaaagggccggagttgctcacgatgtggtttggagaaagtgaagcaaatgttcgggaaatatttgacaaggcacggcaatctgctccatgtgtactgttctttgatgaactcgattccattgctacacagagaggaaattcagtgggagatgctggtggtgctgctgatagagtactcaatcaattgttaacggagatggatggaatgacagcaaagaaaacagttttcattattggggcaacaaataggccagacattattgaccctgcattgctcagaccaggtcgtctagaccaattaatttacatccccctcccggatgaagcttcccgtcttcaaatcttcaaagcatgtttgcgtaagtcccccgtcgcaaaggacgtagatctgtcagctctatcacggtatacacgtggttttagtggtgcagacataactgagatttgtcagcgagcatgcaaatacgccattagggaaaacattgaaaaggatattgagcgagagaggaagaggagcgtgaaccctgaagccatggatgaagatgacactgatgaagtggctgaaataaaggctgcacactttgaggagtccatgaaatatgctcgaagaagtgtgagtgatgctgacattaggaagtaccaggcttttgctcaaacattacaacaatcacggggacttggaactgagttcaaatttgcagagcatgcagctaatgctacaccaaccggggcaacagccgatccattcgcttctgttaatgctgctggagacgaggacgacttgtacagttaagaagttaaccttgagcacaaggatgctagggatgctggaaaaatggaatgttagtgtaagtagaataactaggtgtgttatcatgttgcaacttttgtattaaagaaatattagtgacaatgcacctaaatgttttttcccctgtggatgttatgtaatgtactaatcttataggctataacaagaattgagatgcatctgtctttgatagattgtt

SEQ ID NO: 7512 - DNA, 2425 bp, Aquilegia formosa
tatatactaaaccctaaaacaaagaatatggctggttcaagtgagaagaaagattactctactgctatattggaacgtaaaaaggctcctaatcgtctggtagttgatgaagctgttaatgatgataattctattgtttccctgcaccctgcaacaatggagaagcttcagtttttcagaggagatactattctacttaaggggaaaaggcgaaaagacacactgtgtatcgttgttgaagacgaagaatgtgaagaacataaagtcagagtgaacaaagttgcgcgtgctaatctgagagtgcgcttgggagatgtggtatctgttcatatgtgccctgagctgcaatatgggaagcggattcatgtgcttcctatggatgatactgtagagggcttgactggcgacttgtttgagccctatttgaagccatatttctgcgactctttccgacctctcagaaagggtaaccttttcttagttaggggaggcatgcgaagtgtggagttcaaggtagttgaaacagaccctcctgagtattgtattgttgctgcagatactgagattttctgtgaaggagaacctatcaagcgtgaggatgaagagagattggatgaagttggttatgatgatgttggaggtcttaggaagcaaatggctcagattcgtgagcttcttgaacttccactcagacaccctgagctttttaaatgtattggtatcaaacctcctaaaggtatccttctctatggccctccaggatctgggaaaaccttgattgcgagagctgtggccaatgaaacgggagcctttttcttatgtataaatggacctgagataatgtcaaagatgtctggtgaaagtgaatcaaatttgaggaaggcatttgacgaagcagaaaagaacgctccttctatcatcttcattgacgagattgacagcattgccccaaagagagacaagacaaatggcgaagtggagaaacgcatagttgcgcaactgctgactttaatggatggtcttaagagccgagctcatgtggttgtcatgggagctactaataggcctaacagcattgatccagctttgaggagatttgggaggtttgatcgagagattgatattggcgtgcccgatgaggttggaaggctagaggttctgagaattcataccaaaaatatgaagctatcagaagatgtagatcttgaattagctgcaaaagagacccatgggtatgttggcgcagatcttgctgcgctttgtaccgaggctgcccttcagtgcatcagagagaagatggatattatcgatttggaagatgaaacaattgatgcagaggtactaaatatgatggctatcacaaatgatcactttaaaactgctttaggaacttcaaatccatcagcattgcgtgaaacggttgtggaagtgcccaatgtttcgtgggctgatattggagggttagattctgttaaaagggagctccaggagactgtccaatacccagtggagcatcctgaaaagttcgagaaattcggtatgtctccatccaaaggtgttctcttttacggccctcctggatgtggtaaaacccttcttgcgaaggcaatcgcaaatgaatgccaggctaacttcataagtatcaagggacctgagctattgactatgtggtttggagagagcgaggcaaatgtacgagagatatttgataaagctcgccagtctgctccatgtgttctgttctttgatgagcttgattcaattgcaatgcagcggggaagttcggtaggagatgctggtggtgctgctgatagagttttgaaccaactcttgacggagatggacggcatgaacgcgaagaaaacagtttttatcataggcgcaaccaacaggcctgacatcattgatcctgcattgctcagacctggtcgtctagatcaattaatatacatacctttgccagatgaggcttctcgacatcaaattttcaaagcatgcttgcgaaaatcccctgtttccaaagatcttgacctttcaatgctagcaaaatacactaatggttttagtggtgctgatatcactgaaatctgccagcgtgcctgcaaatatgcaatcagggagaatatcgagaaggatattgagaaggagaggaagagaaaagaaaacccagaggcaatggaagaagatgatgaagatgaggtcccagaaatttcagtagcgcactttgaagaatcaatgaagtttgctcgccgaagtgtgagtgatcttgatataatgaaatatcagctcttcgcaaacaaattgcagcagtctcgtggttttggatctgagttcaaatttgccactcattctgagactgaagctgcagatgcattcactactgctgcagcaacaggcgatgacaccttatatagctaaactttag

SEQ ID NO: 7513 - DNA, 2425 bp, Aquilegia formosa
tatatactaaaccctaaaacaaagaatatggcttgttcaagtgagaagaaagattactctactgctatattggaacgtaaaaaggctcctaatcgtctggtagttgatgaagctgttaatgatgataattctattgtttccctgcaccctgcaacaatggagaagcttcagtttttcagaggagatactattctacttaaggggaaaaggcgaaaagacacactgtgtattgttgttgaagacgaagaatgtgaagaacataaagtcagagtgaacaaagttgcgcgtgctaatctgagagtgcgcttgggagatgtggtatctgttcatatgtgccctgagctgcaatatgggaagcggattcatgtgcttcctatggatgatactgtagagggcttgactggcgacttgtttgagccctatttgaagccatatttctgcgactcttttcgacctgtcagaaagggtaaccttttcttagtgaggggaggcatgcgaagtgtggagttcaaggtagttgaaacagaccctcctgagtattgtattgttgctgcagatactgagattttctgtgaaggagaacctatcaaacgtgaggatgaagagagattggatgaagttggttatgatgatgttggaggtcttaggaagcaaatggctcagattcgtgagcttcttgaacttccactcagacaccctgagctttttaaatgtattggtatcaaacccccaaaaggtatccttctctatggccctccaggatctgggaaaaccttgattgcaagagctgtggccaatgaaacaggagccttcttcttatgtataaatggacctgagataatgtcaaagatgtctggtgagagtgaatcaaatttgaggaaggcatttgacgaagcagaaaagaacgctccttctatcatcttcattgacgagattgacagcattgccccaaagagagacaagacaaatggcgaagtggagaaacgtatagttgcgcaactgctgactttaatggatggtcttaagagccgagctcatgtggttgtcatgggagctactaataggcctaacagcattgatccagctttgaggagatttgggaggtttgatcgagagattgatattggtgtgcccgatgaggttggaaggcttgaggttctgagaattcatacaaaaaatatgaagctatcagaagatgtagatcttgaattagctgcaaaagagacccatgggtatgttggcgcagatcttgctgcactttgtaccgaggctgcccttcagtgcatcagagagaagatggatattatcgatttggaagatgaaacaattgatgcagaggtactaaatatgatggctatcacaaatgatcacttcaaaactgctttaggtacttcaaatccatcagcattgcgtgaaacggttgtggaagtgcccaatgtttcgtgggcagatatcggagggttagattctgttaaaagggagctccaggagactgtccaatacccagtggagcatcctgaaaagttcgagaaattcggcatgtctccatccaaaggtgttctcttttacggccctcctggctgtggtaaaacccttcttgcgaaggcaatcgcaaatgaatgccaggctaacttcataagtatcaagggacctgagctattgactatgtggtttggagagagcgaggcaaatgtacgagagatatttgataaagctcgccagtctgctccatgtgttctgttctttgatgagcttgattcaattgcaatgcagcgtggaagttcggtaggagatgctggtggtgctgctgatagagttttgaaccaactcttgacggagatggatggcatgaacgcaaagaaaacagtttttatcataggcgcaaccaacaggcctgacatcattgatcctgcattgctcagacctggtcgtctagatcaattaatatatatacctttgccagatgaggcttctcgacatcaaattttcaaagcatgcttgcgaaaatcccctgtttctaaagatcttgacctttcaatgctagcaaaatacactaatggttttagtggtgctgatatcactgaaatctgccagcgtgcctgcaaatatgcaatcagggagaatatcgagaaggatattgagaaggagagaaagagaaacgaaaacccagaggcaatggaagaagatgatgaagatgaggtcccagaaatttcggtagcacactttgaagaatcaatgaagtttgctcgccgaagtgtgagtgatcttgatataaagaaatatcagctcttcgctcacaaattgcagcagtctcgtggttttggatctgagttcaaatttgccactcattctgagactgaggctacagatgcattcactactgctgcagcaacaggcgatgacaccttatatagctaaactttag

SEQ ID NO: 7514 - DNA, 2439 bp, Ostreococcus lucimarinus
cgcgcgcgcgttcgccctcgcaccatgaccgaatccaaggacgaggtcaagaaagaaaccaaacccgccgatccatcgctggccatcctcgagcgcaagaaggcgccgaacaggctcgtcgtcgatgaggcgatcaacgacgataactccgtcgtggcgctgaacctgcaaaagatggacgagctgcagttgttccgaggggacaccgtgctgctcaagggcaaaaagcgaaaggacacggtgtgcatcgtgctcgcggacgagagttgcgaggaggggaagattcgcatgaataaggtggtgcggaaaaacttgcgggtgcgacttggggacgtcgtgagcgtgcatcagtgtacggatgtgaagtatggtaagcgcgtgcacgtgttgccgttcggtgattcgatcgaaggcgtgactgggaacttgttcgacgtgtacttgaagccgtactttttggaggcgtaccgaccggtgagaaagggcgatacgttcttggctcgcggtggtatgcgggcggtggagttcaaagtcgtcgaaaccgatcccgcggagtattgcattgtcgccccggatacggagatcttttgcgaaggagagcccatcaaccgtgaggacgaggagcgcctcgacgacgtcggctacgacgacgtcggcggggttcgcaagcaaatggcgcaaatccgcgaacttgttgagttaccgcttcgacacccggcgttatttaagacgattggggtcaagccgccgaaaggtatcttactttacggccctcccggtagcggaaagactttgattgctcgcgctgtggccaacgaaaccggcgcctttttcttcttgatcaacggccccgaaatcatgtccaagctcgccggtgaatccgaatcgaacttgcgtaaggcgttcgaagaagccgaaaagaacgctccggcgatcattttcatcgatgagattgactccattgccccgaagcgcgaaaagaccaacggcgaagtcgaacgtcgcatcgtttcgcagcttttgactttgatggatggcatgaagtcacgatcgcacatcatcgtcatgggcgcgacgaaccgaccgaattctatcgacccagctcttcgtcgattcggccgcttcgatcgcgagatcgatattggtgttccggatgaagtcggtcgtctcgaagtgttgcgcattcacaccaagaatatgaagctcgacgaagccgttgacttggaaaagatttccaaggagacgcatggctacgtcggcgccgatttggccgcgctttctaccgaagccgcgcttcagtgcatccgtgaaaagatggatctcatcgatcttgaggatgagaacattgacgccgctgtcttagattctatggccatcaccaatgagcacttcgccacggcgttgaccacgtcgaacccgtctgcactgcgcgagactgtcgtcgaagtgccaaatgtttcttgggacgacattggtggtcttgaaggcgtcaagcaagagcttcaagagactgtgcaataccccgtcgagcacccggaaaagtttgaaaagtttggcatggcgccttccaagggtgtgctcttctacggtccgccgggttgtggtaagacgctcctcgccaaggcgatcgcgaacgagtgccaagcgaactttatcagtatcaagggtccggagcttttgaccatgtggtttggtgaatctgaagccaacgtgcgcgagattttcgacaaggcacgtcaaagtgctccgtgcgtgctcttcttcgacgagctcgactccatcgccaaccagcgcggtaacagtgctggtgacgctggtggagccggtgatcgcgtgttgaatcagcttctcacggagatggacggcatgggctcgaagaagactgtgtttatcatcggcgccacgaacagaccggacatcatcgactctgctctcatgcgtccgggtcgcctcgatcaactcgtgtacattccgcttccagacgaaccttctcgcttgagcatcttcaaggcaaacttgcgaaagtctccgatcgctgccgacgttgatctcgaagtcttggccaagttcacgaatggtttctccggtgcggacattaccgagatatgccagcgcgcgtgcaagtacgccattcgtgagagcattcaacgtgatatcgaggccgaacgtgccgctgctgtgaacccggatgcgatgcaagacgagaacgccgaggacccggtgcctgaaattaccaaggcgcacttcgaagaagcgatgaagcacgcgagaaaatctgtcaccgatgcggacattcgcaagtaccaaacctttagccaaacgcttcaccaagcgcgtggattcggtgcgagcgacttccaatttccagatgcccagggtggtggcgcgagcgccggtacgcccgcggccgcggctgcggacgacgatttgtacgactaa

SEQ ID NO: 7515 - DNA, 2556 bp, Castanea mollissima
taaccagtcatgtgggtggtgcttttggttgattctttttgtctacagtttcatcgaaaatagcttttattatgcaatttgcatctcctgatgcgaatgctttacctttgtctctttctctctcttcattcgcttcgttttgcttggaaacttttccgatcgcaaccacaatggcgcgccgccagggcgaatcgtccggctcgaaatcggggaagaaggacttatcgacggcgattcggaagtggaaaaagcagccgaatcggcttgtcgttgacttggcggtcaacgacgacaactccgtcgtctgtttgcacccttacaccatggaaaagatccagatttcccgtggcgatacgattctcatcaagggcaagaaacaaaaggatacaatctgcattgctgttgctgatgacacatgtgaggagctaaagattgggatgaacagggttgttagatcaaatctgagggttcagcttggggatgttgtaactgtgcaccagtgcgctgatgttaagtatggaaagcgtgtccacatactgcctgttgatgttactatagaaggtgttactgacaatctgtttgacgcatacttgaaaccgtatttcttggaggcttatcgccctgtaaggaagggagacctattccttgtcaggggagggaggagaagtgtagagttcaaggttatagaaactgaccctggggagtattgtgtgattgccccagacactgaaatcttctgtgggggggaacctgtcagaagggaggatgaggataagttggatgaagttggatacgatgatgtgggtggtgttcggaagcagatggctcagattcatgaattagtggagctgcctctatggcaccctcagctttttgaatcaattggtgtgaaagcacctaaaggaattttgctttatggaccgccaggttctggaaagaaattaatagctagagctgtggccaacgaaactggagctttctttttctatattaatgggcaggagattatgtccaaattggatggggagagtgaaagcaatctccagaagacgtttgaagaagctgaaaagaatggtccatccatcattttcattgatgagattgattgcattgctcctaagcaggagaagagacatggtgaagttgaaaggaggatcgtttcacagcttttgactcttatggatggacttaaatctagggcccatgttatctttattggggctacaaatcgtccaaacagcattgacccagctttgagaaggtttggtcgttttgatagggaaatagacattggtgttctggatgaagttgggcgccttgaagttcttcacatccataccaggaacatgaagctctctgatgatgttgatttggaaagaattgcaaaagatacccatggttatgttggtgccgatcttgctgctctctgcactgaggctgcactgcagtacattagagagaagatggatgtaattgacttggaagatgaatctattgatgttgtgatactagattccatggctgttaccaatgagcacttccagaatgcttttggaacaagcaacccatctgctttacgagaaacagtggttgaattgcccaatgtcagctgggaagacattggaggccttgagaatgttaagcgggaacttcaagaaactgtacagtatcctgtggagcacccagagaaattcgagaaatttggaatgtcaccctcaaaaggggttcttttctatggtcccccaggatgtgggaaaactctattggccatggcaattgcaactgaatctcaagcaaacttcatcagtgtcaagggccctgaactgcttacaatgtggtttggcgagagtgaagccaatgttcgagagattttttacaaggctcgacaatctgcaccatgtgtccttttttttgacgagcttgactcaattgctacccagagaggaaacagtgttggggatgcaggtggtgctgttgaccgggttctgaaccagcttcttactgaaatggatgacatatttgcaaaaaagactgtgttcataattggggctaccaatagacctgacataattgacccagcacttctgaggccaggtcgtcttgaccaattgatttatattcctctccctgaagaggagtcacgttatcaaatctttaaatcctgcttgagaaaatcacctgtctctaaagatgttgatttgagagcactggtcaaatgtactcaaggcttcagtggagctgacatcacagagatttgccagcgagcatgcaagtatgctatcagagaggacatagaaaaggatattaagaaggagaggaggagaagtgacaatcctaaggctatagataaggatgaaaccgatgaagtgacagagattagggctgctcattttgaggagtccatgaagtttgcccgtaggagtgttagtgatgctgatatatgcaaataccaggtatttgctcagaccttgcagcagtctaggggtcttggaggtgaatttaggttctctgagacacgtactggggccaacattgggtctgatccatttgtaactt

SEQ ID NO: 7516 - DNA, 2347 bp, Zostera marina
gcaaggatactatatgcatagtactggctgaagatgactgcgataagtctaaaattaaaatgaataagatagtcaggtctaacctgagggttagactgggtgatgttgtttctgttcatcagtgtcaggatgtgaaatatgggttacgcgttcatatccttccagtggacgacactattgaaggtgtcgctggaaacttgtttgatacatatttgaaaccctattttcaagaagcataccgtcctgtgaggaaaggtgattttttccttgtcaggggaggtatgcgaagtattgaatttaaaattattgagacagaccctgctgagtactgtgttatctctcctgacactgagatcttctgtgagggtgaacctgtgaaaagagaagatgaagatagactggatgaagttggttatgatgatgttggtggtgttagaaaacagatggctcagatcagagagttagttgagcttcctcttagacaccctcagctttttaaatccattggggttaaaccaccaaaaggaattttattgtatggtcctcctgggtctgggaaaacattgatagctagagcagttgcaaatgaaacaggtgcatttttcttttgcatcaatggtccagagatcatgtcaaaacttgctggtgaaagtgagagcaatcttaggaaagcatttgaggaagctgagaagaatgcaccatcgattatttttattgatgagattgactccatagctcccaaaagggagaaaactaatggagaagttgaaagacgcatagtttctcaactcttgaccctaatggacggattaaaatctcgagctcatgttattgtcatgggagccacaaatcgaccaaatagcattgatccagctctaagaaggtttggacgatttgacagagaaattgacattggtgttcctgatgaagtcggaagactcgaagtacttcgcattcatacaaagaatatgaaacttgctgaagatgttgatttggaaacaatatcaaaaaacacacatggttatgttggtgctgatcttgctgctctctgcacagaagctgctcttcagtgcatcagagaaaaaatggatgttattgatttggaagatgattcaatagatgccgaaattctgaattcaatggctattacggatatacacttcaaaactgctcttggaacaagcaatccatcagcacttcgtgaaacagttgttgaagtgcctaatgtcagctgggaggatattggtggtcttgaaaacatcaagagagaattacaagagactgtgcaatatcctgttgaacatccagaaaaatttgagaaatttggcatgtcgccttcaaagggagttcttttctatggtccaccaggttgtggaaaaactctacttgctaaggcaattgccaatgagtgtcaagcaaacttcatcagcatcaaaggccccgaactacttactatgtggtttggagaaagtgaagcaaatgtaagggagatcttcgacaaagcccgtcaatctgctccctgcgtctgttttttgacgaacttgattcaattgctaatcagagaggtggcagcagtggggatgcaggtggtgccgcagatagggtgctcaatcaacttttaacagagatggatgggatgtctgcaaagaaaactgtttttataattggtgcaacaaacagacctgacatcatagattcagcattgctgcgaccaggtcgccttgatcaacttatatatattcctctccctgatgatgcttctcgtctacagattttcaaagcatgcctaaggaaatctcccattgcaaaaaatgttgatctaaatgctctggctaaatatactcaaggctttagtggtgctgatatcacagagatttgccagcggtcatgcaaatatgcaattagggaaaatattgaaaaggacattgagcgggagaagaaaatgagtgagaacccagaggccatggaagaagatgttgaggatgtcgcagagataaaagctgtgcatttcgaagagtctatgaaatttgcacgaagaagtgttagtgatgctgacattcggaagtatcaggcatttgctcaaacattgcaacagtcaagaggttttggaaccgagttccgattcagtgacaagtctgagagtaccccaaccgatgacgtggatccatttgcaacatctgctgctgttgctgccgatgatgatgatttatatagttgattcatttgaagttatctactgatacttttcattatgcatattattcataatacatttgatttagattttgatttaaattctggtgacactatttattatgcatttggctttaattttacagagacaaag

SEQ ID NO: 7517 - DNA, 2367 bp, Triphysaria pusilla
cattgcccttgctgatgatacatgtgaagagccaaaagattaggatgaacaaggttgtccggaaaaacataggggttcgtcttggcgatgttgtatctataaaccagtgccaagatgtaaaatacgggaagcgtgttcacatattgcccttggatgacacaatcgaaggcctcactggggatctctttgatgcttacttgaaaccttattttagtgaagcatatcgccctcttaggaaaggtgatcattttcttgtcagagggggtatgagaagtgtggaatttaaggttgtcgagactgaccctggccagtattgtgttgtggcccccgatactgagatattttgtgaaggggaacccgtgaggagagaagatgaggataagctcgatgtggttggctatgatgatgtgggcggtgttaggaaacagatggctcagatccgagagctggttgaattgcctttgaggcatcctcagcttttcaaatctatcggtgtgaaaccaccaaaaggaatcttactttatgggcccccaggctctggaaagaccctaattgcaagggccgttgccaatgaaactggtatcttcttctttctgattaatgggcctgagattatgtccaaaatggctggggagagtgagagcaatctgaggaaagcgtttgaggaggcagagaaaaatgccccatcgatcattttcattgacgaaatcgattcaattgctcctaagagagagaaaacgaatggagaagttgaaaggagaattgtttctcagcttctgactctcatggacgggttgaaatcccgggcccatgtcattgtcatgggtgcgacgaataggcccaacagcattgaccctgctctgagaaggttcggtagatttgatagggagatagacattggagtccccgatgaaattggagccttgaggttcttaggattcataccaagaacatgaagctcgctgaagatgttgatttagaaagaataggcaaagatacccatggatatgttggtgctgacctggcagccctttgcacagaagctgctcttcattgcatcagagagaagatggacgtcatcgatatggaagatgatacgattgatgctgagatactgaactctatggcagttacgaacgagcactttcacactgctcttggaacaagcaacccctctgctttacgagagactgttgttgaagtgcctaatgtttcatgggaagatattggagggctcgaaaacgtcaagagggagcttcaagagactgttcagtatcctgtggagcatcccgagaagtttgagaaattcggtatgtcgccctcaaagggtgttcttttctatggccctcctggatgtggtaaaactctactggctaaggcgattgcaaacgaatgccaagcaaatttcatcagtattaaaggacctgagttgctcaccatgtggtttggagagagtgaagccaatgttcgggaaatttttgacaaggctaggcaatcggctccttgtgtcctcttctttgacgagcttgactctattgctacacagagaggaagcggcggtggaggagatgctggtggtgctgctgaccgagttctaaatcaactgttgactgaaatggacggaatgaatgcgaaaaagactgtttttataattggggctactaacaggcctgacatcatcgatccagctcttttacgtccaggtcgtcttgatcagttaatttatatccctcttccagatgaagattcacgccatcagatcttcaaatcttgcctccgtaaatccccactctccaaagacattgatctgcgtgctcttgcacaatatactcaaggatttagtggagcagatatcacggaaatttgtcaaagggcctgcaaatatgccatcagagagaatatcgagaaagacattgaaagggagaagagaagaaatgagaatccggattccatggacgaggacctcgatgacgaggtttcggaaatgaagcctgcacatttcgaggagtcaatgaaatttgctcgcaggagtgtgagcgatgcagacattcgcaagtaccaggcgtttgctcagaccttgcagcagtcaagagggttcgggaccgagttccgttttgctgagtcagcaggtggggcatcgactggggctgatgcgtttgcagcaccagctggtggagctgatgaagatgatttatataattagatgtttcgtggacttttaatcttttatgcaattttctttgctaaatgtcttaagtagttaacaccagaacccttttaatatttatgcaattttctttgcttcctggtttattaataattcgttgtgactgtttgcagacatgaattttttgtagcatgcctatt

SEQ ID NO: 7518 - DNA, 2285 bp, Cenchrus ciliaris
gttgtcaggaagaacttgagggtacgacttggtgatgtggtttctgtccatcaatgcccagatgtcaaatatgggaagcgtgttcacatacttccaattgatgatacagttgaaggcattaccggcaacttatttgatgccttcctgaaaccatactttcttgaagcctatcgtcctgtgaggaaatcagacctattccttgtgaggggtggtatgagaagtgtagaattcaaagttatagagactgacccaacagagtattgcatcgttgcaccggatacagagttattctgcgaaggtgagcctattaagagggaggatgaggaaaggcttgatgaggttggctatgatgatgttggtggagttaggaagcaaatggcccaaatcagagagctggttgaactcccactgcgccacccccagcttttcaagtctattggcgtgaagccaccaaagggcatattgctgtatggaccacctggctctggcaagactcttattgctagagctgttgctaatgagacaggtgctttcttctttctgatcaatggaccggaaatcatgtcaaagcttgcgggagaaagtgagagcaatctcaggaaggcatttgaagaagctgagaaaaatgcaccttccatcatttttatcgatgagatagattccatagcacctaagagggagaagacccatggagaagttgagaggcgtattgtttcacagcttttgactctcatggatggcctcaagtctcgtgcacatgttattgttatgggtgccacaaaccgtccaaacagtattgatcctgctcttagaaggtttggtaggtttgaccgtgagattgatattggtattccggatgaagttgggcgccttgaggttctccggattcataccaaaaacatgaagctgtctgaagatgttgaattggagcacattgcaaaggacacccatggttatgttggtgctgatcttgctgccctgtgcactgaggcagctcttcagtgcattcgtgagaagatggatgttatagatcttgaggatgagaccatagatgctgagatactcaactctatggctgtctcaaatgatcatttcaagactgcacttgggacaagcaacccgtctgctctgcgtgaaactgtcgttgaagttccaaatgtctcttgggaggatattggtggcctggagaatgtcaagagggagctccaagagactgttcaatatccagtggagcatccagagaaattcgagaagtttggcatgtctccctcaaagggtgttctgttctacggccctcctggctgtggaaagactttgttggccaaggcgattgctaatgaatgccaggctaacttcatcagtgtgaagggacctgagctgcttaccatgtggtttggtgagagtgaggccaatgtccgtgagatctttgacaaggctaggcagtctgctccttgtgtcctcttcttcgacgagcttgactccattgctactcagagaggaggtagtgttggtgatgctggaggtgcggctgatagagtgttgaaccagctgctgactgagatggatggcatgaacgcaaagaagactgttttcattatcggtgccactaacagacctgacatcattgaccctgctttgctgaggccagggcgtctcgatcagcttatctacattcctctgcctgatgatcaatccaggctccagatcttcaaagcctgcctcaggaagtctcctgtggctaaggatgttgatttgaacgcccttgccaaatacacccagggattcagcggtgcagatatcactgagatctgccagcgtgcgtgcaagtacgccatcagggagaacattgagaaggatatcgagatggagaggcgtaggaaggacaaccctgaggcaatggaggaagatgaggtggatgaagttgctgagatcagggctgttcactttgaggagtccatgaagtatgcgcgccggagtgtgagcgacgccgacatccgcaagtaccaagcctttgcccagaccctccagcagtctcgcggattcggcagcgaattccggttccccgaccaacctgcggcagcggcggccgaccccttcgcagcccctgcggctgcagctgatgatgatgacctatacagttaaactagcagttctgctgtggcataacttatatatagatgcttagtatgccaaacttatcgtgtgtaaggcacgggacgggagaagatgtacttgcttttaagttaagtattttgctagatacctaaatcgtgtcatctacttga

SEQ ID NO: 7519 - DNA, 2186 bp, Panicum virgatum
aaatatctgtcgccatcccgtctctctcgtcgaattcgatagccatggcgagccaaggcgcgtcttcctccgatccgaaggataagaaggactattctacggcgatcctcgagaggaagaagtcgccgaaccgactggtggtcgacgaggccaccagtgatgacaactccgtcgtcgcactgcacccggacaccatggagcgcctccagctcttccgcggcgacactgtcctgcttaagggtaagaagagaaaggacactatctgcatcgtgcttgcagatgacacttgcgaggagccaaaaatcaggatgaacaaggttgtcaggaagaacttgagggtacgacttggtgatgtggtttctgtccatcaatgcccagatgtcaagtatgggaagcgtgtacacatacttccaattgatgacacgattgaaggcattactggcaacttatttgatgccttcctgaaaccatacttccttgaagcctatcgtcctttgagaaaaggagaccttttccttgtcaggggtggtatgagaagtgtagaattcaaagttatagagactgaccctgcagagtattgtattgttgcaccagatacagagatattctgtgaaggtgagcctattaagagggatgatgaggaaagactcgatgaggttggctatgacgatgttggaggagttaggaagcaaatggcccaaatcagagaactggttgaacttccactgcgtcatccccagcttttcaagtccattggtgtgaagccaccaaagggcatattgctgtatgggcctcctggttctggcaagacccttattgctagagctgtagcaaatgagacaggtgctttcttctttctgatcaatggaccggaaatcatgtctaagctagcaggagaaagcgagagcaatctcagaaaggcttttgaagaagctgagaagaatgcaccttccatcattttcattgatgagttagattccatagcacctaagagagagaagacccatggagaagttgagaggcgtattgtttcacaacttttgactctcatggacggcctcaagtctcgcgcgcatgtcattgttatgggtgccacaaaccgtccgaacagtatcgatcctgctcttagaaggtttggtaggtttgaccgtgagattgatattggtgttccggatgaagttgggcgccttgaggttcttcggattcacaccaaaaacatgaagcttgctgaagatgttgacctggagcacattgccaaggatacccatggttacgttggtgctgatcttgctgccctttgtactgaggctgctcttcagtgcattcgtgagaagatggatattatagatcttgaggatgaaacaatagatgccgagatactcaactctatggctgtctcaaatgatcatttcaagactgcacttgggacaagcaacccgtctgctctgcgtgaaactgttgttgaagttccaaatgtctcttgggatgatattggtggcctggagaacgtcaagagggagcttcaggagactgttcaatatccagtggagcatccagagaaattcgagaagtttggaatgtctccttcaaagggtgttctattttacggccctcctggctgtggaaagactctgttggccaaggcaattgctaatgaatgccaggctaacttcatcagtgtgaagggacctgagctgcttaccatgtggtttggtgagagtgaggccaatgtccgtgagatttttgacaaggctaggcagtccgccccatgtgttctcttctttgatgagcttgactccattgctactcagaggggaagcagcgttggtgatgctggaggtgctgctgacagagtgttgaaccagctgttgactgagatggatggcatgaatgccaagaagactgttttcatcattggtgccaccaacaggccagatatcattgaccctgctttgctcaggccagggcgtcttgatcagcttatctacatccccctgcccgatgaccaatccaggcttcagatcttcaaagcctgcctcaggaagtctcctgtggctaaggatgttgacttgaacgctcttgccaagtacacccaaggattcagtggtgcagatatcactgagatctgccagcgtgcgtgcaagtatgccatcagggagaacattgagaaggacatcgagagggag

SEQ ID NO: 7520 - DNA, 3258 bp, Volvox carteri
ctttgtgacgtcgttacaagcgcatttgcttatacaacattactcgcaaggagtagctgcgctttttcttgcctcaatattcttggttttctcgattttctcgataaaaaatggctgatgctggcccatctgatgctgggaagaaggagaagaaggacttcagcacggcaatcttggagcgtaagaagagcccaaaccggctaattgttgaagaggctgttaacgacgacaactcggtggtggcgctgcacccgaaaacaatggaaaagctgcagctcttccgtggcgacacggtccttttgaaggggaagaaaaggaaggacaccgtgtgcattgttctctccgatgacacggtggacgagaataagattcgcatgaacaaggtggtgcgcaagaaccttcgcgttcgccttgcagatatcgtctccatacaccagtgcacggacgtcaagtatggaaagcgcattcacgtattgccgatcgatgacactatcgagggtattaccggcaacctcttcgacgcctacctgaagccctactttctggaggcgtaccggcctgtgcgcaagggcgataccttcttagctcgtggaggtatgcgcagcgttgagttcaaagtggtggagacagatcctgctgagtattgcatcgtcgcaccggacacggaaatcttttgtgagggcgagcccattaagcgcgaggacgaggaaaagcttgacgaggttggctacgacgacattggcggtgtccgaaagcagcttgcgcagattcgcgaactcgtggagttgcctctgcgccatccgcagctcttcaagacgattggtgtcaagccgcccaagggtattttgctgtacgggccccctggcagtggcaagacgctgattgctcgtgcagttgcaaacgagacgggtgcattcttcgttgtggttaatggaccggagattatgtccaagctggctggcgagtctgagagcaacttgcgcaaggtgttccaagaggccgagaagaacgcgccttccatcatcttcattgatgaggtggactcgattgcgcccaagcgtgacaagacgcagggcgaggtggagcgccgtatcgtctcgcagctgctgacgctcatggacggcctgaagagccgcgcgcacgtgattgtcatcgcagccactaacaggcccaactccatcgacgctgccctgcgccgcttcggtcgttttgaccgcgagatcgacatcggtgtgcccgacgagactggccgtctggaggtcctgcgcatccacacaaagaacatgaagctggacgaagacgtgaatctggaagccattgcgcgcgacactcacggctacgtgggtgctgatcttgcggcgctgtgtacggaagcggcgctgcagtgtatccgcgagaagatggacgtgattgacctggaggacgagcagatcgacgccgaggtgctcaactccatggcggttacgcaggaccacttcaagacagcgctaggcatgagcaatccgtcggctctgcgcgagacggttgtggaggtacccaacgtatcatgggatgctattggtggcctggagaacgttaagcgggaacttcaggagctgattcaatatccagtggagcacccagagaagtttgaaaagtttggcatgtcgccttccaagggtgtgctcttctatgggcctccaggttgcggcaagaccctcctcgctaaggcgattgcaaacgagtgccaggccaacttcatctcggtcaagggccctgagctgcttactatgtggttcggcgagtcggaagccaacgtgcgtgaaattttcgacaaagcccgcggctctgccccctgcgtgctgttcttcgatgagctcgactcgatcgcggtgcagcgtgggtccagcgcgggtgatgctggcggagctgcggaccgcgtgctgaaccaactgctgacggagatggatggcatgaattccaagaagacggtgttcattatcggcgccacaaacaggcccgacattattgaccccgcgctgctccggcctggtcgtctggaccagctcatctacattccgctgccagacgagaagtctcggttgcagatcttcaaggcttgcctgcggaagtcgcccatcgcccctgacgtggacttcgacacgcttgtaaagttcacgcacggcttctccggcgccgatattacggagatttgccagcgtgcctgcaagtcggccatccgtgaggacattgagaagaacatcgagcgtgagaggcgacgagcagagaacccggatgctatgatggaggacgagccggacccagtgccatgcatcacgaaagcgcactttgaggaggctatgaagtatgcgcgtcgatccgtttccgatgctgacattcgcaagtaccaggctttcgctcagacgctccaacagagcccggatcggacttccgtttcccagatggtcctggcgggggggctagcgcggcaccggctgctgctgccactgcggctccagcctttacccaaagcgctgctgcagcagacgacgacgacctgtacaattagttctaagttttcggtaccctaggctagagggtgtgccgtgtaaattcgtatgggcttctggtatgttggacttgcgtcatcgagcacatcgccatcgttgcgtcgacgagtgtagggacgcctaaattgcccccaagtgcatcgcgtagtacagtttatggcgacgtgctgttttaaaatttttccacggatcatgaccatgaggacctacgtgtggtgactaggcgaagcgaatgtccggttaatgaccggcaagggcttccggtatcggaggcatgcttatgatgctgctgatggtaatctagtcataactgttttaaggattgtgaaggcatacgactaaccgtgttccaacttgaagcgcgtgggtgtcgggactgcgttggatccgtataaatagttttacggaaagcgttttttgggtcattaatctgccgattgctttgaagagatgtatgcatgttaggactgtgcagacacgcgtagcagataagcaccgcgggtacaagttgcaacgcgttaatgagtgtgcaggaatttttagccctagagggatttttttatggttgcaggtttgctcgttcgtgcttattgcaaggtttgcaagggaacagctgagcggtcgagctacagccacggtctggcaaaatccattctagttccacaaacatctgtggacataacaggcattgtaaaatgcagtatgccta

SEQ ID NO: 7521 - DNA, 2423 bp, Brachypodium distachyon
ctcgacccgacacgcacacagaaccgttcgaccgtagcagaaacgcgatgtcgggcacgtcgtcggcttcgaagaaggctgcgaaccggctggtggtggaggaggcccccgaggacgacaactccatgtgcagcctccaccctgccaccatggagcgtctctcgttattcaaaggcgacgtcgtcctgctcaaggggaagcgccgccgcagcaccatctgcatcgccatccccgacgacgactgcgaggagcacaagctcaggatcaacaaggcggtccgctccaacctcagggcacgcatcgccgacgtggtgtcgatccacgagtgccgtgacgccaagtacgggaagcgcgtgcacatcctccccattgacgacaccgtggagggcatcacggggaacctcttcgacgcgtacctcaagccctacttcttggacgcctaccgccccgtccgcaagggcgacctcttcctcgtccgcggcggcatgcggagcgtcgagtttaaggtcgtcgaggtcgacgccgatgccgctgtcgagtactgcatcgtggcggccgacacggagatcttttgtgatggcgagccgttgaagagggaggacgaggagaggctcgacgacgtgggctatgacgatgtcggcggcatgcgtaagcagatgacgcagatcagggagctcgtcgagctaccgctcaggcatccgcagctcttcaagtccatcggtgtcgagcctcccaaggggatccttctttacggccctcccggctccggtaagacgctcatcgcccgtgccgtggccaacgagactggagccttctttttcctcatcaacgggcccgagatcatgtccaagttggccggggagagcgagagcaacctgaggaaggcgttcgaggaggccgagaagaacgcgccgtccatcatcttcattgacgagatcgactccatcgctcccaacagagagaagactcacggcgaggtcgagaggcgtattgtgtcgcagctgctgacgctcatggacggcatgaagtctcgcgcgcacgtcatcgtcatgggcgccacgaaccgccccaacagcatcgaccctgctctccgccgcttcggcaggttcgaccgggagatcgacatcggcgtgccggacgaggttggccgcctcgaagtgcttcgtatccacactaaaaacatgaagctcgacgcggacgtcaacttggaagtggtcgccaaggacacgcacggctacgttggcgccgaccttgcagcgctctgcacggaggcggcgttgcagtgcatcagagagaagatggacattatcgacttggaggatgacaccatcgatgccgagatcttgaactccatggccgtcaccaacgaccacctaaagacggctctggtcggcaccaacccttcggcgctccgcgagaccgtggtggaggtgcccaacgtgagctggagcgacatcggcgggttggacggcgtgaagagggagctacaggagacggtgcagtacccggtggagcacccggagatgttcgagaagttcggcatgtcgccttccaagggcgtcctcttctacgggccgccgggctgcggcaagacgctgctggccaaggccatcgccaacgagtgccaggcaaacttcatcagcatcaaggggcccgagctgctcaccatgtggttcggcgagagcgaggccaacgtgcgcgagatcttcgacaaggccaggcagtcggcgccctgcgtgctcttcttcgacgagctcgattcgatcgccatgcaacgcggcggcagcgtgggtgacgccggcggcgcggctgaccgtgtgctgaaccagctgctgacggagatggatggcatgaacgcgaagaagacggtcttcatcatcggagccaccaacaggccggacatcatcgactcggcgctgctccgtccgggccgcctcgaccagctcatctacatcccattgccggacgaggcctcacggcaccagatcttcaaggcatgcctcaggaagtctccgctggccaagaacgtcgacctcggcgcgcttgcgaggttcaccaagggctttagcggtgccgacatcacggagatttgccagagggcgtgcaagtacgcgattagggaagacatcgagaaggatatcgagagggagaggctggggaaggaagccatggaggtggacgactccggagaggtggctgagatcaaggcggcgcacttcgaggagtcgatgaagtacgccaggaggagcgtcagtgatcgcgacatcaccaagtatcgggccttcgcgcagacgctgcagcagtccaggggctttggcaccgagttccgcttccctgagcagtccaaaccggcagaagcttcagctgccacggccaacgcctacgctgcagctgacgaagaagatgacctttacaactgattg

SEQ ID NO: 7522 - DNA, 2240 bp, Medicago truncatula
tatttgttaatgtggtttatgttgtgttgcagggaaagaaaaggaaggatagtgtttgtattgctcttggtgatgatacctgtgaagagcctaggattaggatgaacaaagttgtgaggtcgaatttgcgagttcggcttggagatgttgtgtctgtgcatcagtgtactgatgtcaagtatggtaaacgtgtgcacattctgcctattgatgatacaattgaaggtctcactggaaatctctttgatgctttcttgaaaccctatttcttggaggcttattgtccggtcagaaaaggagatctatttcttgtgcggggagggatgagaagtgtagaatttaaggtcaatgaaactgatcctggggagttctgtgcggttgctccagacactgaggtcttctgcgagggggaacccgtgaaaagagaggatgaagaaaggcttgatgaagtcggttatgatgatgtgggtggttttaggaagcaaatggcacagatccgtgagttggtcgagcttccacaactttttaagtcaattggtgtgaaaccacccaaaggaatttttctatatggacccccaggttctggaaagacattaatagcaagagctgttgctaatgaaactggagctttcttcttttgtattaatggaccagagattatgtccaaactggctggagagagtgaaagcaatcttaggaaagcgtttgaagaagcagaaaagaatgcaccatccatcatctttatttgatgaaattgattctattgcacccaagcgggagaagacaaacggtgaagttgaaagaaggattgtctcacaacttctgactcttatggatgggctagaatctttatttgattctattgctactaatcgtcccaacagcattgagaaggtttggtagatttgatagggaaatcgatattggtgttccagatgaaattgggcgacttgaagtccttcgcatacataccaaaaacatgaagctctctcatgatgttgatttggagagaatttcaaaagatactcatgggtatgttggtgctgaccttgctgctctttgcactgaagctgctctacaatgcattagggagaagatggacgtcattgacttagaggatgagactattgatgctgaaatactaaattctatggcagttacaaatgagcatttccataccgcacttggaacaagcaacccatcagctctacgtgaaactgtgcctaatgtcagctgggaggacatcggaggccttgagaatgtcaagcgtgaactgcaagagactgttcaatatccagttgagcacccggaaaagtttgagaagtttgggatgtcaccatcaaaaggagttctcttctatggtcctccgggatgtggaaaaactttgttagccaaagcaattgctaatgaatgtcaagctaacttcatcagtataaaaggcctagaattacttacaatgtggtttggtgaaagtgaagccaatgttagggaaatttttgacaaggctagacaatcagctccatgtgtcctcttttttgatgagcttgattccattgccactcagagagggagccgtgttggggatgctggtggtgctgctgacagagttctaaatcaacttctgacagaaatggatggcatgtctgccaaaaagaccgtgttcattatcggggcaactaacagacctgacatcattgatcccgcactccttggccaggccgtctagatcagttgatctatattcctcttcctgacgaggattcccgtcattcgatcttcaagtcctgcttgagaaagtcaccgatcgcgaaaaatgttgatttgggagcattggccaggcatactcaaggttttagtggtgccgacattacagaaatatgccagcgtgcatgcaaatatgctataagagaaaacatagagaaggacatagagaaagagaggaagaggaaggaaaaccctgaggcgatggatgaagacatggttgatgaagaagttgcggagatcaaggcggctcactttgaggagtcgatgaattatgcacgcaagagtgtcagtgatgcagatatacgcaaatatcaggcatttgctcagactttacaacaatcttgaggtttcggaagtgaatttaggtttgcagatagcgcaaataggactactgcatctgatccttttgtaactactactgcagctggtggggctgatgaagatgacctgtataattagattttcttttcaaagga

SEQ ID NO: 7523 - DNA, 2375 bp, Glycine max
ctttatcttccattccaacaatgtctcaccaagtcgaatcttccgactcgaaatcttggaagaaagactcttccacttcgattcttgaacggaagaaatcgccgaaccggttagtcgttgacgaagcagttaacgatgacaattcggtggtcgccatgcaccctcaaaccttgaaaaaactccaacttttccgcggagacactatcctcgtcaaggggaagaaacggaaggacacggtttgcattgctcttcgggacgagaattgtgaagaatcgaagataagattgaacaaagttttgaggtcgaatttgagggttcgtctcggagatgctgtgtctgtgcattcgtgccctgatgttaagtatgggaaacgcgttcacattcttcccattgatgataccattgaaggtgtcactggcaatctctttgatgcttacttgaaacttgttgttatgagaagctattattgtctactatgggtgtggttgggtaaaaagcgtgatttagtgcttgtcatcatatttcttgtccaaggagggatgagaagtgtagagttcaaggtcattgaaattgatcctggggagtattgtgtggttgctcgagacactgaaatattctgtgagagggaacctgtgaaaagagaggatgaagaaaggctggatgaggttggctatgatgatgtgggctgtgtcaggaagcaaatggcacagattcgtgagttggtagagcttccactaagacacccacaactttttaaatcaattggtgtgaaaccacccaaaggaattttgctgtatggacccccaggctctggtaagacattgaaagctagagctgtttctaatgaaactggagcgttcttcttttgtattaatggcccagagattatgtccaaactggctggagagagtaaagtaatctcaggaaagcatttgaagaagctgaaacgggagaagacacatggtgaagtcgaaaggagaattgttttacaacttttgactcttatggacggatttaaatctcgtgctcatgttattgttattggagctacaaataggccaaatagtagccccgctttgagaaggtttggtagatttgatagggaaattgatattggtgttcctgatgaagttggaagacttgaagtccttcgtatacataccaaaaacatgaagttttcagatgatgttgatatagagagaattgcaaaagatactcatggatatgttggtgctgaccttgctgccatttgcactgaagctgctctgcaatgcatcagggagaaaatggatgttattgatttggaagatgagaacattgatgctgaagtgctgaattctatgacagtttcaaatgagcatttccataccgctctaggaacaagcaatccatctgctttacgagaaactgttgttgaggtgcctaatgtcagctgggaggatattggaggcctcgagaatgtcaagcgcgagctgcaagagactgttcaatatcctgtggagcacccagaaaaatttgggaagtttggtatgtcaccatcaaaaggagttctcttctatggtcctccaggatgtgggaaaacgttgttagcaaaagcaatcgctaatgaatgtcaagctaacttcatcagtgtgaagggcccagaattgctcactatgtggtttggtgaaagtgaagccaatgttcgagaaatttttgacaaggccagacaatcagctccatgtgtcctcttctttgatgagcttgattccattgctactcaggaagtagtgttggagatgctgggggttgctgctgatagagttctgaatcaacttctgactgaaatggatggcatgaatgtcaaaaagaccgtgttcataattggggcaaccaacagacctgatatcattgactcagcacttctttggcctggtcgtctagatcaattgatctatattcctcttccagatcaggagtcccgttatcaaatcttcaaggcctgcatgaggaagtcacctgtctcaaaagatgttgatttgagagcactagctgagtatacaaaaggctttagcggtgctgatataacagagatatgccagcgagcatgcaaatatgctattagagaaaacatagaaaaggacatagagcgtgagagaaagaaaagagacaaccttgaggccatggatgaagacattgaggaggaagatgttgcagagatcaaggctgctcattttgaagagtcaatgaagtatgcgccatttgctcagaccttacagcaatccaggggctttggaagtggctttaattttccagcaactggaggtaggaccgtaggatctgaaccctttgcaacttctgctggtagagctgatgatgatgatctctatagttag

SEQ ID NO: 7524 - DNA, 2239 bp, Brassica napus
cccgttgatgacaccgtcgaaggagtcaccggaaacctcttcgacgcttacctcaaaccttacttcttggaggcgtaccgtccggtgaggaagggcgatctcttcctagtccgaggagggatgaggagcgtggagttcaaagtcatcgaaaccgatccagctgagtactgtgtagtcgctccagacactgagattttctgcgaaggcgaaccaatcaagagggaggacgaggagaggctagacgaagtgggttacgacgacgttggaggcgtcaggaaacagatggctcagataagagagctcgttgagcttcctctgaggcatccgcagctcttcaagtccatcggcgtgaagccacctaaggggattctcctctacggacctcccggatcgggaaagactctcatcgctcgcgcagtggctaacgaaacgggagcgttcttcttttgtattaatgggcctgagatcatgtccaagatggcgggggagagcgagagtaatctcaggaaggcgtttgaggaggcggagaagaacgctccttcgattatattcatcgatgagattgactccattgcgcctaagagggacaagactaacggtgaggttgaacggaggatcgtctctcagttgcttacccttatggatggactgaagtcacgtgcgcatgttatcgtcatgggagctaccaaccgtcctaatagtattgatccggcgttgaggaggtttgggaggttcgacagggagattgatatcggtgttcctgatgaggttgggcgtcttgaggttcttaggatccacaccaagaacatgaagctagctgaagatgttgatcttgaaagaatctccaaggacacgcacggatacgtcggctctgatcttgcggctctgtgcactgaagctgctcttcagtgtatcagagagaagatggatgtgattgacttggaggatgagtctatcgacgcggagattctcaactccatggcggtgtctaacgaacacttccacaccgctcttgggaacagcaacccgtctgcactccgcgaaaccgtcgtggaggttccaaacgtctcctgggaggatattggagggcttgagaatgttaagagagagctgcaggagactgttcagtaccctgtggagcatccagagaagtttgagaagtttgggatgtctccatcgaagggagtactcttctacggtcctcccggatgcgggaagacactcttagccaaagccatagcgaacgagtgtcaagcaaacttcatcagcgtcaagggacctgagcttctcaccatgtggttcggagagagcgaagccaacgtccgtgagatcttcgacaaggctcgtcagtccgctccttgcgttctcttcttcgacgagctggactcaatcgctactcagagaggaagcagcgtgggggacgcgggaggggcggccgatagagttttgaaccagcttttgacggagatggatgggatgaacgccaagaagacagtcttcatcatcggagcgacgaacaggcccgacattatagatccggctctcctccgaccagggagattggatcagctcatctacattcctcttcccgatgaggattcgcgtctcagcatcttcaaggcgtgtttgaggaagtctcccgttgctaaagacgttgacgtgagggccctcgctaagtacactcaggggttcagcggcgctgacatcactgagatttgccagagggcgtgcaagtacgctattagagagaacatcgagaaggatattgagagagagcgtaggaggggggagaatccggaggccatggaggaagatatggtggatgatgaggtggcggagattagagctgcgcatttcgaggagtcgatgaagtatgcgaggaggagtgtgagcgatgctgatattcgcaagtaccaggcttttgctcagacgctgcagcagtcgagagggattgggagtgagttcaggtttgatccaaccgcggctgctggacgtactactggtggtgctgctgctgatccctttgctacttcaggggctgctgcagatgatgatgatctctacagttaagattatggttcctcaatgtagttgttttttttctttctaagtttaaaagttgcgtactgaatgagtgatgtcgagagtgatacagagaacacttcttcgggcttgttatgtgatgtcgagagtgatacagagaacacttcttcgggcttgttatgtgatattattgcgt

SEQ ID NO: 7525 - DNA, 3223 bp, Vitis vinifera
tttgttttgatggtttcaggcaagcctcggccaagaaagacttctcaacgacgattttggagcggaagaaggcccccaatcgtctcattgtcgacgaagcaaccaccgatgataactcctctgtctctatgcactccataaccatagagacattgaagattttccgcggggatactattctcatcaagggcaagaagaggaaggacacagtctgcattgccattactgatgacacatgtgagccagcaaagatcaggatgaacaagattgttaggtcaaatctgagggttaagcttggagacgtcgtatctgtgcacgattgcatggatattatgtatggggagcgtgtccacatactgccaatggatgacaccatagaaggtgtcactggaaatctatatgatgcatacctgaaaccttatttctcggataatttccgccctgtgaggaaaggggatctcttccttgtgaggggagggatgagaagtgtagagttcaaggttgttgaaacccacccaggggagtactgtgtggttgatccagacactgaaatcttctttgaagggaagccggtgaggagggaggatgaagaaaggttggatgaggttggttatgatgatgttggtggctttcggaaacaaatggctcaaatacgtgagttagtcgagctgccattgaggcatcctcaactttttaaatcaattggtgtaaagccacccaaaggaattctactttatggacccccaggttctggaaaaactttaatagccaaggctgttgctaatgaaactggtgccttcttcttctgtattaatggacctgagattatgtcaaaattggctggagagagtgaaggaaatctcaggaaggcattcgaggaagctgagaagaatgccccatccatacgtattgtttcacagcttttgactctcatggatggactgaaatcccgggctcatgttattgttattggagctactaatcgcccaaacagcattgacccagctttgagaaggtttggtcggtttgacagagaaatagacattggtgttccagatgaagttggccgtcttgaagttcttcgcattcataccaagaacatgaagctctctgatgatgcaattcaaaaagaaaaaggaattatagttgatttggaaaggattgcaaaagatagtcacggctatgttggtgctgatcttgctgctctctgcactgaagctgcacttcagtctattagagaaaagatggatgtgatagacttggaagatgaagctattgatgctgaagtactcaattccatggctgttactgataagcacttcaagactgcactgggaacaaccaacccatctgctttgcgggaaacggttgttgaagtgccaaatgtcagctgggaagacattggtggtcttgagtatgtcaagcgggagcttcaggagactgttcaatatcctgtggagcatccagagaagtttgagcaatttggtatgtcgccttccagaggggtacttttctatggcccaccaggatgtgggaaaactctactggctaaggcaattgcaaatgagtgtcaagcaaactttatcagtgtcaaggggcctgaactgctcacaaagtggtttggtgagagtgaagccaatgttcgagaaatttttgacaaggctcgacagtcagcatcatgtgtccttttcttcgacgagcttgactccattgctactcagagggggagcaatcttggggatgcaggtggtgctgatcgggtcctgaaccaactcttgattgagatggatggcatgtcagcaaaaaagactgttttcataattggggctacaaacagacctgacataattgacccagcacttttgcggccaggacgtcttgatcagttgatttatatccccctgccagatgaagactctcggcatcagatttttaaggcctgcttaagaaaatcaccagtttctaagcatgtggatttgagggccctcgccaagtacactcaaggctttagtggagcagatattacagaaatatgccagcgagcatgcaagtatgcaataagagagaacattgagaaggacatagagaagaagagggggagagaggaaaatcctaaggctatggatgaggaccttgaggaagaggttgcagagattacggcctctcactttgaggagtcaatgaagtatgctcgcaggagtgtgagtgaggctgacatacgcaaataccaggcatttgctcagcagtctaggggttttggatcacaattccggttttcagaggcaggaccaggtggctctggttctaacccattaggaacttctactagtgggccggaagaagatgatctttatactcacatcacggataagagatctgccatgggagttattgttaccttacctgtgaagtggacaaagatattccaaatggagcttgcactgcacactctaccgttaaagacaagtagggacttcaagcctcatattcataatgcgtttgatccagatcctatttcttcaactgatgtgaagttacaagcacaacgaagaaaaatatgtagagtatcttatgcactaccagaaacggctgcttctgtagcaattgctgccacagtcgtgggtgctgcagctacacttcttgtaagaagaagtagaccttctgaagcaactgagattcctttaaaaatttgtgaagattgtggtggttctggcatatgttctgaatgcaatggtgaaggatttgtgcttaagaaactgtcagaggcaagtgctgagaaggcaagattgactgcaaagaatatggctactcgatacactgcagggcttccgaagaaatggagttactgtactaagtgctcttctgcccgttcctgtagcacttgtggtggcagtgggaagttgagttcatagttttgttgttatcatgtctttcttctaattgagatttttgctcctgatttcatccccacatcattatcaaagaatgtaatcaacttgcagtcgcagaagatcaaaagtgagttcaagcttcattttatgcgctactgttgatggttggcgaatgtatatcttgtaatattgctgcctcaactttgcaatatcgcaaaagtaaaatgttaccaaaatcattttagcgtccaacatttggctaatcttcttcccatggatctgtaaaagcacatcttcccatcaaaactagataaccagtatcttgattatag

SEQ ID NO: 7526 - DNA, 2313 bp, Pinus pinaster
gggggggctttattcaaaatacattgcctttagtgttggtcgctcggagtggtgggtgaaagcaggaaggggaggccatctgatgcgaaccatcagatctcattaatttctgcggagatcttcttctgcatctttctcttctctgtggttgttccctttctatcatttcatcctttaaaatctacgatggcgagcttaatacctggagaatcatctgaagggaagggaacaaagaaagactttagcactgcaatacttgagcgtaagaagtctcctaatcggttagttgtggatgaagccataaatgatgataactcggttgtggctcttaattcgaaaacaatggaaacattgcagcttttccggggtgataccattcttgttaagggtaaaaagagaaaggatacagtttgcattgttctggctgatgatacctgtgaagagcataagatcagaatgaacaaagttgttaggtcaaatctaagagtaagattaggggatgtagtatctgttcatcagtgcccagatgttaagtatgggaagcgtgtgcatattcttcctatagatgacacaattgaaggtgttacaggaaacttgttcgatgtgtacttgaagccttacttcttggaagcctatcgcccagtaagaaaaggagacctttttctagtacgaggaggaatgagaagtgtagaatttaaaatcattgagacagatcctggtgagtattgtgttgtttctccagatactgaaattttttgtgagggagagccaataaaacgagaagatgaagacagattggatgacgttggctatgatgatgttggtggtgtaaggaaacaaatggcacagatcagagaactagttgaattaccactaaggcatccacaacttttcaaatccattggtgttaagccccctaagggtattttgctttatggtcctcctggttcaggaaaaaccttgattgctagggcagtggcaaatgagactggagctttcttttttctaattaatggtcctgaaattatgtcaaagcttgctggagaaagtgaaagcaatcttagaaaggcttttgaagaagcagagaagaatgccccttctatcattttcattgatgaaattgactccatagctccaaagagggagaaaacaaatggtgaagtagagaggcgcattgtatctcaactattgacattgatggatggtctaaaatctcgatctcatgtgattgtcatgggagcaacaaataggcctaacagcattgatccagcacttagaaggtttggtaggtttgatcgtgaaattgacattggggttccagatgaagttggccgactggaagttcttcgcatccacacaaagaatatgaagctttctgaagatgttgatcttgaacgtatttcgaagaatacacatggctatgttggggcagatcttgcagctctttgcactgaggctgcactgcattgtattagggaaaaaatggatgtcattgacttggaagatgaaactattgatgcggaagttctgaattctatggctgttacaaatgagcactttcaggctgcactgggctctagtaacccttctgccctgcgtgagactgttgtggaggtgccaaatgtttcttgggaggatattgggggtctggaaaatgtcaaaagagagcttcaggagactgtgcaatatccggtggaacatccagagaaattcgagaagtttggtatgtctccctctaaaggtgttctattctatggacctcctggttgtggtaagacgcttctggcaaaggccattgccaatgagtgtcaggccaactttatcagtgtgaaaggcccagagctcctaacaatgtggtttggagaaagtgaagccaatgtgcgtgatatttttgataaggctaggcagtcagcaccttgtgtccttttttttgatgagcttgattcgattgctacccagcgtggtagtagtgcgggagatgctgggggtgcggcagacagagttttgaatcagttgctgactgagatggatggcatgtctgccaagaaaactgttttcattattggagctacgaatcgccctgacattattgattcggctttattacgacctggtcgccttgatcaattaatatacatacccttgcctgatgaagcttcccgctttcaaatctttaaagcatgtttgcggaagtcacctgttgcaaaggatgttgaaattgtgactcttgctcaatacacacaaggatttagtggagctgatattactgaaatttgtcagcgtgcttgcaaatatgctattagagaacatatt

SEQ ID NO: 7527 - DNA, 2650 bp, Sorghum bicolor
ccacgacgaccccatcggaacgcaaacgcgaactgcttttcctgccgcggacgcaagaggcgaagccaaagagcaccaagccacgccacacgcccacacgacaccacaccacactgccaccaaccgttctcgagcaagattgagcccggcacgacgtcggacgacggcgcagcggcgtgctgtcctcccgccgccaggacgatgaagaaggcggcgaacaagctggtggtggaggagccgaccaacgacgacgtctccatatgcaacctccacccggcgaccatggagaagctgtccatctaccacggcgacgtggtcctgctcaaggggaagcggcgccgcgacacgatctgcatcgccatgaacaacgaggggtgcggggagcacgcgctcggcatcaaccggtccgtccgctccaacctccgggtgcgcctgggcgacgtcgtgtccgtgcacccgtgccacgacgccgcgtacggggccaaagtgcatgtcctgcccctcgacgacaccgtggagggcctcacgggggacctcttcgaggcctacctgaagccgcacttcctcaacgcctaccgccccgtccgcaagggcgacctcttcctcgtgcgcggcggcatgaggagtgtggaattcaaggtggtggacatccacccgcccgccgagtactgcatcgtcgccgacgacacggtggtgttctgcgatggcgagcccgtgaagcgggaagacgaggagaggctcgatggcgttggctacgatgacgttggtggcatgcggaagcagctggctcagatcagggagctggtcgagctcccactcaggcacccgcagttgttcaagtcgattggagtgaagccccccaagggcatcctattgtacgggccgcctggctccggaaagactctcattgcccgtgcagtcgctaacgaaaccggcgccttcttcttctgcataaacggtcccgagatcatgtcgaagctagccggagagagcgagagcaatcttcgaaaagcattccaggaggcggagaagaacgcgccgtccatcatctttattgatgaaatcgactctatcgcgcccaagagggagaagacacacggcgaggtggagaggcgcattgtgtcccagcttctcacgctcatggacggcctcaagacacgcgcgcatgtcattgtcatgggcgcgacgaaccgccccaacagcatcgaccccgccctgcgacgcttcggccggttcgatcgcgagattgacatcggcgtgccggacgaggtcggacgcctcgaggtgctgcgcgtgcacaccaagaatatgaagctcgccgaggacgtcaacctggaggccgtgtccaaggacacgcacgggtatgtcggcgccgacctggccgcgctctgcaccgaggccgcgctgcagtgtatcagggagaagatggacgtcattgacctcgaggacgacacgatcgacgcggagatcctcaactcgatggccatcacgaacgaccacctcaagaccgccctcgccggcaccaacccgtcggcgctacgcgagaccgttgtggaggtgcctaacgtcagctgggcggacatcggaggcctggagggcgtcaagcgggagctgcaggagaccgtgcagtaccccgtggagcacccggacatgttcgagaagttcggcatgtctccgtccaggggcgtgctcttctacgggccgcctgggtgcggcaagacgctgctcgccaaggcgatcgcgaacgagtgccaggccaacttcatcagcgtcaagggtccggagctgctgaccatgtggttcggcgagagcgaggccaacgtccgagacatcttcgacaaggcgcggcagtcggcgccgtgcgtcctcttcttcgacgaactggactcgatcgccatgcagaggggcagccacgtgggcgacgccggcggcgcggcggacagggtcctgaaccagctcctcaccgagatggacggcatgagcgccaagaagacggtgttcatcatcggcgccacaaaccggccggacatcatcgacccggcgctgcttcggcctggtcgcctggaccagctgatctacatcccgttgccagacgaggcctcgcggcaacagatcttcaaggcctgcctcaggaagtcccccgtggccaagaacgtcgacctcggtgcgctggccaggttcacggcagggttcagcggcgcggacatcacggagatttgccagagggcgtgcaagtacgccatcagagaggacatcgagaaggacatcgagagggagaggaaggccaaggagaatccgggggaaatggcggtggactgcgccgacgacgagccggcgcagatcggggccgtgcatttcgaggagtccatgaggtacgcgcggaggagcgtcagcgacgcggacatccgaaagtaccaggcgttcgcgcagacgctgcagcagtcgaggggattcggcaccgagttccgcttccccatccggccccaacaggcggcagaagcagaggcggcggccgactctgaggaggatgatatttacagctgattcttgtactattggaggttcagcttggtattttcgtttttctggaacacatcgatgttaacgttgttgccggtattgttacagtgtagagcatttatttcattgc

SEQ ID NO: 7528 - DNA, 2399 bp, Setaria italica
atggccgacgacgcagccgccgcgtcgtcctgtcctactcctaccgctacgaagaagagagccgcgaaccggctggtggtagaggaggccaccaccgacgaaaactccgtctgcaacctccaccctgcaaccatggaggagctctccatcttctccggcgacatcatcctgctcaaggggaagcgccgccgcgacacgatctgcatggccatgccggacgaggagtgcggagagaacaagattaggatcaacaaggtggtccgctccaacctccgggtgcgcctcgccgacgtcgtgtccgtgcaccagtgccatgacgccaggtacggggcggccgtccacttcctccccctcgacgataccgtcgagggcatcacgggggacctcgtccaggcctacctcaagccctacttcgacgacgcgtaccgccccgtccgcaagggcgacctcttcctcgtgcgcggcggcatgaggagcgtcgactttaaggtcgtcgacatcaagcccgccgccgagtactgcatcgtcgcgaacgacaccgagatcgtctgcgagggcgagcccgtcaagcgcgaggacgaggagaggctcgacgacgtcggctacgatgacgtcggcgggatgcggaagcagctggcgcagatcagggagctggtcgagctgccacttcgtcacccgcagctgttcaagtcgatcggcgtcaagcctcccaagggcatccttctctacggcccgcccggctccggcaagaccttgatcgcccgtgtggtggcgaacgagaccggggccttcttcttctgcataaacgggcccgagatcatgtccaagatggccggcgagagcgagagcaacctcaggaaggcgttcgaggaggccgagaagaacgctccgtccatcgtcttcatcgacgagatcgactccatcgcgcccaacagggacaagacccacggcgaggtcgagagacgcatcgtctcccagctgctgacgctcatggacggcctcaaggcgcgggcgcacgtcatcgtcatgggcgccaccaaccgccccaacagcatcgaccccgccctcaggcggttcggcaggttcgaccgcgagatcgacatcggcgtgccggacgaggtcggccgcctcgaggtgctgcgcgtccacaccaggaacatgaagctcaccgaggacgtcgacctcgaggtcgtcgccaaggacacgcacggctacgtcggcgccgacctcgccgccctttgcaccgaggccgccctgcagtgcatcagggagaagatggacgtgatcgacctcgatgacgagacgatcgacgcggagattctcaattcgatggccatcaccaacgaccacctcaagactgccctcgccggcaccaacccgtcggctctacgcgagaccatggtcgaggtgcccaacgtcagctgggccgacattggcggcctcgagggcgtcaagcgggagcttcaagagaccgtgcagtaccccgtggagcacccggacaagttcgagatgttcggcatgtccccttccaagggcgtgctcttctacgggccccccggctgcggcaagacgctgctcgccaaggcgatcgccaacgagtgccaggccaacttcatcagcgtcaagggccccgagctgctgaccaagtggtttggcgagagcgaggccaacgtccgcgatatcttcgacaaggcgcgccagtccgcgccgtgcgtcctcttcttcgacgagctcgactcgatcgcgacgcagaggggcggcagcgtgggcgacgccggcggcgccggggacagggtcctcaaccagatgctcacggagatggacggcatgaacgccaagaagacggtgttcgtcatcggcgccaccaaccggccggacatcatcgacccggcgatgctccgccccggccgcctcgaccagctcatctacatcccgctgccggacgaggcgtcgcggcaccagatattcaaggcgtgcctgaggaagtcccccgtcgccaaggacgtcgacctcggcgcgctggccaagttcacggcgggcttcagcggcgccgacatcacggagatttgccagagggcgtgcaagtacgccatccgcgaggacatcgagaaggagatcgagcgggagaggcaggccaaggagaggccggacgacatggcggtggacggcgccgaggacgaggagccggcgcagatcaaggccgtccactttgaggagtcgatgaggttcgcgcggaggagcgtcagcgacgcggacgtccgcaagtaccaggcgttcgcgcagacgctgcagcagtcgcggggattcggcagcgagttccgcttctccaagcagccccaagcggcggagcctgctgccacggccaacgccgacgccgaagatgatctttacgactgatc

SEQ ID NO: 7529 - DNA, 2127 bp, Brassica napus
gaggagtgtggagttcaaggttattgagacagatcctgctgagtactgtgtggtggctccggacactgagattttctgtgagggtgagccagttaagagagaggacgaagagaggctagatgaagtgggttatgatgacgttggtggtgtcaggaagcagatggctcagatcagggagcttgttgagcttcccttgaggcatccacagctgttcaagtcgattggtgttaagccaccgaaggggattctgctttacggaccacctgggtctggaaagactttgattgctcgtgccgtggctaacgaaactggtgcctttttcttttgtatcaatggtcctgagattatgtctaagctggctggtgagagtgagagcaacctaaggaaagcgtttgaggaggctgagaagaacgctccgtcgattatatttattgatgagattgactctattgcacctaaaagagagaagactaatggagaggttgagaggaggattgtgtctcagctccttacgcttatggatgggcttaagtctcgtgctcacgttattgttatgggagcaaccaatcgtcccaacagtattgatccagctttgagaaggtttggaagatttgatagggagattgatattggtgttcctgatgagattggacgtcttgaagttctcaggatccacacaaagaacatgaagcttgctgaagatgtggatcttgagaggatctcgaaggacacacacggttatgttggtgctgatcttgcagctctgtgcacagaagctgccctgcagtgcatcagggagaagatggatgtgattgatttggaagatgactccatagatgctgagatcctcaactccatggcagtgaccaatgaacacttccacactgctctcggaaacagcaacccatctgcacttcgtgaaactgttgttgaggttcctaatgtttcttgggatgacattggaggtcttgagaatgtcaagagagagctccaggagactgtgcaatacccagtggagcacccagagaagtttgagaagttcggtatgtctccatcaaagggagtcctcttctacggtcctcctggatgtggtaaaacgctattagccaaagctatagccaacgagtgccaagcgaacttcatcagcgtcaaaggtcctgagcttctcaccatgtggtttggtgagagtgaagccaacgtccgtgaaatctttgacaaggcacgccagtctgctccatgtgttctcttctttgacgagctcgactccattgcgactcagagaggaggtggaggcggaggtgatgcaggcggtgcagcagacagagtcctgaaccagcttttgaccgagatggatgggatgaacgctaagaagaccgtcttcatcatcggagcaaccaacagacccgacattattgattctgctcttctccgtccaggaaggctcgaccagctcatttacattccgctcccagacgaggattcacgtctcaatatctttaaggcctgcttgaggaaatctcccgttgctaaagatgtggacatcaacgcgctggctaagtacacgcaggggttcagtggtgctgatatcactgagatttgccagagggcttgcaaatacgccatcagagaaaacatcgagaaggacattgaaaaggagaagaggaggagcgagaaccctgaggccatggaggaggatggagtggatgaagtgtctgagatcaaagctgcacactttgaggagtcgatgaagtatgcgcgcaggagtgtgagcgatgcagacatcaggaagtaccaagcgtttgctcagacgctgcagcagtctagagggtttggttctgagttcaggttcgagactaatgctgctggttcaggtgcaaccactggagtcgccgatccttttgccacctcggcagctgctgctgcggacgatgatgatctctacaattagtgtgatcaaatttattatcctttttatttaagttttcaatcgaattctctcaactttcaaccttatgtttctttaaaaagttatcggaattatgttgattgcttttaatcaatgtacctgcttcactcttgttcaatttatttttagaagccaaaagtaacgacttacatgattgtata

SEQ ID NO: 7530 - DNA, 2027 bp, Vinca minor
taccctgtggttgttgcatttacaatcaaatgtaacctcacaaaacatctcgacaaagttctggaagaagctgcagctgagttttatccacatgtaaaatttatgcatgtcgagtgtccaaagtttcctggtttttgcattacgaggcagaagaaggagtatcctttcatagaaatatttcatagcccagaacaggctactaatcaaggacggtctattgatccaaatatcacaaaatactcggtgcaagttctaccagaagaagaaaagtcatttttctctctccagcggcgccgttctcttctctgtcgcttttctccttctccgacgcttttttccttctccggcgcctttcttctctctctattctttttttctgttcaacgtgtggcaaagaatagcttctccgactttttctccggcgcgccatatgtccagtgtagcagatccatcaccgccgcctgcggttcttcttctccggcgcatcgccgccgcctttcttctctgcaggtcatcgagatgacagaaccttcaaaagtcattcatgtgcgcaacgtgggacatgaaatttctgagaatgacttacttcagctgttccaaccatttggggttatcaccaagcttgtgatgcttcgggcaaaaaatcaggctcttcttcaaatgcaagatgttccttcagctgtaaacgcgctgcaatcctacaaaaatgttcaaccgagtataaggggtaggaatgtctacattcagttttcgtcacatcaggaactgacgactatggatcagaatactcaagggcggggagatgagcctaatcgaattgtgttagttacaatacatcacatgctataccccattactgtggaagtgctgcatcaagtgttttctcctcatggacttgtggagaagatcgtcacatttcagaagtcggctggctttcaagctttaattcagtatcagttgcagcaaagtgctgttgctgcaagaaattctcttcaaggacgtaacatatatgatggttgctgccagctagacattcagttctcgaaccttgatgagttacaagtgaattacaataatgagcggtctagggatttcacgaatccatctctgcaatcagaacagaaggggggtagatcatctcatcctggtggatatggagatatgggagttggatatccccagatggccaatgcagctgctattgctgctgcctttggaggtggtttgcctcctgggataagtgggacaaacgacagatgcactgttctcgtttctaatctgaattctgatagaattgatgaggataagctatttaacctgttctccatctatggtaacattgtaaggatcaaacttcttcgtaataagccagaccatgcattggttcagatgggtgatggcttccaggctgaattggctgtccactttttgaagggagccaagctttttgggaagcgtttggaggtgaactattcaaagcatccaaacatcaccactggcgccgatacacatgaatactcaaactcgaacctcaaccgctttaaccgcaatgcagctgcagccaagaactaccggtactgctgttcaccaaccaagatgattcacatatccacccttcctcagaatgtaactgaggaggaaattgtagcccacttggaggagcacggaaccattgtcaactctaagctatttgaaatgaatggaaagaaacaggctcttgtgcttttcgagaatgaggaggatgcaactgaagcacttgtatgcaagcatgcaacgtctcttggtggttcaaccattcggatttccttttctcagttgcagaccatttgagggagtgcatgctggaattggatactatgtgagaattttattgttctaactaataattgtttcgagagtctcacctgtaactgtagttttctcttttttacttgtgtattatgattctttttctattgggcggcataattggactatttctgctgatcttcttgctatttacatataggttggaaatttggtgaagt

SEQ ID NO: 7531 - DNA, 1584 bp, Helianthus annuus
gtcgcatcgcacgggtcacttactccctttgccgcttgcaagcttgttttcttcatcttcttcttcttcttcaggatatggcagagccttccaaagtcattcacgtccggaatgttggtcatgagatttcggagcctgatctgcttcagctattccagccatttggagtcattaataaactagtaatgcttcgtgcaaaaaaccaggctctcctacaaatgcaagatgttcctgctgctgtcagtgcaatgcaattttatgccaatgtgcagccaagcataaggggaagaaatgtttatgttcagttttcatctcatcaagagctaaccacaatggagcaaaatactcaaggacgagtagacgaggagcccaatcgcattcttttggtcaccattcatcatatgctgtaccctataactgtggaagtcctgcatcaagttttttctcctcatggatatgtcgagaaaattgtcacctttcaaaagtcagctggttttcaagcactaattcaatttcagttacggcaaagtgctgtggttgcaagaaattctcttcaggggagaaatatttatgatggttgctgccaactagatattcagttctcaaatcttgaagagttgcaagtcaactacaataatgagcggtctagggattttacaaacccatcactaccctcagaacagaagggcagaccctcccaacctggatatggagatgcgggagctggatatccacagatgaacaacgcggctgcaattgccgctgcatttggaggcggcttgcctcccggaatcaccgggaccaacgacagatgcactgttcttgcatctaatttaaatcctgataggatagacgaggacaagctgttcaacttgttttctttatatgggaacattgtgagaatcaagctgcttcgcaacaaaccagatcatgctcttgttcagatgggtgacgggtttcaggctgagttggcagtacactttttgaagggagccactctgtttgggaagcggttggaggttaatttctcaaagcatcctaatattacaatgggtgctgaaacacacgagtatttaaactccaatttgaaccggttcaaccgcaatgctgccaaaaattaccgttactgttgctcaccgaccaaaatgatccacctatcgaccctaccacaggatgtgaccgaagacgagattatatcccatcttgaagaacacgggagcatcgtcaacaccaaagtgtttgaaatgaacggtaaaaaacaggctcttgttatgtttgaaaacgaggaacaagcaactgaagcacttgtgtgcaagcatgcaactacacttgcagattctatgattcgtatatccttttctcagttgcagacaatttgactagtcaacctctcaccttgatggattccataaatttgctctcttcattttgttctcacaaaccctttgtttgttcttgtgtgtattcttacttttgagattttagatgcttgtacgattttttttctttttgtttgtattatttatttcgctgtttctagttatattgctattttgcagaataaaaactaaaaatggctgctgc

SEQ ID NO: 7532 - DNA, 2738 bp, Flaveria ramosissima
agggcgaagtcgcacccaacaggagtcgctctctctgccgcgtccaagcttcggctgacttcatcttcatcttcatcttcatcttcaggatatgacagagccttctaaagtcatccacgttcggaatgttggtcatgagatttcggagcctgatctgctacatctattccagccttttggagccattaacaaactagtgatgcttcgtgcaaaaaaccaggctcttctgcaactgcaagatgttccttctgctgtcagtgcaatgcaattttatgccaatgtgcagccaatcataaggggaagaaatgtttatgttcagttttcatctcatcaagagctaactaccatggagcaaaatactcaaggacgagtagatgagcccaaccgtattcttttggtcactattcatcatatgctgtaccctataactgtggaagtcctgcatcaagttttctctcctcatggatatgtggagaagatcgtcacctttcaaaaatcagctgggtttcaagcactaattcaatttcagttacgccaaagtgccgtggctgcaagaaattctcttcaggggagaaatatttatgatggttgctgccaactagatattcagttctcaaatcttgaagagttgcaagtcaactacaataatgagcggtctagggatttcacgaacccatcactaccttcagaacagaagggcagaccctcccaacctggatatggagatgcaggagttggatatccacagatgaacaatgcggctgcaattgcagctgcatttggaggtggattgccccctggaattagcgggaccaatgacagatgcactgttcttgcatctaatctaaatcctgataggatcgatgaggacaagctgttcaacttgttttctttatatgggaacattgtgagaatcaagcttcttcgtaacaaaccagatcatgctcttgttcagatgggtgatgggtttcaggctgagttggcagtacactttttgaagggagctacactatttgggaagcggctggaggttaatttttcaaagcatcctaatattacaatgggtgctgaaacacatgagtatttgaactccaacctgaaccggttcaaccgcaatgctgctaaaaattaccgttactgttgctcacctaccaaaatgatccacctatcgaccctgccgcaggacgtgacagaagatgagatcatatcccatcttgaagaacacgggaacattatcaacacgaaagtgtttgaaatgaatggtaaaaaacaggcccttgtactgtttgaaaatgaggaacaagcaacggaagcacttgtgtgcaagcatgcaaccactcttgcagattctatgattcgtatatccttttcccagttgcagacaatttgactggtcaacttcagcttgatgggttccataaatttgcacttggcagcaagccctttgtttgtttgttttatgtagtgtgtattcttatttgagatgttagatgcttgtacttaacttttttggtttgtatcatctgtctgttgtttttattcgaaaaaattcaaacaatccatttatgtaataattaaaaaccactcgtattatacacaatcaatatatatataatcaattataaatcctcctatacgcccttaatcctcatcttgaatttcatatatctgactgctcaaaccatggttcttttcctcgatcgacggtgatgccggtgacccaaatcgggcctccccgtctccttgaaccgttgcctgagcaacggttcaatcacgcattccggtggggaagggggtacctcaaagtatcataacaatacgaataatacatgtacttttccctaaatcttttcatcgcgatcctttgtttcggtgtgatgttgttgtaatgaattgtttcgagttgtttgtcgatttcgacacagttttcggttgagagttgtcgaatcgggttggagatgcagccatggaggaggagatcagtcatctcggtgacgaaaggggcatatttgtaatttaccttgtatttaccgccgttggtggcccaatttgaagcgtcccatatcgtggcgtatagcgccataggctttgacgggaagtcgctgcccatttcgtcgcttcttaggatctcgcggatcgggacctcgtcgatgtaaaatatgattttcgaagaggtccacagaatcgtataacgatgataggctttcgaaggatcaaaccacaaagtgtatctttcttctctacctctacttgtgcttccattgccgtacaaattggtctgaaacctccatggctttcctttaatattccccaagaactcgaaatccaattcgtcgtgtgtcttctcgaacacatcgccattcgacgtataaaatgctacaacgatccccgcggtgtaatccaatggtagtttgattttagcactgaataatccatggttgtacatgtccgatgatcgaaatccagcacctgtgaattgattgaggtggagatggacggtgttgtcatcgtgtgagcggaggagattggtgttgccgccgaagagttgggtgaagccgttgcggaaagagagtatacgcggtggcgtcgtggcggcaccgccggcgaggggctgcaggaggaggaggagggagatgcatatggttgttttagagagagaaatgcggaaatggtcgttcattttgaagttgtgttttttaacacaataatttgggtctattttgcttatatacatagaa

SEQ ID NO: 7533 - DNA, 1631 bp, Tragopogon dubius
tatgcaaaaatatagaagatcgtaattaggtcgaagtcccacacaccaaagaattcgtaacccaataatacgatttctattcagacactctttgccgcttccaagcttcggctgacttcacttctcatcttcagggaaaattataatgacagagccttctaaagtcattcacgttcgaaatgttggtcatgagatttccgagcctgatttgcttcaactattccagccttttggagtcatcaacaaactagtcatgcttcgtgctaaaaaccaggctctccttcaaatgcaagatgtcccttcagctgtcaatgcaatgcaattttatgccaatgttcaaccaagcataaggggaagaaatgtttatgttcaattctcatctcaccaagagctaacaaccatggagcaaaatactcaaggacgaggagacgaggagcctaatcgtatactcttggtcactatacatcacatgctataccctataaccgtggaagtgctgcatcaagtcttttctcctcatggatacgtggaaaaagtcgtcacttttcaaaagtcagctgggtttcaagcacttattcagtttcaatcgcgacaaagtgctgtttctgctagaaattctcttcaggggcgtaatatttatgatggttgttgtcaacttgatattcagttctcaaatcttgaagagttgcaagtcaactacaataacgaacggtcaagggattttacaaacccatcacttccctctgaacaaaagggcagaccttctcaacctggatatggagatgcaggagttggatttccacagatgaacaatgctgcagcaattgcagctgcatttggaggtggtttgcctcctggaattagtgggacaaatgagagatgcactgttcttgcatctaatctaaaccctgataggatagacgaggacaaactcttcaacttgttttctttatacggaaacattgtcagaatcaagcttcttcgcaataaaccagatcacgccctagttcagatgggcgacggctttcaatcagagttagctgtccactttttaaagggcgctacactcttcgggaaacgtttagaagttaattactcaaagcatcccaacatcacaatgggtgccgaaacacacgaatatctgaactcaaatctgaaccggttcaaccgcaatgctgctaaaaactaccgttactgctgctcacctaccaaaatgatccatctttccactttacctcaagatgtgacagaagaggagattgtgtcgcatctggaagaacatggaagcattgtgaacagtaaagtttttgaaatgaatggtaaaaaacaagcacttgttatgtttgagaacgaagaacaggcgactgaagcgcttgtgtgtaaacatgcaagcactcttggcgattccatgattcggatctcgttttctcagttgcagacgatttgagtggtaatgtttctctgacactctcgctttatgtttggtcatgtgattttaaactctttgttttagtgtgtattcttaagttctttgtattattaatttctggtttttgcatgctatattatataaacacatttgtacttttagttatgttagttttgactagactaatagcaatttaaatatg

SEQ ID NO: 7534 - DNA, 1659 bp, Flaveria ramosissima
tctgaagacgttaattagggcgaagtcgcacccaaccggagtcactctctctgccgcgtccaagcttaggctgacttcatcttcatcttcatcttcatcttcatcttcatcttcattttcatcttcatcttcatcttcatcttcaggatatgacagagccttctaaagtcatccacgttcggaatgttggtcatgagatttcggagcctgatctgctacagctattccagccttttggagtcattaacaaactagtgatgcttcgtgcaaaaaaccaggctctcctacaattgcaagatgttccttctgctgtcagtgcaatgcaattttatgccaatgtgcagccaagcataaggggaagaaatgtttatgttcagttttcatctcatcaagagctaactaccatggagcaaaatactcaaggacgagtagatgaggagcccaaccgtattcttttggtcactattcatcatatgctgtaccctataactgtggaagtcctgcatcaagttttctctcctcatggatatgtggagaagatcgtcacctttcaaaaatcagctggttttcaagcactaattcaatttcaattacgccaaagtgctgtggctgcaagaaattctcttcaggggagaaatatttatgatggttgctgccaactagatattcagttctcaaatcttgaagagttgcaagtcaactacaataatgagcggtctagggatttcacgaacccatcactaccttcagaacagaagggcaggccctcccaacctggatatggagactcaggagttggatatccacagatgaacaatgcggctgcaattgcagctgcatttggaggtggattgccccctgggattagcgggaccaatgacagatgcactgttcttgcatctaatctaaatcctgataggatcgatgaggacaagctgttcaacttgttttctttatatgggaacattgtgagaatcaagcttcttcgtaacaaaccagatcatgctcttgttcagatgggcgatgggtttcaggctgagttggcagtacactttttgaagggagctacactatttgggaagcggctggaggttaatttttcaaagcatcctaatattacaatgggtgctgaaacacacgagtatttgaactccaacctgaaccggttcaaccgcaatgctgctaaaaattaccgttactgttgctcgccaaccaaaatgatccacctatcgaccctgccacaggatgtgacagaagatgagatcatatcccatcttgaagaacacgggagcattatcaacacaaaagtgtttgaaatgaatggtaaaaaacaggcccttgtattgtttgaaaatgaggaacaagcaacggaagcacttgtgtgcaagcatgcaaccactcttgcagattctatgattcgtatatccttttcccagttgcagacaatttgacttgtcaacttcagtttgatcggttccataaatttgcacttggcagcaagccctttgtttgtttgttttatgtagtatgtattcttatttgagatgttagatgtttgtactaatttttcctttttggttgtatcatctgtttctgttgtttttattcatattgctattttgcagaataaaaactataaaacgcttacgtttagactgc

SEQ ID NO: 7535 - DNA, 1527 bp, Flaveria ramosissima
agacgttaattagggcgaagtcgcacccaacaggagtcgctctctctgccgcgtccaagcttcggctgacttcatcttcatcttcatcttcaggatatgacagagccttctaaagtcatccacgttcggaatgttggtcatgagatttcggagcctgatctgctacatctattccagccttttggagccattaacaaactagtgatgcttcgtgcaaaaaaccaggctcttctgcaactgcaagatgttccttctgctgtcagtgcaatgcaattttatgccaatgtgcagccaatcataaggggaagaaatgtttatgttcagttttcatctcatcaagagctaactaccatggagcaaaatactcaaggacgagtagatgagcccaaccgtattcttttggtcactattcatcatatgctgtaccctataactgtggaagtcctgcatcaagttttctctcctcatggatatgtggagaagatcgtcacctttcaaaagtcagctggttttcaagcactaattcaatttcagttacgccaaagtgccgtggctgcaagaaattctcttcaggggagaaatatttatgatggttgctgccaactagatattcagttctcaaatcttgaagagttgcaagtcaactacaataatgagcggtctagggatttcacgaacccatcactaccttcagaacagaagggcagaccctcccaacctggatatggagacacaggagttggatatccacagatgaacaatgcggctgcaattgcagctgcatttggaggtggattgccccctggaattagcgggaccaatgacagatgcactgttcttgcatctaatctaaatcccgataggatcgatgaggacaagctgttcaacttgttttctttatatgggaacattgtgagaatcaagcttcttcgtaacaaaccagatcatgctcttgttcagatgggtgatgggtttcaggctgagttggcagtacactttttgaagggagctacactatttgggaagcggctggaggttaatttctcaaagcatcctaatattacaatgggtgctgaaacacacgagtatttgaactccaacctgaaccggttcaaccgcaatgctgctaaaaattaccgttactgttgctcgccaaccaaaatgatccacctatcaaccctgccacaggacgtgacagaagatgagatcatatcccatcttgaagaacacgggagcattatcaacacaaaagtgtttgaaatgaatggtaaaaaacaggcccttgtattgtttgaaaatgaggaacaagcaacggaagcacttgtgtgcaagcatgcaaccactcttgcagattctatgattcgtatatcattttcccagttgcagacaatttgacttgtcaacttcagtttgatgggttccataaatttgcacttggcagcaagtcctttgtttgttttatgtagtgtgtattcttatttgagtatgttagattgtttgtacttaattttttccttttggttgtat

SEQ ID NO: 7536 - DNA, 1484 bp, Cirsium arvense
acccattccctttcagacactctctttgccgcttcaagcttcgtctcacttccttcatcttcatctctttcccttccattccattccatctttcagggatatttttaaaatgacagagccttctaaagtcattcacgttcggaatgttggtcatgaaatttctgagcctgatctgcttcagctattccagccttttggagtcatcaacaaactagttatgcttcgtgcaaaaaaccaggctctgcttcaaatgcaagatgttccctcagctgtcaatgcgatgcaattctatgccaatgttcagccaagcataaggggaagaaatgtttatgttcagttctcgtctcatcaagagctaactactatggagcaaaatactcaaggacgaggagacgaggagccaaatcgtatactcttggttaccattcatcacatgttataccctataactgtggaagttctgcatcaagtattctcccctcatggatatgtggagaaggtcgtcacttttcaaaagtcagctggttttcaagcacttattcaatttcaatcgcgccaaagtgctgtttctgccagaaattctcttcaggggcgtaatatatatgatggttgctgtcaactagatattcagttctcaaatcttgaagagctgcaagtgaattacaataatgagcggtctagggatttcaccaacccatcgctgccttcagaacagaaagggagaccctctcaacctggatacggagatgcaggagttggatttcctcagatgaacaatgctgctgcaattgcggctgcatttggaggtggcttacctcctggaattagtgggacgaatgaaagatgcactcttcttgcatctaatttaaatcctgacaggatagatgaggataaactcttcaacttgttttctctgtatgggaacattgtccgaatcaagcttcttcgcaataagccagatcatgcgttagttcagatgggtgacggctttcaggctgagttggctgttcactttttgaagggagctacactatttgggaagcggttggaggttaatttttcaaagcatccaaatatcacaatgggtgctgaaacacacgagtatttaaactcgaatctgaaccgttttaaccgcaacgctgctaaaaattaccgttattgttgctcaccaaccaagatgatccacttatcgaccctgccacaggacgtgacagaagaggagatcgtatcacacctggaggaacatggaagcatagtgaacacaaaaactgtttgaaatgaacggaaagaagcaggctctcgtgttattcgaaagcgaagaacagtcgactgaagctctcgtctgcaagcatgcaagcacgcttggtgattcgatgattcggatctccttttctcagttgcagacaatttgagttataaatctcatcgtgtttattcatggatttcttggataaatttggtatttcttgtgatttttatgcaac

SEQ ID NO: 7537 - DNA, 1664 bp, Ambrosia trifida
tttaaaaagaaagaaaacatagaagtggaagatgtgttaattagggcgaagtcgcagactccctttgccgcttccaagtttctccttccttccttccttgggctgggctgacttgtttttattcattcatccatcaacagataagataggatatgacagaaccatccaaagtgattcacgtccggaatgttggtcatgagatttctgagcctgatctgcttcagctattccagccttttggagtcattaacaaactagtcatgcttcgtgctaaaaaccaggctctcctacaattgcaagatcttccttctgctgtcagtgcaatgcaattttatgccaatgtgcagccaagcataaggggaagaaatgtttatgttcagttttcatctcatcaagagctaactactatggagcaaagtacccaaggacgagtagacgaggagcccaatcgcattcttttggtcaccattcaccatatgctgtaccctataactgtggaagtccttcatcaagttttttctcctcatggatatgtggagaaaatcgtcacctttcaaaagtcagctggttttcaggcactaatccagtttcagttacggcaaagtgctgtggctgcaagaaattctctgcaggggagaaatatttatgatggttgctgccaactagatattcagttctcaaatcttgaagagttgcaagtcaactacaataatgagcggtccagagacttcacaaacccatcgctaccttcagaacagaagggcagaccctcccaacctggatatggagatgcgggagctggatatccacagatgaacaacgcggccgcgattgctgctgcatttggcggcggattgcctccaggaatcagcgggaccaacgacagatgcactgttcttgcatctaatttaaatcctgataggatagacgaggacaagctgttcaacttgttttctttatatgggaacattgtgagaatcaagcttcttcgcaacaaaccagatcatgctcttgttcagatgggtgatgggtttcaggctgagttggcagtacactttttgaagggagctactctatttgggaagcggttggaggttaatttctcaaagcatccgaatattacaatgggtgctgaaacccacgagtatttaaactccaatttgaaccggttcaaccgcaatgctgctaaaaattaccgttactgttgctcaccaaccaaaatgatccacctatccaccctaccacaggatgtgacagaagacgagattatatcccatcttgaagaacacgggagcatcgtaaacaccaaagtgtttgaaatgaacggtaaaaagcaggctcttgttatgtttgaaaacgaggaacaagcaactgaagcacttgtgtgcaagcatgcaaccacactttcagattctatgattcgtatatccttttctcagctgcagacaatttgaccagtcaactttcaccttgattgattccataaatttgctctcttcattttgttctcacagaccctttgtttgttctagtgtgtattcctacttttgagatcgtagatgcttgtactatttttttctttttggttgtattatttacttcgtgtttttaattgtattgctattctgcagaataaaaactaaaaatggcagcttcttgtttaa

SEQ ID NO: 7538 - DNA, 1703 bp, Mimulus guttatus
tccttattcttatgctatcgttttgatcataattctctctctcctggaagctgataggattttcaagcattttgctatactgtttgtgctcttactatatcacttctaaaagatcgactcgacaccattttctggattcttgacaatggcagagccttcaaaagtcattcacgtccgtaacgtgggtcatgaaattgctgagaatgacttgctccagctattccagccttttggagtcattaccaagcttgtgatgcttcgagccaagaatcaggccctccttcaaatgcaagatatcacttcagcagtaaatgccttacaattttactctaatgttcagccgagcataaggggaagaaatgtttatgttcaattttcatcacaccaagaacttacagttatagatcagaattcccaagcaagaggagatgagcctaaccgagtcctcttagttacggtgcatcacatgctatatcctataactgtggaagtgctgcatcaagttttttctcctcatggattcgtagagaagattgtcacgtttcagaagtcggctggttttcaagctctaattcagtatcaactacagcagagtgctattttagcaagaaactctcttcagggacggaatatatatgatggttgctgccagctggacattcagttctcaaaccttgatgaattgcaagtgaattataacaatgagcgctctagggatttcacaaacccttccttgccttcagaacaaaagggcaagtcctctcaacctgggtatggagatgcaggcatgtatgcgcatccagttggatatcctcagatgggtaatgctgctgctattgctgctgcctttggaggagttttgccacctggtttaagtggtaccaatgatcggtgcacggttcttgtatccaacctgaatcctgatagaatagatgaggataagcttttcaatttgttctcaatttatggaaacattattagaatcaaactgctccgaaacaaaccagatcatgcgttggtccaaatgggtgatggttttcaggctgaattggtcgttcactttttgaagggtgccatgttgtttgggaaacggttggaggttaatttctcaaagcatgtaaacataacaactggatctgatacccacgattactccaactcaaatctgaaccgtttcaaccgaaatgctgccaagaactaccgatattgctgttcaccaactaaaatgatccacatatccactcttccccaggatgtgaccgaagaagaaatagcaagtcaccttgaagagcatggaacaattgtcggtacaaaactgtttgagatgaatggaaaaaagcagtctctggtactttatgaaaatgaggagcaggctacagaagcccttgtgtgcaagcatgctacatctcttggtggttcaactattcgcatttccttctcacaattgcaaaccatatgagagaggggactttcttgcaaatacagcaaccttttgtagctgtagaccagtatgttttcatttcacaaacttgtatattggcaatatcctcactctgttttacttgcacaatgccatcattgggggtaatgcattggttatacattgttctttgttatattgaacaatctccatgaacgaatatgatgatgttacttttgttttttaacctgtaacccgttgaaaggagtaacctaccttgacc

SEQ ID NO: 7539 - DNA, 1519 bp, Lactuca sativa
caagataatatatgaaaaggcccatacttttatttaccctgtttatgaaacgaagcaaaagcaaaaatatagaagatcatattcataactagggcgaagtccccacaacactaagagaattcgtaacccaatacgattttccctttcagacactactctctttgccgcttccagcttcggctgacttcgttcatcatcttcaggataatttaaaatgacagagccttctaaagtcattcacgttcggaatgttggtcacgagatttcggagcctgatctacttcaactattccaaccttttggagtcatcaacaaactagttatgcttcgtgcaaaaaaccaggctctccttcaaatgcaagatgtcccttcagctgtgaatgcaatgcaattttatgccaatgttcaaccaagcataaggggtagaaatgtgtatgttcagttttcatctcaccaagagctaaccacaatggagcaaaatactcaagggcgtggagacgaggagcctaaccgtatactcctggttacaatccatcacatgctctaccctattactgtggaagtcctgcagcaagtcttttctcctcatggatatgtcgagaaaatcgtcacttttcaaaagtcagctggttttcaagcacttattcagtttcaatcacgccagagtgctatatctgcaagaaattcccttcaggggcgtaatatttatgatggttgttgtcaactagatattcaattctcaaatcttgacgagttgcaagtgaactacaataatgatcggtctagagacttcacaaacccatcactgccttcagaacaaaagggcagaccttcttctcaacctggatatggagacgcaggagttggatttccacagatgaacaatggcgcagcaattgcagctgcatttggaggagggttgcctcctggaattagtgggactaatgacagatgcactgttcttgcatctaatctaaatcctgataggatagatgaaaacaaactgttcaacttgttttctttatatggaaacattgcccgaatcaagcttcttcgcaataaaccagatcacgcgcttatccaaatgggtgatgactttcagtctgaattagcagtacactttttaaagggggcaacattatttggaaagagattggaggttaattattcaaaacatccacacatcacaatgggtgctgaaacgcatgagtatttaaactcaaatcttaaccgatttaaccgcaatgctgctaaaaactatcgttactgttgctcaccaaccaaaatgatccacctgtccaccctaccacaggacataacagaggaggagattgtggcccaccttgaagaacatgggagcatcatcaacacgaagctttttgaaatgaatgctaaaaaacaggctcttgttttgtttgaaaatgaagaacaggccactgaagctcttgtgtgtaagcatgcaagtagccttggtgattccatgattcggatctcattttctcagttgcagaccatttga

SEQ ID NO: 7540 - DNA, 1941 bp, Momordica charantia
cggccgggggaagcatagggcagccgtagcagccgatctcagtctctgattccctcttcttccattttccggctttgtttctctatcctcccctgtttcctctctctctaagtgtagaatgacagaaccatcaaaagttatccacgtccgaaatgttggccatgaagtatcggagaatgatttgcttcagctattccagccatttggtgtcataactaagcttgtgatgcttcgtgctaaaaatcaggctcttatccaaatgcaagatgttccctcagcagttaatgctttgcagttctttgcaaatgttcagccaagcattaggggaaggaatgtttatgtccagttttcatcacatcaagagctaactacagctgatcagaatgcccaaggacgaggagacgagccaaatcgaatactcttagtcacaatccatcacatgctatatcccataacagtggaagtgctgcatcaagttattttttccacatggatttgtggagaagatcgtcacatttcagaagtcagctgggtttcaggctctcattcagtatcaatcacgccagtgtgctgtttctgctaggactgcactacaaggacgcaatatatatgatggttgctgtcaactagacattcagttctccaatcttgacgagttacaggtgaactacaataacgaacgttcaagggatttcacaaatcctagcctgccttctgaaccaaaaggccggtcgtcccaacctggctatggggatgcaggaggcatgtatgcacttcaagcatctggtgcaagaccagttgcatttccacagatggccaatgcagctgctgttgctgctgcatttggtggaggtctgccacctggtgtcagtgggacaaacgacaggtgtacagtccttgtttccaatctggatcctgatagaatagatgaagacaagctttttaacctcttctccatctacggtaacattgtaagaattaagcttctccgaaataaacccgatcatgcactagttcagatgggagatggattccaggcagaattagctgtgcactttttgaagggagcgatgttgtttggcaagagattggaggtcaacttctcaaagcatcctaatattacacaaggggctgatactcatgaatatgctaactcaaatcttaatcgttttaaccgaaatgctgcaaaaaactaccgctactgctgctccccgacaaaaatgatccacatttcatctctatcccaggaagtaactgaagaagaaatcgtgactctcctcgaggaacatgggccgattgtcaacaccaagctctttgagatgaatgggaaaaagcaggcactcgtcatgttcgacactgaggagcaggccactgaagctcttgtttgcaagcatgctatttctcttggcgggtcgatcattcgaatttcattttcccagttgcagacaatatgatgaagttaacaagggcgttaaacaagtaagaagtgatggattcttaatgcttgattggggttgaggattcatattttacaaggatttttaaaaatggagatgatggcgcatactgtcctaattcttgtaacaattatttctctctttggatttctctcgtgggattgtacttctgcttagtgttgtctcaaatcttctcgtcttctcttctcgtatcttctcttctcttctcttctcttatattttctcctcttcgtgcttatcgaaatcattcgcaagacttgtcgactgagttagattttctttcatgttatcagttttgaagaataggaagaaagaagaaaagctaacttttttcttttctttttttgagggtctctttgttaggtagtttgtacatgtcttgtaatttgaagctaatgggccattggctgttgtaatttcagttcataatgctcaactctcttctacctcatttattgatgag

SEQ ID NO: 7541 - DNA, 1396 bp, Arnica chamissonis
ggaatgttggtcatgagatttcggagcctgatctgcttcagctattccagccctttggagtcattaacaaactagtgatgcttcgtgcaaaaaaccaggctctcctacaattgcaagatgttccttctgctgtcagtgcaatgcaattttatgccaatgtgcagccaagcataagaggaagaaatgtttatgttcagttttcatctcatcaagagctaactaccatggagcaaaatactcaaggacgagtagatgaggagcccaatcgcattcttttggtcaccattcatcatatgctgtaccctataactgtggaagtcttgcatcaagttttctctcctcatggatatgtggagaaagtcgtcacctttcaaaaatcagctggttttcaagccctaattcaatttcagttacgccaaagtgctgtggctgcaagaaattctcttcagggtagaaatatatatgatggttgctgccaactagatattcagttctcaaatcttgaagagttgcaagtcaactacaataatgaacggtctagggatttcacaaacccatcactaccttcagaacagaagggcagaccttcccaacctggatatggagatgcaggagctggatatccacagatgaacaatgcggccgcaattgctgctgcgtttggaggcggacttccccctggaattagcgggaccaatgacagatgcaccattcttgtctccaatctaaatcctgataggatagatgaggacaagctgttcaacttgttttctttatatgggaacattgtgagaatcaagcttcttcgcaacaaaccagatcacgctcttgttcagatgggcgatgggtttcaggccgagttggcagtacactttttgaagggagccacactatttgggaagcggttggaggttaatttttcaaagcatcctaatattacaatgggtgctgatacacacgagtatttgaactctaatttgaaccgcttcaaccgcaatgctgctaaaaattaccgttactgttgctcaccaaccaaaatgatccacctgtcgaccctaccacaggatgtgacagaagacgagattatatcccatcttgaagaacacgggagcatcatgaacaccaaagtgtttgaaatgaatggtaaaaaacaggcgcttgtattgtttgaaaacgaggaacaagcaacggaggcgcttgtgtgcaagcatgcaacgactcttgcagattctatgatccgtatatccttttctcagttgcagacaatttgagcagtcaacttcagcttgacctgacggattccatataaatttggtgttgtcatttgcaaactctgtggcttggtgtgtattgagattttagatgtttgtactaatttttgtttttggttgtatta

SEQ ID NO: 7542 - DNA, 1961 bp, Vitis vinifera
gctgaacgtgcgtagcagtcgatctctgatgctctgactctcaccgacgaatcttttttttatatgtatatacatcacccaacgcttttatcacttcctactccctctctctctctcaccttccatcagccaaagctttctccttttgtcttcagaaggattattcattgttggagttatttaaaatgacggagccttccaaagtcattcatgttcgtaatgtggggcatgaaatatcagagaatgatttgcttcagctgttccaaccatttggcgtcattactaagcttgtgatgcttcgtgcaaaaaatcaggctctcctccaaatgcaagatgttccctcagctgccaatgcaatgcaattctacacgaatgttcagccaagcataagggggaggaacgtctatgttcagttctcatcacatcaagaactaacaacagtggatcagaatgctcaaggacgaggagatgagcctaatcgaattctcttagttacaattcatcacctgctataccctataacagtggaggtgctgcatcaagtgttttctcctcatggttttgtggagaagattgtcacgtttcagaagtcagctggttttcaagcccttatccagtatcaatcacgccagagtgcagttgcagcaaggaattctcttcagggacgcaatatctatgatggttgctgtcagcttgacattcaattttcaaaccttgatgagttacaagtgaactacaataatgagcgctctagggacttcacaaatccatctctgccttcagagcagaaaggcagatcttcacagtctggttatggtgatgcaggaggtatgtatgcccttcaaccaggagccaggacagttggatttccacagatgcccaatgcgtctgccattgctgctgcctttggaggaggtttgccccctggaattagtgggacaaatgacaggtgtactgtccttgtctctaatctaaatcctgacagaatagatgaagataagcttttcaacctgttctccatctatggaaacattgtcagaattaagctgctccgcaataagccagatcatgcactagtccaaatgggtgatggcttccaggccgagttggcagtacattttctgaagggagccatgctatttggaaagagattggaggtgaacttctcgaagtattcaaacataactacaggtgctgatacacacgagtatatgaactcaagtcttaaccgcttcaaccgtaatgctgcaaagaattaccgctactgctgttcccctacaaagatgatccatgtgtccactcttaaccaggacatcacggaggaggagattgtgtctcacctggaggaacatggcaccattgtcaacaccaagctctttgagatgaatgggaagaagcaggctctggtgatgtttgaaaatgaggagcaggcaactgaagctcttgtatgcaagcatgccaccccccttggtggattagcaatccgcatttccttttcccagttgcagggtatataggaaagccctcaccataaaggggtggtgggggttaagggctaataaacgtgaaggatatttatgtgcggattacatcttctataactttctctttctttttcttgtatttgtgatttaattgcttttgtagtggtggaatgctcagttggttttgtattaatataacatttgctctcaccctagtttctctagggttttccaatgctaggacttaggagcaatctctgttgtaggcagatatgctgggcttttgaaaagtaccagggaaatataagtgtaatattcccttacgcgtgagcctgagggatctcttccttttccgctttctttttctgtatagtttttacttttcccaattgaggcttatattttttaatgtatccaaattggttatggccgactgattgatgagtgtgccaaggttactttgttcttagtacatcg

SEQ ID NO: 7543 - DNA, 1407 bp, Valeriana officinalis
ctctgcaaatcaacttcacttctcactgcacactccggatcttctgcaatgacggatgcctctaaagtcattcacgttcgcaatgtcggacatgaaatatccgagaacgatttgcttcaggtgtttcagccatttggagttatcaccaaacttgttatgcttcgtgccaaaaatcaggctctccttcaaatgcaagatgttccttcagctgttaatgctctgcaattctatacgaatgtccagccgtgcagtaagggggagaaacgtttatattcaattttcatcacatcaagaactgactactgtagagcagaattcacaaggacggggagatgagccaaaccgaattctgttagtcactattcatcacatgctataccctattacagtggaagtgctgcatcaagttttttcaccacatggatttgtagagaagatcgtcacgtttcaaaagtcagctggctttcaagcacttatccaatttcagtcacgccagagtgctattgctgctagaaactcacttcagggtcgcaatatatatgatggttgctgtcagttggacattcagttttctaacctcgatgagttacaagtgaattacaacaacgaacgttcaagggatttcacaaacccatctcttccatcagaacagaagggaagatcctctcaatctggttataatgatgcaggtgtgtacggcgttcaaccatctggatcgggcggagttggatttccgcagatgggtaatgctgcagccattgcagctgcttttggaggaggtttgcctcccggaataagtggaacaaatgacaggtgtacagttcttgtttctaatttaaatccagatagaatagacgaggacaagctttttaacctcttctctctatatggcaacatcgtcagaattaaactcctccgcaacaaaccggatcacgctcttgttcaaatgggcgacggcttccaagctgagctggcagtccacttcttgaagggagcaattctgtttgacaagcggttagaggttaacttttcaaagcactcaaacataacaaccggcgctgacacacacgagtactccaactcgaatctcaaccgatttaaccgaaacgcagccaagaattacaggtactgttgctcgccgacaaagatgattcacctgtcaaccctgcctcaagacgtgattgaagatgaaatagtggctcatttagaagaacacggcacaattgtgaataccaaactttttgatatgaacggcaaaaaacaagcacttgtgcttttcgataacgaggaacaggccaccgaagctcttgtttgcaagcatgctacttctcttggcggttctatgatccgaatctcattctcgcagctcaacaccatttgagatccttccaaatgtcagatatttat

SEQ ID NO: 7544 - DNA, 1898 bp, Citrullus lanatus
gcagtttaggatgactgaaccatcaaaagttattcacgtccgcaatgttggtcatgaaatatcggagaacgatttacttcagctattccagccatttggtgtcataactaagcttgtgatgcttcgtgctaaaaatcaggcacttatgcagatgcaagatgttccctctgcagttaatgctttgcagttctttgcaaatgttcaaccaagcattagggggaggaatgtttatgtccagttttcatcacatcaagagctaactacagcagatcagaatgctcaaggacgaggagacgagccaaatcgaatactcttagtcacaatccatcacatgctatatcccattacagtggaagtgctgcatcaagtgtttttcccacatggatttgtggagaagatcgtgacgtttcagaagtcagctggttttcaggctctcattcagtatcaaactcgccaatgtgctgtttctgctaggactgcactacagggacgtaatatatatgatggttgctgtcagctagacattcagttttccaatcttgatgagttacaggtgaactacaataatgaacgttcaagagatttcacaaatcctagcctgccttctgaaccaaaaggccggtcatctcaacctggatatggtgatacgggaggcatgtatgcacttcaagcatctggagcgagaccagttgcattctcacagatggccaatgcagcggctgttgctgctgcatttggaggaggtttgccacctggtgttagtgggacgaacgacaggtgtacagtccttgtgtccaatctgaatccggatagaatagatgaagacaagctttttaaccttttctccatttacggtaacattgtaagaattaagcttctccggaataaacctgatcatgcacttgttcagatgggagatggattccaggcagaattagctgtgcactttttgaagggagcgatgttgtttggcaagagattggaggtcaacttctcaaagcatcctaacattacgcaaggggctgacactcatgaatatgctaactcaaatcttaatcgttttaaccgaaatgctgcaaagaactaccgctattgctgctccccgacaaagatgatccacatatcatctctatcccaggaagtaactgaagaagaaatagtgagtctgctcgaggagcacgggccgattatcaacaccaagctctttgagatgaatgggaagaagcaggcactcataatgtttgacactgaggagcaggccactgaagctctagtttgcaagcatgctagttcgcttagtgggtcgatcattcgcatttcgttttcccagttgcagactatatgaagcagttgcagactatatgaagttaacaacggcattaaacaagtaagaagtgatggattcttaatgcttaattggggttgaggattcataatttacgaggattttaaaaatggagatgatggcgcatactgtcttaattcttgtaacagttaatttgtctttggatttttcgtggaattgtacttctgctttgttgttgtctcaattcttctcttctcatctcttctcttttcttctcttgtgcttatcgaaatcattcttaagacttctcgacggagctagatttttcattttatgttgtcagttttgaagaataggaagaaagagggaatgctaacctgcctttttttttttttttttttcagttgaggatctccttattaggtgctatgtatatgtcttgtaatttctggcaaatcaggccattggctcttgtaattcagttcatagtactcttaatctcttctacctaatttattgatgaacactttgtctttgacaaaaatttgtccaattctcttcttagccttgacagacataaagaaatagctgt

SEQ ID NO: 7545 - DNA, 1735 bp, Cucurbita pepo
atgactgaaccctcaaaggttattcacgtccggaatgttggccatgaaatatcggagaacgatttgcttcagctattccagccatttggtgtcataaccaagcttgtgatgcttcgtgctaaaaatcaggctcttatccagatgcaagatgtcccctcagcagttaatgctttgcagttctttgcaaatgttcaacctagcattagggggaggaatgtttatgtccagttttcatcacatcaagagctaactactgctgatcagaatgctcaaggacgaggagatgagccaaatcgaatactcttagtcacaatccatcacatgctatatcccattacagtggaagtgctgcatcaagtgtttttcccacatggatttgtggagaagatcgtgacatttcagaagtcagctggttttcaggctctcattcagtatcaaactcgccaatgtgctatttccgctaggactgcactacagggacgcaatatatatgatggttgctgtcagcttgacattcagttctccaatcttgacgagttacaggtgaactacaacaatgaacgttcaagggatttcacaaatcctagcctgccttctgaaccaaaaggccggtcatctcaacagcctggatatggtgatgcgggaggcatgtatgcacttcaagcatctggagcaggaccagttggctttccacagatggccaatgcggctgctgttgctgctgcatttggaggaggtttgccacctggtgttagcgggactaacgacaggtgtacagtcctcgtgtccaatctgaatcctgatagaatagatgaagacaagctttttaaccttttctccatatacggtaacattgcaagaattaagcttctccggaataaacctgatcatgcacttgttcagatgggagatgggttccaggcagaattagctgtgcacttcttgaagggagcaatgttgtttggcaagagattggaggtcaacttctcaaagcatcctaacattacacaaggggctgacactcatgaatatgctaactcaaatcttaatcgttttaaccgaaatgctgcaaagaactaccgctactgctgctccccaacaaagatgattcacatttcatcgttatcccaggaagtgactgaagaagaaatagtgaatctcctcgaggagcacgggccgatcatcaacaccaagctctttgagatgaacgggaagaaacaggcactcatcatgtttgacactgaggagcaggccactgaagctcttgtttgcaagcacgctagttcgcttagtgggtcgatcattcgcatttcgttttcccagctgcagagtatatgagttaacaacggcattaaacgcgtaagtgatgaattcttaatgcttaattggtgttgaggattttaaaaatggagatgatatggcgcatactgtcttatttcttgtaacagttaactttgtctttggacttttggtgggattgtacttctgctgctttgttgttgactcaatacttcttctcttctcttctttctcttgtgctaaccgaaattattgtcgagacgacttcacgacggagttagaatttcgttttatcttatcagttttgaagaacaggaagaaaaagggaaagctaacctctgccttttctgagttgaggatctctttgttaggaggtatgtatatgatgtgtttgtaatttctggcaaatcaggccattggctgttgtaattttagt

SEQ ID NO: 7546 - DNA, 1717 bp, Artemisia annua
ggagggtgtaagtaaaattaggtcgaaagaagttaagacttgcacaaacaaaaacataaacataaacatagagaaacagcagcagcagtcattcttgagttcagtttagtttattggtttcagacacttcttccttccaacccttcaacctacaacctttcttgtctttcattcagggataagggattgattgaaatatggcaacgcaagagccttccaaagtcattcacgttcgtaatgttggccatgagatttctgagcctgatctgcttcagctcttccagccttttggagtcgtcaacaaactagtgatgcttcgtgccaaaaatcaggctctccttcaaatgcaagatgttccttcggctgtcagtgcgatgcagttctacgctactcatcagcctagcataaggggaagaaacgtttatgttcagttctcatctcatcaagagctaactactatggagcaaagtacccaaggacgaggagacgaggagcctaatcgtattctgttggttacgattcatcacatgctttaccctattactgttgaagttctgcatcaagtcttctctccacatggatatgtcgagaaagtcgtcacctttcagaagtcagctggtttccaagcacttattcagtttcaatcacgccagaatgccatagctgcaagaaatgcccttcaggggcgtaatatatatgatggttgctgtcaactagatattcagttctcaaatcttgaagagctgcaagtgaactacaataatgagcggtctagggattttacaaacccatcgctaccttcggagcagaagggcagaccctcccaacctggatatggagatgcaggagttggatatccacagatgaataacgctgctgcaattgctgctgcttttggaggagggttgcctcctggtattagtgggacgaacgatagatgcactcttcttgcatctagtctgaatccggatatgatcgatgaggacaagctgtttaacttgttttctctttatgggaacattgtgaggatcaacgcaacaaaccagatcatgcacttattcagatgggtgatggttttcaggccgagttagctgtacactttttgaagggatctacactatttgggaagcggttggaggttaattattcaaagcatcctaatattaccatgggtgctgagacacacgagtatttaaactccaatctgaaccggtttaaccgcaatgccgctaaaaactaccgttactgctgctcaccaacgaagatgatccatctgtccacactgccacaggatgtgacagaagaggatattgtatcccatcttgaagaacacgggcacattgtcaactcaaaggtgtttgaaatgaatggtaagaagcaggctctggtcttgtttgaaagtgaggagcaggcgactgaagctcttgtgtgcaaacatgcaaccacactcggtgattccatgatccgtatctccttttctcagttgcagacaatttgagtgtcaccttcccggattcgatttgatcgataaacttggagtttgtgatattatcatagaaccttcttctgttttagtgtgtattcttactcactcccttgcatttttagatggtagtagcgctactttttgtttgtaccaattgttatttttggatgtattatttatttgagtttttctgtgacgaaaaaaaaaaaaaacaaatgtcggatctagaat

SEQ ID NO: 7547 - DNA, 1898 bp, Orobanche aegyptiaca
acaaatctcgatcttctgtctctcgatccaccacagcccagcagcacgtctatccatcttccggcggccggccaccaccaccaccaccataaccagggttactgataatggcagagccctcaaaagtcattcatgttcgtaatgtgggtcatgaaatttcagagaatgacttgctccagcttttccagccatttggagtcgttgccaagcttgtgatgcttcgagctaagaatcaggccctgctccaaatgcaagatattcccgcggctgtaaatgcattgcaagtctacactaatgttcagccgagcataaggggaaggaatgtttatgttcagttttcatcacatcaagaactaacaattatggatcagaatgctcaggcacgaggagacgagcctaaccgaatcctgttagttacggtacatcagatgctatatcctataaccgtggaagtgctgcatcaagttttttctcctcatggatttgtagagaagatcgtcacttttcagaagtcggctggattccaatctctcattcaatatcagtcgcaccagagtgctatttctgcaagaaactctcttcagggacgtaatatctatgatggttgctgtcagctggacattcagttttcaaaccttgatgagttgcaagtgaactataataatgagcgctcaagggattttacaaacccttccttgccttcagagcaaaggggcaagtcctctcaacttgggtatggagatgcaagtttgtatgcccatccagttggatttcctcagatgagcaacgctgctgctattgctgctgccttcggaggaggcttgccaccgggtataagtggtacaaatgataggtgcactattcttgtatctaatctgaatcctgataaaatagacgaggataagctttttaatctgttctccatatatgggaacattgatagaatcaaacttctccgaaacaaaccagatcatgcgttggttcaaatgggtgatggttttcaggctgagttggctgttcactttttgaagggtgccatgttgtttgggaagcggttggaggtgaatttctcaaagcatgcaactataacaacaggagctgaaacccacgagtactccaactcaaatctcaaccgttttaatcggaatgcagcaaaaattaccggtattgttgttcaccaacaaaaatgattcatatctcgactctcccccaggatgtaaccgaggaagacataataaatcacctgggagggcatggaacaattgttagtaccaaactctttgagatgaacggaaagaagcaggctcttgtcctttttgaaaatgaggagcaggcaacagaaacccttgcgtgcaagcatgctacatcacttggtggctcaaccatccgaatttccttttctcagttgcaaaccatatgaatgagggccagaattggaacaaggacaggtcattggcggagttcactttttcagtatatgatgttgatgattggaacggagctactaatcatataattctaattgtcgtcggttcggacattgtgcactcgcccttcctcgttgattcttatttaaatgtgacttgctacaggtatgcatgtcatacacacgaactggagcctggagatgataaaattattagtctgcaatgcatacggccactcgttgctgtgttattctgcaactgattttccatggatgttatatttgaaattatattcctttttatgtttactttttttttttacaaattataacttatatttatttgagacactatttacagtagaattcttcggtttggttttatcttctttttatataattgatgatgttcctgttctgttgagcggattgagaaagctgatagtttatttacttcaaccaactcttttgg

SEQ ID NO: 7548 - DNA, 1531 bp, Actinidia deliciosa
  misc_feature (805)..(805): n is a, c, g, or t
  misc_feature (809)..(809): n is a, c, g, or t
  misc_feature (1207)..(1207): n is a, c, g, or t
  misc_feature (1270)..(1270): n is a, c, g, or t
  misc_feature (1295)..(1296): n is a, c, g, or t
  misc_feature (1327)..(1327): n is a, c, g, or t
  misc_feature (1455)..(1455): n is a, c, g, or t
  misc_feature (1490)..(1491): n is a, c, g, or t
caacctggggccgtgcatctctctctctgatatcgtcgggtcttttaaaatgacagagccttccaaagtcattcatgtgcgcaatgtggggcatgaaatttctgagaatgacttgcttcagctattccagccattcggggtcatcacgaagcttgtgatgcttcgtgccaaaaatcaggcactcctccaaatgcaagatgttccttcagctgtcaacgcattgcaattctactcaaatgttcagccaagcataaggggaagaaatgtttatgttcaattctcatcccatcaggaactaacaactatggagcagaattctcaaggccgaggtgatgagcctaatcgaattctcttagttacaattcatcacatgctatatcctataaccgtggaagtgctgcaacaagtgttttctcctcatggcgttgtggagaaggtcgtcacatttcagaagtcagctggttttcaagctcttatacaatatcaattatgccaaagtgctgtcttggcaaggaactctcttcaggggcgtaatatttatgatggttgctgtcagctggacattcaattttcaaaccttgatgagttacaagtgaactacaacaatgagcgctcaagggattttacaaatccatccctgccttccgaacagaagggaagatcctcacaacctgggtatggagatgcaggaagcatgtatgctcttcaagcttctggaactagggcagttggatttccgcagatgggtgatgcagctgccattgctgctgcgtttggaggaggattgcctcctggaataagcggntcanatgacaggtgcactgtgcttgtatctaacctaaatcctgatagaatagacgaggataaacttttcaacctcttctcactctatggaaacattgtgagaatcaaacttctccgcaataaaccggatcatgcactagttcagatgggtgatggcttccaagctgaattggcagtacacttcttgaagggagccatgctgtttgggaagcgattggaggtgaacttttcgaagcatgcacacattacaactggtgcagatacacatgagtactcgaactcaaatctcaaccgctttaaccgcaacgccgcgaagaactaccgttactgctgctctccgaccaaaatgatccacctgtccacgctcccacaggatgtcacggaggaggagattgtgtcccanctagaggaacacggcaccatcgtcaataccaagctctttgagatgaacggtaaaaagcaagcnctcgtcctcttcgagaatgaggagnnggccactgaagccctcatttcgaaacatgcnagcgcccttagggatgcaatgatccggatctccttttcccagttgcagaacatttagggcacttgtaccaaataaggtaataaggagtaacaagtgttgggaaacggattttatgccactggtgatcnttttttcctttcaatctcacttctgttgtaactgnntgttattgcttttgttttggtggaagtctctttaatttcg

SEQ ID NO: 7549 - DNA, 1849 bp, Cucumis melo
ttctctctctcctctctccatttctatctctcagtttaggatgactgaaccatcaaaagttattcacgtccgaaatgttggccatgaaatatcggagaacgatttgcttcagctattccagccctttggtgtcataactaagcttgtcatgcttcgtgctaaaaatcaggcacttatgcagatgcaagatgttccctcagcagttaatgctttgcagttctttgctaatcttcaaccaagcattagggggaggaatgtttatgtccagttttcatcacatcaagagctaactacagcagatcagaatgctcaaggacgaggagatgagccaaatcgaatactcttagtcacaatccatcacatgctatatcccattactgtggaagtgctgcatcaagtatttttcccacatggatttgtggagaagatcgtgacgtttcagaagtcagctggttttcaggctctcattcagtatcaaactcggcaatgtgctgtttctgctaggactgcactacagggacgtaatatatatgatggttgctgtcagctagacattcagttctccaatcttgacgaattacaggtgaactacaacaatgaacgttcaagggatttcaccaatcctagcctgccttctgaaccaaaaggccggtcttctcaacctggttatggtgatacgggaggaatgtatgcacttcaagcatctggagcgagaccagttggattctcacagatggccaatgcggccgctgttgctgctgcatttggaggaggtttgccgcctggtgttagtggaacaaacgacaggtgtacagttcttgtgtccaatctgaatcctgatagaatagatgaagacaagctttttaaccttttctccatttacgggaacattgtaagaattaagcttctccggaataaacctgatcatgcacttgtgcagatgggagatgggttccaggcagaattggctgtacactttttgaagggagcgatgttgtttggcaagagattggaggtcaacttctcaaagcatcctaacattacacaaggagctgatactcatgaatatgctaactcgaaccttaatcgttttaaccgaaatgctgcaaagaactaccgctactgctgctccccgacaaagatgatccacatatcatctctatctcaggaagtgactgaagaagagatagtgagtctccttgaggagcatgggccgattgtcaacagcaagctctttgagatgaacggtaagaagcaggcactcatcatgtttgacactgaggagcaggcgactgaagctcttgtttgcaagcatgctagtttgcttagtgggtcgatcattcgcatttcgttttcccagttgcagactttatgagtttaacaacggcattaaacaagtaagaagtgatggattcttaatgcttaattggggttgaggattcataatttacgaggatttaaaaaaaatggagatgatggcgcatactgtcttaattcgtgtaacagttaatttgtctttggatttttttcgtgggattgtacttcttctgctttgatgttgtctcaattcttctcttctcatctcttctcttctcttgttgctcttatggaaatcattcttaaaacttctcgacggagttagattttcattttatgttgtcagttttgaagaataggaagaaagagggaaaactaacctaccttttttcagttgaggatctccttgttaggtgcagtgctatgtacatgtcttgtcttgtaatttctgggaaatcaggccattggctcttgtaatttcagttcatagtactcttttatctcttctacctaatttattgatgaacacttt

SEQ ID NO: 7550 - DNA, 1551 bp, Cucumis sativus
ttctctccctctctctcctctctccatttctctctctcagtttaggatgactgaaccatcaaaagttattcacgtccgaaatgttggtctctctctctctctctctcaaaacgatttgcttcagctattccagccctttggtgtcataactaagcttgtcatgcttcgtgctaaaaatcaggcacttatgcagatgcaagatgttccctcagcagttaatgctttgcagttctttgctaatcttcaaccaagcattagggggaggaatgtttatgtccagttttcatcacatcaagagctaactacagcagatcagaatgctcaaggacgaggagatgagccaaatcgaatactcttagtcacaatccatcacatgctatatcccattacagtggaagtgctgcatcaagtatttttcccacatggatttgtggagaagatcgtgacatttcagaagtcagctggttttcaggctctcattcagtatcaaactcggcaatgtgctgtttctgcaaggactgcactacagggacgtaatatatatgatggttgctgtcagctagacattcagttctccaatcttgacgaattacaggtgaactacaataatgaacgttcaagggatttcaccaatcctagcctcccttctgaaccaaaaggccggtcatctcaacctggttatggtgatacgggagggatgtatccacttcaaccatctggagcgagaccaggtgccttaatggccaatgcagccgctgttgctgctgcattcggaggaggtttgccacctggtgttagtggaacgaacgacaggtgtacagtccttgtgtccaatctgaatcctgatagaatagatgaagacaagctttttaaccttttctccatttacggtaacattgtaagaattaagcttctccggaataaacctgatcatgcacttgtgcagatgggagatgggttccaggcggaattggctgtacactttttgaagggagcgatgttgtttggcaagagattggaggtcaacttctcaaagcatcctaacattacgcaaggggctgacactcatgaatatgctaactcaaaccttaatcgttttaaccgaaatgctgcaaagaactaccgctactgctgctccccgacaaaaatgatccacatatcatctctatctcaggaagtgactgaagaagagatagttagtctccttgaggaacatgggccgattgtcaacagcaagctctttgagatgaatggtaagaagcaggcactcatcatgtttgacactgaggagcaggcgactgaagctcttgtttgcaagcatgctagtttgcttagtgggtcgatcattcgcatttcattttcccagttgcagactttatgaggttaacaacggcattaaacaagtaagaagtgatggattcttaatgcttaattggggttgaggatttaaaaaaaatggagatgatggcgcatactgtcttaattcttgtaacagttaatttgtgtttggatttttttcgtgggattgtacttctgctttgttgttgtctc

SEQ ID NO: 7551 - DNA, 1386 bp, Brassica napus
gccgtacgaatctcaatctaatggctaggccagctattcaagacggcgacgaagggatctcgctgctcgtgtttaacggtgacggtgacggtgaccgctcgtggcagctgaacttcgacgatttccaggtttctcctgagcacaaggagaagaaatctccgagcaaactccataactgtcttggctgcttgggtccagaagacaatgtagcagattactaccagcagcaagtagagatgctcgaaggcttcaccgaaatggacgagcttgcggaacgtggctttgtccctggaatgtcaaaggaagagcaagacaatctagctaaaagcgagacgttagccatcagaatatcaaacatcgcgaacatggttctttttgctgctaaagtctacgcttccgtcacaagcggctctctagcaatcgttgcttccacgttggactctcttctcgatctcctttctggattcatcctctggttcaccgccttttcgatgcagaccccgaacccttatcagtaccccatcgggaagaaacggatgcagccgctgggaatcctagtctttgcctcggtgatggccacgcttgggttgcagatcatcttggagtctcttcggacgatggtgtccagtcaaaaggagttcagcttgacaaaagagcaagagagctgggtggttgggatcatgctctccgtcacattagtcaaactccttctcgtactttactgcagatcgttcagcaacgagattgttaaagcctatgctcaagaccacttcttcgacgtcatcacaaacatcattggactcattgcagtgatcctcgccaattacttcgataactggatggatccagttggagccatcattcttgcattgtacacaatacggacatggtcaatgacggttctggagaacgtgaactcactcgtcgggaaatcagcaacgccggagtatcttcagaagcttacgtacctgtgttggaaccaccatagagagatcaggcatattgacacggtgagggcgtacacgtttgggtctcattactttgtggaggttgatattgttcttccagctgatatgcctctgcaagtggctcatgatattggagaagcgctgcaagagaagctggagcagttgcaggagattgaaagggcttttgtgcatcttgattatgagtacactcacaaaccggagcacgctagttcccactgttagcttgcggggaaggtgtctctacgtctacaaaattcttacagattaaagaatacttcaatcgtattgtttagtagacaagtgtacctttgtaactatctagttttgttgttctactagtaaaactataattctaagtctaaataaaaaattcatttcagtcgaaaaaaaaaaaaaa

SEQ ID NO: 7552 - DNA, 1378 bp, Raphanus sativus
  misc_feature (148)..(148): n is a, c, g, or t
  misc_feature (172)..(172): n is a, c, g, or t
  misc_feature (538)..(538): n is a, c, g, or t
gggccagcagcagcggccgtacacgaatctctatccaatggctaggccatctatcgaaaacgccgacgaagagatctctcttctcgagtttcacggcgagggcgaccgctcgtggcagctgaacttcgacgattttcaggtttctccngagcacaaggagaagaaatctccnagcaaactccataactgtcttggctgcttgggtccggaagacaatgtggcagattactaccagcagcaggtggagatgcttgaaggcttcaccgaaatggacgaactcgcagaacgtggattcgtccccggaatgtcaaaggaagagcaagacaatcttgctaaaagcgagacgttagccatcagaatatcaaacatcgcgaacatggttcttttcgccgctaaagtctacgcctccgtcacgagcggctctctagccatcgtcgcttccacgctagactctctcctcgatctcctctccggcttcatcctctggttcaccgccttctccatgcagacgccgaacccttatcagtatcccatcggnaagaaacggatgcagccgctcggtatcctcgtctttgcgtccgtaatggccacgcttggactgcagatcatcctggagtctcttcgcaccatggtgtccagtcacaaagagttcagcttaacaaaggaacaagagagttgggtggttgggatcatgctctccgtcacactagtcaaactcctcctcgttctttactgcagatcattcagcaacgagatcgttaaagcctatgctcaagaccacttcttcgacgtcatcacaaacatcatcggactcatcgcagtcatcctcgctaactacttcgataactggatggatccactcggtgccatcattctcgcactgtacactataaggacatggtcgatgacggttctggagaacgtgaactctctcgtaggcaaatcagcgacgccggagtatctgcagaagctgacttacctgtgttggaaccaccacagagagattaggcacatcgacacggtgagggcgtacacgttcgggtctcattactttgtggaggttgatatagttctccccgctgatatgcctctgcaagtggcgcatgatatcggagaagcgctgcaggagaagctggagcagctgcaggagattgaaagggcttttgtgcatcttgattatgagtatactcacaaacctgagcacgctagttcccactgttagctttacggtgaaggtgtttctacgtctacgaattcttaagagatttaagaatcttacaatcatatttgtttagtagacgaccattgtaactatgtctcgttttgttgttctactagtaaaactataaatttctaaattaaaaaaggttcatttcta

SEQ ID NO: 7553 - DNA, 1444 bp, Brassica napus
tccttctcctcaccttcaccgttaatgccagcatcagcagccgtacgaatctcaatctaatggctaggccagttatccaagacggcgacgaagagatctctctcctcgtgtttaacggtgacggtgacggcgaccgctcgtggcagctgaacttcgacgatttccaggtttctcctgagcacaaggagaagaaatctccgagcaagctccataactgtcttggctgcttgggtccagaagacaatgtggcagattactaccagcagcaagtagagatgctcgaaggctttaccgaaatggacgagcttgcagtacgtggctttgtccctggaatgtcaaaggaagagcaagaaaatctagctaaaagcgagacgttagccatcagaatatcaaacattgcgaacatggttctcttcgccgctaaagtctacgcctccgtcaccagcggctctctagcaatcgttgcttccacgttggactctcttctcgatcttctttctggattcatcctctggttcactgccttttcgatgcagacgccgaacccgtatcagtatcccatcggcaagaaacggatgcagccgctgggaatcctagtctttgcatcggtgatggccacgcttgggctgcagatcatcttggagtctcttcggacgatggtatccagtcaaaaggagttcagcttgacaaaagagcaagagagctgggtggttgggatcatgctctccgttacattagttaaactccttctcgttctttactgcagatcattcagcaacgagattgttaaagcttatgctcaagaccacttcttcgacgtcatcacaaacatcattggactcattgcagtgatcctcgccaattacttcaataactggatggatccagttggagccatcattcttgcattgtacacaatacggacatggtcaatgacggttctggagaacgtgaactcacttgtcgggaaatcagccacgccggagtatcttcagaagctgacttacctgtgttggaaccaccatagagagatcaggcatattgatacggtgagggcgtatacgtttgggtcacattactttgtggaggttgatatagttttaccagctgatatgcctctgcaagtggctcatgatattggagaagcgctgcaagagaagctggagcagttgcaggagattgaaagggcttttgtgcatcttgattatgagtacactcacaaaccggagcacgctagttcccactgttagcttgcggtgaaggtgtctctacgtctacaaaattcttgcagatttaagaatcttcaatcgtattgtttagtagacaagtgtacctttgtaactatctagttttgttgttctactagtaaaacttataaatttctaaattaaaaagttcatttcagtaaaaaaaaaaaaaaaaaactcgaggggggcccgtccca

SEQ ID NO: 7554 - DNA, 1521 bp, Brassica napus
aaactaccctcgccgtctcttcaagttccttctcctcaccttcaccgttaatgccagcatcagcagccgtacgaatctcaatctaatggctaggccagttatccaagacggcgacgaagagatctctctcctcgtgtttaacggtgacggtgacggcgaccgctcgtggcagctgaacttcgacgatttccaggtttctcctgagcacaaggagaagaaatctccgagcaagctccataactgtcttggctgcttgggtccagaagacaatgtggcagattactaccagcagcaagtagagatgctcgaaggctttaccgaaatggacgagcttgcagtacgtggctttgtccctggaatgtcaaaggaagagcaagaaaatctagctaaaagcgagacgttagccatcagaatatcaaacattgcgaacatggttctcttcgccgctaaagtctacgcctccgtcaccagcggctctctagcaatcgttgcttccacgttggactctcttctcgatcttctttctggattcatcctctggttcactgccttttcgatgcagacgccgaacccgtatcagtatcccatcggcaagaaacggatgcagccgctgggaatcctagtctttgcatcggtgatggccacgcttgggctgcagatcatcttggagtctcttcggacgatggtatccagtcaaaaggagttcagcttgacaaaagagcaagagagctgggtggttgggatcatgctctccgttacattagttaaactccttctcgttctttactgcagatcattcagcaacgagattgttaaagcttatgctcaagaccacttcttcgacgtcatcacaaacatcattggactcattgcagtgatcctcgccaattacttcaataactggatggatccagttggagccatcattcttgcattgtacacaatacggacatggtcaatgacggttctggagaacgtgaactcacttgtcgggaaatcagccacgccggagtatcttcagaagctgacttacctgtgttggaaccaccatagagagatcaggcatattgatacggtgagggcgtatacgtttgggtcacattactttgtggaggttgatatagttttaccagctgatatgcctctgcaagtggctcatgatattggagaagcgctgcaagagaagctggagcagttgcaggagattgaaagggcttttgtgcatcttgattatgagtacactcacaaaccggagcacgctagttcccactgttagcttgcggtgaaggtgtctctacgtctacaaaattcttgcagatttaagaatcttcaatcgtattgtttagtagacaagtgtacctttgtaactatctagttttgttgttctactagtaaaacttataaatttctaaattaaaaagttcatttcagtaatgactgatttttgtttgggtgtatggtaaaaactgtagctataactggtgatcactaaatagataatatgaaacaaaaaaaaaaata

SEQ ID NO: 7555 - DNA, 1376 bp, Raphanus sativus
ggattgttatcaggcagacaagaccaagcttaatctctttctctatctcaccgagtaatggttaggccagatggagacgaggaagggatattgcttctcgagtttcaaggtaacggtgaccgctcgtggcagctaaacttcgacgatttccaggtttctccggagcacaaggagaagaaatcgacgagcaaactccataactgtcttggttgcttgggtccggaagacaatgtggcggattattaccagcaacaggtagagatgcttgagggctttactgaaatggatgaacttgctgaacgtggctttgtccctggaatgtcaaaggaagagcaagacaatctggctaaaagcgagacattggccattagaatatcaaacattgcaaacatgcttctttttgctgctaaagtctatgcctccgtcacaagcggctctttagcaatcgttgcttccacgctggactctcttcttgatcttctttctggcttcatcctctggtttaccgccttctctatgcagacaccaaacccgtatcagtatcccattggcaagaaaaggatgcaaccactgggaatcctagtatttgcatcagtgatggccacacttggattgcaaatcatcttggaatctcttcggacaatgttatccagtcaaaaggagttcagcctaactagagagcaagagagctgggtggttgggatcatgctctccgttacattggtcaaactgcttctcgtcctttactgcagatccttcagtaacgagatcgttaaagcttatgctcaagaccacttcttcgacgtcatcacaaacatcattggactcatcgcagtgatcctcgccaactacatcgataactggatggatccagttggagccatcattcttgcactgtacacgataaggacgtggtcaatgacggttttggagaacgtgaactctctagttgggaaaacagcaacgccagagtatctgcagaaactgacttacctgtgttggaaccaccatagagagattaggcatattgacacggtgagggcgtacacgtttggatctcattactttgtggaggttgatatagttctccctgctgatatgcctctgcaagtggcgcacgacattggggaatcgctgcaagagaagctggagctgatgcaggagatagaaagggcttttgtgcatcttgattatgagtatactcacaaacctgagcatgctagatcccactgttagcttggtttcttcttcttccatctctctacgtctaaaagttcttaatagagcttaagaatcttcaaccatattgtttagtagacaaagtacctttgtaactagttttgttgttctactggcaataaaactataatttttaa

SEQ ID NO: 7556 - DNA, 1456 bp, Eutrema halophilum
actgatacgtctaccacaccagtcgtagttagtagccgcctcggatgatcgggatccatggcttaattaccggatttaccctcgtcgtctcttcaaatttcccattccctacctcaccgtttatgctattagccgctccaaatccctcgcgcgccgctaatctctacctcaccgagtaatggttgggccagctattcaagatggcgacgaagggatcgctctgctcgagcttcacggtaacgttgaccgctcctggcagcttaacttcgacgatttccaggtttctccggagcacaaggagaagaaatcgcccagcaaactccataactgtcttggctgtttgggtccggaagataatgtggcagattattaccagcagcaagtagagatgcttgaaggctttactgaaatggacgaacttgcagaacgtggatttgtccctggaatgtcaaaggaagagcaggaaaaactagctaaaagcgagacattggcgattagaatatcaaacattgcaaacatggttctttttgctgctaaagtctatgcttctgtcacaagcggctctttagcaatcattgcgtccacattggactcccttcttgatcttctctctggcttcatcctttggtttaccgccttctcgatgcagacaccaaacccgtatcagtatcccattgggaagaaaagaatgcaaccactgggaatcctagtctttgcttcagtgatggcgacacttggattgcagatcatcttggaatctcttcgcacaatgttatccagtcacaaggagttcagcttaacaaaagagcaagagagttgggtgattgggatcatgctctctgtcacattggtcaaactgcttctggttctctactgcagatccttcagtaacgagattgttaaagcttatgcacaagatcacttcttcgacgtcatcacaaacatcatcggactcattgcagtaatcctcgccaattacatcgataattggatggatccagttggagctatcattcttgcattgtacacgatacgaacatggtcgatgacggttttggagaatgtgaactctctagttgggaaatcagcgacaccagagtatctgcagaagctaacttacctgtgttggaaccaccataaagccatcaggcacatcgatacagtgagggcttacacttttggatctcattactttgtggaggttgatattgttctccctgctgatatgcctctgcaagtggcacacgacattggagaatcgctgcaagagaagctggagctgcttgaggagatcgaacgggcttttgtgcatcttgattatgagtacactcacaaacctgagcacgctagatcacactgttaagctcttttatttttcctaatcagccaaaaaaggttacagcttttgtttggtttttaatcaactgttcggtttggtattgttagagtttggttc

SEQ ID NO: 7557 - DNA, 1629 bp, Cleome gynandra
cccaccacaacagtctcataatcagatatttgttttcccaaattgccctctcactcttgtccaattttcgttccttgccctttcccctgcccttccccatttgacgtaaactaattcgcttctgctacttcgtctcacatctcttcctcttctattaccggagcatcctctatctatctatctatctatctcagtgggtcaccggaaaatggctgagccggtgacgaacgatcgcgacgaagggatctcactgctcggagatcaaggcaacaatgaccggtcctggcagttaaacttcgaggattaccaggtttctccggagcacactgagaagaaaccgccgaacaagctccacgattgccttggttgtttgggtcctgaagacgatgtagcggagtattaccagcagcaagtagaaatgcttgagggcttcaatgaaatggacgcacttgcagaacggggttttgtccctggaatgtcaaaggaggagagggaaaagttggcccgaagcgagacattcgcaataagaatatcaaatcttgcaaacatgatccttttcattgccaaagtctatgcttctgtcaggagcggttctttagccattattgcatccacattggactctcttcttgatcttctttcgggcttcatcctgtggtttacagcattctcaatgcagacgccaaatccgtatatgtatcccattgggaagaaaaggatgcagccactgggaatcctcgtatttgcatcagtgatggctacgttggggctgcagattatcttggaatctattcgcactatgatatctaatgatggtggttttaacctaacgagcgagcaagagagatgggtcattgggattatgctgtcggttaccctagtcaagttccttctggttatttactgcagatcgttcagtaacgagattgttaaagcttacgcacaggatcacttctttgatgtcatcacaaatataattggacttattgccgcacttctcgcaaattacatcgacgattggatggatcctgttggagctatcattcttgcattgtacacgatccgaacatggtcaatgacggtgttggagaatgtgaactcgcttgtggggaaatcagccacaccagaatatctgcagaaactaacgtacctttgttggaaccaccacaaggccatcaggcacatcgacacagtcagggcctacacctttggctcccattacttcgtggaggtcgacattgtgctgcctgcagccatgctccttcaagaggctcatgacattggggaatcactccaagagaagcttgagctgctcccggagatagaacgggcctttgtgcacctcgattacgagtacacccacaagcccgagcatgcaaaagctcactgctagctgccaaacccgaggatttgaaaaggttcatatgaagtttagattggttcaaagctgaagaaggtagcgggagtgttggagtgagttgtttgtattactctgggatttgcctttggaattaaggtgctgcaaattcttaaggtatttgacttggtaatgtcctgtgaacgattcggtagttttagtctcaagaatctgaaattgcatgtgtttctatatatatacactctagatta

SEQ ID NO: 7558 - DNA, 1897 bp, Citrus clementina
ccgaactttgcccgctctctcactagataagagatatacctacttctcgtcttgtacccatcgtgccgtatctcgaccgtacacgtgtttctcgtctccacacgtaaaccagcacctacacacaacccatcacgtgttcttctcaccaaccaatcaatatccgccacgtaaaccacattaactgttcccttatttaaacttttctgcctcttcacgcttatgttcctccaactctctcgcacactcaatttcttctgctggtgaatgcctgataacacgcacaacaccacaacggatttcagtattccgagaacgccaccgttttcagctcattacatataggttgtttcacttcttagggtgacccgaaaaatggtggaaccggtcgcacgtgaaagcgacgaggagacgtcgctgctggcgcagcaaggcaatgttgaccggtcgtggcgtttgaacttcgacggctttcaggtgtcgcctgaacgcacagagaagaaacctccacgtggcctccatgactgcctgggagttttaggtccagaagataacgtggctgaatactatcaacagcaggtacagatgcttgaaggatttaacgaaatggatgccttagcagaacgaggttttgttcctggaatgacaaaggaagagcgggagaatttggctagaagtgagacactggctattagaatatcaaatgttgccaacatggttctttttgctgctaaagtttatgcttctgtcaaaagtggttcattggccatcattgcatccacattagactcccttcttgatcttctatcgggattcatcctatggtttactgcattctccatgcaaacaccaaacccgtaccaataccctattggaaagaaaaggatgcagccattggggattctggtgtttgcatctgtcatggcaactcttggactgcagattatcttagagtcattgcgcactttggtatctaatgaggatcaattcaacttgacaaaagaacaagagcaatgggtcgtgggcatcatgctttcggtgaccctagtaaaacttcttctggttgtgtattgccgtgcctttactaatgagattgtcaaagcttatgcccaggatcacttttttgatgttatcaccaacatcattggcctcgtagctgtacttcttgctaattacattgatgactggatggatcccgttggagctattattctggccttgtacaccatccgcacatggtcaatgacagtgttggaaaatgtgaactcccttgttggaagatcagctgctccagagtatctacaaaagctcacatacctctgctggaaccaccacaagtccataagacatattgacacagtccgagcttacacatttgggtctcactactttgtggaggttgacattgtgctgccagcaagcatgcccttgcaagaggcccatgacatcggtgagtccttgcaggagaagctcgagcttctgccagagattgagcgcgcctttgttcatcttgattacgagtacactcacagacctgagcatgctcaagcacactactaggaactgtagaatattctgatgttgtatttattatcatcttgttggtgctttttgttcccaccctacaagtccaattattaattatccacgaaaatcaagccttgtgaaagatagattgtcattgacaagattatttacacatattttagtaatttaagttctattacacgatcagcagagagttctggggaggtaagagtagtctaaaatggctcttgggctctgttgatgggagtgatgaattagtaatgtgcttgttaagtttgggctgtttagcccaatgtgacgtgactttttcttttcccctttttcgcctgacgttaaaaagatttcttttgca

SEQ ID NO: 7559 - DNA, 1898 bp, Citrus sinensis
ccgaactttgcccgctctctcactagataagagatatacctacttctcgtcttctatccatagtgccgtatctcgaccgtacacgtgtttctcgtctccacacgtaaaccagcacctacacacaacccatcacgtgttcttctcaccaaccaatcaatatccgccacgtaaaccacattaactgttcccttatttaaacttttctgcctcttcacgcttatgttcctccaactctctcgcacactcaatttcttctgcttggtgaatgcctgataacacgcacaacaccacaacggatttcagtattccgagaacgccaccgttttcagctcattacatataggttgtttcacttcttagggtgacccgaaaaatggtggaaccggtcgcacgtgaaagcgacgaggagacgtcgctgctggcgcagcaaggcaatgttgaccggtcgtggcgtttgaacttcgacggctttcaggtatcgcctgaacgcacagagaagaaacctccacgtggcctccatgactgcctgggagttttaggtccagaagataacgtggctgaatactatcaacagcaggtacagatgcttgagggatttaatgaaatggatgccttagcagaacgaggttttgttcctggaatgacaaaggaagagcgggaaaatttggctagaagtgagacactggccattagaatatcaaatgttgccaacatggttctttttgctgctaaagtttatgcttctgtcaaaagtggttcattggccatcattgcatccacattagactcccttcttgatcttctatcgggattcatcctgtggtttactgcattctccatgcaaacaccaaacccgtaccaataccctattggaaagaaaaggatgcagccattggggattctggtgtttgcatctgtcatggcaacccttggactgcagattatcttagagtcattgcgcactttggtatctaatgaggatcaattcaacttgacaaaagaacaagagcaatgggtcgtgggcatcatgctttcggtgaccctagtaaaacttcttctggttgtgtattgccgtgcctttactaatgagattgtcaaagcttatgcccaggatcacttttttgatgttatcaccaacatcattggcctcgtagctgtacttcttgctaattacattgatgactggatggatcccgttggagctattattctggccttgtacaccatccgcacatggtcaatgacagtgttggaaaatgtgaactcccttgttggaagatcagctgctccagagtatctacaaaagctcacatacctctgctggaaccaccacaagtccataagacatattgacacagtccgagcttacacatttgggtctcactactttgtggaggttgacattgtgctgccagcaagcatgcccttgcaagaggcccatgacatcggtgagtccttgcaggagaagctcgagcttctgccagagattgagcgcgcctttgttcatcttgattacgagtacactcacagacctgagcatgctcaagcacactactaggaactgtagaatattctgatgttgtatttattatcatcttgttggtgctttttgttgccaccctacaagtccaattattaattatccacgaaaatcaagccttgtgaaagatagattgtcattgacaagattatttgcacatattttagtaatttaagttctattacacgatcagcagagagttctggggaggtaagagtagtctaaaatggctcttgggctctgttgatgggagtgatgaattagtaatgtgcttgttaagtttgggctgtttagcccaatgtgacgtgactttttcttttcccctttttcgcctgacgttaaaaagatttcttttgca

SEQ ID NO: 7560 - DNA, 1648 bp, Citrus sinensis
ctctctcgcacactcaatttcttctgctggtgattggtgaatgcctgataacacgcacaacaccacaacggatttcagtattccgagaacgccaccgttttcagctcattacatataggttgtttcacttcttagggtgacccgaaaaatggtggaaccggtcgcacgtgaaagcgacgaggagacgtcgctgctggcgcagcaaggcaatgttgaccggtcgtggcgtttgaacttcgacggctttcaggtgtcgcctgaacgcacagagaagaaacctccacgtggcctccatgactgcctgggagttttaggtccagaagataacgtggctgaatactatcaacagcaggtacagatgcttgaaggatttaacgaaatggatgccttagcagaacgaggttttgttcctggaatgacaaaggaagagcgggagaatttggctagaagtgagacactggctattagaatatcaaatgttgccaacatggttctttttgctgctaaagtttatgcttctgtcaaaagtggttcattggccatcattgcatccacattagactcccttcttgatcttctatcgggattcatcctatggtttactgcattctccatgcaaacaccaaacccgtaccaataccctattggaaagaaaaggatgcagccattggggattctggtgtttgcatctgtcatggcaactcttggactgcagattatcttagagtcattgcgcactttggtatctaatgaggatcaattcaacttgacaaaagaacaagagcaatgggtcgtgggcatcatgctttcggtgaccctagtaaaacttcttctggttgtgtattgccgtgcctttactaatgagattgtcaaagcttatgcccaggatcacttttttgatgttatcaccaacatcattggcctcgtagctgtacttcttgctaattacattgatgactggatggatcccgttggagctattattctggccttgtacaccatccgcacatggtcaatgacagtgttggaaaatgtgaactcccttgttggaagatcagctgctccagagtatctacaaaagctcacatacctctgctggaaccaccacaagtccataagacatattgacacagtccgagcttacacatttgggtctcactactttgtggaggttgacattgtgctgccagcaagcatgcccttgcaagaggcccatgacatcggtgagtccttgcaggagaagctcgagcttctgccagagattgagcgcgcctttgttcatcttgattacgagtacactcacagacctgagcatgctcaagcacactactaggaactgtagaatattctgatgttgtatttattatcatcttgttggtgctttttgttcccaccctacaagtccaattattaattatccacgaaaatcaagccttgtgaaagatagattgtcattgacaagattatttgcacatattttagtaatttaagttctattacacgatcagcagagagttctggggagctaagattagtcgaaaatggctcttgggctttgttgatggaagtgctgaattagtaatgtgcttgttaagtttgggctgtttagcccaatgtgacgtgactttttcttttccccttttttgcc

SEQ ID NO: 7561 - DNA, 1619 bp, Tripterygium wilfordii
agcaaccaagctctcgaaccatgatcccctaaatgcccctgacttcttgtcaattttccattctccgcccttgcttgagcagattagtacactgtacacattgtctgaacttagcaactccaaaactagggctttctccggtgacggtgaactatggtggagccggcgacgcacgaccgggatgaggagctctctttgttatccctgcatagcaatggtgacgactcgtggcggttgaacttcgacgagtttcagttatcgccggagcacacagagaataaggctcctcgtgggctccaagactgccttggggtattaggccctgaagataatgttgcagtgtactatcaacagcaagtagaaatgcttgagggctttaatgaaatggatgccttgtcagagcgtggttttgttccaggaatgtcaaaggaagaacgggaaaacttggccagaagtgagacacttgccattagattatcaaatgttgcaaatatggttctttttgctgctaaagtttatgcatccgtcagaagtggctcattagcgatcatcgcatctacattggactctcttcttgaccttttgtcaggcttcatcctatggtttactgctttctccatgcaaacaccaaatccatatcagtaccccattggaaagaaacgtatgcagccattggggatccttgtgtttgcatctgtcatggcaactctaggacttcagataatcttggagtcagtgcgcacaatggtatctgatgagaaagaatttagcctcaccaaagagcaagaaagctgggttgtgggcattatgctctcagtaaccctggtaaaactcatcctggttgtctattgccgctcttttaaaaatgaaattgtcaaagcatatgcccaggatcacttttttgatgttattaccaacattattggcctcattgctgcgcttcttgccaattacattgctgattggatagaccctgttggagctatcattcttgctctgtacaccatccgaacatggtcaatgacagtattggaaaatgtgaattcccttgttggaagatcggctactccggattttcttcaaaaactcacatacctctgttggaaccaccacaaggccgttagacacattgacacagtccgggcttacacatttgggtcacactattttgttgaggttgacattgtcctacctgcaagcatgccattgcaagaggcacatgacataggtgaatccttgcaggaaaagcttgagctactgccggagatcgagcgtgcctttgttcatcttgattacgagtacacccacaaacccgagcatgcacaggtatattaaagacaaggaaatatgatgttcccacaaagataattttaagttgtatgcatgctctagagagctatggttttcctgcttttgcttgtgcaatttggttctaagtagagtactaatgatccctgccccctgcccttgtagcatgaactccattgcttccttattagggctcaaattctagcatgttatctagtggtcagtcttttggtccatccacgaaacttttactgaagagttggctatctgttggtcattccttttcggtctttgtttctattacattctat

SEQ ID NO: 7562 - DNA, 1584 bp, Malus domestica
tgcccctcgaatgctcctctgctcatcgtcccacaaactctctccttttacctagccctttctctccatctctttctctctctggctcaccgtgaccgggagaatggtggagccggtgacgcccgactacgacgaggagcgctcgctgttgcaggagtcgagcattgtcgaggggtcgtggcggttgaacttcgacggattccaggtgtcgccggagcacaaggagaaaaagcatccgcgcggaatccatgactgccttggggttttcggtccggaggataatgtggcggagtactaccaacagcaggtagaaatgcttgagggctttactgaaatggatgccttagcggagcgtggttctattcctggaatgtcgaaggaagaacaggaaaagttggcaaaaagcgagacatttgccatcagaatatccaatattgccaacatggttctctttgcagctaaagtttatgcatctgtcagaagtggttcattggccatcatcgcatccacattagactcattgcttgatcttttgtccggcttcatcctgtggtttactgcattctccatgcaaacccgtagcccatatcagtatcctattgggaagaaacgaatgcagccgttgggaatccttgtttttgcctctgtcatggcaaccctgggactgcagatcatcctggagtcaatgcgcacactagtttctgatgaggatgagttcagcttgaccaaggatcaagagcgatgggtcgtgggcattatgctctcggtgactttggtaaaattccttctgatgctttactgccgcagtttcaagaacgaaattgttaaagcatatgcccaggatcacttctttgatgttataactaacatcattggtctcgttgctgtgctccttgctaattattttgatgattggatggaccccgttggagccatcattctggccttgtacaccattcgcacatggtcgttgactgtgctggaaaatgtgaactcgctagttggaaaatcagctgctcccgaatatctacaaaaattgacatacctttgctggaaccatcacaaggcaatacgccatatcgatacagtccgggcttacacctttggctctcactacttcgtcgaggttgacattgtcctgccggctgacatgcccttacaagaggctcatgacataggggaaaacctgcaggagaagcttgagctcttgcccgaaattgagcgcgcctttgttcatctggatttcgagttcagtcacaagcccgagcatgcacaatcacactcatagaagtcggaatatttttattgggaattgttattagcactccaaaaatctcattttacattccaaattttctacattaggaaagaaaaatacacttatgaggagtgtagaatgagatttttaaaatgccaataacacttccatttctatttattattttcttcaactttgtatgctagaatcgattccgaatggaaggcaatattaaactgaaaatgtgtagttatttggtaggcgtcaagaacaagttgggattcttgtaacactgggaaaatagcatgcgtatggctgggtctcaa

SEQ ID NO: 7563 - DNA, 1535 bp, Euonymus alatus
ggtcacaatttcccagcagccaagacccccccgaatcatgatcccctaacttgctgtcaaatttcccttctccgcccttgcttgaacagattagtacacattgtctgaacctagcaactccaaaactagggttttctccggtgacagtgaacaatggtggagccggcgacgcacgaccgggatgaggaactctcgttgttgtcactgcacagcaatggtgaccactcgtggcggttgaacttcgacgagtttcagttatcgacggagcacacagagaataagcctcctcgtggactccaggactgccttggcgtattaggccctgaagataatgttgcagtgtactatcaacagcaagtagaaatgcttgagggctttaatgaaatggatgccttgtcagaacgtggttttgttccaggaatgtcaaaggaagagcgggaaaacttggccagaagtgagacacttgccattagattatcaaatattgcaaatatgtttctttttgctgctaaagtttatgcatctataagaagtggctcgttagcaatcattgcatctacgttggactctcttcttgatcttctatcaggcttcatcctatggtttactgcattctccatgcaaacaccaaatccatatcagtaccccattggaaagaagcgtatgcagccattggggatccttgtttttgcatctgtcatggcaactctaggacttcagataatcctggagtcagtccgcacaatggtatatgacgacaaagaatttaaccttaccaaagagcaagaacactgggttgtgggcattatgctctcagtaaccctggtaaaactgatcctggttatctattgccgctcttttaaaaatgaaattgtcaaagcttatgcccaggatcacttttttgatgttatcaccaacattattggcctcattgctgcccttcttgctaattacattgatggttggatagaccctgttggagctatcattcttgctctgtacaccatccgaacatggtcaatgacagtgttggaaaatgtgaattcccttgttggaagatcggctactccagattttcttcaaaaactcacgtacctctgttggaaccaccacaaggccattagacacattgacacagtccgggcttacacatttgggtcacactattttgttgaggttgacattgtcttgcctgcaagcatgccattgcaagaagcacatgacataggtgaatctttgcaggagaagcttgagctactgccggagatagagcgtgcctttgttcatctcgattatgagtacacccacaaacccgagcatgcacaggcatattaaagtcaatgaaatataatgttccaaccgttgtattacccaaaaacatgtatctttgttctacagaggttatgtgttgcctttcttttgtttgctaaacctagttgtttaaagtttaatataaagttaggcttggctttccttattattgttgacaaacaccgtgctgaagatgttatttgaaaaggtcctcctgacattat

SEQ ID NO: 7564 - DNA, 1650 bp, Gossypium hirsutum
ctgagttaggctaacttagccgtcggagttttcttcatatccccaaaataccctcatcttttcatctaatttccaatctagaccctctctgctaaaatagaataaaaacggaaaacggaaaggcaaaatcacaagctctttttttttttcctcatattggaagggagtgaaacgggacaatggtagagacggtggcgcgtgaaagcgacgaagagctagcgctgttgccacatcagaacaatggcgaccggtcttggcggttgaacttcgatggtttccagttatcgcctgaacacaaagatgttaaaaagcctcctcgaagcctccatgattgcctcggggttttaggtccagaagacaatgtggctgaatactatcagcagcaggtggaaatgctcgagggttttaatgaaatggatgccttagctgaacgtggttttattcctggaatgtcgaaggaagaaagggaaaagttggctagaagtgagacgttagccattagaatttccaatgttgcaaacatggttctttttgctgctaaagtttatgcttctgtctggagtggttcgttagctataattgcatccacgttggactcgcttctcgatcttctgtctggctttatcctctggtttactgcgttctctatgtcaacaccaaatccatatcagtatcctattggaaagaaaagaatgcagccattgggtatccttgtttttgcctctgtcatggcaacccttggcctgcagataatcttggagtctgtacgaaccatggtatcagatgatgatgaattcaacctgacgaacgaacaagaacggtgggttgttggcattatgctcggagtgaccctggtaaagcttttcctcgtgttttattgccgcacatttacaaacgaaattgtcaaagcgtatgcccaagatcatttcttcgacgttatcacaaacatcatcggcctcattgctgtgctgctcgcaaattacatcgatgattggatggacccagttggagctatcattctggctctatacactatccggacatggtcgatgacagtactagagaacgtgaattcattagtcggaaaatcagcagctccggaataccttcagaaactaacatacctgtgttggaaccaccacaaggccataagacatatcgataccgtccgagcctacaccttcgggtctcactactttgtggaagtcgacattgtactcccagcaaacatggcattgcaagaagctcatgacattggggaatcattgcaagaaaagctggagttgctgcctgagattgagcgtgcctttgttcatctggattatgaattcagtcacaaacctgaacatgcacaagcacatgctttgtagacaaataaataacctaggatgtcttaaatgctatgtctatgatccttccccccccccccaaccctccccccttttttttcctgggattttaccatcaaattctatgaagtatgtatgctgcgtgaattgagccatataaaagcaatttaaactttatggcaaacatttgtaaatgcaacatgtttaatttaatttagttggtgtcatcaagtgatgctaattcagaaaaattaaattgatgtatgattgaaaatatttcttaaaaaaagtattcaaggat

SEQ ID NO: 7565 - DNA, 1581 bp, Malus domestica
ccacaacagaactataatataaattcccgtttcccaaaaacccctcggattctcatcgagttttcagttcctgcccctcgaatgctcccctgctcctcccgcactctctctctaacccagccttctctctctccctctctttctctctctaactcacggtgaccggggtaatggtggatcctgtgacgccctgctacgacgaggagagctcgctgttgcaggagtcgagcattgtcgacgggtcgtggcggttgaacttcgacggcttcgaggtgtcgtcggagcacaaggagaagaagcctccgcgcggaatccatgactgccttggggttttagggacggaggatactgtggcggagtattaccaacaacaggtagaaatgctcgagggctttactgaaatggatgctttggcggagcgtggttttattcctggaatgtcaaaggaagagaaggaaaagttggcaaaaagcgagacttttgccatcagaatatccaatattgcaaacatggttctttttgcagctaaagtttatgcatctgtcagaagtggttcattggccatcatcgcatccacattggactcattgcttgatcttttgtccggcttcatcttgtggtttactgcattctccatgcaaacccctagcccatatcagtatcctattgggaagaaaagaatgcagccgttgggaatccttgtttttgcctctgtcatggcaaccctgggactgcagatcatcctggagtcattgcgcacactagtttctgatgaggatgagttcagcttgaccacggatcaagagcgatgggtcgtgggcattatgctctcggtgactttggtaaaattccttctgatgctttactgccgcagtttcaagaacgaaattgttaaagcttatgcccaggatcacttctttgatgttataactaacatcattggtctcgttgctgtgctccttgctcattattttgatgattggatggaccccgttggagccatcattctggccttgtacaccattcgcacatggtcgttgactgtgctggaaaatgtgaactcgctagttggaagatcagctgctcccgaatatctacaaaaattgacgtacctttgctggaaccatcacaaggcaatacgccatatcgatacagtccgggcttacacctttggctcgcactacttcgtcgaggttgacattgtcctgccggctgacatgcccttacaagaggctcatgacataggggaaacgctgcaggagaagcttgagctcctgcctgaaatcgagcgcgcctttgttcatctagattacgagttcagccacaagccggagcacgcacagtcgcactcataaaagtgaggataattctatttgttgttgtgttcaactttgtacgctagaatcgatcccaaatcgaaggcagtaataaactgaaaatgtgtagatgtttggtaggcgtcaagaacaagttgggattctggtaacactgggaaaacagcatttgtatggccgggtcgcatgcaccttttagtgagacccagcaatttcaagttactgtatatcactactccttgagaaa

SEQ ID NO: 7566 - DNA, 1628 bp, Fragaria vesca
gcagaccacaccagcgtcgtcgtccttccaataatttccgcattcccaaaatacccctaggattctctccggaattttccagcaccgttctccggcgccgatcgccgcggtgtcctcggacggtcctccgaagctctctctggaccgggaatggcgtcgccggtgacatccgaccacgacgaggcgcagtcgctgctgcgagattccggcaatgtcgacggctcgtggcggttgaacttcgagagcttccaggtggcctcggagcacaaggagaagcaaccgcgggccttccatgactgtcttggagttaaaggcccggaggataatgtggcagagtattatcagcagcaggtggaaatgctcgaagggtttaatgaaatggatgccttagcggagaggggttttattcccggaatgtcaaaggaagagcgggataatttggctaaaagtgaaacctttgccatcagaatatcaaatgttgcaaacatggctctttttgcagctaaagtttacgcatcttacagaagtggttcattagccattattgcatccacactggactcattgcttgatcttttgtctggcttcatcctgtggtttactgcattctcgatgcaaaccccaaacccttatcagtatcctattggaaagagacgtatgcagccgttgggaatccttgtttttgcttctgtcatggcaactctgggactgcagatcatcttagagtctatgcgcaccttattttctgatgaagatgagttcaacttaaccaaggatcaagagcgatgggttgtgggtattatgcttggtgtcactctggtgaaattgcttttgatgctttattgccgcactttctccaacgaaatagtcaaagcctatgcccaggatcatttctttgatgttatcaccaacatcattggtctggttgctgtgctccttgctaattactttgatgaatggatggaccctgttggagcaattattctggccttgtacactattcgcacctggtcattgactgtcttggaaaatgtgaattccctagttggaaaatcagctgctccagaatacctacaaaaactgacatacctgtgctggaaccatcacaaggcgatacgccatatcgacacagtccgtgcatacacctttggctcacactactttgtcgaggttgacattgtcctgccagcagccatgcccttacaagaggctcatgacataggggaagcgttgcaggagaagctcgagctcctgcctgaaatcgagcgcgcctttgtccatctagactacgagttcagtcacaagcccgagcatgcgcagtcacactcttagaaagagagaatgttatatattatgatggtccagatccttctgtgtatcaacttttgaaagctagagttgatccccaatggaggaaatatcaaaactggagatgtgtagatatttgttcttgtcaatgtcgaaggacatggcacttaattctggtgaaactgggtatgaatgctggtccatgcatcttgtagcgagacatagcacttttaatttaaatgattcccacatctttttaccatgttccttttatgtttttatcacatggtcatgactcatatcccgaacaagggttcgta

SEQ ID NO: 7567 - DNA, 2107 bp, Theobroma cacao
gtgtcactttctcattggccttatcatggacctttctaccaacagtcacttgacagctcatgacatcacgagaatttcgagctcctcacgccattgtcccatcatttcggtggataaacctttccgctatcgcggccgacccgacgggtttcatcagaagatgacgaagaatcgcgcggctcagatcattcgtcccctagattcacgcatgatatcagatgatacttacctctgatcccatctagaccgcccacgtgtcgttcaaaattccatcaccataaagcccaaccctttatataccttcccttcgctctcccacccaactttcttggcctcacaaagctcagcttgctaaccgacgtccaatgattttcacatccccaaaataccctcgtatctccttcaaatttccaacctctactttccgctaaattggaaaagataaaaataaaaaccaagtacactaacgaatctcaaagctttggagggtgactgggaaaatgggagagccggaggcgcgtgagagcgacgaagagctgtgcctgttgtcacatcagagcaatggtgaccggtcatggcggctgaacttcgatggtttccagttatctcctgaacacaaagacaaaaagcctcctcggagcctccatgattgccttggggtttcgggtccagaagataacgtggctgaatactatcagcagcaggtagaaatgcttgagggtttcaatgaaatggatgccttggctgagcgtggctttattcctggaatgtcaaaggaagagcgggaaaagttggctaggagtgagacattagccattagaatttccaatattgcaaacatggttctttttgctgcgaaagtttatgcttcagtccgaagtggctcattagctataattgcatccacattagactctctccttgatcttctttctggcttcatcctctggtttactgcattttccatgtcaacaccaaacccatatcagtacccaattggaaagaaaagaatgcagccactgggtatccttgtttttgcctctgtcatggcaactcttggactgcagataatcctggagtcagtgcaaacaatgatatcggatgaggatgaattcaacctgacgaaagagcaagagagatgggttgttgtcattatgcttggagtgaccgtggtaaagcttctcctggtgttttattgccgtacatttacgaatgaaattgtcaaagcttatgcccaggatcacttctttgatgttataacaaacatcattggccttgttgctgcgcttcttgctaattacattgatgattggatagaccctgttggagctatcattctggctttgtacactatacgcacatggtcaatgacagtgttggagaatgtgaactcattagtcggaagatcagctgcccctgagtatcttcagaaactgacctatctctgttggaaccaccacaaggccataagacatatcgacacagtccgagcttacaccttcgggtcccactactttgtggaggttgacattgttctcccagcaaacatgcccttgcaggaagctcatgatatcggagaatccttgcaagaaaagctcgagctactgcctgagattgagcgtgcctttgttcatctcgattatgaatacactcacaaacctgaacacgcacaggcacatgctttgtaggcagaagctagagagtctgattgtctgtaatgctatatttttgttggttatttttgtttctaccaacgaattctacaacttgtgcatgcttgggaaaattgagctatataaaattaatgtaaactgatggtaaatattggtaaaacccagatgtttacgaattgtaagctcctccattaatgctcaggtaggtttctttaactctttggtgagatcagttttgtaggcaaggtaaagttgaggattgatttagccatggagttggatgtatggctttgggtcttcaaatattcacgtggagaaatgtggaaatcatatccttaagagtcattgaaaagtacctaactcggtgcaagtgtcatgaattcgcgtttgtaactcaaaagacattgcaattaagatcaaaatttatgttgttc

SEQ ID NO: 7568 - DNA, 1594 bp, Amsonia hubrichtii
tcgcattctttgctccctcttccactctaccaaaccccctccccggctactacttcaccgagagtacctgtaagggttttctttttgtccgttgcatgaacaagcagtgaggccggaaaaaatggttgagccgttaactcttgactgcgatcacggtggctccgaagagcaacttcttttgcaggagagtggaaatgctgacagttcctggcgattgaactttgacggtttccagttgtcttgtgagcataaggagaagcctcctcgtggccttcaagactgcctcggtgtgttaggtccagaagataatgtagctgagtattatcagcagcaggtggaaatgctagagggcttcaatgaaatggacgccttagcagaacgtggtttcgttcctgggatgtcaaaggaagaaagagaaaagttggccagaagtgagacaactgccatccggctatcaaatatagcaaacatggttctttttgctgctaaagtttatgcatccgttaggagtggttcactggctatcatcgcatccacattagattcacttctcgatcttctctcaggatttatcctttggttcacagcattctccatgcagactccaaatccatatcaatatcccattggaaagaaacgaatgcaaccattgggaatcctcgtttttgcatctgttatggcaactttaggattgcaaataatcttggagtctctgcgcacactaatatatgatgaggatgatttcaacttgaccaaggagcaagaacactgggtggttggtattatgctctcagtgactttggtaaaactacttttggtggtgtactgccgatcttttaccaatgagattgtcaaggcatatgctcaagatcacttctttgatgtgatcaccaatatcattgggctcattgctgcgctccttgctaattatgtcaatggttggatggaccctgttggagctatcattctggctctatacaccattcggacctggtcattaacggtattggagaatgtaaactctcttgttggaaaatcggctgctccagaatatctgcaaaaactgacctacctctgttggaatcatcacaaggccataaggcacattgatactgtgagggcctacacctttggttctcattactttgttgaggttgacattgtattgccagctagcatgcccttgcaagaggcacatgatattggagaggcgttgcaagagaagcttgaactgttacctgaaattgagcgtgcctttgttcatctagattacgaatacagtcataaacctgagcatgcacaagcacaacattagaggacacatataatttcttactggagtgctaggtgttttccacttgagttggctgtaggcaaagcttgtcaaaatacaggaatcagctggaatatattctggaaaagtgaaccttaccttcattttgtggcttatcaaaatggaaatttgactgttgaatttgagacgtcagatttgaattcttcttgtttttttttttgtaaactaatcacactcaaagtgtctggctaccaaatactcaacgtctgcaattctcaaccatcggcaattctcagaaag

SEQ ID NO: 7569 - DNA, 1730 bp, Catharanthus roseus
tccattatctcccaattccctccttctccgctctacagtttctcaccaaacccctactgaagaaagagtcctctttccagcaggttctccttcttcttctcgttgtcaaatattgcatgagcaaccagtgaacgtcgccgccaatatggtggagccgttaactctcgacggcggtcacgatgcctccgaagagcgactacttttgcaggagactggaaatgctactactgaccattcctggcgattgaacttcgatggtttccacttgtcttgcgagcataaggagaaacctcctcgtggtctccaggattgcctcggtgtattaggttccgaagataacgtggctgagtattatcagcagcaggtggagatgctagagggcttcaatgaaatggatgccttagctgaacgtggttttgttcctggaatgtcaaaggaagaaagagaaaagttggccagaagtgagacgactgccatccagttatcaaatatagcaaacatggttctttttgctgctaaagtttatgcatccgttcggagtggttcactggctatcatcgcatccacattggattcacttcttgaccttctctctggatttatcctttggttcacagcgttttccatgcaaactccaaacccatatcaataccccatcggaaagaaacgaatgcaaccattgggaatccttgtttttgcatctgttatggcgactttaggattgcaaataatcttggagtctctgcgtacattaatatatgatgatggtgatttcagcttgaccaaggagcaagagcgctgggtcgtcggtattatgctctctgtgactttggtaaaactgtttttggttttttactgtcgatcatttaccaatgagattgtcaaggcatatgctcaagatcacttctttgatgtgatcaccaacatcattgggcttattgctgcactccttgctaattatgtcactgactggatggaccctgttggagctatcattctggctctgtacaccattcgaacatggtcattaaccgtactggagaatgtaaactccctggttggaaaatctgccgcaccagaatatctgcaaaaactgacctacctctgttggaaccaccacaaggctataaggcacattgatactgtccgggcctatacttttggttctcactactttgtagaggttgatattgtattgcctgctgacatgcccttgcgagaagcacacgacattggagaggccttgcaagagaagcttgagctgttgcctgaaattgagcgcgcctttgttcatcttgattatgaatacagtcataaacctgagcatgctcaatcacaccattagattatagactgcttaagaaagttgtcggtgctggctgcagtgaaacaaaccgcgtatgtgcattcaggtgagtattttatcccaactcggagctgaataaactgttgatttgcatagctagctagtgaatcctcctggcgggcgttttaggtttcacataaatataatatattccacaatgggaaggcaggcgtaatgtttccacatgagttatattgcatatagcaaaggcaaggctgttcaaaatacaggaattgtttggagagcttgcggatgactattgtgtaggctttttatatagttgtacttgactgttgctatcattttagttttattcaattagagattaatgtctttttactgctctaaataaaatcaattccca

SEQ ID NO: 7570 - DNA, 1819 bp, Quercus alba
gtgctccattatctctggttggtatcgaaaatatagcagccagccaccacaatagtctctcttattacacagtcttacattacacactttctcagaaaactcctcctattctcattgaatttacgacctctaccctcctcttcacagctcgagtgacatgaaaatgactgagctggtggcgttcgacaacgacgaggagcgctcgctgttgtcggagcccgacattactgttgaccggtcgtggcggttgaacttcgatgattttcaggtgtctactgaccaccaggacaaaaagcctcctcgtggactccatgactgctgtcttggggttttaggtcctgaagataatgtggctgagtactatcagcagcaggcagaaatgctcgagggctttaatgcaatggatgagttaacagaacatggttctcttcctagcatgtcaaaggaggagagggacaatttggctagaagtgaaacgtttgctattaggatatcaaatattgcaaacatgtttctctttgcggctaaagtctatgcatctgtccaaagtggttccttagccatcattgcatccacattggactcacttcttgatcttctgtctggcttcatcctgtggtttacagcattctccatgaaaacaccaaatccatatcaatatcctattgggaagagacgtatgcagccattggggatccttgtatttgcctctgtcatggcaacccttggactgcagataatcttggagtcaatacgcacactgttatctgatgagagtgatttctcattgaccaaagagcaagaggaatgggttgttggtattatgctctctgtgactttggtaaaactcggtctggttctttattgccgttctttcactaatgagattgtcaaagcttatgcccaggaccacttttttgatgttatcaccaacgttattggactcattgctgctctccttgctaattatattgatgattggatggaccctgttggagctatcattctggctgtgtataccatccgtacatggtcaatgacagtgttggaaaatgtgaactccctcgtgggaagatcagctgctccagagtatctacagaaactgacatacctctgttggaaccacgacaaggccataaaacatatcgatacagtccgggcatacacctttggctctcactactttgtggaggttgacatagtcttgccagcagacatgcccttgcaaaaggctcacgacattggggaatccttgcaggagaagcttgagcacctgcctgagatcgagcgtgcctttgtacatctcgattatgagtactcgcacaaacctgagcatgctcagtcacaccactaggaataagaagtaaatctaatattaaatctgttaaaagttttgtttcttgctcttttttacactcagctacaggttcttgacttcaatctgaaccttttgaggacaatctgaagctgtaagaatcatgtagaaaattgattacaagtgtacattcagtgaaattgtctaatactttggtggaacatttgttagctggggagctaacttgccctgggcatctgcttagggctattggccttttgcaactttaaaggtaacccattacccaagcaaaccatttcttattgttatgttaacatgcagattgaaatatgggcctaacctcaactagcacaagaaagttcttaaatgtcaatttaacgttcttaaatctgtggaccaagcttgctttttggaggccatagttgggggagtttgtttggaacaattggagcttggaaaatgcttgtccgtgtttgggccttt

SEQ ID NO: 7571 - DNA, 1894 bp, Gossypium hirsutum
atcttccactcatcaatctatctagccaccatatctcatatttggggcttggaattctctattatttctcctccttagctccggctcttcaccttacatggacgaatcgacacttcccccaccactttctccttattgaaatcttgtaacaacatttagtttttatttcaaaattaattggaaaaaaaaagtgagagtataatttattcttaggttcaccaaccaggtagtttatagtttatccaagttgaaacgtagccctttacatatcttcccttcgctttcccatccaacattcctggacgctaaatgccaggggatttttttattcccgaaataccctcgcttttccttcaaatttccaacctttgccgctgctaaattgaataaagaaaaaggaaatcacacttaacagatctaaacaattttcctgtttggaatggtgcgcggggaaatggtggagatggtggcgcgagaaaccgacgaagagctttcattgttgccacatcagagcaatgttgatcgatcatggcggttgaacttcgatggcttccagttatctcccgaacacaaagacaaaaagcctcctcgtagcctccatgattgccttggggttttaggtccggaagataatgtggctgaatactaccagcagcaggtagaaatgctagagggttttagtgaaatggatgccttagccgagcgtggatttattcctggcatgtcaaaggaagagcgggaaaggttggctagaagcgagacattagctattagaatttcgaatattgcaaacatggttctttttgccgctaaagtttacgcttccatgagaagtggctcattagctataattgcgtccacattggactctcttcttgatctcttgtctggcttcatcctctggtttactgcattctccatgtcaacaccaaacccatatcagtacccaattggaaagaaacgaatgcagccactgggtatccttgtttttgcctctgtcatggcaactcttggactgcagataatcttggagtctgttcgaacaatggtatcaaatgaggatgaattcaacctgacaaatgagcaagagaggtgggttgttggcattatgcttggagtgactctgacaaagcttctcctcatgttctattgccgcacatttacaaacgaaatcgttaaagcttatgctcaggatcacttctttgatgttatcacaaacatcattggccttgttgctgtgctacttgctaagtacatcgacgattggatggaccctgttggagctatcattctggctttgtacacaatacggacatggtcgatgacagtattagagaacgtgaactcactggttggaagatcagcagctccagaatatcttcagaaactgacctatctgtgttggaaccaccataaggccataaagaacatcgatacggtccgagcttacaccttcgggtctcactactttgtcgaagttgatattgtacttccggcaaacatggcattacaagaagctcatgacattggagaatccttgcaagagaaactggagttactgcccgacattgagcgagcgtttgttcatttggattatgaattcagtcacaaacctgaacatgcacaggcacatgctctgtaggtagccattaacctatggtttgtccggttgggctagtatgttagaatgtttctacctacaaattctatggcctatgtatggttggaactcgaggtttagtttagtttagttagttcatgtactgaacctcggcttctaacaagtctagagttcgagtttctgtattttcagtaaaaaagaatcaactgagagtaaaacaagtaaaggtaaatattggtaaatgcagatctttactaattttatgctccttta

SEQ ID NO: 7572 - DNA, 1933 bp, Tabernaemontana elegans
ccacctttttcgttcattccccaaaaggccctccgtctccccccattttctcgcattttttcctttttccttcttcctctctaacattcttcaccgaccaccctctactgtccaactgatagtcgccgtaagggttttccttttgcccattggacgagtaagcggtgacgccggaaaaatggtggagccgttaactctcaactgcgatcacgatgcctccgaagaacaacttctcttgcaggagactggaaatgctgacagttcctggcgattgaacttcgatggtttccagttgtcttgtgagcaaaaggagaaacctcctcgtggcttacaagactgtctcggtgtgtcaggtccagaagataatgtagctgagtattatcagcagcaggtggaaatgctagagggcttcaatgaaatggatgctttagcagaacgtggttttgttcctggaatgtcaaaggaagaaaaagaaaagttggctagaagtgagacaactgccatccggttatcaaatatggcaaacatggttctttttgctgctaaagtttatgcatccattaggagtggctcactggctatcatcgcttccacattagattcacttcttgatcttctttcgggatttatcctttggttcacagcgttctccatgcagactccaaacccatatcaatatcccattggaaagagacgaatgcaaccattgggaatcctcgtttttgcatctgttatggcaactttaggattgcaaataatcttggagtctgtacgcaccctaatatctgatgaggctaatttcagcttgaccaaggagcaagagcgctgggtggtcggtattatgctctctgtgactttggtaaaactatttttggtgctgtactgccgatcttttacgaatgagattgtcaaagcatatgctcaagatcacttctttgatgtgatcaccaacataattgggctcattgccgcactccttgcaaattatgtcagtgattggatggaccctgttggagctatcattctggctctttacaccattagaacctggtcattaacggtgttggagaatgtgaattcccttgttggaaaatctgctgctccagaatttctgcaaaaactgacctatctctgttggaaccaccacaaggccataaggcatattgatactgtccgagcttacacctttggttctcactactttgttgaggttgacattgtattgccggctgacatgcccttgcaggaggcacacgacattggagaggccttgcaagagaagcttgagctgttgcctgaaattgagcgtgcctttgttcatcttgattacgagtatagccataaacctgagcatgcacaagcacaccattaagtataagccattatattgttggctgtgcatctcatatccttttgtttcgtgtcctaatctgaaaggaagcacatgtatgccagtgagaattttatcccaaaatggaacaagtatggggtgaaaaatcctgattacagatgaaactggtggtacatatatagctaactcgtgaaatcccagggtaattaggctctccttcagtcccaagctatgactgctacatcacaagaccgaaaaatccttactggaatgcaaggtgtttcatccattagctggctgtagcatatggtgcaaagcttatcaaaatacaggaatcatttgaggggcgtgcaacctacaagattatgtagtaggcattttgtctagttttactttatcaataatatgttatttgtgttactagtattattgtttcctctctttagttgatgcttttattagttaattctttaccccttccctacggctactatcctctggagtctgaatagtatgattatttgtattttgtttaccctaaattttctaagtgttggtatacttaggtggttggtcggtcgt

SEQ ID NO: 7573 - DNA, 1479 bp, Aquilegia formosa
atttccatttccattaattaataaatatataaagtaaagatactcaacaaacaagttacaagtttcctttatttatttcactttctttctttgttaagttttgattcttggggtttttattagttatcggaaagaatggtggatccggtgagctccgatgaatattcagaagaacaacttttattagaaactggtactgaagagaggtcatggaggttaaactttgatggcattcaacgttctgaatatacaaaagttaaaccttctcgtggtcttcatgactgtcttggagtgttggcttccgaagatgtggttgctgtgtactaccaacagcaggaagagatgttggatgggtttaacgaaatggatgccttggcagaacgtggttttttccctgggatgtcaaaggaagaacgagagcagttggctaaaagcgagacattggccatcagaatatcaaatattgcaaacatggttcttttcattgctaaagtatacgcttcagtcaggagtggttcattggccattatagcatccacattggactcacttctggatcttttatctggattcattttgtggttcactgctttctctatgcagacaccgaacccctatcagtatccaattgggaagaaacgcatgcaaccattgggaattcttgttttcgcctctgtcatggcaaccctaggtctgcaaattatcttggagtcagttcgcacattggtatctgatgaggatgagttcaacttgaccaaggagcaagaggcttgggttatttcgataatgctctcggttacactggtgaagctcctcctttgtgtttattgccgctctttcacgaacgagattgtcaaagcttatgctcaggatcatttctttgatgtgatcaccaacattattggtctcatagctgccctccttgcaaattatatcagtgactggatggacccagttggagctatacttcttgcattatacacaatccgtacgtggtcaattacagtgctggaaaatgtgaactccttggtaggcaagtcggcagcacctgaatatctccaaaaactgacgtatctctgctggaaccaccacgaggccattagacacattgatactgtacgagcttacaccttcggctctcactactttgtcgaggttgacattgtcttgccatctactatgcccttgcgggaggcacacgacattggggaagccttgcaagaaaagcttgagcagcttcccgagattgagcgagcttttgttcatcttgactatgagttcactcacaagcctgaacatgcacaatcacattagagagagcaatttaccaccggggtgaaagtgattttccattgtttggagagtctggcacgagaaacatttttttgtaaatatactatgggcattgccaatgcagttgcgtcatgttgaatcctgttaaaatcttctcatcaatttagctgaaatagcaagcttgac

SEQ ID NO: 7574 - DNA, 1609 bp, Cucumis melo
accatttgcaccactacaactcccatttcctcccccttcttcctcctccttcttcctcctcctcctcctctcaaattcctccattcctacattctctcacattttcacttctctcaaaaatggttcaccctgttgtctccatcgagaacgacgaagagagctccctgttgctccagtccaccgccggggacctttcatggcgtttgaacttcgatggctttcagttatctccagagcataaagagaagaagccctctcgtccacttcatgattgccttggggttttgagtcctgaagattatgtagctgagtactaccagcagcaggtagagatgcttgagggatttaatgaaatggatgctttaactgatcgtggttatgttcctggaatgtcaaaggaagaacgtgaaaatttagcaaaaagtgaaacatttgcaatcagaatatcaaatattgccaatatggttttgtttgcagctaaagtatatgcatccatcagaagtggttccttagctataattgcatccacactggattcacttcttgacctgttatctggtttcattctatggttcactgcattttccatgcaaacaccaaacccctaccagtatcctattggcaaaaagcgcatgcagccgttgggcattcttgtttttgcctctgttatggcaactcttggattacagataatactggagtcaattcggactctcctattaggtgattctgtgttcaacttaaccaaggaacaagagcgatgggttgtgggcattatgatttcagttactatagtgaaactagtcttaatggtctactgccgtactttcaccaacgagatagtcaaagcatatgcccaagatcatttctttgatgtagtcaccaatgcaatcggccttgttgctgctctccttgctaattatatagctggctggatcgaccctcttggagctattattctggctttatacactatacgcacgtggtcgatgacggtattggaaaatgtgaactcccttgtcggaagatcagctgcccctgagtatctacagaagctaacctacttatgttggaaccatcacaaagccatcagacatattgacacggtccgagcgtatacatttggatcacactactttgtcgaggtcgatatcgtcctgcctggagacatgccactggaagaggctcacgacataggtgaatccctgcaagaaaagctcgagctgttaccggaaattgagagggcctttgttcatcttgattacgagtacaagcataaaccggagcacgcacaggcacactcttagaacaacaaggcaatatggtaatttcttctcttcaactctaaatcccgcatgttcatttatgtggtagtaaaattgcaataacgacgtggttttgagttgtgtaaatttgtgcctaattctgcgtgaatgatgatgaggaatttctttggtgattttagaagaaaatttagagcaacaaaccaaagaagaatcttttagtggctgtcaggtaattgtataaaaatagaaaattcttaagccatcatttctccttaaattttagacttctgaaccacaagcacgaaccaatttcctttggtcct

SEQ ID NO: 7575 - DNA, 1394 bp, Vinca minor
tcttacctccgatatccacttagggttccgccattacatgaccatcaaacagtaactccgccgctaaaaatggtggagcctttagttctcgactctggtcgtcacggtggttgttccgaagagcaacttcttttacaagagactggtaaggctgctgctgctgaccattcgtggcgattgaacttcgatggtttccagctgtccagtgagcatagtaaggagaagcctcctcgcggcggcctccaggactgcctcggagtgttgggtcccgaagataacgtggctgagtattatcagcagcaggtggaaatgctagagggcttcaatgaaatggatgccttagcggaacgtggttttattcctgggatgtcaaaggaagacagagaaaaattggctagaagtgagacaactgccatccggttatcaaatatagcaaacatggttctttttgttgctaaagtttatgcatccataagaagtggttcactggctatcatcgcatccacactagattcacttctcgacctcctctcaggatttatcctttggttcacagcattctccatgcagactccaaacccatatcaatatcccattggaaagaaacgaatgcaaccactgggtatccttgtttttgcatctgttatggcaactttaggattgcaaataatcttggagtctctgcgcactctagtatccgatgatgccgatttcaacttgaccaaggagcaagagctctgggtggttggtattatgctctctgtgactttggtaaaactatttttggtgttctactgccgatcatttaccaacgagatcgttaaggcgtatgctcaagatcatttctttgatgtaatcaccaacatcattgggcttattgccgctctccttgctaattatgtcagtgattggatggaccctgttggagctatcattctggctttgtacacaatccgaacatggtcattaacagtgttggagaacgtgaattcccttgccggaaaatctgccgcaccggaatatctgcaaaaactgacctacctctgttggaatcatcacaaggccataaggcacattgatacagtcagggcctatacctttggttctcactactttgtcgaggttgacattgtattgccagcttccatgcccttgcaagaggcacacgacattggagaagccttgcaagagaagctcgagcagttgcctgaaattgagcgcgcttttgttcatcttgattacgagtacagtcacaaacctgagcatgctcaagctcacctttaaatataagcgtgattatttcttcctcttccacaatctttgaaatgcatattgaaattatagactggtttaaggttggtggtggtggctgcagttaaagaaggaacgtttat

SEQ ID NO: 7576 - DNA, 1647 bp, Citrullus lanatus
gggttcaaacgtttcggactacactaaccgcaacagtgaacaaacccaacttctattttgccgaaatgcccacaaattctcgttaaatttaccatttgcaccactaaaatttctccctcctcttcttcttcttcttcttcctcttcctcccaaattcattcattcatacatttctcgcattttcacttatcgcaaaaatggtgcagcccgttgtatccaccgagaacgacgaggagagctcgctgttgctcgactccaccgccggcgacgtctcatggcgcttgaacttcgacggctttcagttatctccagagcataaagagaagaaaccctctcgtccactccatgattgccttggggttttgagtcctgaagattatgtagctgagtattaccagcagcaggtagaaatgcttgagggatttaatgaaatggatgctttaacagatcgtggttatgttcctggaatgtcaaaggaagaacgtgaaaaattagcaaagagtgaaacatttgcaatcagaatatcaaatgttgccaatatggttctgtttgcagctaaagtatatgcatccatcagaagtggttccctagctattattgcatccacattggattcacttcttgatcttttatcgggtttcattctatggttcactgcgttttccatgcaaacaccaaacccgtaccagtatcctattggcaaaaaacgtatgcaacctttgggcattcttgtttttgcctctgtcatggcaactcttggattacagataatattggagtcaattcggactctcttattaggtgattctgtgttcaacttaaccaaggagcaagagcgatgggttgtgggcattatgctttcagttactctagtgaaactattcttaatggtctattgccgggctttcaccaatgagattgtcaaagcatatgctcaagatcatttctttgatgtggtcaccaatgcaatcggccttgttgctgctcttctcgctaattatatagctgcctggatcgaccctctcggggctattattctggctatatacactatacgcacatggtcgatgacagtgttggaaaacgtgaactcccttgtcggaagatcagcagcccccgagtatctacagaagctcacctacctatgttggaaccatcacaaggccatcagacacattgacacagttagagcatatacatttggatcacactattttgtcgaggttgatattgtcctgcctggagatatgccactggaagaggctcacgacataggtgaatcgctgcaagaaaagctggagctgctaccggaaattgagagggcctttgttcatcttgattacgagtacaagcataaaccagagcacgcacaagcacactcttagaacaagggaaacatggtgatttcttcaactctaaaccccgtatgttcatttatatggtagtaaaattccaataacgtcgtttttcggtcttgtaaattcgtgcctgattctgcctgaatgatgaggaatttctttggtgattgtagaagaaaattcagagcaacaaaccaaagggaatctttgagtggcttgtttaatgtcaattgaagctggcgattgtataaaaattgaaaattcttaagccacgatttcgcaaaatttt

SEQ ID NO: 7577 - DNA, 1354 bp, Cucumis sativus
accatttgcaccactactactctcttcccttccccttcttcttttcttcttcttcctcctcctctcaaattcctccattcctacattctctcacattttcacttctctccaaaatggttcagcctgttgtctccatcgagaacgatgaggagagctctctgttgctccagtccaccgccggtgacctctcttggcgtttgaacttcgatggctttcagttctctccagagcataaagagaagaagccctctcgtccacttcatgattgccttggggttttgagtcctgaagattatgtagctgagtactaccagcagcaggtagaaatgctcgagggatttaatgaaatggatgctttaactgatcgtggttatgttcctggaatgtcgaaggaagaacgtgaaaatttagcaaagagtgaaacgtttgcaatcagaatatcaaatgttgccaatatggttttgtttgcagctaaagtatatgcatccatcagaagtggttccttagctataattgcatccacactggattcacttcttgatcttttatctggtttcattctatggttcactgcattttccatgcaaacaccaaacccctaccagtatcctattggcaaaaaacgcatgcagcctttgggcattcttgtttttgcctctgttatggcaactcttggattgcagataataatggagtcaattcggactctcctattaagtgattctgtgttcaacttaaccaaggagcaagagcgatgggttgtgggcattatgatttcagttactatagtgaaactagtcttaatgatctactgccgtactttcactaacgagatagtcaaagcgtatgcccaagatcatttctttgatgtagtcaccaatgcaatcggccttgttgctgctctccttgctaattatatagctggctggatcgaccctcttggagctattattctggctttatacactatacgcacatggtcgatgacggtattggaaaacgtgaactcccttgtcggaagatcagctgcccccgagtatctacagaagctcacctacttatgttggaaccatcacaaagcgatcagacatattgacacggtacgagcatatacatttggatcacactactttgtggaggtcgatatcgtcctgcctggagacatgccactggaagaggctcacgacataggtgaattgctgcaagaaaagctggagctgttaccggaaattgagagggcctttgttcatcttgattacgagtacaagcataaaccagagcacgcacaggcgcactcttaagaagttgtaggcaaatggtgaatgatgtttcattcatttatgtggtagtaaaa

SEQ ID NO: 7578 - DNA, 1512 bp, Brassica napus
attttcctttactctctttctcgttttctcgctttaacataccaaaatagaatctctctctctctctctctctctctcgcgccataagatctattttgatccactttcattctctccctctctctattgctcgttgtgatctccttgtaaatcttgacgaaatcgaacaacacccttctggattcagggacaaaaatgggtggcgaggcagagatcaaggagcgtttacaacccaaatcctcatctgaaacaacaatgcacaacgtcaaagggaagagactctggcagaaggtgaagtatcagctggtggagtatcacgcattgcctgcttacctcagagacaacgagtacatcctccgccactaccgttccgaatggcccatcaaacagatcctcctcagcatcttcactatccacaacgagaccttgaacgtctggacgcacttgattgggtttttcctgtttctagcgcttactatatacacagctaccaaagtgcccagcgttgtggatcttcactctcttcagcaccgtttgcctgatgtcctgaggaaaacggatcttcacaaacttcactctgacctcatgtctcgccttccttctagtccttctaagtggcatgtcatggagctgctttataactgtctccctgaacgattctctcatggcaactccaccgacatgtgtgtcctgcattctgtgaaggaagatcttgcaaacatgatagctcctttaatcttcagaccaatcaccagatggcccttctacgcatttctagggggcgctatgttctgtctattagcaagcagcacctgccacctcctctcctgtcactcagagcgtgtctcttacataatgctaaggcttgactacgctggaatcgcagctctgatctccacttccttctacccacctgtctactactccttcatgtgcgatcctttcttctgtaacctctacttaggattcataacaatcttgggaatctccacggtgctcgtctcgctcttacctgtcttccagagccctgagtttcgtgttgtgagggcctctcttttctttggaatgggattctctggagctgcaccgatacttcacaagctgatcatcttttgggaccagcctgaggcgcttcacacgacgggttatgaggttttgatggggttgctttatgggttgggagctttggtttatgcgactaggattcctgagaggtggatgcctggtaagtttgatatagctggacatagtcatcagttgtttcatgttttggtggttgctggtgcgtttacacattatagagctgggcttgtgtatctcaagtggagagacattgaaggatgttgaagatttgatgatttgatgttttgaatctttctttttgtagcttcacgaaaaaaaagttggattgtgtaaagtctatgtgtaaccaaatgctttttttttttgaattgccctgatcctattctaacacatatttcggtcctctcaaagtgtgatgaattagggtgg

SEQ ID NO: 7579 - DNA, 1531 bp, Raphanus sativus
  misc_feature (15)..(15): n is a, c, g, or t
  misc_feature (18)..(18): n is a, c, g, or t
  misc_feature (76)..(76): n is a, c, g, or t
  misc_feature (205)..(205): n is a, c, g, or t
  misc_feature (685)..(685): n is a, c, g, or t
  misc_feature (791)..(791): n is a, c, g, or t
  misc_feature (819)..(819): n is a, c, g, or t
  misc_feature (1013)..(1013): n is a, c, g, or t
ggagcctcctcctcntcntcttcatccattctttctcgttttctcgcctaacgtatcaaaacaggatctctctctntctctctctcatcccttaagatctattttgatccactttcattcattctctctctctcttgctcgtggtgatctctccctctcgccaactcttgacgatagatatcgcagaaaacactattggattatnagagacaaaaatgggtggtggcgaggcagaagagatcaaggaacgtttacaaccaacaaaggagaagaagaaacaacaacacaaaaacgtgaaagggaagagactatggcagaaagtcaagtaccaactcgtggagtaccacgctttgcctgcttacctcagagacaacgagtacatcttgggccactaccgttccgaatggcccctcaaacacatcctcctcagcatcttctccatccacaacgagaccttgaatgtctggacgcacttgattggttttttcctgtttctagcacttactatatacacagctaccaaagtcccaagcgttgtggatcttcagcaccgtttacctcatctcctcaggaaaactgatcttcacaaacttcactctgacctcatgtctcgccttccttcttctccttctaagtggcatctcatggagcttctctataactgtctccctgacagattctctcntgccaactccactgacatgtgtgtcctgcattcagtgaaggaagatcttgcaaacatgatagctcctttgatcctcaggccaatcactcgatggcccttctacgcnttcctaggcggcgctatgttctgtctantagcaagcagcacctgccacctcctctcctgtcactcagagcgtgtctcttacattatgcttaggcttgactacgctggaatcgcagctctcatctccacttccttctaccctccggtctactactctttcatgtgtgatcccttcttctgcaacctctacttaggattcatcacaatcctgggaatctccacngtcctcgtctccctcctacccgtcttccagagccctgagtttcgtgtggtgagagcctctctcttctttggaatggggttctccggcgcggcaccgatcctgcataagctgatcatcttttgggaccagcccgaggcgcttcacacgacggggtatgaggttttgatgggtttgctttacgggttgggagctttggtttatgcgactaggatccctgagagatggatgcctggtaagtttgatatagctggacatagccatcagttgtttcatgttttggtggttgctggtgccttcacacattatagagctgggcttgtgtatctcaagtggagagacattgaaggatgttgaaagtatttgatggaattcttctaatgttttgaatcaaaaatgaaaaaaattgggttctgtaaagtcttatgtgtaagcaatgttattagtttttccacttatcctttgttcctaagcttaacccataactttaacacaaggtggtttactccatgctttgcacc

SEQ ID NO: 7580 - DNA, 1338 bp, Eutrema parvulum
tagagaaaatgggtagtgaggcagagatcaaggaacatttacaacccaaatctccatctgaaacaatggagaagaagcagcaaaatgtgaaagggaagagattgtggcagaaagtgaagtatcaactggtggaatatcactcgttgcctgcttatttgagagacaatgagtacatcattggtcattaccgatccgaatggccaattaaacaaatccttctcagtatctttaccatccacaacgagaccttgaatgtttggacgcacttgattggatttttcctgtttctagctctcaccatatacacagccacgagggtaccaagcgtcgtggatcttcactcgcttcaacaccgtttacccgatgtgttgaggaaaacagatcttcacaaacttcactccgagctcatgtcgcgccttccttctagtccatctagttggcatgtaatggaacttctttataactgtttgcctgaaagattctctcatggcaactacaccaacatgtgtgttctgcattcggtgaaggaagatcttgcaaacatgatagctcctttaatcttcaggccaattacccgatggccgttctatgcatttctaggcggcgcaatgttctgtctattagcaagcagcacgtgccacctcctctcgtgtcactctgagcgagtctcttacataatgcttaggcttgattacgccggaatcgcagctctaattgctacttccttctaccctcctgtatattactctttcatgtgtgatcctttcttctgcaacctttacttaggattcataacaatcttaggaatcgccactgtgcttgtctcgctcctaccggttttccagagcccggagtttcgcgttgtgagggcctctctgttttttggaatgggattctctggtgcggctccgatcctacacaagctgatcatcttctgggatcagcccgaagcgcttcacacgacaggttatgagattttgatgggtctgttatacgggttaggagctttggtttatgcaactaggattcctgagagatggatgccgggtaagttcgatatagctggacacagccatcagttgtttcatgttctggtggttgctggtgcgttcacacactataaagccgggcttgtgtatctcaagtggagagacattgaaggatgttgaagattgaagaagatgaagattaaggaagatgaagattgatgatttgatagaatcttgatgtttgaatcttgtttgtagcttcgctaaaagaagttggattgtgtaaagtctatgtgtaagcaagtgtgtttttttttttaccaacgaggagtttaaattattaattcct

SEQ ID NO: 7581 - DNA, 1551 bp, Arabidopsis lyrata
cttccatcttcgtcttctatttttccttctttcatcgatttcataattcatacaaaacaaagaactctctgttttcgacaaaaacgaaaccttgagatctattttgcttgactttttattttccaaaagaatttgagagttttttttgttctcgtcggcattgaagatccagggtttgagatctttcgaaattcagagagaaagaatgggtggtgaggacgcagagatcaaggaacatttgaaacctcaagcttcatctgaaacaatggagaagaaacataatgtgaaagggaagagattatggcagaaagtgaagtatcaattggtggagtatcattccttgcctgcttatttaagagacaatgagtatatcattggtcattaccgatccgaatggccgattaaacagatccttctcagcatctttaccattcacaatgagaccttgaatgtttggacgcacttgattggttttttcctgtttctggcacttaccatatacacagcaacgaaagtaccgagcgtcgtggatcttcattctcttcaacaccgtttacctgatttgttgagaaaaacagatctccacaaacttcacgctgagctcatgtctcggcttccttctagtccatctagttggcatgtaatggaccttctttataactgtttgcctgaaagattctctcatggcaactacaccgacatgtgtgttctgcattcggtgagggaagatcttgcaaacatgatagctcctttgatcttcaggccaattacccgatggccgttctatgcatttctaggtggtgcaatgttctgtctattagcaagcagcacgtgccacctcctctcatgccactccgagcgagtctcctacataatgcttaggcttgattatgctggaattgcagctctaatagctacttccttctaccctccggtctattactccttcatgtgtgatcctttcttctgcaacctctacttaggattcataaccatcttaggaatcgccacagtgcttgtctcactcctcccggttttccaaagcccggagtttcgggtcgtgagggcgtctctgttttttggaatgggattctctggcttagctccgattcttcacaagctgataatcttttgggaccaacctgaagcgcttcacacgacaggttatgagattttgatgggtttgctctacgggttaggagctttggtttatgcaactaggattccagagagatggatgccggggaaattcgatatagcaggacatagccatcagttgtttcatgttttggtagttgctggtgcgttcacacactatagagctgggcttgtgtatcttaagtggagagatattgaaggatgttgatgaagattgaagattagatggaatctttgatgttttaaatcttgtttgtagtagcttcatataaaagttggattatgtaaagtcttatgtgtaatcaatgttgaattgtttcctttattaaacaaaggattcatattgttaatctacatattactggttacagaagctgaaggatccatattttt

SEQ ID NO: 7582 - DNA, 1571 bp, Eutrema halophilum
gtggcttcagagcctctatcgtcgtcgatttcataccgaaacaagaggacaactctctgttgttgataaaagaacgaagctttaagatctattttgatcgacttttcatctacctcgcggtgatttaaagattttaaaagattttagagtttttttctcgtcggcattgaaatcgagggtttgagaattgagatccgaagaagaacatctgaaattcgtatcatttctttgactttcccttcgaaattcagagaagatggatggtgagtcagagatcaaggaacatttacaacccaaatctccatctgaaacaatggagaagaagcaaaatccgaaagggaagagattatggcggaaagtgaagtatcaactggtggaatatcactcattgcctgattatttgagagacaatgaatacatcatcggtcattaccgatccgaatggccaatcaaacagatccttctcagcacttttacaatccacaacgagaccttgaatgtttggacgcacttgattgggtttttcctgtttctagcactcaccatatacacagccacaaaagtaccaagcgtcgtggatcttcactctcttcaacaccgtttacccgatgtgttgaggaaaacagatcttcacaaacttcactcagagctcatgtctcgccttccttctagtccatctagttggcatgtaatggagcttctttataactgtttgcctgaacgattctctcatggcaactacaccgacatgtgtgttctgcattcagtgaaggaagatcttgcaaacatgatagctcctctaatcttcaggccaatcactcgatggccgttttatgcatttctaggcggcgcgatgttctgtctattagcaagcagcacgtgccacctcctctcatgtcactcagagagagtctcctacataatgcttaggcttgattacgccggaatcgcagctctgatcgctacttccttctaccctccggtgtattactccttcatgtgtgatcctttcttctgcaacctctacttaggattcataacgatcctaggaatcgccactgttcttgtctcgctcctccccgttttccaaagcccggagtttcgggtcgtgagggcctctctgtttttcgggatgggattctctggcgcggctccgattctgcataagctgatcatcttttgggatcagccagaagcgcttcacacgacaggttacgagattttgatgggtttgctttacgggttaggagctttgatttatgcgactaggattccagagagatggatgcctgggaaattcgatatagctggacatagccatcagttgtttcatgtcctggtggttgctggtgcgtttacacattatagagccgggcttgtgtatcttaagtggagagatattgaaggatgctcatgaagataaaggattaggtttgaatctttgatgtttctgaatctttgtttgtagcttcgtaaaaagaatttggactgtgtaaagtctatgtgtaagcaaatatttcttgttaattcggaattaatattgggtcaaataagagaatcttacaaatcaa

SEQ ID NO: 7583 - DNA, 1564 bp, Arabidopsis thaliana
gtggcttcagagcttccacttccatcgtcgtcttctattttttcttctttcttcgatttcataccaaaacaagaactctctgttttcgacaaaaacgaaaccttgagatctattttgattgacttttaagaaagagagagatctttcttagaagattttgtctcgtcggcattgaagatccagggtttgtctttcgaaattcagagagaaaatgggtgatgaggcagagatcaaggaacatttaaagccacaagcttcatctgaaacaatggacaagaaacataatgtgaaagggaagaggttatggcagaaagtcaagtatcaattggtggagtttcattcattgcctgcttatttaagagacaatgagtacatcattggtcattaccgatccgaatggccgatcaaacagattcttctcagcatctttaccattcataatgagactttgaatgtttggacgcacttgattgggtttttcctgtttttggcgctcactatatacactgcaacgaaagtaccgagtgtcgtggatcttcattcgcttcaacaccgtttacccgatttgttgaggaaaacagatctccacaaacttcattctgagctcatggctcgccttccttctagtccatctagttggcatgtgatggaccttctttataactgtttgcctgaaagattttctcatggcaactacactgacatgtgtgttctgcattctgtgagggaagatcttgcaaacttgatagctcctttgatcttcaggccaattactcgatggccgttttatgcatttctaggtggtgctatgttctgtctattagcaagcagcacgtgccacctcctctcatgtcactccgagcgagtctcctacataatgcttaggcttgattacgccggcatcgcagctctaatagcgacttccttctaccctccggtttattactccttcatgtgtgatcctttcttctgcaacctctacttaggattcataaccatcttaggaatcgccactgtgcttgtttctctcctcccggttttccaaagcccggagtttcgggtggtgagggcgtctctgttctttggaatgggattctctggcttagctccgattcttcacaagctgataatcttttgggaccaacctgaagcccttcacacgacaggttatgagattttgatgggtttgctttatgggttaggagctctggtttatgcaactaggatcccagagagatggatgccgggtaaattcgatatagcaggacatagccatcagttgtttcatgttctggttgttgctggtgcgttcacgcactatagagctgggctagtgtatcttaagtggagagatattgaaggatgttgaagatgaagattgaagattagatggaatctttgaatcttgtttgtagtagcttcatataaaagttggattatgtaaagtcttatatgtaatcaaacgtttaattgtttcctttattcaacaaaggatttatattgttaatccacatatgtattactggttaaagaagctgaaggattcatatttttagatgattcc

SEQ ID NO: 7584 - DNA, 1308 bp, Brassica oleracea
  misc_feature (537)..(537): n is a, c, g, or t
  misc_feature (1015)..(1015): n is a, c, g, or t
  misc_feature (1061)..(1061): n is a, c, g, or t
  misc_feature (1247)..(1249): n is a, c, g, or t
gctcgtggagtatcacgcattgcctgcttacctcagagacaacgagtacatcctcggccactaccgttccgaatggcccatcaaacagatcctcctcagcatcttcactatccacaacgagaccttgaacgtctggacgcacttgattgggtttttcctgtttctagcgcttactatatacacagctaccaaagtccccagcgttgtggatcttcactctcttcagcaccgtttacctgatgtcctgaggaaaacggatcttcacaaacttcactctgatttaatgtctcgccttccttctagtccttctaagtggcatgtcatggagctgctctataactgtctccctgaaagattctctcatggcaactccaccgacatgtgtgtcctgcattctgtgaaggaagatcttgcaaacatgatagctcctttaatcttcagaccaatcaccagatggcccttctacgcatttctaggcggcgctatgttctgtctattagcaagcagcacctgccacctcctctcctgtcactcagngcgtgtctcttacataatgctaaggcttgactacgctggaatcgcagctctgatctccacttccttctacccacctgtctactactccttcatgtgcgatccattcttctgcacctctacttaggattcataacgatcttgggaatctccacggtgctcgtctcgctcttacctgtgttccagagccctgagtttcgcgttgtgagggcctctcttttctttggaatgggattctctggagctgcaccgatacttcacaagctgatcatcttttgggaccagcctgaggcgcttcacacgacgggttatgaggttttgatggggttgctttacggattgggagctttggtttatgcgactaggattcctgagagatggatgcctggtaagtttgatatagctggacatagccatcagttgtttcatgttttggtggttgctggtgcgtttacgcattatagagctgggcttgtgtatntcaagtggagagacattgaaggatgttaaatttgatgattttaatnttctttttgtagcttcacgaaaaagttggattgtgtaaagtctatgtgtaagcaaatgtttttttttttaatttacccttgatcctaaccctaacacatagggccggtcatgtgtaaaacaagatgaaacattggcctcgaaccctcaatttttttgaagaaaattgcataaacttgctccaaaannnttgaaacataagcaagtttgtaataaaacaaatgcaagtttgtaataaaataaattttt

SEQ ID NO: 7585 - DNA, 1256 bp, Brassica napus
tggtgatggtagtaggagaaacatccatggagctagaccagtgttttcagatgatgatgatgaagatggaaggagtctcgatcaaagagtggaaagacatccctgttgagcttctcatgagaatcctctcccttgttgatgatcggaatgtcattgctgcttctggtgtttgctgtggttggagagatgccatctctcttggtctcactcgtctccgtctctcttggtgcaataacaacatgaacagcttggttctttctcttgctccaaagtttataaagctgcagactttaatactgcgccaagacaaacctcagctagaggacaatgcggtggaggccatagcaaatcactgccatgagctgcaagagcttgatctcagcaaaagcctgagactcactgaccgttccctctacgcacttgctcatggctgccctaacctcacaaaactcaaccttagcgcttgcacttcgttcagcgacaaagctattgcgtatctgaccacgttctgcagaaacctgaaggttctaaatctttgtggatgtgttaacgctgtttctgactataccttggaggctattgggaacaactgcaatcagatgcagtcactaaacttgggatggtgtgagaagatcagtgatgatggggttatgagtttagcttatggctgtccagatctcaggaccctggacttgtgtggttgtgttctcattacagatgagagtgtggtagctttagctgattggtgcgtccacttgagatcactggggctatactactgcagaaacataacggacagagccatgtactcgctagctcaaagcggggtgaagaacaaaccaggggggcaatggaaatcatcggccaagaagagcaaattcgacgaagaagggctgagaagtctcaacataagccaatgcactgcacttacaccttcggctgttcaagcggtttgcgatacgtttcctgctcttcacacgtgttcggggagacattcgcttgtgatgagcgggtgtttgaacttgacgtctgtgcactgtgcttgtatccttcaggctcatcgctcggttcctcactcggctcactgaaagagatggaatgggtaatgtttgtatatagatgcttaataagttgatgaagagattagatgccaaactctaaaattgcttttgagttggtttctttacgttgtcttgaaggatctttttgtaagaactctttgttactacttattacccttgcttattactgaaggt

SEQ ID NO: 7586 - DNA, 1325 bp, Eutrema halophilum
ctctcatcattggtggtgataggaccaagaaaccgcttcattagtcattaatctaaacatggtgatggtaggaggagcatccatggaactggaccagtgctttcagaagatgaagatggaaggaatctcgatcaaagagtggaaagacatccctgtggagcttctgatgaggatcctttcccttgtcgatgatcggaatgtcattgttgcttctggtgtttgcagtggttggagagatgccatatctcttggcctcactcgtctacgtctctcttggtgcaaaaacaacatgaacagtttggttctttctcttgctccgaagtttgtaaagctgcaggctttaatactacggcaggacaaaccgcaactagaggacaatgcagtggaggcaatagcaaatcactgccatgagctacaagagcttgatctcagcaaaagcttgaaacttactgatcgttccctttacgcacttgctcatggctgccctaacctcactaaactcaaccttagcggatgcacttcattcagcgacactgctattgcttatttgatcagattctgtagaaagctcaaagttctgaatctttgtggatgtgtccaagctgtatctgaccatgccttggaggctattgggaataactgtaaccagttgcagtcacttaacttgggatggtgtgagaatatcagtgatgatggggttatgagtttagcttatggctgcccagatctcaggaccctggacttgtgtggatgtgttctcatcacagatgagagcgtagtggctttagcagattggtgtgtgcacttgagatcactggggctatattactgcagaaacataacagacagagcgatgtactcactagcacaaagcggagtaaagaacaaaccgggacaatggaaatcggttaagaaggagaaatacgacgaagaagggcttagaagtctcaacatcagccaatgcactgcccttacaccttcagcggttcaagcggtttgcgacacctttcccgctcttcacacatgttcgggaaggcattcgcttgtcatgagcggttgtcttaacttgacatctgtgcactgtgcttgtattcttcaggctcatcgcgcacacagtgtgtttcctcatccggctcattgaaacagaggaattgatgtgttgtagtatatagaagcatcatgttgatgagactagatgacggacgatcgggtattattactagtagctttctaagatgtatgtatatgtgaaaacttcaaaagctcttgagttgttctttctttgtcttgaaagatctttgtatatgttggtgctatgttcatga

SEQ ID NO: 7587 - DNA, 1275 bp, Eutrema parvulum
ctctcatcctttgtggtgataggatcaagaaaccgcttcattagtcaataacttaaaagatggtgatggtaggagaagcgtccatggaactggaccagtgctttcagatgatgaagatggaaggaatctcgatcaaagagtggaaagatatccctgtggagcttctgatgagaatcctttcccttgtcgatgatcggaatgtcattgttgcttctggtgtttgcagtggctggagagatgccatatctcttggcctcactcgtctccgtctctcttggtgcaacaacagcatgaacagcttggttctttctcttgctcccaagtttgtaaagctacagactttgatactgcgtcaggacagaccgcaactagaggaaaatgcagtggaggccatagcaaatcactgccgtgagctacaagagcttgatctcagtaaaagcttgaaacttactgatcgttcgctctatgcacttgctcacggttgccctaacctcacaaaactcaaccttagcggatgcacttcattcagcgacactgctattgcttatatgaccagattctgtagaaagctcaaaggtctgaacctttgcggatgtgtccaagctgtatctgaccatgccttggaggctattgggaataactgtaaccagttgcagtcacttaatttgggatggtgtgagaagattagtgatgatggagttatgaatttagcttatggctgtccagatctcaggaccctggacttgtgtggatgtgttctcatcactgatgagagtgtggtagctttagcagattggtgtgtccacttgaggtcattggggctatactactgcagaaacataacagacagagcgatgtactcgctagctcaaagcggtgtaaagaacaaaccagggttatggaaatcagctaagaagagcaagtacgacgaagaaggcctgagaagtctcaacatcagccaatgcactgcccttacaccttcagcggttcaagcagtctgcgatagttttcctgctcttcacacgtgttcgggaaggcattcgcttgtcatgagcggttgtttgaacttaacgtctgtgcactgtgcttgtatctttcgggctcatcgcgcacacagttcggttcctcacccggctcattaagacagaggaatatatatgtatgttgtatatagaagcatcatgttgaatgagattagatgtcaacttaaaagcttgagttgttctttacatgtcctgaaagatcttttatatatgttggtgttatgttcatgag

SEQ ID NO: 7588 - DNA, 1372 bp, Arabidopsis lyrata
agtcgaaggaaacaacaaagaacccagaaagagggacgaagaaactaattcaaagcgatcaagaacaccgcttcattttactcattaaacaaagatggtgatgggaggagaagcatccatggagctggaccagtgttttcagaagatgaagatggaaggaatctcgatcaaagagtggagagacatccctgtggagcttctgatgaggatcctttcccttgttgatgatcgtaatgtcattgttgcttctggtgtttgctgtggctggagagatgctttctcttttggcctcactcgtctccgtctctcttggtgtaacaacaacatgaacagcttggttctttctcttgctcccaagtttgtaaagctgcagactttaatactgaggcaggacaaaccgcaactagaggacaatgcagtggaggccatagcaaatcactgccatgagttacaagaacttgatctcagcaaaagcttgaaaattacagatcgttcactttatgcacttgctcatggttgccctgacctcacaaaactcaaccttagtggctgcacttcattcagtgacactgctattgcgtatttgaccagattatgcagaaagcttaaagttttgaatctttgcggatgtgtcaaagctgtaactgacaatgccttggaggcaattgggaataactgcaatcagatgcagtcactaaacttgggctggtgtgagaatatcagtgatgatggggtaatgaatttagcttatggctgtccagatctcaggacccttgacctctgtggctgtgttctaattacagatgagagtgtggtagctctagcagactggtgtgtccacttgaggtcactggggttatactattgcagaaacataacagacagggcgatgtactcgttagctcaaagcggggtaaagaacaaaccgggttcatggaaatcagtaaagaaaggcaaatacgatgaagaaggactgagaagtctcaacattagccaatgcactgccctcacaccttcagcggttcaagctgtttgtgattcctttcccgcgcttcacacatgttcaggaaggcattcgcttgtcatgagcggttgtctgaacttaacaactgtgcactgtgcttgtatccttcaggctcatcgtgcgcacaatgcggttcctcatccggctcattgaaacagaggaatatatatgttgtatatataagcatcatgttgatggagattagtattataaacgaagtagcttttttaaggtgtatgtgaaaccttagaagcttttgagttgttctttctttgccttgaaagatcttttgtatattttggtgctatgttcatgactttttttttgtaagacctctctttgttacca

SEQ ID NO: 7589 - DNA, 1408 bp, Arabidopsis thaliana
tcaaatgaacaaatatatcaaataataatagtgtaattaagtcggaggaaaacaacaagaacccagaaagaggaacgaagaaactaattcaaaggatcaagttcaccgcttcattttagtcattaaacaaagatggtgatgggaggagaagcatccatggaactggaccagtgttttcagaagatgaagatggaaggaatctcgatcaaagagtggaaagatatccctgtggagcttctgatgaggatcctttcccttgttgatgatcgtaatgtcattgttgcttctggtgtttgcactggctggagagatgctatctcttttggcctcactcgtctccgtctatcttggtgcaacaacaacatgaacagcttggttctttctcttgttcccaagtttgtaaagctgcagactttaaatctaaggcaggacaaaccgcaactagaggacaatgcagtggaggccatagcaaatcactgccatgagttacaagaacttgatctcagcaaaagcttgaaaattacagaccgttcactttatgcacttgctcatggttgcccagacctcacaaaactcaaccttagtggctgcacttcattcagcgacactgctattgcgtatttgaccagattctgcagaaagcttaaagttttgaatctttgcggatgtgtcaaagctgtaactgacaatgccttggaggctattgggaataactgcaatcagatgcagtcactaaacttgggatggtgtgagaatatcagtgatgatggggtaatgagtttagcttatggctgtccagatctcaggacccttgacctctgcggctgtgttcttattacagatgagagtgtggtagctctagcagactggtgtgtccacttgaggtcactggggctatactattgcagaaacataacagacagagcaatgtactcgctagctcaaagcggggtaaagaacaaaccgggatcgtggaaatcggttaagaaaggtaaatacgatgaagaaggactgagaagtctcaacattagccaatgcactgcccttacaccttcagcggttcaagctgtttgcgattcatttcccgcacttcacacatgctcaggaaggcattcgcttgtcatgagcggctgtctgaacttaacaactgtgcactgtgcttgtatccttcaggctcatcgtgcacacaatgcggttcctcatcctgctcattaagacagaggaatagttatgttgtatatataaacatcatgttgatggagattagtattataaacgaagtagcttttttaaggtttatgtgaaaccttagaagcttttgagttgttctttctttgtcttgaaagatcttttgtatattttggtgctatgttcataacttctttagtaagacctctcgttgttacca

SEQ ID NO: 7590 - DNA, 1070 bp, Brassica rapa
  misc_feature (858)..(858): n is a, c, g, or t
  misc_feature (863)..(863): n is a, c, g, or t
  misc_feature (900)..(900): n is a, c, g, or t
attttaattaaaattcaaaaaacccagaaacagagacgaagaaactaattcaaaggatcaagaaaccgcttcacttttaaaaagagatggtgatggtagtaggagaaacatccatggagctagaccagtgttttcagatgatgatgatgaagatggaaggagtctcgatcaaagagtggaaagacatccctgttgagcttctcatgagaatcctctcccttgttgatgatcggaatgtcattgctgcttctggtgtttgctgtggttggagagatgccatctctcttggtctcactcgtctccgtctctcttggtgcaacaacaacatgaacagcttggttctttctcttgctcccaagtttgtaaagctgcaaactttaatactgcgccaagacaaaccccaactagaggacaatgcggtggaggccatagcaaatcactgccatgagctacaagagcttgatctcagcaaaagcttgaaactcactgaccgttccctctacgcacttgctcatggttgccccaacctcacaaaactcaaccttagcggctgcacttcgttcagcgacaaagctattgcgtatctgaccaggtcctgcagaaacctgaaagttctgaatctttgtggatgtgtcaacgctgtttctgactataccttggaggctattgggaacaactgcaaccagatgcagtcactaaacttgggatggtgtgagaagatcagtgatgatggggttatgagtttagcttatggctgtcctgatctcaggaccctggacttgtgtggttgtgttctcattacagatgagagtgtggtagctttagctgattggtgcgtccacttgagatcactggggntatantactgcagaaacataacggacagagccatgtactcgntagctcaaagcggggtgaagaacaaaccaggggggcaatggaaatcatcagctaagaagagcaaattcgacgaagaaggcctgaggagtctcaacataagccagtgcactgcacttacaccttcggctgttcaagcggtctgcgatacgtttcctgctcttcacacgtgt

SEQ ID NO: 7591 - DNA, 1423 bp, Brassica napus
ggtccaaagtttcaatctttagtttcatttttattattttcctacagttttggtcttttgaggctctgttattttctctaatctctgtttattttttgtgatggtaaagaaccaaggaaccgctttcaaaaagtattaaaagatggtgagtgaagaagggtcagcaacacttgaccgatgctttgaaaagatgaagatggaaggcatcgtgatcagcgagtggaaagatatccctgtggagcttctcatgaagatccttaaccttgttgatgatcggacggtcatcattgcttctggtgtttgcagtggctggagagatgctatttcctttggtctcactcgtctctccctctcttggtgcaagaagaacctgaatagtttggttctgtctcttgctccaaaactcgtcaagcttcagacattagtattgagacaggacaacccccagcttgaggacaacgcagtggaagcaatagcgaatcactgtcacgagctacaagatcttgacctaagcaaaagcttgaaactcaccgaccattctctctattctctggctcgcggttgcacaaacctcactaaactcaaccttagcggctgcacttcattcagcgacactgctttggcctatttgacaaggttttgcaggaaactcaaagttctgaatctttgtggttgtgtggaagctgtatctgacaatgcattgcaggctattggagaaaactgcaatgagatgcagtcactaaacttgggatggtgtgagaatataagtgatgatggagtcatgagcctagcttatggctgtcctgatctaagaacccttgatctttgcggctgtgttctaattacagatgagagtgttgttgctttggcaaataagtgtgtacacttgaggtcgttggggttatactattgcaggaacataacagacagagcaatgtactcactggctcagagtggagtgaagaacaagcacgagatgtggcggtcggttaagaaaggaaaattcgatgaagaaggtctaagaagcctcaacattagccaatgcacttacctcacaccttcagcggttcaagctgtctgtgatacattccctgcgctccacacttgctcaggcaggcattctctggtcatgagtggttgtctgaatctaacatcagttcactgtgcctgtatcctccaggctcaccgcacccacaccgctctccctcacccggctcattaagccaccagtgtgtaagccagaggggtctctcttccttggtatgtgtacatataagcctaaggttaagaaataaaagcttatttgtttgagtttatcttcccatctcaagattttacattacaggcaacctttaaaatgattacaaggttctttactttgtttaacaatattttgtataagtttgtgtaagttcgatccatc

SEQ ID NO: 7592 - DNA, 1506 bp, Eutrema parvulum
cactaatcgtttcttttgttaactttttgtcaaaaagagtcacgcagagacattagtgtttactgcgttttggtttcaatttatttttgtcctacatttgtcgtctttcagagatatctatcatttctctctctctatttctccaagctcaattttctttttgtggtgttagaatcaagaaaccgcttaagagtattaaaagatggtgagtgaaggaggatcagcatcacttagccgatgcttcgagaagatgaaggagatgaagatggaaggaatcgtaatcactgagtggaaagatatccctgtggagcttctgatgagaatccttaaccttgtagacgatcggacggtgatcattgcttctggtgtttgcagtggctggagagatgctatttcctttggtctcactcctctctctctctcttggtgtaaaaagaatatgaatagtttggttctgtctcttgctccaaaattcgtcaagcttcagactttagtactgagacaggacaaaccgcaacttgaggacaacgcagttgaagccatagcaaatcactgtcacgagctacaagatcttgacctaagcaaaagcttgaaactcactgaccattccctctattctctggctcatggttgcactaacctcactaaactcaatcttagcggctgcacttcattcagcgacactgctctggcgtatttgacaagattttgccggaagctcaaaattctgaatctttgtggttgtgtgaaagcagtatcggacaatacattgcaggctattggagataactgcagtcaaatgcaatcactaaacttgggatggtgtgagaatataagtgatgatggagtcatgagtttagcttatggctgtcctgatttgagaagccttgatctctgtggctgtgtactaattacagatgagagtgtggtggctttggcgaatcggtgtgtacacttgaggtcattggggttatactattgcaggaacattaccgacagagcaatgtattcgctggctcagagcggagtgaagaacaagcatgagatgtggcgctcggttaagaaaggcaaattcgatgaagaaggactaagaagcctcaacattagccaatgcacttacctaacaccttcagcggttcaagcagtctgcgatacattccctgcgctccacacttgttcaggcaggcattcgcttgtcatgagcggttgtctgaatttaacatcggttcactgtgcctgcatcctccaggcgcaccggacccacacccacaccgcttaccctcacccggctcactgaaccagtgtaagccagagggtgatgtgtacatatataagcttaaggttaaataaataaaagcttgtttgttttagtttttcgtcccgtctttgatcatgcaatctcaagattttatattatagcaaccttgaaatgattacagagtactttacttttaacaatcatcatcataaaataatgaataagaggctgcatcaaattgcaatgtg

SEQ ID NO: 7593 - DNA, 1423 bp, Brassica napus
ggaacaaaaacgaagtgaagaaaaaaaagactatggtcctacgttagtcaaaaagagttgggaagagacataaatgtttactgctttttagtttcagttttatttaattatcttacgtttgtcgttttccaagagatattagtaaatgtcatttctctctctgttttactcctaatctctcagtttcttttgtggtggtagaatcaagaaaccgcttaaccgagatgatgagtgaaggaggatcacttaacctatgcttcgagaagatggaaggaaacatgatcaccgagtggaaagatatccctgtggagcttctcatgaggatccttaaccttgttgatgatcggacggtcatcattgcttctggtgtttgctctggctggagagatgctatctcctttggtctcactcgtctctccctctcatggtgcaagaaagacatgaacagtttggttctgtctctcgcaccaaaactcgtcaagcttcagactctagtacttagacaagacaaaccgcaactcgaagacaacgcagtggaagcaatagcgaatcactgtcacgagttacaagctcttgacctaagcaaaagcttgaaactcactgaccactccctctattctctagctcgcggctgcactaacctcactaaactcaaccttagcggctgcacttcgttcagcgacactgctctcgcgtatttgacaaggttttgtaggaagcttaaagttctgaatctttgtggttgtgtggaagctgtatctgacagtgcattgcaggctattggagagaactgtagtcaaatgcagtcactaaacttgggatggtgtgagaagataagtgatgatggtgtcatgagtttagcttatggttgtcctgatcttagaagccttgatctctgtggctgtgtacttattacagatgagagtgtggtggctttggctaatcgttgtgtacacttaaggtcattggggctatactattgcagaaacataaccgacagggccatgtactcgctggctcagagcggagtgaagaacaaacacgagatgtggagatcggttaagaaaggcaaattcgacgaagaaggactaagaaaccttaacattagccaatgcacttacctcacaccttcagctgttcaagcggtttgtgatacgttccctgcgctccacacttgttcaggcaggcattcacttgtcatgagcggttgtctgaacttaacatcggttcactgtgcttgcatccttcaggctcaccgcacacgcacagctttacctcacccggctcattgaactagtgtgaagactaaaggggtctctctcccttggtatgtgtacatacaagcctagaggttaaataaataaatgcttgtttgtttgagtttgcctttgatcatgtaagcaaccttgaaatgatttcaagt

SEQ ID NO: 7594 - DNA, 1303 bp, Brassica napus
aatcaagaaaccgcttaaccgagatgatgagtgaaggaggatcacttaacctatgcttcgagaagatggaaggaaacatgatcaccgagtggaaagatatccctgtggagcttctcatgaggatccttaaccttgttgatgatcggacggtcatcattgcttctggtgtttgctctggctggagagatgctatctcctttggtctcacacatctctctctctcatggtgcaagaaagacatgaacagtttggttctgtctctcgctccaaaactcgtcaagcttcagactctagtactaagacaagacaaaccgcaactcgaagacaacgcagtggaagcaatagcgaatcactgtcacgagttacaagctcttgacctaagcaaaagcttgaaactcactgaccactccctctattctctagctcgcggctgcactaacctcactaaactcaaccttagcggctgcacttcgttcagcgacactgctctcgcgtatttgacaaggttttgtaggaagcttaaagttctgaatctttgtggttgtgtggaagctgtatctgacagtgcattgcaggctattggagagaactgtagtcaaatgcagtcactaaacttgggatggtgtgagaagataagtgatgatggtgtcatgagtttagcttatggttgtcctgatcttagaagccttgatctctgtggctgtgtacttattacagatgagagtgtggtggctttggctaatcgttgtgtacacttaaggtcattggggctatactattgcagaaacataaccgacagggccatgtactcgctggctcagagcggagtgaagaacaaacacgagatgtggagatcggttaagaaaggaaaattcgacgaagaaggactaagaaaccttaacattagccaatgcacttacctcacaccttcagcggttcaagcggtctgcgatacgttccctgcgctccacacttgttcaggcaggcattcacttgtcatgagcggttgtctgaatttaacatcggttcactgtgcttgcatccttcaggctcaccgcacacacacagctttacctcacccggctcattgaactagtgtgaagactaaaggggtctctctcccttggtatgtgtacatacaagcctagaggttaaataaataaatgcttgtttgtttgagtttgcctttgatcatgtaagcaaccttgaaatgatttcaagttaatttacttcgaagttttaacaagttcacaatcataaagtaacgacatgtagcgccaactaaatctgaagttaggaacct

SEQ ID NO: 7595 - DNA, 1417 bp, Arabidopsis thaliana
aatccttatttccttacatttgtcgtcttttgatgtcatagactcagagatatttatttatcttctttctctctcatttctcattctcatatttacttttgatctcgtggtgttagaatcaaagaaaccgcttcaaggatggtgagtgaaggagcaacaagaaaagaacttaacctctgtttcgagaatatgaagatggaaggagttttgatctctgagtggaaagatatccctgtggagcttctcatgaagattttaaaccttgttgatgatcggactgtgatcattgcttcttgtatttgtagtggctggagagatgctgtttcccttggcctcactcgcctctccctctcttggtgcaagaagaatatgaacagtttggttctatctcttgctcccaaattcgtaaagcttcagactttagtactgcgacaggacaaaccgcagcttgaggacaacgcggtggaagccatagcaaatcactgtcatgagctacaagatttggacttaagcaaaagctcgaaaatcactgaccattccctatattcacttgctcgtggttgtactaacctgactaaactcaaccttagcggctgcacttcgttcagcgacactgctcttgcgcatttgacaagattttgcaggaagctcaaaattctgaatctttgtggttgtgttgaagctgtatctgacaatacattgcaggctattggagaaaactgcaatcagttgcagtcactaaacttgggatggtgtgagaatataagtgatgatggagttatgagtttagcttatggttgtcctgatttaagaactcttgatctttgtagctgtgttctaatcacagatgagagtgttgtggctttggcgaatcggtgcattcacttgaggtcattggggttatactactgcagaaacattacagacagagcaatgtactctttagctcagagcggagtcaagaacaaacacgagatgtggcgagcggtaaagaaaggaaaattcgatgaagaaggactaagaagccttaacattagtcaatgcacttacctaacaccttcagctgttcaagctgtctgtgatacattccctgctctccacacttgttcaggcagacattcacttgtcatgagcggttgtttgaatctacaatctgttcattgtgcttgtatccttcaagctcaccgcactcacaccgtttaccctcacccggcgcattgaaacggtgtgtgagccagagggtctactactctctagtatgtgtgtacatacatataaccatatggtgttaataaagcttctttgagttccttctttgtctttgatgcaatcttaagattttaacattacctagtcttgaaaatcttgtaatgaatcgcgaaatacttatttcttctaacaatttgtttaagttgca

SEQ ID NO: 7596 - DNA, 1421 bp, Arabidopsis lyrata
aatccttatttccctacatttgtcgtcttttgatgtcctaaactcagagatatttatctatcccctctctctctctctctctctcattctcttatttacttttgatcttgtggtgttagaatcaaagagaccgcttaaagatggtgagtgaaggagcaacaagaaaggaacttaacctatgcttcgagaagatgaagatggaaggaatcgtgatctctgagtggaaagatatccctgtggagcttcttatgaggatcctaaaccttgttgatgatcggacggtgatcattgcttcttgtatttgtagtggttggagagatgctatttcccttggcctcactcgtctctccctctcttggtgcaagaagaatatgaacagtttggttctttctcttgctcccaaattcgttaagcttcagactttagtactgcgacaagacaaaccgcagcttgaggacagcgcggtggaagccatagcaaatcactgtcatgagctacaagatttggacttaagcaaaagcttgaaacttactgaccattccctatattctctggctcgtggttgtactaacctcactaaactcaaccttagtgcctgcacttcgttcagcgacactgctctcgcgcatttgacaagattttgcaggaagctcaaaattctgaatctttgtggttgtgttgaagctgtatctgacaatacattgcaggctattggagaaaactgcaatcagttgcagtcactaaacttaggatggtgtgagaatataagtgatgatggagttatgagtttagcttatggttgtcctgatttaagaacccttgatctttgtggttgtgttctaattacagatgagagtgttgtggctttggcgaatcggtgtatacacttgaggtcattgggattatactactgcagaaacattaccgacagagcgatgtactctttagctcagagcggagtaaagaacaaacacgagatgtggcgaacggtaaagaaaggcaaattcgatgaagaaggactaagaagccttaacattagccaatgcacttacctaacaccttcagcggttcaagcggtctgcgatacattccctgcactccacacttgctcaggcaggcattctcttgtcatgagcggttgtcttaatctacaatctgttcattgtgcttgtatccttcaggctcaccgggctcaccgcacccacaccgctttccctcacccggctcattgaaccggtgtgtgtgagccagagtgtcttctctttggtatgtgtgtacatacatataagcatatggtctaaataaagcttctttaagtttcttctttgtctttgatacaatctcaagatttttaacattatctattatggaaaatcttgtagatttgcgaaataattatttctagcaatttgttttaagtt

SEQ ID NO: 7597 - DNA, 1496 bp, Eutrema halophilum
tcataattatctcctacatttgtcgtctttcgaggttctaattcagagatatttattatcatctctctctctctctctctctgttctaattcctgtatttcctttgaggtggtagaatcaagaaaccgcttaaaagtattaaaagatggtgatgagtgaaggaggagcaggaacaagggaacttagccgatgcttcgagaagatgaaggagatgaaaatggaaggaatcatgatcactgagtggaaagacataccactggagcttctgatgaggatccttaaccttgtagatgatcggacggtgatcattgcttctggtgtttgcagtggctggagagatgctatttcctttggcctcactcgtctctctctctcttggtgcaagaagaatatgaacggtttggttctgtctcttgctcccaaattcgtcaagcttcagactttagttctgcgacaggacaaaccgcaacttgaggacaacgcagtggaagctatagcaaaccactgccccgagctacaagatcttgacctaagcaaaagcttgaaacttactgactgttccctctattctctggctcgcggttgcactaacctcactaaactcaaccttagcggctgcacttcattcagcgacactgcactcgcgtatttgacaagattttgcaggaagctcaaaattctgaatctttgtggttgtgtggaagctgtatctgacaatgcgttgcaggcaattggagaaaactgcaatcaaatgcagtcactaaacttgggatggtgtgagaatataagtgatgatggagtcatgaatttagcctatggctgtcctgatctacgaagccttgatctctgtggctgtgttctaattacagatgagagtgtggtggctttggcgaataggtgtgtacatttgaggtcattgggtttatactattgcagaaacattacggacagggcaatgtactcgctggctcagagcggagtgaagaacaagcacgagatgtggcgctcggttaagaaaggcaaattcgatgaacaaggactaagaagccttaacattagccaatgcacttacctcacaccttctgctgttcaagccgtctgcgatacattccctgcgctccacacttgttcaggcaggcattccctcgtcatgagcggttgtctgaatctaacatcagttcactgtgcctgcatcctccaggctcaccgtgctcacacccacactgcttttcctcacccggctcattgaatcagtgtgagccagagggtctctccctgcaggtgtgtgtacagataagcttttaaggtgaaataaagcttgtttgtttgagttttgtcttcctgtctttgatcatgcaatctttacattatagcaaaccttgaaatgattacaaagtgtagttacttttaacaattcgttaagttggatccatcaatcatcatcataaaatgatgaacaactcagaaaataagaagatgctaattctcatgtgaga

SEQ ID NO: 7598 - DNA, 1703 bp, Brassica rapa
cctcactactcgagattccagctctcgcttcttcttctgcctgcatcgttagggtttccaacaaaatcgaaaatccttactctatctaatagatggagggaagacggattacagctagccctaggccttgcagcggcggaagaagagtcgtcgcgaagaagagacctcgtcccgatgggttcgtcaacagcgtcaaaaagctccaacgaagagaaatctcgtctcgcaaagatcgagctttctccatcagcactgcccaggagagattccgcaacatgcgtctcgtggagcaatacgatactcatgatcccaagggacattgtttagttgcgttaccgtttttgatgaagagaactaaagttatcgagatagttgctgcgagggacattgtctttgcgcttgctcactctggtgtctgtgcagctttcagtagagagacgaataggaggatatgctttttgaatgtaagtccagatgaagtcattaggagcttgttctacaacaagaacaatgattccctcatcactgtttctgtttatgcttctgacaatttcagctctttgaaatgcagatccactagaattgagtatattctgagaggtcagccagatgcagggtttgccctttttgagtctgaatcgttaaagtggcctggttttgtagagtttgatgacgttaatggaaaggtgcttacgtattctgcacaggacagtgtgtacaaggtttttgatctgaaaaactataccatgctgtattcgatatcagataaacatgtccaagaaattaaaataagtccagggataatgttattgatcttcaagagagctacaagtcacgttcctttgaagattctgtcgatagaagacggcacagttctcaagtccttcaatcatttacttcaccgaaacaagaaagttgatttcattgaacagtttaacgagaaacttcttgtgaaacaagagaatgagaatctccaaattcttgacgttagaaacgctcaactaatggaagttagcagagccgagttcatgacaccttctgcgttcatatttctgtatgagaatcagctgtttctaacgttcaggaaccgaaacgtatctgtgtggaactttcgcggagagctcgtgacttcctttgaggatcatctcctatggcatccggactgtaacacaaacaacatctacataacaagtgatcaagatctgatcatctcgtattgcaaagcagataccgaagatcagtggatagaaggaaatgcgggatcgatcaatatcagcaacatattgactgggaaatgcttagctaagataacgtcaagcagtggacctccaaaagaagatgagagcagtagcagtagcagcagttctttggggaacaactcaaagctgagaagaaacgctgtggctgaagctttggaagacataacggctctgttctatgacgaagaacgcaatgagatatacacaggaaacagacacggctttgttcatgtgtggtccaattgatttcacatcatcatcatcatcatcatgttagctacttctactacttgtactgtgttatttggtttacttcaattgtgtgtgtagcgatcaatctgttttaacttagtgtttttcgagcagctatttgtgttgttgtgaactacgtttgggcatgtgtttgtgattcagaatgccaattatgtacactagtttcattgg

SEQ ID NO: 7599 - DNA, 1670 bp, Brassica napus
aatcaaaaccccttttcagatggaaggaagaaggatcacagctagccctagaccttgcagtggaagaagagtcgtggcgaaaaagaggactcgccccgatgggttcgtgaacagcgttaagaagctccagcgaagagaaatctcgtctcggaaagatcgagctttctcaatcagcactgctcaggagagattccgtaacatgcgtctagtggagcaatatgatactcatgaccccaaggggcatagtttagtagcgttaccgtttttgatgaagaggactaaagttattgagattgttgctgcgagggatattgtctttgcgcttgctcattctggtgtctgcgctgctttcagtagagagacgaacaggaggatatgttttttaaatgtgagtccagatgaagttataaggagcttgttttacaacaagaacaatgattccctcatcactgtctctgtttatgcttctgacaatttcagctctttgaaatgcagatccactaggattgagtatattctgagaggtcagccagatgcagggtttgctctttttgagtctgagtcattgaaatggcctggctttgtagagtttgatgatgtcaatggaaaggtgcttacctattctgcgcaggacagtgtgtacaaggtttttgatctgaaaaactataccatgctgtattccatatcagacaaacatgttcaagaaattaaaatcagtccagggataatgttattgatcttcaagagagctacaagtcacgtccctttgaagattctatcgatagaagatggcacagttctcaagtcctttaatcatttgcttcaccggaacaagaaagttgatttcattgaacaattcaatgagaaacttcttgtgaagcaagagaatgagaatctccaaattcttgacgttagaaacgctcaactaatggaagttagtagagccgagttcatgacaccctctgcgttcatttttctctatgagaaccagctgtttctaacgttcaggaaccggaacgtatctgtgtggaactttcgaggagagctcgtgacttcctttgaggatcatctcctatggcatccggactgtaacacaaacaatatctacataacaagtgatcaagatctgatcatctcatattgcaaagcagataccgaagatcagtggatagaaggaaatgcgggatcgatcaatattagcaacatattgactgggaaatgcttagctaagataacgtcaagcagtggacctccaaaagaagatgagagcagcagcagtagtagttccttggggaacaactcgaagcagagaagaaacgctgtggctgaagctttggaagacattacggctctgttctatgacgaagagcgcaatgagatatacacaggaaacagacacggctttgttcatgtgtggtccaattgatttcacatcatcatcatcatcatcatcatcatgttagctacttctactacttgtactgtgttatttggtttacttcaattgtgtgtgtagcgatcaatttgttttaacttagtgtctttcgagcagctatttgtgttgttgtgaactacgtttgggcatgtgtttgtgattcagaatgccaattatgtacactagtgtcattgtacgtaacatttgggtttgacaaaatgtattacagaccctt

SEQ ID NO: 7600 - DNA, 1887 bp, Brassica napus
agattggttcgtgctcgaaatcgagattttgaaagagaaaagagtttcttcgagacattgaatcaaaacccaatcccccaaatctgaatctacaaaaagctctgtacctcactttggtatgtagcatcatcccctcactttctcatctcctcacttagggtttcctctaaactcagccgcctctcttacctcatcctttagggttttcccccaaaaaatcaaaaaacctttttcagatggaaggaagaaggatcacagctagccctagaccttgcagtggaagaagagtcgtggcgaaaaagaggactcgccccgatgggttcgtgaacagcgttaagaagctccagcgaagagaaatctcgtctcggaaagatcgagctttctcaatcagcactgctcaggagagattccgtaacatgcgtctagtggagcaatatgatactcatgaccccaaggggcatagtttagtagcgttaccgtttttgatgaagaggactaaagttattgagattgttgctgcgagggatattgtctttgcgcttgctcattctggtgtctgcgctgctttcagtagagagacgaacaggaggatatgttttttaaatgtgagtccagatgaagttataaggagcttgttttacaacaagaacaatgattccctcatcactgtctctgtttatgcttctgacaatttcagctctttgaaatgcagatccactaggattgagtatattctgagaggtcagccagatgcagggtttgctctttttgagtctgagtcattgaaatggcctggctttgtagagtttgatgatgtcaatggaaaggtgcttacctattctgcgcaggacagtgtgtacaaggtttttgatctgaaaaactataccatgctgtattccatatcagacaaacatgttcaagaaattaaaatcagtccagggataatgttattgatcttcaagagagctacaagtcacgtccctttgaagattctatcgatagaagatggcacagttctcaagtcctttaatcatttgcttcaccggaacaagaaagttgatttcattgaacaattcaatgagaaacttcttgtgaagcaagagaatgagaatctccaaattcttgacgttagaaacgctcaactaatggaagttagtagagccgagttcatgacaccctctgcgttcatttttctctatgagaaccagctgtttctaacgttcaggaaccggaacgtatctgtgtggaactttcgaggagagctcgtgacttcctttgaggatcatctcctatggcatccggactgtaacacaaacaatatctacataacaagtgatcaagatctgatcatctcatattgcaaagcagataccgaagatcagtggatagaaggaaatgcgggatcgatcaatattagcaacatattgactgggaaatgcttagctaagataacgtcaagcagtggacctccaaaagaagatgagagcagcagcagtagtagttccttggggaacaactcgaagcagagaagaaacgctgtggctgaagctttggaagacattacggctctgttctatgacgaagagcgcaatgagatatacacaggaaacagacacggctttgttcatgtgtggtccaattgatttcacatcatcatcatcatcatcatcatcatgttagctacttctactacttgtactgtgttatttggtttacttcaattgtgtgtgtagcgatcaatttgttttaacttagtgtctttcgagcagctatttgtgttgttgtgaactacgtttgggcatgtgtttgtgattcagaatgccaattatgtacactagtgtcattgtacgtaacatttgggtttgacaaaatgtattacagaccctt

SEQ ID NO: 7601 - DNA, 1812 bp, Brassica napus
tcgaaatttgggattttgaaggaaagaggtttgagttaattccaaatctgaatctgtaaaaaactctttacctttcactggggtatgtagtagaagccctcactactcgagattccagctctcgcttcttcttctgcctgcatcgttagggtttccaacaaaatcgaaaatccttactctatctaatagatggagggcagacggattacagctagccctaggccttgcagcggcggaagaagagtcgtcgcgaagaagagacctcgtcccgatggcttcgtcaacagtgtcaaaaagctccaacgaagagaaatctcgtctcgcaaagatcgagctttctccatcagcactgcccaggagagattccgcaacatgcgtctcgtggagcaatacgatactcatgatcccaagggacattgtttagttgcgttaccgtttttgatgaagagaactaaagttattgagatagttgctgcgagggacattgtctttgcgcttgctcactctggtgtctgtgcagctttcagtagagagacgaataggaggatatgctttttgaatgtaagtccagatgaagtcattaggagcttgttctacaacaagaacaatgattccctcatcactgtttctgtttatgcttctgacaatttcagctctttgaaatgcagatccactagaattgagtatattctgagaggtcagccagatgcagggtttgccctttttgagtctgaatcgttaaagtggcctggttttgtagagtttgatgacgttaatggaaaggtgcttacgtattctgcacaggacagtgtgtacaaggtttttgatctgaaaaactataccatgctgtattcgatatcagataaacatgtccaagaaattaaaataagtccagggataatgttattgatcttcaagagagctacaagtcacgttcctttgaagattctttctatagaagacggcacagttctcaagtccttcaatcatttgcttcaccggaacaagaaagttgatttcattgaacaattcaacgagaaacttctcgttaagcaagagaatgagaatctccaaatactcgacgtcagaaccgctgaacaaatggaagttagcagagcagagttcatgacaccgtctgcgttcatatttctttacgagaaccagctgtttctaacattcaggaaccggaacgtgtccgtgtggaactttcgtggagagctggtgacttcctttgaggaccatcttctatggcatccggactgcaacacaaacaacatctacataacaagtgatcaagatctgatcatctcgtattgcaaagctgatactgaagatcaatggatagaaggaaatgcgggatcaattaatatcagcaatatattgactgggaagtgcttagctaagataacatcaagcagtggacctccaaaagaagatgagagcagcagtagtagtagtagtttggggaccaactcaaagcagaggagaaacgctgtggctgaagctttggaagacataacggctctattctatgacgaagaacgcaatgagatatacactggaaacagacacggttttgttcatgtgtggtccaactgatctcacatcacgtcatcatcgttggctacttctactgtactacttggtttcttcaattgtgtgtagtactcaaatcttttaacttagtgtcttttgagcagcttgttgtgaatctactttgggcatgcgtttgtgtgttgtgtaacactagtatcatcgtacgtaacatttggggtttgataattttattagagaccctttatttcacttaaa

SEQ ID NO: 7602 - DNA, 1958 bp, Eutrema halophilum
tcagattggttaggctggttcgtgctcgaaattgggatttttttgaaggaaagagcttttgagacattgaatcagccattccaatctgaatctgcaaactcttaccgtcttacgtcacagtgggtatgtagtagccgtcacttctcgtcttcctctggagatttcttctctcgctcccgctaaactgcgccgcgtattccctcttcttcctcatcgttagggtatccaaaaaaaatttcgaaaaccttctctagggcttcaaggagaaagttagatggaaggaagaaggattacagctagccctagaccttgcagtggaagaagagttgtagctaaaaagaggtctcgaccagatgggttcgtcaacagcgttaaaaagcttcaacgaagagaaatctcatctcgcaaggatcgagctttctctattagcaccgcccaggagagatttcgcaacatgcgtctcgtggagcaatatgatacacacgatcccaagggacattgtttagttgcattaccatttttgatgaaaagaactaaagttatcgagatagttgctgcaagggacattgtctttgcgcttgcccattctggtgtctgcgcagctttcagcagagagacgaacagaagaatatgctttttaaatgtaagtccagatgaagtcatccggagcttgttctacaacaagaacaatgattctctcatcacggtttcagtttatgcttcagacaatttcagctctttgaaatgcagatccactagaatcgagtatattctgagaggtcagccagatgcagggtttgccctttttgagtctgaatcgttgaagtggcctggttttgtagagtttgatgatgtcaatggaaaggtgcttacttattctgcgcaggacagtgtgtacaaggtttttgatctgaaaaactacaccatgctatattcgatatcagataaacatgtccaggaaattaaaatcagtcctgggataatgttattgatcttcaagagagctaccagtcatgttcctttgaaaattctatcgatagaagatggcacagttctcaagtccttcaatcatttgcttcaccggaataagaaagttgatttcattgaacaattcaatgagaaacttcttgttaagcaagagaatgagaatctccaaatccttgacgtcagaaatgccgatctaatggaagttagcagagctgagttcatgacaccatctgcattcatatttctgtatgagaaccagctgtttctaacattcaggaaccgaaacgtttccgtgtggaatttccgcggagagctcgtgacttccttcgaggatcatcttctatggcatccggactgtaacacaaataatatctacataacaagtgatcaggatctgatcatctcgtattgcaaagcagatacggaagatcagtggatagaaggaaatgcgggatcgatcaatatcagcaatatattgactgggaaatgtttagctaagataacatcaagcagtggacctccaaaagaagatgagagcagtagtagcagttgttttgggaagagctcaaagcaaagaagaaacgctgtggctgaagctttagaagacataaccgctctattctatgacgaagaacgcaatgagatatacacaggaaacagacacggccttgttcatgtgtggtccaattgatttcacatcacatcacatcctcagcgttagccactactacttctattgtattttaaggtttccttcaattgtgtgtagcgttcaatttctttaacttagttatctttgaacagctagccatttgtgttgttgtgaactatttgggcatgtgtttgtgagtcagaatgccaattatgtacactaatatcattgtacgtaacatttgggtttgacaaaattctattgaagacccttctatttcacttcaaagaatctctgcttctttggaagacccgtcaag

SEQ ID NO: 7603 - DNA, 3113 bp, Arabidopsis lyrata
  misc_feature (1885)..(1885): n is a, c, g, or t
tcggattggttcggctggttcgtgctcgaaattgagagattttgaaagaaagaaagagctttgaaacaatgaatcagccaaatttccaatctgaatctgcaaaaaactcttacgtcactctcccatgtagtagccgtcacttctcgtcttcctcttagagattacccaaactctctcgcttcttcttcttcttcttctttagggtttcctcatcctttagggtttcaagcaaatccacaacctgctttaaatattggggcttaaaaggaggaagaagtagatggaaggaagaaggattacggcaagccctagaccttgtagtggaagaagagttgtggctaaaaaaaggtctagacccgatggattcgtcaacagtgttaaaaagcttcaacgaagagaaatctcatctcgtaaagatcgagctttctctattagcaccgcccaggagcgatttcgtaacatgcgtctcgtggagcaatatgatactcacgacccaaagggacactgtttagttgcattaccgtttttgatgaaaagaactaaagttatcgagattgttgctgcaagggacattgtttttgcgcttgctcattctggtgtttgtgcagcttttagtagagagtcgaacaaaagaatatgctttttaaatgttagtccagatgaagtcatcaggagcttgttctacaacaagaacaatgattctctcatcacagtttctgtttatgcttcagacaatttcagctctttgaaatgcagatccactagaattgagtatattctgagaggtcagccagatgcagggtttgctctttttgagtctgaatcattaaagtggcctggttttgttgagtttgatgatgtcaatggaaaggtgctgacttattctgcgcaagacagtgtgtacaaggtttttgatctgaaaaactacacaatgctatattcgatatcagataaaaatgttcaggaaattaaaatcagtccagggataatgttactgatcttcaagagagctgccagtcatgttcctctgaagattctgtcgatagaagatggcacagttctcaagtccttcaatcatttgcttcaccgaaacaagaaagttgatttcattgaacaattcaatgagaaacttcttgttaagcaagagaatgagaacctccaaattcttgacgtcagaaatgctgagctaatggaagttagtagagctgagttcatgacaccgtctgcattcatatttctgtatgagaaccagttgtttctgacattcaggaatcgaaatgtttctgtgtggaattttcgcggagagctcgtgacttcctttgaggaccatcttctatggcatccagactgtaacacaaataatatctacataacaagtgatcaagatctgatcatctcgtactgcaaagcagataccgaagatcagtggatagaaggaaatgctggatcgatcaatattagcaatatattgactgggaaatgcttagctaaaataacaccaagcagtggacctccaaaagaagatgagagcagcagcagtagttgtttgggaaagaactcaaagcaaagaagaaatgcggtagctgaagctttggaagacataaccgctcttttctatgacgaagaacgcaatgagatatacacaggaaacagacacggccttgttcatgtgtggtccaattgatttcacatcacatcatcatcgttagctactactactacgacttctgtattatttggtttccttcaattgtgtgtagcgataaatctttttaacttagtgtctttgagcagccatctgtgttgctgtgaagccatatgtgttgtgagtcagaaaacaatgtgtacactagttaatcaattctatgaaagaccccttgttacnaattacaatctttgcaactcctctttatacgcttatatggtcaacgtgacatcttgagaaagtttgtatgacttgcagagaataaagcaatgcctcactgctggattgtgtgcatcttatttgccttgggactatcaaggaaaagtcgtcgaaaaaaataaagggaacaaagcctactactaatggaaactaatgttttcatgcatttatcagaaaacactctgaaaatataaagagagtatgtggacgtgaatgaatacaattgcaattatctttcaaattgtatagaattgaacgtcggttggagagccgagtattttggatctttatcttcaccaccatcatctttcttttcagcaacatcagaaacacaatttccatccctttctttattctctctatctccttctctttctcttccagtttctcttgcaatattatcaccgtttcatttgatctctcaacatcattggttaattcctccatgtgtttgtatagtccttcaaattgacttctaagttctgcgttttgagacttctgcattgtaagctttattgctagttcatgaatctttccttcagcagcttggtgcccaatctcttcattttcctcttgcagggttttgcactttgccataagcatctttccattcttgctttgaggagtaaaagtaacggctgaaatgttgtcctggagttccttgatcttcttgtctttttcctcaactagattcttcagacgtgaaaattcctcatgaattgctggatccagtaacaacctcctcgcctgcattgacgctggcttgagttgagatttcaaatcgcgaacagctgacttcaattctgccatttcctgttcccgtttcgcatattgtacaatgcatgacgcttcttttctctttgcgatttctaactgttctttcaaagatctctcagaagattttagattttgaatatagtcaatcaaaaatctaggttcaggagatttcccagcgggaacaaaggactcattctgaaacgctgatttccacttctgaatctctgttttcgctgattcaagctcattttgacatgaagcaagatcatctttacaattctgaagactctcacgaagtgacaaaatcatcccagttgcaacaccaggtgcagcttcctccactttagttcgacccttttttgatccgaaaatatcatcttcatcgtcttcaagatcaccgaagcttctttta

SEQ ID NO: 7604 - DNA, 2208 bp, Eutrema parvulum
gtagccgtcacttctcgtcttcctctggagatttcgactctcgctccctataaacttcgccgcctcttccgtcttcttcctcatcgctagggtttccaagaaatcgaaaaccttctctaaatattgaggaagaaggaagttagatggatggaagaaggataacagctagccctagaccttgcagtggaagaagagttgtggctaaaaagaggtctcgacctgatgggttcgtcaacagcgttaaaaagcttcaacgaagagaaatctcatctcgtaaggatcgagctttctccattagcaccgcccaggagagattccgcaacatgcgcctcgtggagcaatatgatactcacgaccccaagggacattgcttagttgcattaccgtttttgatgaaaagaactaaagttattgagatagttgctgcaagggacattgtctttgcgcttgctcattcgggtgtctgcgcagctttcagtagagagacgaacagaagaatatgctttctaaatgtaagtccagatgaagtcattcggagcttgttctacaacaagaacaatgattctctaatcactgtttccgtttatgcttcagacaatttcagctctttgaaatgcagatccactagaattgagtatattctgagaggtcagccagatgcagggtttgccctttttgagtctgaatcattgaagtggcctggttttgtagagtttgatgatgtcaatggaaaggtgcttacgtactctgcgcaggacagtgtgtacaaggtttttgatctgaagaactataccatgctatattcgatatcagataaacatgttcaagaaattaaaatcagtccagggataatgttattgatcttcaagagggctacaagtcacgttcctttgaagattctatcgatagaagatggcacagttctcaagtccttcaatcatttgcttcaccgaaacaagaaagttgatttcattgaacaattcaatgagaaacttcttgttaagcaagagaatgagaatctccaaattcttgatgtcagaaacgctgaactaatggaagtcagtagagctgagtttatgacaccatctgcgttcatatttctgtatgaaaaccagctatttctaacatttaggaacagaaacgtatctgtgtggaattttcgtggagagctcgtgacttcctttgaggatcatcttctatggcatccggactgtaacacaaacaatatctacataacaagtgatcaagatctgatcatctcgtattgcaaagcagatactgaagatcagtggatagaaggaaatgctggatcgatcaatatcagcaatatattgactgggaaatgcttagctaagataacaccaagcagtggacctccaaaagaagatgagagcagtagtagtaatttggggacgaactcaaagcaaagaagaaacgcggttgctgaagctttggaagacataaccgctctattctatgacgaagaacgcaatgagatatacacaggaaacagacatggcctcattcatgtgtggtccaattaaattcacatcacatcatcttcgttagctactacttcttcgcctgtattatttggtttcttttcaattgtgtgtagctatcaatctcttgaacttagtgtctttgagcagccatttgtgttgttgtgaactactttgggcatgtgtttgtgactcagaatgccaattgtgtacactaatatcattgtacgtaacatttgggtttgacaaaattctatcagagaccctttcacttcaaagacactacatcttttaaagtcctctttatacgcttatggtcaagttgacatcttgagaaagttaagcagcaagtttgtaagattacaaaataaggaagtaatcttttgggtatcttcccattgttacaacactattctgttttacattcaattgagaaaacaagcttcaccagtatttttctgcaaagacaaggatttgtataaaacctacagaaaaatgaaatgtttatatttccccaagacgatgacaacaagattcagcactttaacttctcaacaccaagagaagtcgtattcttgaagtgaaagggaagcttcaaaactgagacttgtcaaggctgtcaaaatatgggtgaacaagtgctgtttttgcagcaattctttcagcaggattgtacttcagcatcttctgcatttgtttaaaacat

SEQ ID NO: 7605 - DNA, 1647 bp, Brassica napus
tcttcttctgcctgcatcgttagggtttccaacaaaatcgaaaatccttactctaatagatggaaggaagacggattacagctagccctaggccttgcagcagcggaagaagagtcgtcgcgaagaagagacctcgtcccgatgggttcgtcaacagtgtcaaaaagctccaacgaagagaaatctcgtctcgcaaagatcgagctttctccatcaacactgcccaggagagattccgcaacatgcgtctcgtggagcaatacgatactcatgatcccaagggacattgtttagttgcgttaccgtttttgatgaagagaactaaagttatcgagatagttgctgcgagggacattgtctttgcgcttgctcactctggtgtctgtgcagctttcagtagagagacgaacaggagaatatgctttttgaatgtaagtccagatgaagtcattaggagcttgttctacaacaagaacaacgattccctcatcactgtttctgtttatgcttctgacaatttcagctctttgaaatgcagatccactagaattgagtatattctgagaggtcaaccagatgcagggtttgccctttttgagtcagaatcgttaaagtggcctggttttgtagagtttgatgacgttaatggaaaggtgcttacgtattctgcacaggacagtgtgtacaaggtttttgatctgaaaaactataccatgctgtattcgatatcagataaacatgtccaagaaattaaaataagtccagggataatgttattgatcttcaagagagctacaagtcacgttcctttgaagattctttctatagaagacggcacagttctcaagtccttcaatcatttgcttcaccgaaacaagaaagttgatttcattgaacaattcaacgagaaacttctcgttaagcaagagaatgagaatctccaaatccttgacgtcagaaccgccgagcaaatggaagttagcagagcagagttcatgacaccgtccgcgttcatatttctttatgagaaccagctgtttctaacattcaggaaccggaacgtgtccgtgtggaactttcgtggagagctggtgacttcctttgaggaccatcttctatggcatccggactgtaacacaaacaacatctacataacaagtgatcaagatctgatcatctcgtattgcaaagctgatactgaagatcagtggatagaaggaaatgcgggatcaattaatatcagcaatatattgactgggaaatgcttagctaagataacatcaagcagtggacctccaaaagaagatgagagcagcagtagtagtttggggaccaattcaaagcagaggagaaacgctgtggctgaagctttggaagacataacggctctgttctatgatgaagaacgcaatgagatatacactggaaacagacacggttttgttcatgtgtggtccaactgatctcgcatcacatcatcatcgttagctacttctactgtactacttggtttcaattctgtgtagtaatcaatcttttaacttagtgtcttttgagcagcttgttgtgaatctactttggccatgtgtttgtgttgtgtaacactagtatcattgtacgtaacatttggggtttgataattttatt

SEQ ID NO: 7606 - DNA, 1725 bp, Brassica napus
cctcactactcgagattccagctctcgcttcttctcctaacctcttcttctgcctgcatcgttagggtttccaacaaaatcgaaaatccttactctaatagatggaaggaagacggattacagctagccctaggccttgcagcagcggaagaagagtcgtcgcgaagaagagacctcgtcccgatgggttcgtcaacagtgttaaaaagctccaacgaagagaaatctcgtctcgtaaagatcgagctttctccatcaacactgcccaggagagattccgcaacatgcgtctcgtggagcaatatgatactcatgatcccaagggacattgtttagttgcgttaccgtttttgatgaagagaactaaagttattgagattgttgctgcgagggacattgtctttgcgcttgctcactctggtgtctgtgcagctttcagtagagagacgaacaggagaatatgctttttgaatgtaagtccagatgaagtcattaggagcttgttctacaacaagaacaacgattccctcatcactgtttctgtttatgcttctgacaatttcagctctttgaaatgcagatccactagaattgagtatattctgagaggtcaaccagatgcagggtttgccctttttgagtcagaatcgttaaagtggcctggttttgtagagtttgatgatgtcaatggaaaggtgcttacgtattctgcacaggacagtgtgtacaaggtttttgatctgaaaaactataccatgttgtattcgatatcagataaacatgtccaagaaattaaaataagtccagggataatgttattgatcttcaagagagcttcaagtcacgttcctttgaagattctttctatagaagacggcacagttctcaagtccttcaatcatttgcttcaccgaaacaagaaagttgatttcattgaacaattcaacgagaaacttctcgttaagcaagagaatgagaatctccaaatccttgacgtcagaaccgccgagcaaatggaagttagcagagcagagttcatgacaccgtccgcgttcatatttctttatgagaaccagctgtttctaacattcaggaaccggaacgtgtccgtgtggaactttcgtggagagctggtgacttcctttgaggaccatcttctatggcatccggactgtaacacaaacaacatctacataacaagtgatcaagatctgatcatctcgtattgcaaagctgatactgaagatcagtggatagaaggaaatgcgggatcaattaatatcagcaatatattgactgggaaatgcttagctaagataacatcaagcagtggacctccaaaagaagatgagagcagcagtagtagtttggggaccaattcaaagcagaggagaaacgctgtggctgaagctttggaagacataacggctctgttctatgatgaagaacgcaatgagatatacactggaaacagacacggttttgttcatgtgtggtccaactgatctcgcatcacatcatcatcgttagctacttctactgtactacttggtttcaattctgtgtagtaatcaatcttttaacttagtgtcttttgagcagcttgttgtgaatctactttggccatgtgtttgtgttgtgtaacactagtatcattgtacgtaacatttggggtttgataattttattagagaccctttatttacgaaaaaaaaaaaaaactaa

SEQ ID NO: 7607 - DNA, 1804 bp, Raphanus sativus
  misc_feature (77)..(77): n is a, c, g, or t
  misc_feature (96)..(96): n is a, c, g, or t
  misc_feature (297)..(297): n is a, c, g, or t
  misc_feature (306)..(306): n is a, c, g, or t
  misc_feature (462)..(462): n is a, c, g, or t
  misc_feature (675)..(675): n is a, c, g, or t
  misc_feature (819)..(819): n is a, c, g, or t
gggcgaacattgaatcggataccattcccaatccgaatctgcaactctcttaccttcactgcgtatgtagtagtagnagtagtaccccctcacttntcacagcttccctttcgaagatttcaactctaccctcactcttccgcatcgtttgggtttccaactttctctaaatagattatggaaggaagacggattacagctagccctagaccttgcagtggaagaagaagagtcgccgtcgcggctaaaaagagacctcgtcccgatgggttcgtcagcagcgtcaaaaagcttcancgaagaganatctcgtctcgtaaagatcgagctttctccatcagcactgcccaggagagattccgcaacatgcgtctcgtggaacaatatgatactcatgatcccaagggacattgtttagttgcattgccgtttttgatgaagagaactaaagttattgagatngttgctgcgagggacattgtctttgcgcttgctcactctggtgtctgtgcagctttcagtagagagacgaatacaagggtatgctttttgaatgtgagtccagacgaagtcattaggagcttgttctacaacaagaacaatgattctctcatcactgtttcggtttatgcttctgacaatttcagctctctgaaatgcagatccactagaatngagtatattctgagaggtcagccggatgcagggtttgccctttttgagtctgagtcgttgaagtggcctggttttgtagagtttgatgatgtaaatgggaaggttcttacgtattctgcgcaggacagtgtgtacaaggttttngatctgaaaaactataccatgttgtattcgatatcagataaaaatgtccaagaaattaaaatcagtccagggataatgttattgatcttcaaaagagctacaagtcacgttcctttgaagattctgtctatagaagatggcacggttctcaagtccttcaatcatttgcttcaccgaaacaagaaagttgatttcattgaacaattcaatgagaaactccttgttaagcaagagaatgagaatctccagattcttgacgtgagaaccgctaaacaaatggaagttagtagagctgagttcatgacaccctctgcgttcatattcctttacgagaaccagctgtttctaacattcaggaaccggaacgtgtctgtgtggaattttcgtggagagctcgtgacttcctttgaggatcatcttctatggcatccggactgcaacacaaacaacatctacataacaagtgatcaagatctcatcatctcgtattgcaaagctgatactgaagatcagtggatagaaggaaatgcgggatcaatcaatatcagcaatatattgactgggaaatgcttagctaagataacatctagtagtggaccaccaaaagaaaatgagagtagcactagtagtagtagtagtttggggacgaactcaaagcagagaagaaacgctgtggctgaagctttggaagacataacggctctattttatgacgaagaacgcaatgagatatacacaggaaacagacatggctttgttcatgtctggtccaattgatttcacttcacttcacatcatcttcgtttagctactactacttctgtacccacttggtttccttcaaattgtgtgtagcgatcagtctctttaacttagtgtatgttgagcagcttgttgtgaaactagtttgggcatgtgtttgtgtttaagtgtatcatttgtacgtaacatttgggtttgacaaactttattagagaccctttat

SEQ ID NO: 7608 - DNA, 1910 bp, Arabidopsis thaliana
tcggattggttcggctggttcgtgctcgaaattgagattttgaaagaaaaaaagagctctgaatcattgaaatcagcttaattccaatctgaatctgcaaaaaagtcttacgtcacactcccatgtagtagccgtcacttctcgtcttcctcctagagattacccaactctctcgcttcttctttttcctcttagggtttcttcatcctttagggtttccacaaaaattcaaaacctacttggaaatatttgggcttgaagaaggaagaattagatggaaggaagaaggattacggcaagccctagaccttgtagtggaagaagaattgtggctaagaaaaggtctcgacccgatggattcgtcaacagtgttaaaaagcttcaacgaagagaaatctcttctcgtaaagatcgagctttctctattagcaccgcccaagagagatttcgtaacatgcgtctcgtggagcaatatgatactcacgatcctaaagggcactgtttagttgcattaccgtttttgatgaagagaactaaagttattgagattgttgctgcaagggacattgtttttgcgcttgcacattctggtgtttgcgcagcttttagtagagagtcgaacaaaagaatatgctttttaaatgttagtccagatgaagtcatcaggagcttgttctacaacaagaacaatgattctctcatcacagtttctgtttatgcttcagacaatttcagctctttgaaatgcagatccactagaattgagtatattctgagaggtcagccggatgcagggtttgctctttttgagtctgaatcattaaagtggcctggttttgttgagtttgatgatgtcaatggaaaggtgctgacttattctgcgcaggacagtgtatacaaggtgtttgatctgaaaaactacaccatgctatattcgatatcagataaaaatgtccaggaaattaaaatcagtccagggataatgttattgatcttcaagagagctgccagtcatgttcctctgaagattctgtcgatagaagatggcactgttctcaagtccttcaatcatttgcttcaccgaaacaagaaagttgacttcattgaacaattcaatgagaaacttcttgttaagcaagagaatgagaatcttcaaattcttgacgtcagaaatgctgagctaatggaagttagtagagctgagttcatgacaccgtctgcattcatatttctgtatgagaaccagttgtttctgacattcaggaaccggaacgtttctgtgtggaactttcgcggagagctcgttacttcctttgaggaccatcttctatggcatccagactgtaacactaataatatctacattacaagtgatcaagatctgatcatctcgtactgcaaagcagataccgaagatcagtggatagaaggaaatgcgggatcaatcaatatcagcaatatattgactgggaaatgcttagctaaaataacaccaagcagtgggcctccaaaagatgatgagagcagcagcagtaattgtatgggaaagaactcaaagcaaagaagaaacgctgtagctgaagctttggaagacataaccgctcttttctacgacgaagaacgcaatgagatatacacaggaaacagacacggccttgttcatgtgtggtccaattgatttcacatacatcgtcatcgttagctgctactactactactacgaatgtatcatttggtttccttcaattgtgtgtagcgataaatctttttaacttagtgtctttgagcagccatctgtgttgtaaaccatttgtgggcaagtgtgcgcgtcagaatgccagttgtgtacactaataccattgtacgtaacatttgggttttgacaattctatgaaagaccctttattcca

SEQ ID NO: 7609 - DNA, 3224 bp, Raphanus sativus
  misc_feature (191)..(192): n is a, c, g, or t
  misc_feature (228)..(228): n is a, c, g, or t
  misc_feature (236)..(236): n is a, c, g, or t
  misc_feature (252)..(252): n is a, c, g, or t
  misc_feature (276)..(276): n is a, c, g, or t
  misc_feature (285)..(286): n is a, c, g, or t
  misc_feature (299)..(299): n is a, c, g, or t
  misc_feature (315)..(315): n is a, c, g, or t
  misc_feature (318)..(318): n is a, c, g, or t
  misc_feature (324)..(324): n is a, c, g, or t
  misc_feature (330)..(330): n is a, c, g, or t
  misc_feature (342)..(342): n is a, c, g, or t
  misc_feature (378)..(378): n is a, c, g, or t
  misc_feature (387)..(387): n is a, c, g, or t
  misc_feature (408)..(408): n is a, c, g, or t
  misc_feature (417)..(417): n is a, c, g, or t
  misc_feature (426)..(426): n is a, c, g, or t
  misc_feature (429)..(429): n is a, c, g, or t
  misc_feature (446)..(446): n is a, c, g, or t
  misc_feature (453)..(453): n is a, c, g, or t
  misc_feature (471)..(472): n is a, c, g, or t
  misc_feature (486)..(486): n is a, c, g, or t
  misc_feature (498)..(498): n is a, c, g, or t
  misc_feature (504)..(504): n is a, c, g, or t
  misc_feature (507)..(507): n is a, c, g, or t
  misc_feature (519)..(519): n is a, c, g, or t
  misc_feature (523)..(523): n is a, c, g, or t
  misc_feature (540)..(540): n is a, c, g, or t
  misc_feature (559)..(559): n is a, c, g, or t
  misc_feature (564)..(565): n is a, c, g, or t
  misc_feature (570)..(570): n is a, c, g, or t
  misc_feature (759)..(759): n is a, c, g, or t
  misc_feature (810)..(810): n is a, c, g, or t
  misc_feature (816)..(816): n is a, c, g, or t
  misc_feature (949)..(949): n is a, c, g, or t
  misc_feature (960)..(960): n is a, c, g, or t
  misc_feature (975)..(975): n is a, c, g, or t
  misc_feature (984)..(984): n is a, c, g, or t
  misc_feature (993)..(993): n is a, c, g, or t
  misc_feature (1011)..(1011): n is a, c, g, or t
  misc_feature (1101)..(1101): n is a, c, g, or t
  misc_feature (1212)..(1212): n is a, c, g, or t
  misc_feature (1815)..(1815): n is a, c, g, or t
  misc_feature (2339)..(2339): n is a, c, g, or t
  misc_feature (2345)..(2345): n is a, c, g, or t
  misc_feature (2359)..(2359): n is a, c, g, or t
  misc_feature (2363)..(2363): n is a, c, g, or t
  misc_feature (2390)..(2390): n is a, c, g, or t
  misc_feature (2396)..(2396): n is a, c, g, or t
  misc_feature (2398)..(2398): n is a, c, g, or t
  misc_feature (2406)..(2406): n is a, c, g, or t
  misc_feature (2408)..(2408): n is a, c, g, or t
  misc_feature (2470)..(2470): n is a, c, g, or t
  misc_feature (2473)..(2473): n is a, c, g, or t
  misc_feature (2690)..(2690): n is a, c, g, or t
  misc_feature (2697)..(2697): n is a, c, g, or t
  misc_feature (2756)..(2756): n is a, c, g, or t
  misc_feature (2759)..(2759): n is a, c, g, or t
  misc_feature (2761)..(2761): n is a, c, g, or t
  misc_feature (2765)..(2765): n is a, c, g, or t
  misc_feature (2777)..(2777): n is a, c, g, or t
  misc_feature (2858)..(2858): n is a, c, g, or t
  misc_feature (3045)..(3046): n is a, c, g, or t
  misc_feature (3072)..(3072): n is a, c, g, or t
  misc_feature (3085)..(3085): n is a, c, g, or t
  misc_feature (3119)..(3119): n is a, c, g, or t
  misc_feature (3156)..(3156): n is a, c, g, or t
  misc_feature (3169)..(3169): n is a, c, g, or t
  misc_feature (3184)..(3185): n is a, c, g, or t
gaagggaaaagagcttcttcaaggaacattgaatctaacccatcccccaaatctgaatctacaaagctctttacctcactgggtatgtagccatcccctcactttctaaactcctcccttctcccttagggtttcctcaaaactcagccgcctcttacctcatcctcagggttttcccccaaaaaaaatcnnaaaaacctagtaacaaagatggaaggaagaaggatnacagctanccctagaccttgcagnggaagaagagtcgtggcggcggcnaaaaagagnnctcgtcccgatgngttcgtcaacagcgtnaanaagctncagcgnagagaaatctcntctcgtaaagatcgagctttctccatcagcaccgcncaggagagnttccgcaacatgcgtctcgtngagcaatangatactcangancccaagggacactgttnagttgcnttaccgtttctgatgaanngaactaaagttatngagattgttgcngcgagnganattgtctttgcncttnctcattctggtgtctgngctgctttcagtagagagncgaanngaagnatatgtttcttgaatgttagtccagatgaagtcatacggagcttgttctacaacaagaacaatgattctctcatcactgtttctgtttatgcttctgacaatttcagctctttgaaatgcagatccactaggattgagtatattctgagaggtcagccagatgcagggtttgctctttttgagtctgantcattgaagtggcctggttttgttgagtttgatgatgtcaatggaaaggtncttacntattctgcgcaggacagtgtgtacaaggtttttgatctgaaaaactatacgatgctgtattcaatatcagacaaacatgttcaagaaattaaaatcagtccagggataatgttattgatcttcaagagagctncaagtcacgtncctttgaagattctntcgatagangatggcacngttctcaagtccttcaancatttgcttcaccgaaacaagaaagtcgacttcattgaacaattcaatgagaaacttctcgttaagcaagagaatgagaatctccaaatncttgacgtcagaaacgctgaccaaatggaagttagtagagctgagttcatgacaccctctgcgttcatatttctgtatgagaaccagctgtttctaacgttcaggaaccgnaacgtatctgtgtggaacttccgcggagagctcgtgacgtccttcgaggatcatcttctttggcatccggactgtaacacaaacaacatctacataacaagtgatcaagatctgatcatctcatactgcaaagcagatacagaagatcaatggatagaaggaaatgcgggatcgatcaatatcagcaatatattgactgggaaatgcttagctaagataacaccaagcagtgcaccaccaaaagaagatgagagcagtagcacttctttggggaataactcgaagcaaagaataaacgctgtcgctgaagcgttggaagacataactgctctcttctatgatgaagaacgcaatgagatatacacaggaaacagacacggcttcgttcatgtgtggtccaattgatttcacatcattgttagctactattattactactgtattatttggttttctttaagttgtgtgtagtgatcaatctcttttaacttagtagtagtgtctttgagcagccatttgtgttgctgtgaagccatatgtgttgtgagtcagaaaacaatgtgtacactagttaatcaattctatgaaagaccccttgttacnaattacaatctttgcaactcctctttatacgcttatatggtcaacgtgacatcttgagaaagtttgtatgacttgcagagaataaagcaatgcctcactgctggattgtgtgcatcttatttgccttgggactatcaaggaaaagtcgtcgaaaaaaataaagggaacaaagcctactactaatggaaactaatgttttcatgcatttatcagaaaacactctgaaaatataaagagagtatgtggacgtgaatgaatacaattgcaattatctttcaaattgtatagaattgaacgtcggttggagagccgagtattttggatctttatcttcaccaccatcatctttcttttcagcaacatcagaaacaacaacctccatccctttctttactctctctagctccttgtctttctcttccaatttgtcttgcaatattatcaccgtttcgtttgatctctcaacatcgttagttagttcgtccatgtgtttgtacagtccttcaaattgctttctaagttcngcgttntgagacttctgcantganagcttcattgctagttcatgaatcttnccttcngnagcttggngnccaatctcctcgttttcctcttgcagggttttgcacttttccataagcatcttgccctttangcncagaggggtaaatgtaaacgctgtaagactatcctgtagttccttgaccctcttgtctttttcctcaactagattcttcagacgtgaaaattcttcatgaatagctggatccagtaacagcctccttgcctgcattgatgccggcttgagctgagatttcaaatcgcgaacagcagacttcaactcagccatttcctgttcccgtttggcatattgnacaatgnatgaagcttcttttctctttgcaatttccaactgttctttcaaagatctctcggaaganttnanattntggatgtagtcnatcaaaaatctaggctcaggagatttgccagctggtatgaaagactcgttctgaaacgctgatttccacttgaggatctcngcttttgctgattctagctcattctgagatgaagcaagatcatctttacagttttgaagactctctcggagtgagaggatcatcccagttgcaacaccaggggcagcttcctccgctttcgtacgaccctttttggatccgaagatatcatcttcatcgtcttcaagatcaccgaaacttcttttanncctgaagctctggcggcgttagtagnggagaaatcgccnccaaaatcgtcgtcttccattagcgcaacccacnataagatctcagatttgtgtcaatgatgaaagcgagngacggcagttganaatcttagggctttnngttttcagaggtcaggctctggatacctttcttttggtc

SEQ ID NO: 7610 - DNA, 1797 bp, Arabidopsis lyrata
aaaaaccaataatgttgtagattcagaaaaatatcatcataagccaaactttatcataggcttatgatatttttattttatgcttaagaaattcagattgaaaagtgaaaattttgcagttagcccattggagcctaagccttgctgctgcaacagttgcagtctcttcagtgttacggattcttcttcttcttcggccctaaaaatcatcactttggaatcaaaagcaaagcaaaagcttgaatgatggaaggaagaagaatcatagcaaaccctagaccttgtagcggtagtaaaagagttgttgctaagaagaggtctcgtcccgacggaatcgtcaatagcgttaaaaagcttcaacgccgagaaatctcttctcgtatggatcgagctttctcaatcagcaccgctcaagagagattccgcaatatgcgtctcgtggagcaatatgacacgcatgatcctaaaggatactgtttagtatcattacctaacttgttgaaacgaagcaaagttattgagattgttgctgctcgagacattgtctttgctcttactctatctggtgtttgtgcttcttttagcagagagacgaataaaagggtttgctttttaaatgttagtcctgatgaagtcattcggagtttgttctacaacaagaacaatgattctctcattactgtttctgtttacgcctctgacaattacagctctttgaaatgcagatccactagaatcgaatatattctgaggggtcaagcagacgcaggatttcctctttttgagtctgagtcactaaagtggccaggttttgtagagtttgatgatgttaatgggaaggtgctgacatattctgcacaggatagtgtttacaaggtgtttgatctcaaaaactatgccttgttatactcggtatcagacaaaaatgtacaggaaattaagatcagtccagggataatgttgttgattttcaagagagctgtgagtcatgttcctttgaagattctatcaatcgaagatggcacggttctcaagtccttcaatcatttgcttcaccgaaacaagaaagttgatttcattgaacaattcaatgaaaagcttctagttaagcaagagaacgagaatctccaaatacttgacgttcgaaatgctgagctgatagaagttagcagaactgaattcatgacaccatcagcattcatatttttgtatgagaaccagttgtttctaacattcaggaaccgaaatgtttctgtgtggaatttccgcggagagcttgtgacctcgtttgaggatcatcttctttggcatccagactgtaacacaaacaatatctacataacaagcgatcaggatctgatcatctcatattgcaaggcagatactgaagatcagtggatagaaggaaatgcggggtcgattaacataagcaatatcttgactggtaaatgcttagctaagataaaagcagataatggccctcctaaggaagaagactgcagcagtagtgatatggggaactccaatagaaggataagtgcggttgctgaggctttggaagacataaccgctctcttctacgacgaagaacggaatgaaatatacacaggaaacagacacggctttctccatgtctggtctaattgaagctactcatcatttgtttttttaacattaattagctttggagatctctgtatcttgttctgtttctcaattgtgtaatatcatgtgatctgtaatttacttgtgtttgagcagcaattgtggttgtaatgaagcagcaaagatttcaaa

SEQ ID NO: 7611 - DNA, 1835 bp, Arabidopsis thaliana
tttgtttctgttttggtcaacaatgcttctgtcttcagccacttagccgataaaaaaaaaaaaaaaaaaatgttacagattcagaaaaaatatcataagcctaactttcttatgatgatatttccggtttatgcttaagaaattctgcttgatactgaaatttcgtaattagccccattggtagcctttgctgctgcaacagttgcagtctcttcttcagtgttacggattcttattcttcagccctaaaaatcatcactttggaatcagaagcttgaatgatggaaggaagaagaatcatagcaaaccctagaccgtgtagcggtagtagaagagttattgctaagaagaggtctcgtcccgatggattcgtcaatagcgttaaaaagcttcaacgccgagaaatctcttctcgtatggatcgagctttctcaatcagcactgctcaagagagattccgcaatatgcgtctcgtggagcaatatgatacgcatgatcctaaaggatactgtttagtatcattacctaacttgttgaaacgaagcaaagttattgagattgttgctgctcgtgacattgtctttgctcttactctatctggtgtctgtgcatcttttagcagagagacgaataaaaaggtttgctttttaaatgttagtcctgatgaagtcattcggagtttgttctacaacaagaacaatgattctctcattactgtttctgtttacgcctctgacaattacagctctttgaaatgcagatccactagaatcgaatatattctgaggggtcaagcagacgcaggatttcctctttttgagtctgagtcactaaagtggccaggttttgttgagtttgatgatgttaatgggaaggtgctgacatattctgcacaggatagtgtttacaaggtgtttgatctgaaaaactatgccttgctatattcgatatcagacaaaaatgtacaagaaattaagatcagtccagggataatgctgttgattttcaagagagctgcgagtcatgttcctttgaagattctatcaatcgaagatggcactcttctgaagtccttccatcatttgcttcaccgaaataagaaagttgatttcattgaacaattcaatgaaaagcttctagttaagcaagagaacgagaatctacaaatacttgacgttcgaaatgctgagctgatagaagttagcagaactgacttcatgacaccatcagcattcatatttttgtatgagaatcagttgtttctaacattcaggaaccgaaatgtttctgtgtggaatttccgcggagagcttgtgacctcgtttgaggatcatcttctttggcatccagactgtaacacaaacaatatctacataacaagcgatcaagatctgatcatctcatattgcaaggcagatactgaagatcagtggatagaaggaaatgcggggtcgattaacataagcaatatcttgactggtaaatgcttagctaagataaaagcaaataatggtcctcctaaggaagaggactgcagcagtagtgatttggggaattcctctcgaaggagaagtgcggttgctgaggctttggaagacataaccgctctcttctacgacgaagaacggaatgaaatatacacaggaaacagacacggcctcctccatgtctggtctaattgaagctactcatcatttgttttgttttttttacattaatacaagagatctctgtatcttgttctgtttctcaattgtgtaatatcatgagatatgtaatttacttgtgtgtttgagtagcaattgtcgttgtaatgaaacagcaaatatttcaaa

SEQ ID NO: 7612 - DNA, 1771 bp, Eutrema halophilum
acactgaaattttgaaagagagaaaccttggattagccattgctctcattgggagcctctagctgcaccagttgcagtcgccaagttttcatctttcttacagccctcgtttctcaagcccatgattcttctgccctaaagcttcaactcagaagaaagctgatgatggaaggaagaaggatcatagcagaccctagaccttgcatcggtagaagagttgtagccaataagaggtctcgtcccgatggattcgtcaatagcgttaaaaagcttcaacgcagagaaatctcgtcccgtagggatcgaggtttctccattagcaccgctcaagagagattccgcaatatgcgtctcgtggagcaatatgatacgcacgatcttaaaggagactgtttagttgcattaccctttttgatgaaacgaaccaaacttatcgagattgttgctgcgcgggacattgtctttgcgcttgctcattctggtgtttgcgcatctttcagcagagagacgaataaaagggtctgctttttgaatgttagccctgacgaagtcataaggagcttgttctacaacaagaacaatgattctctcatcacagtttctgtttacgcctcagacaatttcagctctttgaaatgcagatccactcgaatcgaatatattatgaggggtcaagcagacgctggatttcccctttttgagtctgaatcgctaaagtggccaggtttcgtagagttcgatgatgttaatgggaaggtgctgacatattctgcgcagaacagtgtttacaaggtgtttgatctgaaaaactatgcaatgctatattcgatatcagacaaaaatgtccaggaaattaaaatcagtccagggataatgttattgattttcaagagagcttcaagtcatgttcccttgaagattctatcaatcgaagatggcacagttctcaagtcctttaatcatttgctccaccgaaacaagaaagttgatttcattgaacaattcaatgaaaagcttctagttaagcaagagaacgagaatctccaaatacttgacgtccgaaacgctgacgtgatagaagtcagcagaactgaattcatgacgccatcggcattcatatttttgtatgagaaccagttgtttctaacattcaggaaccgaaatgtttctgtgtggaatttccgcggagagcttgtgacttcatttgaggatcatcttctttggcatccagactgtaacacaaataatatctacatcacaagcgatcaggacctaatcatctcatattgcaaggcagatactgaagatcagtggatggaaggaaatgcagggtcgattaatataagcaatatcttgactgggaaatgcctagctaaaataaaagcaagcaatggccttcaaaacgaagaggagtcctgtagcagttccaatcaaagaaatagtgcggtttctgaggctctggaagacataaccgctctatactatgatgaagaacggaacgaaatatacactggaaatagacatggctttctccatgtctggtctaattgagaagctactcaatcatttgtttgtgtagattattagctatggaggatctctttgtatcttggggttttcttgaaaatgcgtgtaatgtcgtttaaaactttactattctttgagcagcaattgtggttgtaatgatagcaggaactatttggtgggggattcggctccacgttatgtacactaatatgattcgtctgcttatgagaattaaatttgagca

SEQ ID NO: 7613 - DNA, 2119 bp, Citrullus lanatus
taattccttttcccccttcttctttctccctctccctctccctctccctctcctcttatctcttcctacaacgatgttagctgttcaatcccatctgacttcacttggactccactgacactctctaactctccgctccggcggccttactccgccgcctcaccggagatactctccttcgatcttttttttacttcccggtgagttttcctctgctctagggtttgcagatttcacaattccacctcttgaattttcctcgatcgcctcgcgttttcaaatttcttttcgccaattgacttccttccggggtttaaaacttttgttttccccaatttctttcggtaattggggatttatttggagggttatatgaagttcgttcctccttggaacgaggagaagtaggagcttcttgttttgggggaaatactcatggaagggaggaggatttcagcgagtcctcggccttgttctggtcggcgtattttggctaagaaacgacctcgggttgatgggtttgttaatagtgtgaagaagctgcagagacgggagatttgctcgaagcgcgatcgtgcttttagtatgagtaatgcccaagagagatttcgcaacatgcgtttgatggaggaatatgatactcatgatccaaaggggcattgttcaccagttttaccttttctgatgaagagaaccaaagtaatagaaattgttgctgcacgtgacattgtttttgctctggcacattctggtgtttgtgcagcctttagtagagagacaaatgaaagaatatgcttcttgaatgtcagtcctgacgaggtcattcggagtttgttttacaataagaacaatgattcacttatcacagtttcagtttatgcttctgataacttcagctctttgaaatgcagatctacaaggattgaatacattcgaaggggcaagcctgatgcaggttttgcactttttgagtctgaatcgttgaagtggcctggatttgttgagttcgatgatgttaatgggaaagttctaacctactctgcacatgatagtatatacaaggtgtttgacctgaaaaactataccatgctttactctatatcagataaacatgttcaagaaatcaagatcagccctgggatcatgttattgattttcaatagagccagtagccacgttcctcttaagattctatccatagaagatggcacagttctcaaagctttcaaccatcttcttcatcggaacaagaaagtggacttcatagaacaatttaatgaaaaacttcttgtgaagcaagaaaatgaaaatcttcaaatacttgatgttcgtaatgctgaattgatggaagtaagcagaactgaatttatgaccccgtcagcatttatctttctgtatgagaaccagttgtttctgacatttagaaaccggactgtggctgtctggaactttcgtggggagcttgtaacttcatttgaagatcaccttttatggcatccagactgcaataccaataacatttacatcactagtgatcaggatctcattatatcctactgcaaagctgattctgatgatcattggatggaaggaaatgctggttcgatcaatatcagcaacatcttgactgggaaatgtctagccaagattaatgcaagcaatggaaatcccaaggttgacgactccagcagcgctggcatctctagaaagaaatgcaactcttcacagatgagaaacacagttgcagaggctttggaagatattactgcacttttctatgatgaagagcgtaacgagatatacactggtaacaagaatggtttggtacatgtgtggtctaactgagacctgatttttttatttgtttttatttccttttctgaagtatgctttgacattgatcaaactgatgatttgatgatgatgaaaggcggttcatattgtcaagcgctaatgcagattttatggtagaataataggttgtgtcagttagttgaatagaaagctttgcttgcattgtaatattaaaatagattttaatgtgtttatgtatactgttgtaaaaatccaccttcgctttatgagaatagtcaacaattcgatatttctctcgttaaaa

SEQ ID NO: 7614 - DNA, 1716 bp, Manihot esculenta
cacaatcatctcatctctcacaggaacacagtgaccgaccccaacagcaagagagagagagagagagagagagtggggtttttgccttagcaattgagtttgatttctccgctttattctatttctacaatttagggtttgctctccaggttaagggggaagtacctttctttgttttgttttagggttttcgctgcttggatcggatttaaattgaagttggagagagagagagagagatgggagggataagggggtgttgatttccttcttcatctctcgggtctggcggtgaaatacaagtagcgtaggaggatggaagggaggaggatatcggcgaatccaaggccttgttccggaaggaggatattggcgaagaagaggcctcgcaccaatggatttgtcaacactgttaagaagttacagagacgcgagatttcttctaagcgagatcgtgctttcagtatgagcaatgcccaggagaggtttcgcaatatgcgtttgatggaagagtatgatactcatgatcccaagggccattgttcagtagtgctgccctttttgatgaagagaacaaaagtcattgagattgtagctgcacgtgatattgtctttgctcttgcacattctggtgtttgtgcagcttttagtagagagacaaatcagaggatatgttttctgaatgtgagtcctgatgaagtcattcgaagcttgttctataataagaacaatgattcactcatcacagtttcagtttatgcttctgacaactttagctccttgaagtgcagatcaactagaattgagtacataaggagaggcaaaccagatgctggttttgctctttttgagtctgagtccttgaagtggccgggctttgtagagtttgatgatgttaatgggaaggtcctaacctactctgcgcaagatagtgtttacaaggtttttgaccttaaaaactacacaatgctgtactctatatcggacaaacatgttcaagaaatcaaaatcagtccgggaatcatgttgttgatattcaatagagcaagtagccatgttcctcttaagattttatcaatagaagatgggacagttctaaaagccttcaaccatctgcttcatcgaaataagaaggtggacttcattgaacaatttaatgaaaagctccttgttaagcaggaaaatgagaatcttcagatcctggatgttcggaattcagaattaatggaagttagcagaactgagttcatgactccctctgcatttatctttctctatgagaatcagctgttcctaactttcagaaacagaactgttgctgtttggaattttcgtggggagcttgtaacttcatttgaggatcacctgttatggcatcctgactgtaacacaaataacatatacataacaagcgatcaggatctaattatttcttactgcaaagctgaatctgaagaccagtggatggaaggaaatgctggctctatcaatgtcagcaatatcttgacggggaagtgcttggccaaaataaatgctagcaatggcaatcccaaaggtgatgagtgcagtggcagtacctcaaagcagagtcactctcctatgagaagtacggttgcagaggcgttggaagacataactgcacttttctatgatgaggagcggaatgagatctacactggtaatagacatggattggttcatgtgtggtctaactga

SEQ ID NO: 7615 - DNA, 1522 bp, Brassica napus
atcagcactgctcaggagaggttccgtaacatgcgtctagtggagcagtatgatactcatgaccccaaggggcatagtttagttgcgttgccgtttttgatgaagaggactaaagttattgagattgttgctgcgagggatattgtctttgcgcttgctcattctggtgtctgtgctgctttcagtagagagacgaatagaagaatatgttttttaaatgtgagtccagatgaagtgattcggagcttgttctacaacaagaacaatgattcgctcatcactgtctctgtttatgcttctgacaatttcagttctttgaaatgcagatccactaggattgagtatattctgagaggtcagccagatgcagggtttgctctttttgagtctgagtcattgaaatggcctggctttgtagagtttgatgatgtcaatggaaaggtgcttacatattctgcgcaggacagtgtgtacaaggtttttgatctgaaaaactataccatgctgtattccatatcggacaaacatgttcaagaaattaaaatcagtccagggataatgttattgatcttcaagagagctactagtcacgttcctttgaaaattctatcgatagaagatggcacagttctcaagtccttcaatcatttgcttcaccgaaacaagaaagttgatttcattgaacagtttaacgagaaacttcttgtgaaacaagagaatgagaatctccaaattcttgacgttagaaacgctcaactaatggaagttagcagagccgagttcatgacaccttctgcgttcatatttctgtatgagaatcagctgtttctaacgttcaggaaccgaaacgtatctgtgtggaactttcgcggagagctcgtgacttcctttgaggatcatctcctatggcatccggactgtaacacaaacaacatctacataacaagtgatcaagatctgatcatctcgtattgcaaagcagataccgaagatcagtggatagaaggaaatgcgggatcgatcaatatcagcaacatattgactgggaaatgcttagctaagataacgtcaagcagtggacctccaaaagaagatgagagcagtagcagtagcagcagttctttggggaacaactcaaagctgagaagaaacgctgtggctgaagctttggaagacataacggctctgttctatgacgaagaacgcaatgagatatacacaggaaacagacacggctttgttcatgtgtggtccaattgatttcacatcatcatcatcatcatcatgttagctacttctactacttgtactgtgttatttggtttacttcaattgtgtgtgtagcgatcaatctgttttaacttagtgtttttcgagcagctatttgtgttgttgtgaactacgtttgggcatgtgtttgtgattcagaatgccaattatgtacactagtttcattgtacgtaacatttgggtttgacaaaatgtattacagaccctttattacatctttgctattcctttg

SEQ ID NO: 7616 - DNA, 2090 bp, Cucumis sativus
cttcttcttctcatctttttctgctcattcttatctcttcttagaacaatgcttgttgttcaatcccatctgacttcacttggactccactgacactctcccactcccggcgccgggggcctctcaccggaaccactcccccccgcttcatctctctttttcttttacttcccggtaagtttttctctgctctagggtttctaaatttcacaatttccccctcttctatttctcctcaatcgcctcaccttttcaaacttttctttccaattgagttccttcctggggtttaaaccttctgttttccccaatttctttcggtaattggggatttctttcgagggttatgtgaaatccgttcctgcttggaacgaagagaagtaggagggcttcttgtttgtttgggggaaagtactactcatggaggggaggaggatttctgctagtcctcggccttgttctggtcggcgtattttggctaagaaacgacctcgggttgatgggtttgttaatagtgttaagaagctgcagagacgggagatttgttcgaagcgcgatcgtgcttttagtatgagtaatgctcaagagagatttcgcaacatgcgtttaatggaggaatatgatactcatgatccaaaggggcattgttcacctgttttaccttttctgatgaagaggacgaaagtaattgaaattgttgctgcacgtgatattgtttttgctctagcacattctggtgtttgtgcagcttttagcagggagacaaatgaaagaatatgcttcttgaatgtcagtcctgatgaggtcattcgcagtttgttttacaataagaacaatgattcacttatcacagtttcagtttatgcttctgataacttcagttctttgaaatgcagatctacaaggatcgaatacattcgaaggggcaaacctgatgcaggttttgcactttttgagtctgaatcgttgaagtggcctggatttgttgagtttgatgatgttaatggtaaagttttaacctactctgcacaagatagtatatacaaggtgtttgacctgaaaaactataccatgctttactctatatcagataagcatgttcaagaaatcaagatcagccctggaatcatgttgttgatcttcaatagagccagtagccatgttcctcttaagattctgtctatagaagatggtacagttctcaaagctttcaaccatctgcttcatcggaacaagaaagtcgacttcatagaacaatttaatgaaaaacttcttgtgaagcaagaaaatgaaaatcttcaaatacttgatgttcgcaatgctgaattgatggaagttagcagaactgaatttatgaccccatcagcatttatctttctgtatgaaaaccaattgttcttgacatttagagaccgaactgttgctgtctggaactttcgtggggagcttgtaacctcttttgaggatcaccttttatggcatccagactgcaataccaacaacatttacatcactagtgatcaggatctcattatatcttactgcaaggctgattctgatgatcattggatggtaggaaatgctggttcgatcaacatcagcaatatcttgactggcaagtgtctagccaagattaatgcaagcaacggaaaccccaaggtcaacgacagcagcagcagcagcagcagcagtgctggcagctcgagaaaggtgtgcaactcttcacagatgagaaacacggttgcggaggctttggaagatattactgcacttttctatgatgaagagcgtaatgagatatacactggcaacaagaatggtctagtacatgtgtggtctaactgaagacctcatttttttaaaaaaaattgtttttttgttattttttttttcttttctgaagtttgctttgacattgatcaaactgatgatttgatgatgaagatgaaaggcagctcatatgatgagctccaatgcaggaaatttgatggtagaataataggttgtgtcagtttagttgaatagagaaagctttggttgcattgtaatattaaatagattttaatgtgttatgtatactgatttgtaaa

SEQ ID NO: 7617 - DNA, 1831 bp, Eutrema parvulum
acactgaaattttgaaagagagcttaaaaaacatttggattagccattgaaacctgctgcaccagttgcatcttcatctttcttcctcgtttctcaagcccatgattcttctgccctaaagctccaactcaaaagaaagctgatgatggaaggaagaaggatcgtagcaaaccctagaccttgcagcggtagaagagttgtagctaaaaagaggtctcgtcccgatggattcgtcaatagtgttaaaaagcttcaacgcagagaaatctcttcccgtatggatcgaggtttctccattagcaccgctcaagagagattccgcaatatgcgtctcgtggagcaatatgatacgcacgaccccaaagggcactgtttagtttcattaccctttttaatgaaacgaaccaaagtcatcgagattgtcgctgcacgggacattgtctttgcccttgctcattctggtgtttgcgcgtctttcagcagagagacgaacaaaagggtttgctttttgaatgttagtcctgatgaagttatccggagcttgttctacaacaagaacaatgattctctcatcactgtttctgtttacgcctccgacaatttcagctctttgaaatgcagatccactagaatcgagtatgccttactctcgtattgttgtgtcttcttaggtttagttctcagactcttcaaatttatgtgtttttcttgtactgatagatatattatgaggggtcaggcagatgctggatttcccctttttgagtctgagtcactaaagtggccaggtttcgttgagtttgatgatgttaacgggaaggtgctgacatattctgcacaggacagtgtttacaaggtgtttgatctgaaaaactatgccatgctatattcgatatcagacaaaaacgtccaggaaattaagatcagtccagggataatgttattgattttcaagagagcgacaagtcatgttcccctgaagattctatcaatcgaagatggcacggttctcaagtccttcaatcacttgcttcaccgaaacaagaaagttgatttcattgaacaattcaatgaaaagcttctagttaagcaagagaatgagaatctccagattcttgatgtccgaaacgctgagctgatagaagttagcagaaccgaattcatgacaccatcagcattcatatttttgtatgagaaccagttgtttctaacattcaggaaccgaaatgtttctgtctggaatttccgcggagagcttgtgacgtcgtttgaggatcatcttctttggcatccagactgtaacacaaataatatctacataacaagcgatcaggatctgatcatctcatattgcaaggcagataccgaagatcagtggatcgaaggaaatgcggggtcgatcaatgtaagcaatatcttgactgggaaatgcttagctaaaattaaagcaagcaatggtcttccaaaggaagaggagtgcagtagcagtttggggaagtccaagcaaagaaaaactgcagttgctgaggctttggaagacataaccgctctcttctatgacgaagaacgtaatgaaatatacaccggaaacagacacggctttctccatgtctggtctaattgaatctactcatcatcagatgtttctgtagattaaatagctactcggtatcttggccttttcttaaaattgtgtgtaatgtgatttgtaacttacttttccttgagcagcaattgtggttgtaatgaagcaggaactatttgggggattcagctcccacgttatgtacactaatatgatttgtcttcttttgagaactgaatctgagca

SEQ ID NO: 7618 - DNA, 1970 bp, Citrus sinensis
aacccccgacatttcaacagagaccccttctccttctctggcctttctcctcacaatctcactcttctccttccccaactgctgttcatcatacgcaagattccgttccgtagagggaacgtgagaaggagagagggagagagagagagttaataattataattttagtggatcaaattttgaattttgattatgtttcgctgttgcttgagtttgtgttaacttgtaaaattagggttttgttaaaaaaaaaaattgagagttcaaatggaaggattaggaaggagaatatcggcgagtccaaggccgtgctctgggagaagagtattggcgaagaaaagggttcgttctgatggattcgttaacagtgtaaagaagcttcaaaggcgggagatttgttctaaaagagatcgtgcttttagtatcagcaatgctcaagaacgatttcgcaatatgcatttagtggaggaatatgatacccatgatcccaaagggcactgtccgtttgttttgccttttttaatgaagagaactaaagtaattgagattgtggccgcccgtgatatcgtctttgcccttgcgcattctggtgtctgtgcagcttttagtagagagacaaacaggaggatttgttttctgaatgttagtcctgatgaagtcatacgaagcttgttctataacaagaacaatgattcacttatcactgtgtctgtttatgcttctgataacttcagctctttgaaatgcagatctacaaaaattgaatacataaggcggggtaagccagattcgggttttgctctttttgagtcagagtccttgaagtggcctggctttgtggagtttgatgatgttaatggaaaggtcctgacttactctgcacaagatagtatatacaaggtgtttgacctcaaaaactatacgatgctgtactctatatcagacaaacatgtgcaagaaatcaaaattagtccgggcatcatgctattaattttcaatagatctagtagtcatgttcctctcaagattctatctatagaagatggcacagttctcaaggtcttttatcatctgctgcatcgaaataagaaggtggacttcattgaacaattcaatgaaaagcttcttgtcaagcaagaaaacgagaatctccagatccttgatgtacgaaatgctgagctgatggaagttagcagaactgaattcatgactccatcagcatttatctttctgtatgagaaccagctgttcctaacgttcagaaatcgaactgttgctgtatggaattttcgtggagagcttgtaacttcatttgaggatcacctgttatggcatccagactgtaacacaaataacatttatataacaagtgatcaggatcttattatttcttactgcaaggctgaacctgaggatcaatggatggaaggaagtgctggatcaatcaatgtcagcagtattttgactgggaaatgcctggctaaaataaatgcgacaaattgcagtcccaaggttgatgacgagttaggaagcagcagtactggcaagtcaaagaagttgaataaatcctcctatataagaagcacggtaggagaggcattggaagatataacttctcttttctatgatgaagagcgcaatgagatctacaccgggaacagacatgggcttgttcacgtatggtctaattgaaaatccaataattctgatgagttggctctactgcagtttggttgacatagtgtatcaaattaaattgttttcaacttgtatccttagacgagtaaaattggaatgtagccacttgtagatagccttccttttgagatgaagtgaaattagcctgccttcctattgagatgaagtaaaatcttgcaagatatcattgtatttgtatgtacactaaaatttaattctctttgcttgcttgcctagcctcagaaatggaaagccaaatattttccttgaaa

SEQ ID NO: 7619 - DNA, 1971 bp, Citrus clementina
aacccccgacatttcaacagagaccccttctccttctctggcctttctcctcacaatctcactcttctccttctccaactgctgttcatcatacgcaagattccgttccgtagagggaacgtgagaaggagagatggagagagagagagttaataattataattttagtggatcaaattttgaattttgattatgtttcgctgttgcttgagtttgtgttaacttgtaaaattagggttttgttaaaaaaaaaaaattgagagttcaaatggaaggattaggaaggagaatatcggcgagtccaaggccgtgctctgggagaagagtattggcgaagaaaagggttcgttctgatggattcgttaacagtgtaaagaagcttcaaaggcgggagatttgttctaaaagagatcgtgcttttagtatcagcaatgctcaagaacgatttcgcaatatgcatttagtggaggaatatgatacccatgatcccaaagggcactgtccgtttgttttgccttttttaatgaagagaactaaagtaattgagattgtggccgcccgtgatatcgtctttgcccttgcgcattctggtgtctgtgcagcttttagtagagagacaaacaggaggatttgttttctgaatgttagtcctgatgaagtcatacgaagcttgttctataacaagaacaatgattcacttatcactgtgtctgtttatgcttctgataacttcagctctttgaaatgcagatctacaaaaattgaatacataaggcggggtaagccagattcgggttttgctctttttgagtcagagtccttgaagtggcctggctttgtggagtttgatgatgttaatggaaaggtcctgacttactctgcacaagatagtatatacaaggtgtttgacctcaaaaactatacgatgctgtactctatatcagacaaacatgtgcaagaaatcaaaattagtccgggcatcatgctattaattttcaatagatctagtagtcatgttcctctcaagattctatctatagaagatggcacagttctcaaggtcttttatcatctgctgcatcgaaataagaaggtggacttcattgaacaattcaatgaaaagcttcttgtcaagcaagaaaacgagaatctccagatccttgatgtacgaaatgctgagctgatggaagttagcagaactgaattcatgactccatcagcatttatctttctttatgagaaccagctgttcctaacgttcagaaatcgaactgttgctgtatggaattttcgtggagagcttgtaacttcatttgaggatcacctgttatggcatccagactgtaacacaaataacatttatataacaagtgatcaggatcttattatttcttactgcaaggctgaacctgaggatcaatggatggaaggaagtgctggatcaatcaatgtcagcagtattttgactgggaaatgcctggctaaaataaatgcgacaaattgcagtcccaaggttgatgacgagttaggaagcagcagtactggcaagtcaaagaagttgaataaatgctcctatataagaagcacggtaggagaggcattggaagatataacttctcttttctatgatgaagagcgcaatgagatctacaccgggaacagacatgggcttgttcacgtatggtctaattgaaaatccaataattctgatgagttggctctactgcagtttggttgacatagtgtatcaaattaaattgttttcaacttgtatccttagacgagtaaaattggaatgtagccacttgtagatagccttccttttgagatgaagtgaaattagcctgccttcctattgagatgaagtaaaatcttgcaagatatcattgtatttgtatgtacactaaaatttaattctctttgcttgcttgcctagcctcagaaatggaaagccaaatattttccttgaaa

SEQ ID NO: 7620 - DNA, 2023 bp, Citrus sinensis
  misc_feature (2014)..(2014): n is a, c, g, or t
ggggaacccccgacatttcaacagagaccccttctccttctctggcctttctcctcacaatctcactcttctccttccccaactgctgttcatcatacgcaagattccgttccgtagagggaacgtgagaaggagagagggagagagagagagttaataattataattttagtggatcaaattttgaattttgattatgtttcgctgttgcttgagtttgtgttaacttgtaaaattagggttttgttaaaaaaaaaaattgagagttcaaatggaaggattaggaaggagaatatcggcgagtccaaggccgtgctctgggagaagagtattggcgaagaaaagggttcgttctgatggattcgttaacagtgtaaagaagcttcaaaggcgggagatttgttctaaaagagatcgtgcttttagtatcagcaatgctcaagaacgatttcgcaatatgcatttagtggaggaatatgatacccatgatcccaaagggcactgtccgtttgttttgccttttttaatgaagagaactaaagtaattgagattgtggccgcccgtgatatcgtctttgcccttgcgcattctggtgtctgtgcagcttttagtagagagacaaacaggaggatttgttttctgaatgttagtcctgatgaagtcatacgaagcttgttctataacaagaacaatgattcacttatcactgtgtctgtttatgcttctgataacttcagctctttgaaatgcagatctacaaaaattgaatacataaggcggggtaagccagattcgggttttgctctttttgagtcagagtccttgaagtggcctggctttgtggagtttgatgatgttaatggaaaggtcctgacttactctgcacaagatagtatatacaaggtgtttgacctcaaaaactatacgatgctgtactctatatcagacaaacatgtgcaagaaatcaaaattagtccgggcatcatgctattaattttcaatagatctagtagtcatgttcctctcaagattctatctatagaagatggcacagttctcaaggtcttttatcatctgctgcatcgaaataagaaggtggacttcattgaacaattcaatgaaaagcttcttgtcaagcaagaaaacgagaatctccagatccttgatgtacgaaatgctgagctgatggaagttagcagaactgaattcatgactccatcagcatttatctttctttatgagaaccagctgttcctaacgttcagaaatcgaactgttgctgtatggaattttcgtggagagcttgtaacttcatttgaggatcacctgttatggcatccagactgtaacacaaataacatttatataacaagtgatcaggatcttattatttcttactgcaaggctgaacctgaggatcaatggatggaaggaagtgctggatcaatcaatgtcagcagtattttgactgggaaatgcctggctaaaataaatgcgacaaattgcagtcccaaggttgatgacgagttaggaagcagcagtactggcaagtcaaagaagttgaataaatgctcctatataagaagcacggtaggagaggcattggaagatataacttctcttttctatgatgaagagcgcaatgagatctacaccgggaacagacatgggcttgttcacgtatggtctaattgaaaatccaataattctgatgagttggctctactgcagtttggttgacatagtgtatcaaattaaattgttttcaacttgtatccttagacgagtaaaattggaatgtagccacttgtagatagccttccttttgagatgaagtgaaattagcctgccttcctattgagatgaagtaaaatcttgcaagatatcattgtatttgtgtatgtacactaaaatttaattctctttgcttgcttgcctagcctcagaaatggaaagccaaatattttccttgaaaattgcactgactgatctggcgccaacacaccctataangttgggcgt

SEQ ID NO: 7621 - DNA, 1856 bp, Prunus persica
ttttcgtccccaattcgccttctcagagtttagggtttatgcgatgcgatgctacagaagatcacaaattgtgtaattgaaaaggaagacgagtagtaaaatatgtgttacagtctggttctaagtctgaagtgagtgtatcgggtttttctgagaggaattgatggaagggggaaggagaatatcggcaagtcctcggccttgcaatggtaggagggtggtagcgaagaaacgacctcgtgttggtggcgtggatgggttcgtcaacagcgttaagaagcttcagaggcgcgaaatcagctccaagcgtgaccgtgctttcactatgagcgatgcccaagagcggtttcgcaatattcgcctccaggaggaatatgatacacatgatccaaaaggtcactgtgccatggttctgcctttcttgcgaaagaggtcaaaaattattgagattgtagcagcgcgtgacattgtgtttgctcttgcgcaatctggtgtttgtgcagcatttagccgagaaaccaaccagagaatatgctttctgaatgtcagtcccgatgaagtgataagaagcttgttttataacaaaaacaatgactcacttatcactgtttcagtttatgcttccgacaatttcagttccttgaaatgcagaagcactaggattgaatacatacgaagaggtaaaccagatgctggctttgctctttttgaatcagagtcactgaaatggcctggttttgtagagttcgatgatgtaaatgggaaggttctcacttattctgcacaggataacatatacaaggtgtttgatctgaaaaactacacaatgttgtactccatatcagataagcatgttcaagagattaagattagtcctggaatcatgctgttaatttttactaaagctagtagccacgttcctcttaagatcctgtccatagaggatggtactgttctcaaatccttcaaccatctccttcatcggaataagaaggtggatttcatcgaacagttcaatgaaaagcttcttgtaaagcaagaaaatgagaacctccaaattcttgatgttcgtaattttgagctgacagaagttagcagaactgagttcatgacaccatcagcctttatatttctgtatgagaatcagctattcctgacgtttcgaaatcgaactgtggctgtttggaattttcgaggagaacttgtaacttcttttgaggatcatcttttatggcatcccgactgcaataccaataacatatacattactagtgaccaggatcttattatttcttactgcaaggctgattctgatgatccattatctgaaggaaatgcaggttccatcaatatcagcaatattttaactgggaaatgccttgctaaaataagagcaagcaacaacaaggaaattgaatgtggcagcagctgcaattcgaagaagcgggccctttcatccagaattagaagtacagttgcagaagccttggaagatattactgctctcttctacgacgaagagcggaacgagatctacacgggcaataggcttggtctagttcatgtatggtctaactaatggtttcataagtcagtttattcaccatgtatgcccccccacccaattagattctttgttggtcttctagatggttgaattgattgtgctgcctgcccccactgcaacgacttcctagaacaactgtaccatgaattgcccttgtaccagtaatccctctgtttacgtaaatccgaattccttccttgttgtgtctgtctgtgttgagcttgaaaacttatttatagagtgcctttttcatggtggtgtaatataaatgtagaattgagtttgcctc

SEQ ID NO: 7622 - DNA, 2214 bp, Quercus alba
tctttaataaaaaatcacaaaaaaacctctccatcttcttttcttttattactctcctaagtctccgactcctactccgagaactctctccatctctctctctcttgtcataacaaatgatagatttagagttcagagattacaacactgacagatctctctctccttttcttcttcctttgatttgattcataagagagagagagagtttgagttatgcagttttaaggcggtgttgtttttttgactttttgagtttagggtttggaaaaaaaatggaaggcggccccgggcatcggttatcggcgccgtgctggggcagaagggtaatagcgaataacaagaagagagtgagaggaggagacgggtgcataaacagcgttaagaagcttcaccgccgcgagatttcttcgaaccgcaatcgcgctttttccatcaccaatgctcaggagagattccgcaacatgcgtttgatggaagagtatgacactcacgatccgaagggtcacaattccccagttttgcctttcttgatgaagagagccaaagtcattgagattgttgctgcccgtgacattgtcttcgctttagcccattctggcgtctgtgctgctttcagtagagagacaaaccaaaggatatgttttttgaatgtgtgtcatgatgaagtcattcggagtttgttttataataagaacaatgactcccttattactgtctctgtttacgcttctgacaacttcagttctttgaaatgtagatccacaaggattgaatacattcggaggggaaagccggatgcgggttttcctctttttgagtctgagtctttaaagtggcctgggtttgtagagtttgatgatgttaatggaaaggtgctaacctactctgcacaagatagtatatacaaggtgtttgacctgaaaaactatacaatgctttactctatttcggataaacatgtgcaagaaatcaagatcagtcctggaatcatgttattgattttcaatagagctagcagtcatgttcctcttaagattctatcaatagaagatggcacagttctcaaatcattcaatcatctacttcatcgaaacaagaaggtggacttcattgaacaattcaatgaaaagcttcttgtcaagcaagaaaatgaaaatcttcagattctcgatgttcgaaatgccgagctgatggaagttagcagagctgagttcatgactccgtctgcatttatctttctttatgagaaccagttattcctgacattcagagatcgaactgttgctgtttggaactttcgtggggagcttgtgacttcatttgaggatcaccttttatggcatccagactgcaacacaaataacatatatattacaagtgaccaggatcttattatatcttactgcaaggctgattctgatgaacaatggatggaaggaaatgctgggtctatcaatatcagcaacatcttgactgggaagtgcctagctaaaataaatgccaccaacggcattcccaagggtgatgagtgtagcaccagtgctggcagctcaaagaagcaggattactccaaagtgagaagcacagttgcagaggctttggaagacattactgcccttttctatgatgaagaacggaatgagatatatactggtaacaggcatggtctggttcatgtgtggtctaactgaaaatagattgttctttagtttgccatgggcactaagactgtcgtcagaggattggcttttcttttggctagccctgttgcatatatcatgatgggatagcttcagtgcactctatggtttttcatgaggctttcagagtgatcttggattgtatcatttgttgatctgtgtaattcttatgtaattttgtagatttgcttttagggaaatataggctgcctgattgagatgcaaggatgacatgcctttagaaatctagcaaattatgtgcgaatctctctctctctctgagttagatcccaacaagtctgattttctgtgtactttttaatgaacaattaaacagaatgagtttatatcactattaccaggagtgcaaatatagtagtagcaggactaggatggtattactgtgctaccttctcctatgagagattatcttttaagtttcacaatcttctgtttgccatgatgtacacgatttcattcaaggaattatatgaaaaaaagccacaatgga

SEQ ID NO: 7623 - DNA, 1425 bp, Cleome gynandra
aggagagaatcttagattagacatcttctggatcttcctttcccaatctgtctgcgactgcgatttccacagcgcagcaccggcagctttgtatctgccctttttagggtttcgtcgggttttcgcggcgtcttcatcttccttctctttccgagttagggtttccgatctgatcttggaaactcggaggaagcagatggagggaagaaggattacagctagccctagaccctgtagcggaagaagggttgtcgccaagaagaggtctcgccccgatgggttcgtcaacagcgtcaaaaagcttcaacgccgtgaaatctcttcccgtaaggaccgatctttctccattagcactgcccaggagaagttccgcaacatgcgcctcgtcgagcaatatgacacacatgatcccaagggacactgtttagttgcacttccctttttgatgaaaaggacaaaggttatcgagatagtggcggcccgagacattgtctttgctcttgcccattctggtgtttgcgcggccttcagcagagagacaaacaaaaggatatgtttcttgaatgttagtccagatgaagtcatccgcagcttgttctacaacaagaacaacgattctctcattacagtttcagtttatgcttcagacaactttagctcattgaaatgtagatccactagaattgagtatattctgagggcccaacctgatgcgggttttgctctatttgagtctgaatcattgaaatggccaggtttcgtagagtttgatgatgttaatgggaaggtgctgacatattcagcacaagacagtgtgtacaaggttttcgacctgaaaaactatacgatgctgtattctatatctgataaacatgtccaagaaataaagatcagtccaggaataatgttattgattttcaagagagctacgagtcatgttcctttgaagattctttcaattgaagatggcacggttctcaagtccttcaatcatttgcttcatcgaaacaagaaggttgattttattgaacagtttaatgaaaaacttctcgttaagcaagagaatgagaatcttcaaattcttgatgttcggaatgctgagcttatggaagtcagcagaacagaattcatgacaccatctgcattcatctttttgtacgagaatcagttgtttctaacgttcaggaaccgaactgtttctgtttggaattttcgaggtgaactcgttacatcctttgaggatcatcttctgtggcatccagactgtaatacaaataacatctacataacgagtgaccaggatctcatcatttcgtactgcaaggcagatactgaagatcagtggatcgaaggcaacgctgggtcgattaacatcagcaatatcttgactgggaaatgcttagctaaaattacagcaagtagtgg

SEQ ID NO: 7624 - DNA, 5227 bp, Vitis vinifera
aaaagaaaatgatcaatataaatcacactttccatagcaaagagcatagacaaagcacttaacagattgacaggtttggagatggtggtgattggaaatggcaagttatccaaccttgttcaatcaaagagtggtggaggctctgaaatcatgccaggagaggagggagcctccactgatatgggtgacagaggtggtggaatgtgtggagtcggcaggtctagtgttgccgagtgtggagttagggcaagttttggtgtctcagctgtgtttcacccaaaacagtccctctagatggaagttcttggaccatgccatctcctgcggccttctctctcacttccatgtcctctctcagctcacttccaggattatacctcatcggtggtctcaaccagaagcttatagactctatcttgaacttttaagtcgatatgctttctcatttcatccggtggagccagatgcttccaaagagaggataatcaaatcagttgatgctgcccttcagctttccaagacttaccaggttcatgtactggagcttggacatacaatggttttgttctttttcagcattgttgttggcttattagatagcaccttggatgattggggcttgccagtgacatttctggacagagcaagtggagttgccaggagtggagactacctgaatatggacatcgactctaaaggaaataaaaacttcaagcaaagtgaacatcgtgagcaaatgaggagaacaaattctttcttggcgatggaggtattaggcacactaatggaaaatagaaaagctaaggttctgctccgccttgtccacttgaacatgcctgaaggcttcaatggcctcctgcgaaggattcagtttcttgaagctcataaactggcatcatcaattttaaagtctgctaatcaacttttggtaagactttctgcaaacatccgaggagttctggattttgagtatcagttgaacaagcaccagctcattggaatgcttattgatattgggtcaaataagttggtctctggctgcaattttgaagctgttcagtctgcgtgttgggttccatttgatatttatatggagaatgtgatggatgtaaaacaccttccggtcagatcaactattgtcatacttagagaaactattcgtacgctacaaggatttaatcgggcaagctggcaagaaaccttcctagcgctctggctttcagcccttcggcttgtgcagcgagagcgtgatcctttggaaggacctattccacatcttgagtcccgtctttgtatgcttttgtctattgcccccttggcaattactcagcttctggaggatgaggtcaattcttgtaactcttcttctcaaggaggtagagaatatggatatacagagattggatatggacatgaaatggataggaaatgtcatgcttcaagaaaacatggactgatttcctctcttcaagtccttggacacttttctgcactcttatgccctccctcatcaattgctgatgcagcaaatcttgcagctgcaaaagcagcaggcttcatttctaattccaagaatggtaaggacagtttaggtggaggcagtcatggcaataccattgtgaaatcaggtggcaacatgaggcacctcatagtggaagcttgcattgcaagaaagttaattgatacatcagcatatttctggcctggctatgtgtctgcatctgtaatctcaatgtcagattcatcaccaattcaaggatctccttggtcaacatttatggaaggagctcctttgacaggccctctgattgatgctcttattgcgattcctgcatcaagtttagcggagttagagaagttatatcatgttgcactaaatggttcggaagaggagaagtcagcggctgcaaagattctatgtggtgcatctctcagacgtggatggaatattcaggaacatgtggtacactctatggtgaagcttctctctcctcctatacctcccaattttactggaacaaggagccatttaattgattacctgcccatgttaagtgccattctttttggggcttcctctattgatactgtgcatatactttctttgcatggtgtggcagtcaatgtattgccacaactcattcaaaaggacattatagaaagcagtgatcagctgtcttgtcactgcctctgtataaaatacactttccagtttgatgcctttattacttcttatctgaagcatattatcagtattcactttcaattacttgtatctcaggacgaggaagagcaattggtagtgagcttactctggagtatcttttgatattgcgcaataaccgtattgcctcacataattctgctgcgcatgatgaaacgagtagcagtttgaaccggattgaatcaacatcagataaacctgtgtatatagattcttatccaaaattgcgagcctggtattgtcaaaacagatcttgtattgcctcaactctatctggcctatgtaatggaagtccggttcatcaagttgctaataagatcttaaatatgatttactggaaaatgactaaaagtggggcctcatcaggtaatccttcaacaccatcaggcagtagcataagtgggagcactgccagtactggagaagatgcttaccaaaggcctatgctccctgcatgggaggtgttggaagctgtccctttggtgcttgaggcaattttaacagcttgtgcccatggaatactttcatcacgggacttgacaacaggtctcagggaccttgttgactttctgcctgcttctcttgtagttattattagttacttttctgcagaagtttctcgtggtatatggaaactagtcccaatgaacggaaaggactggcctagtccagcagcaaaccttctatcagttgaatctgaaataaaggaaatacttgcagccataggcgttgatgctcccagatgtagtcctggtaaatctgacaactactttgttatgtcttcttgttatctttttgaaacatacaatatttttcttccttattatttattttattatttttggcttctatcatttgatgtgtgcctttttttcttttccattttatttgacaaatctttggattcaactgcaatgcttccattgccaatggcagctcttctcccttctcactctccctcccactcaaaaggagtcagaatcactcttgttcccagttttccattgttttctcttctctctaagagaaatagccctcaccctaggcctcactccaaaatcccaatttctccacattttttcatccaaaccatccacaaatttgttcaatcctccgcaattttgaagcaaaattgcaatggaggggcggaggatatcggcaatccctcgcccgtgcgccggccggcgagtttcggcctcgaagaagcggccacgtgtcgacgggtttctcaacagcgtcaagaagcttcagaggcgcgagatttcgtcgaggcgagaccggggttttagtatcagcaatgcccaagaacgatttcgcaacatgcggttgagggaggaatatgatacccatgatcccaagggaccttattcgccggtactaccttttaagagaacaaaagttattgagatagtggctgcccgtgacattgtctttgctcttgcacattctggtgtttgtgcagcttttagcagagagacaaatgaaaggatatgtttcctgaatgtgagtccagatgaagtcattagaagcttgttttataataagaacaatgattcgctaatcactgtttcagtttatgcgtcagacagctttagctctttgaaatgcagatccacaaggattgaatacataaggaggggcaagcctgaagaaggttttgctctctttgaatctgaatccttgaagtggcctggctttgtagaatttgatgatgttaatggaaaggtgctaacttactctgcacaagatagcatatacaaagtgtttgacctgaaaaactatgttatgttgtactctatatctgatgaaaatgtgcaagaaataaagataagtcccggcattatgttattgattttcaatagagctacaagtcatgttcctcttaagattttatcaatagaagatggcacagttctcaaagacttcaaccatctacttcatcgaaataagaaagtggacttcatagaacaattcaacgaaaagcttcttgtcaagcaagagaatgagaatcttcagattcttgatgttcggaatactgaactgaaagaagttaacagaactgagttcatgactccctctgcatttatctttctgtatgagaatcagttgtttctaacatttagaaacagaactgttgctgtatggaacttccgaggggagcttgtaacgtcatttgaggatcacctgttatggcatccagactgcaacacaaataacatctatataacgagtgatcaagatcttattatttcttactgcaaggctgattctagtgatcactggacggaaggaaatgctggttctatcaatatcagtaatattttgacagggaaatgcctggctaaaataaatgctagcgatggccgccccaaggtcgaggagcgaaagaggaggagaactggcagctcctgcatgattagaagcacagttgcagaggctttggaagacataactgctcttttctatgacgaagaacgcaatgaaatctatacaggtaacaagaacggcctggttcatgtatggtccaactgatgccctgtttgcttgaattttgctcctgatgatacacgctgctgctggagggtggccattcccaccaggctgccttaccataaaagcactaacttgggcagagtgtatcatgaaatgatccaaaagtacttctctctctatctgtgttagatttgtcattcaaccttctgttgatgttcattttggctcatttaggctgcctgaatgagagataagagctaatgtaccagtagatatatcaaagcatctgtaggaatttgattaccgatcattggatgtacaatagtttgaatttttctttttgtttctaatttgttattgtgctaccattgtgtaattgaatgggcagatgatgttgaatttatttgggaagtagagaagctttcatatatcatcaattgaaagaacttgagtgtaccctacaaaaaatgaagggtatatgggtggtggttccactgatatgtaattctc

SEQ ID NO: 7625 - DNA, 2108 bp, Populus trichocarpa
cctccctcccttaagacattattattattattattattatttttattactcttctgaagagagagacagagagatcaatttcttttctctagggtttggtgttccaagcgcagaagcatattaaaaacactgaaggaggaggaagaggaagacagacagactgctagcaggctaattagtttctgtaaattagggttttttcctcctcctcctcttttttattatttattaaaatcaattcaaattttgaaagagagagagagagagagggaagatgatgatggaagggtcagggaggaggatatcagcagcgaatccaaggccgtgttcggggagaaggatattagcagccaagaaacggggtcgatctgatgggttcttgaacagtgttaaaaagcttcaaagaagagagatttcctcaaagtcagatcgttctttcagtatcaccaatgcccaggagagatttcgcaatatgcgcttgatggaagaatacgatactcatgaccccaagggccattgttcgatggtgctgccctttttgatgaagagaactaaagttattgagattgtggccgcccgggacattgtctttgcccttgcacattctggtgtatgtgctgcttttagtagagagacaaatcagaggatatgttttttgaatgtgagtcctgatgaagtcattcggagtttgttctacaataaaaacaatgattctctcatcactgtttcggtctatgcgtcggataacttcagctccttgaaatgcagatcaacgagaattgagtacattcgaaggggtaagccagatgcaggtttccctctttttgagtccgagtccttgaagtggccaggttttgtggagtttgatgatgtcaatggaaaggtgctaacgtactcagcacaagatagtatatacaaggtttttgacctaaaaaactacacaatgctgtactccatatcagatacagatgtgcaagaaatcaagatcagtccgggcatcatgttattgattttaaatagatcaagtggctatgttcctcttaagattttgtcaatagaagatggtacaattctcaaagacttcaagcatcttcttcatcgaaataagaaggtggacttcattgaacaatttaacgaaaagcttcttgtcaaacaagaaaatgagaatctccagattcttgacgttcgacatactggtattagggaagttagcagaaccgacttcatgacaccatcagcatttatctttctgtatgaaaaccagttgttcttaacattcagaaatagaactgttgctgtttggaattttcgtggagagcttgttacttcattcgaggatcatctcttatggcatcctgactgtaacacaaataacatttacataacaagtgatcaggatcttatcatttcatactgcaaggctgattctgacgatcaatggatggaaggaaatgctggttctatcaatatcagcaatatcctgacaggaaaatgcctagctaaaataaatgccaccaatggcagtcccaaggacgaggaatgcagcagcagcacaggaagctcaaagcagagccgcttgatgatgagaagtacagtggcagcggctttggaagacataaccgctcttttttacgatgaagagcgcaatgaaatctacactggtaataggcatggtctggttcatgtgtggtctaactaaagaggagttttcattattttgattttgaaactgcaagaaggggatgttgtgtcatgcctgcactacataacttgagtgcgcactgtatcattagattgcatcggcattatttgtatcggtagatattcttggactgcagctgtagctgtctgtacattagtatataggcttcttgattgggattcggaggaggcttaaatcttgatgttgtctccatgtatactagattgtagttttctaaattctagtgtctaattgtgtttggattttattttattttattttatttaaagaaaaacataattttaagttgtgttgtgtcactcgcaataaatcacaacataataattgcgaggttgtataaaacataaatgataataattcttggaatccccaaaaaattaaatca

SEQ ID NO: 7626 - DNA, 2009 bp, Euonymus alatus
tattggaccttctgtagctgcaatattttaaaagagatactactctcctccctcacagggcttggcgtttcccgatctgacgtcaccgattaacgatcactgggaaggaagacatagactctctccgtgttctctttgttgggtacttgaagaactaggattagggttttggatttggggttgatgtgttggaattagggttcgaagaagaggaaggaagaatcacgcataaaatgtgttggtgaagtaaaatttagtagtagatggaagggcggaggatatcggcaagccctaggccgtgctctggaaggcgggtggtggccaagaagagagctcggtcggatgttataatgaatagtgtgaagaagctgcagaggcgcgagatttcctcaaagagagatagagctttcactgttagcaacgcccaggagagattccgcaacatgcgcttgacggttgaatatgacactcatgatcccaaggggcattgttcagtggtactcccctttctggtgaagagaacgaaagttattgagattgttgctgccctcgatattgtctttgctcttgcacattctggtgtttgtgcagcttttagtagagagacaaacgacaggatatgttttttgaatgtgagccacgatgaagtcatccggagcttgttctataataagaacaatgattcccttatcacagtctcagtttatgcttctgacaattttagctctttgaagtgcagatccacaaggattgaatacataagaagaggtaagccagatgcaggatttgctctttttgagtcagagtccttaaagtggcctggatttgtggaatttgatgatgttaatgggaaggtgctaacttactctgcacaagatagtatatacaaggtgttcgatctgaaaaactataccatgctctactctatatcagataaaaacgtacaggaaatcaagatcagtcctgggataatgctgttgatttttaatagagccagtagccatgttcctcttaagattctatcaatagaagatggcacagttctcaaagctttcaaccacctgcttcatcgcaacaagaaggtggacttcattgaacaatttaatgaaaagcttcttgttaagcaggaaaatgagaacctccagattcgtgatgttcgaacctccgagctgatggaagttggcagaaatgagtttatgactccttcagcatttatctttctatatgagaatcagctttttctaacattcagaaatagaactgttgctgtttggaactttcgtggggagcttgtaacttcatttgaggatcatttactgtggcatccagattgcaacacaaacaacatttatataacaagtgatcaggatcttatcatttcttactgcagggctgaatctgactatcaatggggagaaggaaatgctgggtctatcaatattagcaatatcttgactgggaaatgcctggctaaaataaatgcgacaaatgcaagtcccacagttgaagagtgcagcagcactagtacaagcaattctaaaaagcggattatcgcagccccaatgacaagcacagtttctgaggctttggaagacataactgctcttttctatgatgaagagcgcaatgagatatacactggtaacagacatggtctggtgcatgtctggtcgaattgaaggggagatgttttgtcattctgatctttgacacggcagggtttcgtacatcgtctaactggggcagatagctgacaccaagtaacggcagtgagaggatggttattctgttccactggctccagtgcaatttaagcttgggagcactgtatcatcaacacgagtttcaaaaccgttttcagattctcattagatttgttaattgttgtgtaataatggttcctgcatatgcccaactaagaagcagcagagatatcatttgtgtacaattgatttttaattgtcggtgttgcttgctgagctgaacaaagtttgccgtataaattgatc

SEQ ID NO: 7627 - DNA, 2248 bp, Eucalyptus grandis
cctttctccttaacttggaggtctccattgttcctccccggctcggcgtgggagctccatttgctccgagagggtcgtggttttcgctttgggcgaagaagcctcatcaaagatccccacaccaaagcccctaacagttccatcccttcgatccccacgtccataatcgaaggaccccacaaccccaatccccctcccaagaacctctctcttcccccctcccccctgtgcaaattcctctttccccaattccagctgagcaccacccgtttctgggttccctcaagaacgccgcgtctcgtcgcgggaatcggtggttcgaggtgaatccgggagggggatgatgttgccccagttgggtcgaggttgaattgcgctgagaggtggtgtccgtggtggggtctgtggtggtgtctgtgggggatgatgatggaagggaggaggatattggcgaaccctaggccgtgctccggccggagggtcgtcgcgaagaagaggccgcgcggggaggggttcgtgaacagcgtgaagaagctgcagaggcgggagattcggtccaagagggatcgcgcgttcagcatgagcaatgcccaggagaggtttcgcaacatgcgattgacggaggaatacgatacccatgaccccagtggacattgttcacctgtattgcctttcctgatgaacaggacaaaggttattgagatagtggctgcacatgacatcgtctttgcccttaaccattcgggtgtttgtgcagctttcagcagagaatcaaacgaaaggatatgtttcttgaatgttacacctgatgaagtcattcggagtttgttttacaacaagaacaatgattcacttattacagtttcagtatatgcatctgacaacttcagctccttgaaatgcagatctacaaggatcgaatacataaggaggggccaaccggatgctggatttgctctttttgagtcagaatccttgaagtggcctggctttgtggagttcgatgatgtaaatgggaaggttcttacttactcagcgcaagatagtatatacaaggtgtttgacttgaaaaactatacaatgttgtattccatctcagacaagcatgtgcaagaaataaaaatcagtccaggtattatgctactgatttttaatagatctactagccacgttcctcttaagatactgtcaatagaggatgggacagtcctcaaggccttcaaccatctacttcatcgtaataagaaggtggacttcatagaacagttcaatgagaagctgctggtcaagcaagaaaatgagaatctccaaatacttgatgttcggaatgctgaagtgatggaagttagccggacggaatttatgactccatcagcattcatctttctttatgagaatcagctgttcttgacatttagaaacagaactgtctcggtatggaacttccgtggcgagctcgtgacttcatttgaggatcaccttctgtggcatccggattgcaacactaataacatctacataacaagcgatcaggatctcataatttcttactgcaaggctgattctgacgatcactgggcagaagggaatgctgggtcaatcaatatcagcaatatcttgactgggaaatgcctggcaaagataaatgcgactaatggcagtccaaaggtcgacgagtgtagcagtgatggcgggaacacgaagaagatgaagttgcttggcgggaagttgaagaagcaaaagctgctgagccactctcagaggatgagaagcacggtctcagaggccctggaggacataactgcacttttctacgacgaagaacggaatgagatatacactggcaaccgtcgcggcttagtgcatgtatggtctaattgaagaacttgtcaattcagttggaagtgtggagagcctgcgaaaaagggcgttgcctgtagaaaagctgtgatgctccccgagcgccctttgatgggcgatggctgcaaagcacgtaggagtatattcaaagtgcagtccgtgttgtaacattaatagttctcttagatttgtttgatgatagcctattgaagatctgttgtatttcggggtagaatgctaatatcaaatgcagatatcaagacatgtatgtttcagaaactcctgcaagattcttcgatctgtgtcatcggttcgatatttgccctgttactaatactgttggcttgccatttattatccaccttggtcagattggatgcttctgcaa

SEQ ID NO: 7628 - DNA, 2283 bp, Coffea canephora
tgcgtctccagtcccggtccttcccccactgtcactcctctatttacagagaaagggaactatactcaataaaatgcgcacttctcgctgttggtagaaaaggattgatttttacagttccatatgtagaaagagagacttaattgcggttagaaaatctctcaggacctggggctggggctacaaaagctctaatttttcaaattgggttctgagatttttagggtttttctaattgaggagtttgagaagctgagatggcatatatacccgggaaaaatcttctctgtaaataatttggagttcgggaatttttttttctgcttgtaaaaaattgtttctgttgttgtattagtttttttagggttttgataatggatggtaggagaataacggcgagtccccggccgtgctctggacggcgagtggtggccaagaagcgccctcgcggagggatggatggttttgtgaacagcgttaagaagcttcaaaggcgggagatttcctcccggcgtgaccgtgctttcagtatgagtgatgcccaagaacggtttcggaacattcgattacaggaggaatatgatacccatgatccgaagggacagtgttctgtggtacttccgtttcttcggaaacgatcaaaaataatagaaatagtagctgctcgtgatattgtttttgctcttgcacaatctggtgtttgtgcagcatttagtcgtgagactaacgagaggatatgctttttgaatgtcagccctgatgaggttataagaagcttgttttataataaaaacaacgattcacttatcactgtttcagtttatgcttcagataatttcagctcactcaagtgcagaactacaaggattgaatacatccgaaagggtaaaccagatgctggtttccctctttttgagtcagagtcattgaaatggcccggttttgtggaatttgatgatgttaatgggaaggttctcacatattctgcacaggatagcatatacaaagtttttgacttgaagaactacacgatgctgtactcaatatcagataagaatgttcaagagattaaaatcagtcctggaatcatgttattgatatttaccaaagcctgtggtcatgttccgctgcaaattctgtcaattgaggatgggactgttctcaaatcttttaaccatctccttcatcggaacaaaaaggtggatttcattgaacagttcaatgaaaagcttcttgtcaagcaggaaaatgagaatctccagattctcgacgtccgcaattctgagttaactgaagttagcagaactgaattcatgaccccatcagcattcatatttctgtatgaaaaccagttgttcttgacattcagaaatcgcactgtggctgtttggaatttccgtggtgagctggttacctcgtttgaggatcatctgttgtggcatccggactgcaacactaataatatttacatcaccagtgatcaggacctaattatttcttattgcaaagctgattctgatgatccattatcagaaggaaatgcaggttcgatcaatatcagcaacattctgacaggaaaatgccttgctaaaataaaagtaagcaacagctctcccctggacgactgctgttgcagttctagttgtggtgggagaagttgcaattcacagaaacgggtccaagctgctaaagtaaggagcacagttgcagaggcactggaagacattactgcccttttctacgatgaagagcgcaatgagatttatactggaaataggcttggcctggtccatgtgtggtcaaactagggtgatctgatgtttgtaccaggcacccatgtttgcttggttcttctccatatggccagttcattttgcaccccgcattgctggagttggctgggactcttgtatcattagaagcatttcaagtggtttagctttctttttattttcttctgttttatgtgaccatttagctctttatgttgtccctcaaaagcggggatactctatcatgtcataattttcccgtattgtgttcttgaattgctcattttgagcaggaaactagtttttgtcctgtagatgcagcttgaatctagggttgtcggaatgatgtatgtggatattgaattgacaagcagctgtttgttgatatatgtattgcatagtgatccatttggtttaacctgaatatgatgctctccagctccactttagctgctttccttcacctctcgtcacccagggaatatgacgtggtggtaattggtatcatcat

SEQ ID NO: 7629 - DNA, 1711 bp, Malus domestica
tggggtttttctgtgagagaaattgatggaagggggaaggagaatctcggcgagtcctcggccttgcaacggtaggagagtggtggcgaagaaacgacctcgtattggtggggttgatgggttcgtcaacagcgttaagaagcttcagaggcgcgaaatcagctccaagcgcgaccgtgctttcactatgagcgatgcccaagagaggtttcgcaatattcgcctccaggatgaatatgatacgcatgatccgaaaggtcattgtgccatggttctgcctttcctgcgaaagaggtccaaaattattgaaattgtagcagcacgtgacattgtgtttgccctcgcacagtctggtgtttgtgcagcatttagccgagaaaccaaccagagaatatgctttctgaatgtcagtcctgatgaagtgataagaagcttgttttataataaaaacaatgactcacttatcaccgtttcggtttatgcctcagacaacttcagttctttgaaatgcagaagcacaaggattgaatacataagaaggggtaaaccagatgctggatttgctctttttgaatccgagtcactgaaatggcctggttttgtagagtttgatgatgtaaatgggaaggttcttacttattctgcacaggatagtatatacaaggtgtttgatctgaaaaactacacaatgttgtactccatatcggataagaatgtccaagagattaagatcagccctgggatcatgctgttgatttttactaaagctagtagccatgttcctcttaagattctgtctatagaggatggtactgtccttaaatcctttaaccatctccttcatcggaataagaaggtggatttcatcgaacagttcaacgaaaagcttcttgtaaagcaagaaaatgagaaccttcaaattcttgatgttcgcaattttgagatgacagaagtaagcagaactcaattcatgacaccatcagccttcatatttctgtatgagaatcagttattcctgacgtttcggaatcgaaccgtggctgtttggaactttagaggagaacttgtgacttcgtttgaggatcatcttttgtggcatcccgactgcaataccaataacatatacattacgagtgaccaggatcttatcatttcttactgcaaggccgattctgacgatccattatctgaaggaaatgctggatccataaatatcagcaatatcttgaccggaaaatgccttgctaagataagagcaaccaacaacgctgaaaaagaatgcacttgtagtggtgagtcttgtggtagcagttgcaattcgaagaagcgggccctttcatcccgaattaggagtacagttgcagaagccttggaagacattaccgctctcttctacgacgaagagcgcaacgagatttacacgggcaataggctcggtctagttcacgtatggtctaactaatggttctccgagtttattctccatgtcgattagattctttcttggtcttctagatggttgaatcgatcgcgctgccccccccaccgcaacgactccctagaactgtaccattagtttgctcgtgtaccatcaatccctttgtgttgcctgaaatccgaattcgttccttgtgtctgtgttgagcttgagaacttattttatagcgactctttcatggtggtgtaatataaatgtagaattgagtttgcc

SEQ ID NO: 7630 - DNA, 2285 bp, Amsonia hubrichtii
aacccatctccccgtcttctttctagacaaatttcttctaatcttcagaagagattaggaatgaatgagtccgtatacagatagagttattcgtataattaattcttgtgggattcccgaattttctttctcaaatgttgttctactagaaccctaatttttcaaattgggtcctgagattttaacagtttgaagagtctagagctcgaaatctgcttgcggagacatgttcatttgcaagaaatctgtttggtgaaaattgaagctgatagatacacacatacatatacttcagatatatgtgtgtgtgcatatggaattactgtagataatcttgggttggtttttcattattgtataaacaataattgttgtatcataagttttaggggttttgaaatggacggtagacgaataacggcgagtccgcgcccttgctctgggcggcgtgtggtggcgaagaagcggcctcgcggtggtatggatgggtttgtcaatagcgtcaagaagctccaaaggcgggagatttcttccaagcgtgaccgagctttcagtatgagtgacgcgcaagagcggtttcgtaacatccgattgcaggaggaatatgatacacatgacccgaaggggcaagttagcatggtcctgccatttcttcggaagcgatcaaaaattattgaaatagtagctgcacgtgatatcgtctttgctcttgcacaatctggagtctgtgcagctttcagcagagagactaatgagaggatatgctttctcaatgtcagtcctgatgaagtcataagaagcttgttttacaataaaaacaatgattcacttatcaccgtttcagtttatgcttctgataatttcagctcattgaaatgcagaaccacaaggattgaatatatacgaagaggaaagccagatgcaggtttccctctctttgaatcagaatcactgaagtggcctggttttgtggagtttgatgatgtaaatggcaaggttctcacttattctgcacaagatagcatatacaaggtatttgacttgaagaactacacaatgttgtactccatatctgataaaaatgtgcaggagatcaaaatcagcccaggaattatgttgctgatatttaccaaagctagtggtcatgttcctctaaagattttgtcaattgaggatgggactgttctcaaatctttcaaccatctcctccatcggaacaaaaaggtggatttcattgaacagttcaacgaaaagcttctcgtcaagcaggaaaacgagaatctccagattcttgatgtccgcaattctgagttaacagaagttagcagaactgaattcatgaccccatcagcattcatatttctgtacgagaaccagctattcttgacattcagaaatcgaactgtggcagtttggaacttcaggggtgagcttgtgacttcatttgaggatcaccttctatggcatcccgactgcaatacaaataacatttacatcacaagtgatcaggacctaattatctcctactgcaaagccgattctgatgatccactgtcaggaggaaacgcgggttcgatcaatatcagcaatatactgacagggaaatgtctcgccaaaataaaagcgagcaatggtgttcctttggacgattgcacttgtgatgctgactgtggtgggagaagttgcaattcaaggaaacgagtcaaagctagtatgaggagcagtgttgcggaagccctggaagacattactgcacttttctatgatgaagagcggaatgagatttacactggaaacaggcttggtctggtccatgtgtggtctaactaaagtttgtggcagcatcatgcttatatgatagttcttagagatgatgaattcgttcagtgaccatcctttgcaagtggtgtaattttcatatcctgtggttctcatttgtatcaggttgtgtagctttctgtcctgtccccctaaaggtggattctatatttggtgttagacaatttccctgtgtgcttttgacttgcttttttgggtcgttgcatttgagtaagatgttagacaagctcatttgttatagatgacaaagtttgtaagctagtgatgttgaatgatcttatagttggcatttaagtaactagcagctgtttcctggcaattggattgagagtttgttgtttgatttggccagggcgatatgctttagatgaagtaaagcttaaataggtatccgacttgtattttgccgacggttttgtgaataactaacgtgagcctattgaatc

SEQ ID NO: 7631 - DNA, 1679 bp, Tripterygium wilfordii
gaggatatcggcgagtcctaggccctgctcggggaggcgggtagtggcgaagaagagagctcagtcggatgttataatgaatagcgtgaagaagctgcagaggcgcgagatttcctcaaagatagatcgagcttttactgtcagcaatgcccaggagagattccgcaacatgcgcttgacggttgaatatgacactcatgattccaaggggcattgttcagtggtactcccctttttggcgaagagaacgaaagttattgagattgtcgccgcccgcgatattgtctttgctcttgcacattctggtgtttgtgcagcttttagtagagagacaaatgaccgaatatgttttttgaatgtgagccctgatgaagtcatccggagcttgttctataataagaacaatgattctcttatcacagtctcagtttatgcttctgacagctttagctctttgaagtgcaggtccacgaggattgaatacataagaagaggcaagccagatgcaggatttgctctttttgagtctgagtccttgaagtggcctggatttgtggaatttgatgatgttaatgggaaggtgctaacttactctgcacaagatagtatatacaaggtgttcgatctgaaaaactacaccatgctctactctatatcagataaaaatgtacaggaaatcaagatcagtcctgggataatgctgttgattttcaatagagcgagtagccatgtgcctcttaagattctatcgatagaagatggcacagttctcaaagctttcaaccatctgcttcatcgcaacaagaaagtggacttcattgaacaatttaatgaaaagcttcttgttaagcaggaaaatgagaaccttcagattcgtgatgttcgaacctctgagctgatggaagttagcagaaatgagtttatgactccttcagcatttatctttctatatgaaaaccagttgtttctgacattcagaaatagaactgttgctgtttggaactttcgtggggagcttgtaacttcatttgaggatcacttactgtggcatccagactgcaacacaaacaacatttatataacaagtgatcaggatcttatcatttcttactgcagggctgaatctgactatcaatggggagaaggaaatgctgggtctattaacatcagcaatatcttgactgggaaatgcctggctaaaataaatgtgacgaatgcaagtcccacagttgaagagtgtagcagcagtagtacaggcaattctaaaaagcggattgtcgcagccccaatgatgagcacagtttctgaggctttggaagacataactgctcttttctatgatgaagagcgcaatgagatatacactggtaatagacttggtctggtgcatgtctggtcgaactgaagagaggatgttttgtcattctgatcttggatacacacgtgaagaacacggcagggtttcgtgcattgtctaactggggcagatagctggcactggaacgtcagtgagaggatggttattctgccttgctggctcgagtgcattttaaccttgaagcactgtatcattagatgagtttcaaaaccgttttcagattgtatcattagatttatttgattgttgtgttgtaatggttcctgcatatgtatgctgcccgactaagaagcggtgatgg

SEQ ID NO: 7632 - DNA, 1310 bp, Manihot esculenta
ccaacactgttaagaagttgcagaggcgcgaaatttcttctaagcgagatcgtgctttcagtatgagcaatgcccaggagaggtttcgcaatatgagtttgacggaagagtatgatactcatgatcccaagggccattgttcagtagttctaccctttttgatgaagagaactaaagtcatagagattgtagctgcacgggatattgtctttgcacttgcacattctggtgtttgtgcggcttttagtagagaaacaaatcagaggatatgttttctgaatgtgagtcctgatgaagtaattcgaagcttgttctataataagaacaatgattccctcatcacagtttcagtttatgcttcagacaacttcagctccttgaaatgcagatcaactagaattgagtacataaggaggggcaagccagatgctggttttgctctttttgagtctgagtccttgaagtggccagggtttgtagagtttgatgatgttaatggaaaggttctaacgtactctgcccaagacagtgtttacaaggtttttgaccttaaaaactatacaatgctgtactctatatcagataaacatgtacaagaaatcaaaatcagtccaggaatcatgttgttgattttcaatagagcaactagccatgtgcctcttaagattttatcaatagaagatggaacagttctaaaagccttcaaccatctgcttcatcggaataagaaggtggacttcatcgaacaattcaatgagaagcttcttgttaagcaggaaaatgagaatctccagatccttgatgttcgaaatgcagagctaatggaagttagcagaaccgagttcatgactccctctgcatttatctttctctatgagaaccagttgttcttaactttcagaaataggactgttgcagtttggaattttcgtggggagcttgtaacttcatttgaggatcacctcttatggcatcctgactgtaacacaaataacatatacataacaagtgatcaggatcttattatttcttactgcaaagctgaatctgaggaccagtggatggaaggaaaagctggttctatcaatgtcagcaacatcttgacaggaaagtgcttggccaaaataaatgctagcaatggcaatcctaaatgtgatgaacccagtggcagtagctctaagcggattcattcacctataagtacagttgcagaggctttggaagacataacagcacttttctatgatgaagagcgtaatgagatctatactggcaataggcatggtttagttcatgtgtggtccaactga

SEQ ID NO: 7633 - DNA, 2067 bp, Populus trichocarpa
attctcacaatctttcctccttgtcgtttatgctattatcacagtgagagagaaaagagacggagagagatcaatttgtatttcttctattattactattattgttgttgtgaatactcattctctagggtttggtgttccacttcagaagcaagatactgaaggaggaggagaaagagagctagctggctagcctattagtttctggaaattagggttttaatgttattcttcttatttttaataaaatcaattcaaatttgaaaagaagagaggttggtaaaaactgttgcgaatttgaatctctctgtgcgtacgtgcgcgcgcgtggaaaaataaaaataaagaaagagaagatgatggaagggaggaggatatcagcagcgaatccaaggccgtgctcagggagaaggatattagcagcgaagaaacggggtcgttctgatgggttcttaaacagtgttaaaaagcttcaaagaagagagatttcttctaaaccagatcgttctttcagcatcaccaatgcccaagagagatttcgcaatatgcgtttgatggaagaatacgatactcatgatccgaagggccattgttcagtggtactaccttttttgatgaagagaacaaaagttattgagattgtcgccgcacaagacatcatctttgctcttgcacattctggtgtgtgtgctgcttttagtagagtgacaaatcataggatatgttttttgaatgcgagtcctgatgaagtcattctaagcttgttctacaataaaaacaatgattctgtcatcactgtttctgtctatgcatcagacaacttcagctccttgaaatgcagatcaacaagaattgagtacattcgaaggggtaatccagatgcaggttttgctctgtttgagtctgaatccttgaagtggccaggttttgtagagtttgatgatgtcaatggaaaggtgctaacatactcagcacaagatagtatgtacaaggtttttgacctaaaaaactacactatgctgtactctatatcagataaagatgtacaagaaatcaagatcagtccaggcatcatgttattgattttgaatagatcaagcagctatgttcctcttaagattttgtcaatagaagatggcacaattctcaaagatttccatcatctgcttcatcgaaataagaaggtggacttcatcgagcaatttaatgaaaagcttcttgtcaagcaggaaaatgagaatctccagattcttgatgttcgacataccggtattagggaagttagcagaactgagttcttgacaccatcagcatttatcttcctgtatgaaaaccagttgttcttaacattcagaaatagaactgttgctgtttggaattttcgtggagagcttgttacttcatttgaggatcatctcttatggcgtcctgactgtaacacaaataacacatacataacaagtgaccaggatcttatcatttcatactgcaaggctgaatctgatgaccagtggatggaaggaaatggtggttctatcaatatcagcaatatcctgacaggaaaatgcctagctaaaataaatgccaccaatggcagtcccaaggatgaggagtgctgcagcagtactggaagctcaaagcagagctgctccctgatgaaaagcacagttgcagaagccttggaagacatcactgcccttttctacgatgaagatcgcaatgaaatctacaccggtaataggcatggtctagttcatgtgtggtcaaactaaagataagtttttcattgttttgatttaggaacttggaaactgcaaagtagaggatgttgtcatgactgtgctacatatctttagtgcactgtatcattagattgcatcagaattattgattccgtagatatacttggattgtcatgtagcagtttgtacattagtaaataggctgcgtggttgatattcataggttaaaatgtccggacaagaattttttgtaacattcatttgtatttgctgagtaaacaaaatgtttgcttgttaattatcagttgctgctactgatgctggt

SEQ ID NO: 7634 - DNA, 2396 bp, Theobroma cacao
ttgaaacagaaagatagatacaaaataaataaatattaatattaatattgttatattattatgagtatttacttcaattcgaaattgaaaaggagatcggacggcgtcctcactggaatctgagagagaagagattgttactagttcaagttcattactaggaaaacttgttctgtcgatttattagttcaaatagaagaaatatttatcttttgctagaggctagagaatgtttctgtagtagataatccctcagtatagcagtaagcaagccctagaagttggaggaggccgtgaatttgatgggagctgatatccggcgccaccagcagcagcggcttttgggtgtttgcagagctagggttttgtttagagcttaggtagatacaaaggagaaccaaagatatggatggtgggcgtagaatagcggtgagcccaaggccttgcagcggacggagaatagtcgcatccaagaaaagagggagagcggattccttcgttaacagcgtcaagaaacttcagcgaagagaaatctgctccaagcgacatcgtgctttctccatcaccgacgcccaggagcgcttccgtaacattcgcttgcaggaggaatatgatactcatgatccaaaaggacattgttctatggtattaccgtttctgaggaagaggtcaaagataattgagattgtagctgcacgggatattgtctttgctcttgcccagtctggcgtatgtgcggcatttagtcgagagactaatcaaagaatatgctttctaaatgtcaccgctgatgaagttatacgaagcttgttttataacaaaaacaatgattcacttatcacggtctcagtatacgcttcagacaatttcagctccttgaaatgcagaagcacgaggattgaatacatacggagaggtcaacctgatgctggttttgctctttttgaatctgagtcactgaaatggcctggttttgtggagtttgatgatgtgaatgggaaggtactcacatattctgcacaggatagtatatacaaggtgtttgacctcaaaaattatacgatgttatactccatatctgataaaaatgttcaagagattaagatcagtccagggatcatgttattgattttcactaaagtcggtggccatgttcctcttaagattctatcaatagaggatggtactgttctcaaatcatttagtcatcttcttcaccggaataagaaggtggattttattgaacagttcaatgagaagcttcttgtcaagcaagaaaatgaaaacctccagattcttgatgtccgcaatactgagctaacagaagttgacaaaattgaatttaagacaccgtcagcatttatatttctgtatgagaaccagttattcttgacatttagaaatcggacagtggctgtgtggaacttccgtggagagcttgtaacttcatttgaggatcaccttttgtggcatcctgactgcaacactaataatatatatatcacaagtgatcaggatctcattatctcttactgcaaggctgattcagatgatccattgtctgaaggaaatgggtccatcaatatcagcaatatattgactgggaaatgtcttgctaaaataagagcaagcaacagcttccctgtggaaaatgaatgcagctacggttatggttgcagcagttcaaagaagcagagcaatatgtcgagaattagaagcacggtggcggaagcgttggaagatattactgctcttttttacgatgaggagcggaatgagatatacacggggaataggcatggtctagttcatgtgtggtctaactgatggggtttgatgtgattaggaaatgtaatttacttgcgtggaggttgagttggttgtgagtctcacgaaactgtaccattattaagtgttattgtatcaattcattttgtttccgatgttaattcagcccaagccctagcccttttgtgttgcattgtgttatcatttgcgaatgagatgttgcgtagaagggagggggatatttggagagtttgcttcttgtgttaggtaagggaggaaatggatatgagaagcaaagatggtggcatgtggggttgatgaaatcaattgcaactgcagttgctgggatgaagaatgaatgaatgatgaatattgtttgtaagttgcgagagaaaatactttggcaacggacaaggtgcgctccagaccagagcagaccaggcctggtcattgatcagtgatcaatcaattattatatcgtcacatgaccacgtgcgccactttcctttcatccattcttccctttattccattttcatttactacgactattttattttatttatttagattacgagagagagagagagagagagagagagagagag

SEQ ID NO: 7635 - DNA, 2328 bp, Solanum lycopersicum
tttggagtaataatttgggttcacataaatttggtccaaacactatttaagagagtacaatgacagtgaagctcatgattgagagaaaaatgaatgcaccgtcaaaagccctttgaaggtgtatttttgaaatccgacacattgctttctctctctttcatctccggctcctcttgccaaatcccaacactactttttgtaataccagtgaagattatactttgtttttgtagcggttttattcaagaaactatacgagaaactattcttgagtaggcctgtttgttgggggtggaaaagccctaaattttccatctgggtcgttgagatttagggttttaattgaaagccacatcttccattagaactctatagaaagtgtgcattgaagctgttatgttgtgtatatgatgtgcaattagttgtattagggttaagatttgtagaatttgttccttagtgttgtgttcgattttgagatggatgggcggagaatatctgctagtcctcgtccgtgttgtggtaggagggtggtggctaagaagcgttctcgtggaggggttgatgggtttgtgaatagcgtcaagaagttacagcggagggagatttgttcaaagcgtgaccgttctttcagtatgagcgatgctcaggagcgctttcgaaatattcgattgcaggaggaatatgacacccatgaccctaaggggcattgtgccatggtgcttccttttcttaagaaaagatcaaagataattgagatagttgctgcacgtgatattgtctttgcccttgcacaatctggcgtctgtgctgcatttagtcgagagacaaatgagagaatatgctttctgaacatcagtccagatgaagttatacgaagtttattttacaataaaaacaatgactcgctcatcactgtttccgtctatgcatcagataacttcagttccttgaaatgcagaaccacaagaatcgaatatattcggagaggtaaaccagatgcaggctttgctttatttgagtcggagtcattaaaatggcctggttttgtggagttcgatgatgtcaatgggaaagtccttacttactctgcccaggatagcatatacaaggtgtttgacctgaagaattacacaatgttatattcaatatcggacaaaaatgttcaagagattaaaataagcccgggaatcatgttgttgatatttaccaaagctagtggccatgtgcctctgaagattctgtcaatcgaggacggtactgttcttaaatctttcaaccatcttcttcaccgaaataagaaggttgatttcattgaacagtttaatgaaaagcttcttgtcaagcaagagaacgagaatcttcagattctggatgtacgtaattctgagttgacagaagtcagcaggactgagttcatgaccccctcagcgttcatatttctgtatgagaaccagttgttcttgacattcagaaacagaacagttgctgtttggaacttccgcggggagcttgttacttcatttgaggatcaccttttatggcatcctgattgcaatactaacaacatttacataactagtgatcaggacctaattatttcatactgcaaagctgattctgatgatcccttatctgaaggaaatgcgggatctattaatatcagcaatattctgtctggtaaatgccttgctaaaataaaagcaaccagcggcaaggccactgatgattgtaatgctagtagcagtgtacctggtaaaaaaagttacaactcaaataagcgggtccaagattccagaattaggagcacggtggcagaagccctagaagatattactgcccttttctatgacgaagagcgcaatgagatctatactgggaacaggcttggactggtccatgtgtggtctaactgactaattatcctgctcccctgatgtctaagattgttactgatggaggaatgcctcaggtaacattgtatcacttagtatggtgtttttagtcttgtacccaaaggaatgatttgagttgtgtcatctctatttactttaaactgtaccgttggtttgtaatgtggttgcttgggtgattgccctgttagatgaggtattctagatgatttctagtgtactgctagtacttttgtaacttagggctgtctactgagttgtagtcagagctagttaaccagtaagtctcatttaattcagccattctaatgctttaaatggttgagagcacagtgttatgtctaagtgacactgcttgttgtttccttaagtgaatgattcttctctctttagttatcgagtgttcctcccttta

SEQ ID NO: 7636 - DNA, 2068 bp, Tabernaemontana elegans
ctcgtgttctttcggacaaattcttcctctcttaggaaaaacttagccatgttcgtagagtgaagagagctattcgtatagttactgatagagggattcaaattctctctcaattcttgtagaaccctaattttttcgatctgggtcctgagattttaacagtttttaggagttttctaccatcggataaattgaagagcttgaaacgcttgtgcgaaaatatgttcattagccggaagtttgtgtggtgataattggagctgaaagatacacacatacatatacttgggatatatgtgtgtgtgcatatgggactactgtagataattttgggttggattatcttttttttgtacaaacgataattgttgtacaataagttttagggtttttggaatggacgggagacgaataacggcaagtccgcgtccttgctctgggcggcgtgtggtggcgaagaagcggcctcgcggtggtatggatggttttgttaatagtgtcaagaagctccaaaggagggagatttcttccaagcgcgaccgggctttcagtatgagtgacgcccaggagcggtttcgtaacatccgattgcaggaggaatatgatactcatgacccaaaggggcaagttagcatggtgctgccatttctccgaaagcgatcaaaaatcatcgaaatagtagctgcacgtgatatcgtctttgctcttgcacaatctggtgtctgtgcagcattcagcagagagactaatgagaggatatgctttctgaatgtcagtcctgatgaagtcataagaagcttgttttacaataaaaacaatgattcacttatcactgtttcagtttatgcttctgataatttcagctcattgaaatgcagaaccacaaggattgaatatataagaagaggaaagccagatgcaggtttccctctctttgaatcagagtcactgaagtggcctggctttgtggagtttgatgatgtaaatggcaaggttctcacttattctgcacaagatagcatatacaaggtgtttgacttgaagaactacaccatgttgtactccatatctgataaaaatgtgcaagagatcaagatcagcccaggaattatgttgctgatatttaccaaagaaagtggttatgttccgcttaagattttgtcaatcgaggatggaactgttctcaaatctttcaaccatctccttcatcggaacaaaaaggtggatttcatcgaacagttcaatgagaagcttcttgtcaagcaggaaaatgagaatcttcagattcttgatgtccgtaactctgagttgacagaagttagcagaactgaattcatgaccccatcggcatttatatttctgtacgagaaccagctattcttgacattcagaaatcgaacagtggctgtttggaacttcaggggtgagcttgtgacttcgtttgaggatcaccttctatggcatcctgactgcaatacaaataacatctacatcacaagtgatcaggacttaattatctcctattgtaaagccgactctgatgatccgttatcagaaggaaacgctggttcaatcaatatcagcaatatactgacagggaaatgtcttgccaaaataaaagcaagcaacagcgttcccttggacaactgcacctgcaatgctgattgcagtgggaaagcttgcaactcaaggaaacgagccaaagctgcgagtatgaggagcaccgttgcagaagccctggaagacattactgcacttttctacgacgaagagcgcaatgagatatatactggaaataggcttggcctggtccatgtgtggtctaactagaatttgtggcagtggctcgttttgcacccatgtttctatgaatagttcttagagatgatgaaattcattctgcaaccttcctttgcaagtggtgtaattttcatttcctgtagtttatcaggttgtctagctttcttctgtccccccccaaaggggggattttttgtttggtgttagacaatttccttgtgtgctttgacagtcctctattatagatgtaaaagtttgtaatttagag

SEQ ID NO: 7637 - DNA, 1890 bp, Gossypium hirsutum
gaattgaaaaggagatcgaaacggtatgctaacgggaatctgagatagaaaggagaagataagaagaaaaattacatctttaccttccggtacgcactacataatcgcttgctgtacataatagtactaagcaagccctagatttggaggttttaggcggtggaggcggcggcggtggctgttaattttgatgggtgctcaactggcagcaccaccaccaccagcgactattgggtgtttgctgaattagggttttttgtgtagaccttacttagattcgaaggagagaaccacaaaaaaagggaaagatatggatggtgggcggagattagcggttagcccaaggccttgtagcggacggagaatagtcgcatcgaagaaaagagggagagcggatgggtttgttaacagcgtcaagaagcttcaacgaagagaaatttgttcaaagcgacaccgtgctttctccatcaccgacgcccaggagcgtttccgtaacatccgcttgcaggaggaatatgatactcatgatccgaaaggacattgttcgatggtattaccatttctgaggaagaggtcaaagattatagagattgtagctgcacgagacattgtctttgctcttgctcaatctggtgtttgtgcagcatttagccgagagactaatcaaagaatatgcttcctaaatgtcaccgctgatgaagttatacggagcttgttttataataaaaacaatgactcacttatcacagtctcagtttatgcttctgacaatttcagctccttgaaatgtagaagcacaaggatcgaatacatacggagaggtcaacctgatgctggctttgctctttttgaatctgagtcactgaagtggccaggttttgttgagtttgatgatgtaaatgggaaggtactcacatattctgcacaggatagcatatacaaggtgtttgacctaaagaattatacaatgttatactccatatcagatagaaatgttcaagagattaagatcagcccagggattatgttattgattttcactaaagttggcggccatgttcctcttaagattctttcaatagaggatggtactgttcttaaatcttttagtcatcttcttcaccggaataagaaagtggatttcatcgaacagttcaatgaaaagcttcttgtgaagcaggaaaatgaaaacctccagattctcgatgtacgcaatgctgagctaacagaagttaggaaaaatgaattcatgaccccatcagcatttatatttctgtatgaaaaccagttattccttacatttagaaatcggacagtggccgtgtggaacttccgtggagaacttgtaacttcatttgaagatcaccttttatggcatcctgactgcaacaccaataatatatacatcacaagtgatcaagatcttattatctcttactgcaaggctgattctgatgatccattgtctgaaggaaatggctccattaatatcagcaatatattgaccgggaaatgtctcgcgaaaatacgagcaagcaacagtttcccagtggaagaacaatgcagctgcagtgacaaatgtggttgcagttcaaaaacgcagagcaacgcgtcgagaattagaagcagggtcgcagaagcattggaagatataactgcacttttctatgacgaagaacgcaacgagatatatacgggtaataggtacggtctagttcatgtgtggtctaactaagggtttgattttggttaggatgttatgtaatattagttgagtggtttgtgaattggggcattgtgattgtcatggaactgtaccattattaactattattgtatcgaaaattcatttagtttctgctctaaatgatattattattaggctttatt

SEQ ID NO: 7638 - DNA, 2042 bp, Eucalyptus grandis
acgagacgaaacgaaacatacgctctcctgcacacagagagagaccccacagcgcacggtgtccgttccacctctccactcccgtcgtctcgctcgcgcccgcgcgcggcggaactcgagctcactcccccccccgtcggaaacccccgctctccgtccccatttcggcggcgtctggtgagttcgttggtcgcggggtgagggcgggatagggcttcagtggagcgcgcggggaagctgtggcgaggcgagcgagcgggggaatcgagaagaggaggggtggggggagagtggagtcgacggtcatgccgatctctgtagtttagaagtgcgaagcattttgcgctcgtgcgtgagagggagagggagaggggggaagtatggaggggaagcgggtatctgcgagtccgaggccctgcagcgggaggagggtgctggcttcgaagaagaggccgaggtggtggtgcggcggggatgggctcgtgaacagcgtcaagaagctccagagacgcgagatcagttccaagcgcgaccgcgctttctcgatgaccgacgcccaggagcggttcagaaacattcggttgcaggaggaatatgatacccatgacccaaagggtcattgtgccatggtcttgacttttttgagaaagaggtccaagattattgagattgtagcagcacgtgacattatctttgcccttgctcaatctggtgtttgtgcagcctttagtcgagagacaaatcaaaggatctgctttttaaatgtcagtcatggtgaagttattcgaagtctgttctataacaagaacaatgactcacttatcacagtttcagtttatgcatctgacaacttcagctccctaaaatgcagaagcaccaggattgagtacataaggaggggtaaacccgatgctggctttgcgctttttgaatctgaatcactgaaatggcctggttttgtggagttcgatgatgtgaatgggaaagtacttacgtactctgcccaagacagtatatacaaggtatttgacctaaagaattacacaatgttgtactccatatcggataaaaatgttaaagaaatcaagataagcccgggaatcatgttgttgatatttacaaaagctagcggtcatgttcctcttaagattctttccatagaggatggtactgttctcaagtcattcaatcatctcctgcatcggagtaagaaggttgattttattgaacaattcaatgaaaagcttttagtcaagcaagaaaacgagaatctccagattcttgatgttcgtaactttgagttaacagaagttggcagatctgagttcatgacaccctcggcatttattttcctctatgaaaatcagttattcctcacttttagaaatcgaactgttgctgtgtggaacttccgtggagagcttgtaacatcatttgaagatcacctcttgtggcatccagattgcaataccaacaacatatacatcacaagtgatcaagaccttatcatttcttactgcaaggctgatgctgaagaccccttatctgaaggaaatgcaggatccataaatgtgagcaacatattgacagggaaatgccttgctaaagtaaaagctagcaacagtgtccctgtcgaggatgaatgtagttgtagcggtgaatgtagtggtgattgccgttccaagaaacgtgcccgtgcctccacaatcaggagcacagttgcagaagccttggaagacatcactgcactcttctacgatgaagagcgaaacgaaatctatacaggcaataggcatggccttgtacatgtatggtctaactgattgttctcaagtttttagatttaatttctcgaggattcattataatcctcccggatgtttataatgattgtgctgccttcgcacgataaccttttttaagtgtatcattagttcttgtatcggttaggtttgagcttcgtaagctgtatcttagagtgctgatgtaatgactggtacctcttatctaatttgcctttgtctgtttcagaatttgtcttc

SEQ ID NO: 7639 - DNA, 1904 bp, Cannabis sativa
gttggtgtgtatgctgagagttgtttaggagggcgggaagggggttagggttgttgtcaagtccatacactccattcccaatctcactcgcattccaccaattttctgaaattttgttaaggaaacaaatggaagttgggaggaggatttcagcaagtcctcgaccgtgctcggttcgccgtgtttcagctaacaagagaccccgcgccgatggattcgtaaactgtgtgaagaagctgcaaaggcgtgagatttgctccaagcgtgatcgtgcttttagcaccagcaatgccctcgagaggttccgtaatatgcgcctcactgatgaatatgatactcatgatcccaaggggcaattcttatctgaatttccgttgctatcaaagagagcgaaaatcattgagatagtttctgcacatgacattgtcttcgctcttgcatattctggagtttgtgcagctttttgtagagagacaaatgagagactttgttttatgaatgttagtcctggtgaagtcatccgaagcttgttttacaataaaaacaatgattcacttataactgtttcagtctactcctcagacagtttcagctctttgaaatgcagatcaacaagaattgagtacataagaagaggcaagcctgacgccggatttgctctttttgagtctgaatctttgaagtggcctggctttgtagagtttgatgatgttaatgggaaggtgctaacttactctgcacaagatagcatatataaggtgtttgaccttaaaaactacactatgctatactctatatcagataaacacgtgcaagaaatcaaaattagtccaggtatcatgctattgatcttcaatagagctaccagccatgttccccttaaaattctttcaattgaagatggcacagttctcaaatccttcaaccatctacttcatcgaaataaaaaggtagagttcatagaacagttcaatgagaaacttctcgtcaagcaagaaagtgagaatcttcagatccttgatgttcgcaatactgagttaatggaagttagcaaaactgagttcatgactccttcagcatttatttttttgtatgagaatcagttgtttctgacatttagaaatcgaactgtgtctgtttggaacttccgtggggagcgtgtaacttcattcgaggatcatatgttgtggcaccctgattgcaatacaaacaacatatatattacttgtgatcaggatcttataatatcctactgtaaggcttcatccgatgatcattgggcagaaggaaatgctggatccattaatatcagcaatatcctgactggaaaatgcttggctaaaataaactctactaatcatcctctcgaagctgacgactgtggttgcagttctaactgctcaaagcagaaatactctccggtaagaagcacagttagtgaggccttggaagacataactgctcttttctatgatgaagaacgcaacgaaatatacacgggcaataggcatggtctcgttcatgtgtggtctaactaaagatccttttatgtttggatgcttttgagtctattctagtaggggcctcgttagagagaatgttctttcgttgatttttttttttttattattatttatttaatttgttaatgttgcattctttggcacaaaggccttctgagattgagacgtaatcctaggataatgatttgggggttcgcttacataatttgtacatgttttgctatatagtatatacagaatgtctacgttggtagtgtccaatgtgtataaaggaatcatttaattatagggataaaatggtagggttgtttgccagcataatagcttacagttcatcgaatatatcattttcatacctaatttgtttattttaaatagaaa

SEQ ID NO: 7640 - DNA, 1792 bp, Solanum tuberosum
ggagaatatctgctagtcctcgtccgtgttgtggtaggagggtggtggctaagaaacgttctcgtggagggattgatgggtttgtgaatagcgtcaagaagctacagaggagggagatttgttcaaagcgtgaccgttctttcagtatgagcgatgctcaggagcgctttcgaaatattcgattgcaggaggaatatgacacccatgaccctaagggacattgtgccatggtgcttccttttcttaagaaaagatcaaagataattgagatagttgctgcacgtgatattgtctttgcccttgcacaatctggcgtctgtgcagcatttagtcgagagacaaatgagagaatatgctttctgaacatcagtccagatgaagttatacgaagtttgttttacaataaaaacaatgactcgctcatcactgtttccgtctatgcatcagataatttcagttccttgaaatgcagaactacaagaattgaatatattcggaggggtaaaccagatgctggctttgctttattcgagtcagagtcattaaaatggcctggttttgtggagttcgatgatgtcaatgggaaagttcttacttactctgcccaggatagtatatacaaggtgtttgacctgaagaattacacaatgttatattcaatctcggacaaaaatgttcaagagattaaaataagcccgggaatcatgttgttaatatttaccaaagctagtggccatgtgcctctgaagattctgtccatcgaggacggtactgttcttaaatctttcaaccatcttcttcaccgaaataagaaggttgatttcattgaacagtttaatgaaaagcttcttgtcaagcaagagaatgagaatcttcagattctggatgtacgtaactctgagttgacggaagttagcaggactgagttcatgaccccctcagcgttcatatttctgtatgagaaccagttgttcttgacattcagaaacagaacagttgctgtttggaacttccgcggggagcttgttacttcatttgaggatcaccttttatggcatcctgattgcaatactaacaacatttacataactagtgatcaggacctaattatttcatactgcaaagctgattctgatgatcccttatctgaaggaaatgcgggatctattaatatcagcaatattctgactggtaaatgccttgctaaaataaaagcaaccagcggcaaggccactgatgattgtaatgctagtggcagtgtgcctggtaaaaaaagttacaactcaaataagcgggtccaagattccagaattaggagcactgttgcagaagccctagaagacatcactgcccttttctatgacgaagagcgcaatgagatctatactgggaacaggcttggactggtccatgtatggtctaactgactaattatcctgctcccctgatgtctaagattgttactgatggaggaatgcctcaggtaacattgtatcactagtatagtgttttttagtcttgtacccaaaggaatggtttgagttgtgtcatctctatttactttaaactgtaccgtttgtttgtaatgtggttgcttgggtgattgccctgttagatgaggtattctagatgatttctagtgtactgctagtgcttttgtaacttagggctgtctactgagtcgtagtcagagctagttaaccagtaagtctcatttacttcagccattctaatgctttaaatggttgagagcacagtgttatgtttaagtgacactgcttgttgtttcctc

SEQ ID NO: 7641 - DNA, 1983 bp, Gossypium hirsutum
aataataataaatagtactaatattttcaaaaattgaaaaagagatcggacggcaatgcaatgctcactggaatctgaactcacagacaagaaaaggaaagaagcaaaagcgaagcgaagcgaagagatgttaaagatgagggactattctggttgagataatcgctgccctagaatttgatgggagctgatatccgtcatacttagggctttctttaagagctaaataaaagatatggatggtgggcggaggatagccgtcagcccaaggccttgcagcggacggagaatactcgcatctaagaaaagagggagacccgatgccttcgttaacagtgtcaagaaactccaacgaagagaaatctgctctaagccgcaccgtgctttctccgtcaccgacgcccaggagcgcttccgtaacatccgcttgcaggaggaatatgatactcatgatccaaaaggacattgttcaatggtattaccatttctgaggaagagatcaaagattatagagattgttgctgcacaagacattgtatttgctcttgctcaatctggtgtatgtgcggcattcagtcgagagactaatcgaagaatatgctttctaaatgtcactgctgatgaagttatacgaagcttgttttacaacaaaaacaatgactcacttatcacagtctcagtttacgcttctgacaacttcagctccttgaagtgcagaagcacgaggattgagtacattcgaagaggtcaacctgatgctggttttgcactttttgaatctgagtcactgaagtggcctgggtttgtggagtttgatgatgtaaatgggaaggtactcacatattcagcacaggatagtatatacaaggtatttgacctcaaaaattatacgatgttatactccatatcggataaaaatgttcaagagattaagatcagtccagggatcatgttattgattttcactaaagttggcggccatgttcctcttaagattctctcaatagaggatggtaccgttctcaaatcttttagccaccttcttcaccggaataagaaggtggatttcatcgaacagttcaatgaaaagcttcttgtgaagcaggaaaatgaaaaccttcagattcttgatgtacgcaactctgagctaacagaagttagcaaaaatgaatttatgaccccatcagcatttatatttctgtatgagaaccagttattcctgacatttagaaaccggacagtggctgtctggaacttccgtggagaacttgtaacttcatttgaggatcaccttttgtggcatcctgactgcaacactaataatatatacatcacaagtgatcaggatcttatcatctcttactgcaaggctgattctgatgatccattgtctgaaggaaatgggtccattaacatcagcaatatattgactgggaaatgccttgctaaaataagggctagtaacggtttcccagtggaaaagcagtgtagctgctgtgatgtcgagtgtggctgcaggtcaaaagtgcaaagcagttcatctagaattagaagcacggtggcagaagcattggaagatatcactgctcttttttatgatgaagagcgcaatgagatctatacggggaataggtatggtctagttcatgtgtggtctaactgatggtttgattttcagtaggaattttatgtagtttgactccggtggaggttgagttggttgtgaacgggaattgcgagtctcatgaaactgtaccattattatttagtgttaattgtatcaattcattgggctcctgtttctggttttaattcaagtcctacacctttataatttattctgtaattttgttcctgtgtgggactgttgttttatatactgtattattattttgcctctgtatgtcaccacaagggctataaatgagtgcatcattgtttcgattatctcactaaataaatgaaatgaacaaaatcttcagg

SEQ ID NO: 7642 - DNA, 2164 bp, Medicago truncatula
aatcagtgtcagagagtcagattccgagttcagaaaatttgaaacgggatcgacaccaattgaattcgtcattcgtcaactcttttcgttccattttttcttcttcctcttgtcgttctcttgttccttcgttcgttcatgaaactcacacagtaacagtaccttttcgtacaaaaccctaattctcgtttttcagatgggagaattattgttactgtgaggtggtgaagaatatggaaggtaccggaagaagaatcacggtgagtcctagaccttgttgtggccgaagagtcagagtcgacgcgaagaagaccggtcgcggtggtcgaacggtggatggtttcgttaacagtgttaagaagcttcagagacgcgaaattagctccaagcgtgatcgtgcttttagtatgaccgatgcgcaagaacgattccgcaatattcgcttgcaggaggaatatgatacgcatgacccgaaaggtccttcgtctgtggtgttgccctttctgagaaaaagatcaaagattattgagattgtggcagcacaagacattgtttttgctctcgcacaatctggtgtttgtgcagcatttagccgagaaaccaatcaaagaatatgctttttgaatgtcagtcccgatgaagttataaggagtctattttataacaaaaataatgactcgcttatcacagtttctgtctatgcatcagacagttacagttccctgaaatgcagaagcacaaggattgaatacattaggcggggtaaaccagatgctggctttgctctttttgaatccgagtctctaaagtggccaggtttcgtagagtttgatgatgtaaatgggaaagtactcacatactctgctcaagatagcatatacaaggtatttgacctgaaaaactataccatgttgtactccatttcggataaaaatgtccaggagattaagatcagtcctgggatcatgttgttgatttttgctaaagcaagtagccatgtcccacttaaaatcctttcaatagaagatggtactgttttgaaatcgttcaaccatcttctttatcggaataagaaggtggattttatcgaacagttcaacgaaaagctccttgtcaagcaagaaaatgaaaaccttcaaattcttgatgtgcgtacttttgagctgacagaagttagcagaagtgaatttatgacaccttctgcatttatctttctttatgagaaccaattattcctgacatttcgaaaccgtactgtggctgtgtggaacttccgtggagagcttgtaacttcttttgaggaccacctcttgtggcatcctgactgcaatacaaacaacatatatataaccagtgaccaggatcttatcatatcctactgcaaagctgattctgacgattcattaactgaaggaaatgcgggttccatcaatgtcagcaacattttatctggcaagtgtcttgccaaaataagagcaagtaatagttctccaatggacgacaagtgtagttgctgtgacagttcttcaggtggaagttgtaattcaagaaagcgaaagcatgtctccaaaatgaggagcacagttgctgaagccttggaagatattactgctctcttctatgacgaagatcgcaatgaaatctatacgggaaataggcacggtctagttcatgtctggtctaactgatataccatgttaacttcactgttgccttgtgttttcttattggcttttcttcatgggtaaggtgatcaacttgatctattgtatgaacatccgggagctgtaacaccactaagtgtctgtatcattcagtttttttccttgtcatgtacgccatgtgagagtttggtctttagttggtaacaaatctttatgaagtgctatgctggtaaatcaccagatgttgcttctgttgtaatctatcgttacattaatggagcggcttggatagaccaaaatatgttgtaaacaatgccaaaccctcttccgaattcatctctttatttttctcttttttgacttgtggcatatggtggaaattcgtttgcacttttttgcacatgacatgaactgtaacttgtaagggcagcgatgccaaatatggggtaaaggtacaaaagcaatcaataaaatcagagagtggtagctttacgatttgc

SEQ ID NO: 7643 - DNA, 2003 bp, Theobroma cacao
aagaaaaagactaatttttattatatcctatgggtcaattctcccagctccaaaacccaaatcaatccatccatccattccttgcttccacctatgtttctttctgctctctgggaggaagcaaatcaggattgaagaacgaagaatttaatctcaaagaataaaagtccgcaaagagcttgatttcgaatcttctgaatgtcaagttagtttggaataaataaatataaagcagatggaaggaagcaggatatcggccagccctaggccatgcagtgggaggagagtgtgggctaataagaagaggcctcgtcttgatggttatgtcaataccttcagtaagctgctcaggcgtgaaatttcatcaaagccttgtttttctatctcaaatgcctacgagaagttccgcaatatgcgtttggtggaggaatatgatagccatgatcccaaaggccattgtccagtagcactgccctttctgatgaagaggaagaaagtaattgagatagtggctgcatgtgacattgtttgtgctcttgcacattctggtgtatgtgctgcttttgatagagagagaagcaagaggatatgttttgtaaatgttagtcctgatgaagtcatccgaagcttattctataacaagaataatgattcacttattacagtttcagtatatgcatcggacaacttcagctctttgaagtgcagatctacaaagattgaatatatacggaggggtaaaccagatgcaggtttcgctctttttgagtcagaatctttgaaatggcctggctttgtagagtttgatgatgttaatggaaaggtgctaacttactctgcccaagatagcatatacaaggtgtttgatctcaaaaactataccatgctgtactctatatcggataaacatgtacatgaaattaagatcagtccaggtatcatgttattgattttcaatagggctagtggtcacattcctcttaagattctgtccatagaagatgggaaagttctcaaaaccttcaagcatttacttcatcgaaataagaaggtagacttcattgaacaattcaacgagaaacttcttgttaagcaagaaaatgaaaacctccagattcttgacgttcgaagctccgagctgatggaagttagcagtactgaattcatgactccatcagcattcatttttctgtatgaaaatcagctattcctaacatttaaaaatcggaccgttgctgtttggaactttcgcggggagctcgtaacttcgtttgaggatcacctcttatggcatccagactgtaacacaaataacatttgtataaccagtgatcaggaacttattatttcttactgcaaggcggaatctgatgatcagtggatggaaggaaatgctggatctatcaatatcagcaacatcttgaccggaaaatgcctggcaaaaataaatgcatcaaatggcagtcccaaggttgatagctctaagatgagaagcacagtttcagaagctttagaagacataactgcccttttttatgacgaagagcgcaatgagatctacaccggaaacagacaaggtttaattcacgtatggtctaattgaagattagatagttccattgagcttgccttaatacagttcagctaaattatagtgtattgccgaaatgcccttgaattgtatgattagataattcttaagttttcctggcattttatagatttgtatttttgtgctttatagactctacttcagatgtaaagcttcagcccgaatgcagagtttcatttcattatctgtacacttgagtgtattcttttattggcttatgattttgcgttttgtaactgggaagttggctggtgagatgctgactatgaaaacaatatgaatgttgatgtcaattttaatttcattgctacagaaagatgcatatgtcagctatattgatttgaaaaaacaattatttgtaatcatcgagcactaaatttcaacattgcaa

SEQ ID NO: 7644 - DNA, 2169 bp, Solanum phureja
tccctccttccctccctccctcttcttccaaaatccaaacagtgtttcactcactcttccaatttccggctgaaattggtactgtaggaagtaaagtaagctcgtatgcctgtagaactgtatacctcatgcccagttcccccaaaacagctaccaacaaagtttcttctctgattttttgctatttggtgagtgagtttctctgtccgtgcaactaactactgtaaaaatcttacctttttcatgggtatttaaaagttagggtttatacatggaaacccatgtttgttttttactctaaaccccagaaacctgatattttgtgtacatgtttctgtgttagggtttgagattttgggtggaatctctttttagagctgtttttgggatttaaggatggatggaaggaggataactgctagtcctcgcccatgttgtgggaggagggtggtagcaaagaagcgcccacgcggtggaatggatgggttcgttaacagtgttaagaagcttcaacggagagagattggttccaagagagaccgttctttcagtatgagcgatgcccaagagcgtttccggaatatacacttacaggaggaatatgatacccatgatccaaaaggtcattgtgcgttagtacttccatttcttaagaaaaggtcaaagataattgagatagttgctgcccgcgatattgtttttgcccttgctcaatccggtgtctgtgcagcatttagccgagaatcaaaccggaggatatgctttctgaatgtcagtccagacgaagtcatacgaagtttgttttacaataaaaacaatgattcattaatcactgtttcagtctatgcttcagataatttcagttccttgaaatgcagaacaacaaggattgaatacataaggaggggtaaaccagatgctgggtttgctctatttgagtctgaatcattaaaatggcctggttttgtggagtttgatgatgtgaatggaaaagttcttacttactctgcccaggatagcatatataaggtgtttgacctgaagaattatacaatgttatactcgatatcagacaagaatgttcaagagataaaaatcagtccaggaatcatgctgctaatatttaccaaagctagcagccatgttcctttaaagattctctccattgaggatggcactgttctcaaatctttcaaccacctgcttcaccgaaataagaaggttgatttcattgaacagttcaatgaaaagcttcttgtcaaacaggagaatgaaaatcttcagattcttgatgtccgcaattctgagttgacagaagtcagcagagccgaattcatgaccccatcagcattcatatttctgtatgagaatcagttattcttaacgttcagaaatagaacagtagctgtttggaatttccgtggggagcttgtgacttcatttgaggatcacttgttatggcaccctgactgcaatacaaacaacatatatattactagtgatcaggaccttattatttcatattgcaaagctgattctgatgatcccttatcagaagcaactgcgggatcgatcaatatcagcaacattttgacaggcaagtgcctcgctaaaataaaagcaaccgaaagacgtaccacagatgattgcagttgcagtaccaattgcaatgggcatggtggcagaagttgcaacgctaagaagcgtatccaagcttctagaactagaagcacagttgcagaagccctggaagatatcactgcccttttctatgatgaagagcacaatgagatctatactggaaacaattttgggctgatccatgtatggtccaactgaaggtcgacattgaatgccattctctgaatatgtcaaaaaggtgacacaacattgaatgccatcttctcgtctggctcgctcgctgtgttttttttattttatttgtagtgttacccccgagaaggggagatgattggatttgtgacatctatttacttcacagtgcatgtctgttaataatttggtttacccagtgatatttcttttgaactagagtgagttgatagtttctagtgttgggagtgtttctttaactttggctttctactgagttgtacagacggtgaaatggctgagagcatattatactgttaacctgcatttgtgtaa

SEQ ID NO: 7645 - DNA, 2421 bp, Catharanthus roseus
gtatttgaagcggtgtgtgaaataccagttgtttttttgaatccggatctctttcaatccgagggtggccaggcaatcggtggtactagtataaatttagagccatctctcgtgtttcactcttcttcttcttcttcttcagacaacccattttctcgtcttctctcagacaaaaaattttcaccgcttcagaaaagattagccatgaatgtgttcaaacagggagggagctactgctacagttaatttgaagagggattctgattttccttctgaattatcggtttgcagtagaaccctaatttttttcaaattgggtcctgagattttagcggttttaagggtttcttatcccgatgaattaaagagttcgaaccctccttcaagaacatgttcatttgccggaaatctgttgggtgaaaattgaagttgattgatacacacatacatatacttgagatatatgtgtgtgtgcatacaggatttctgtatataattttcgtgctgtcttttttagtttgattgaaccttaattgttgtaaagtaagtttttaggggttttgaaatggacggaagacgtataacggcgagtccgcgcccttgcaccaatggaaggcgtgtggtggcaaagaagcggtctcgcggtgctatggatgggtttgtcaacagcgtgaagaagctccaaaggcgggagatttcttcaaagcgtgaccggtctttcagcatgagtgacgcccaggagcgttttcgtaacatccgattgcaggaggaatatgatactcatgacccaaaggggcaaactaccatggtgctgccatttctccggaagcgatccaaaattattgaaatagttgctgcacgtgatattgtctttgctcttgcacaatctggaatctgcgcagcattcagccgagagactaatgagaagatatgctttctgaatatcagtcctgatgaagtcataagaagcttgttttacaataaaaacaatgattcccttatcactgtttcagtttatgcttctgataatttcagctcattgaagtgcagaaccacaaggattgaatatatacgaagaggaaagccagatgcaggtttccctctctttgaatccgagtcgttgaagtggcctggctttgtggagttcgatgatgtaaatggcaaggttctcacttattctgcacaggatagcatatacaaggtgtttgacttgaagaactataccatgttgtactccatatctgataaaaatgtgcaagagatcaagatcagcccaggaattatgttgctgatatttaccaaatccagcggtcatgttccattgaagattttgtcaatcgaggatgggactgttctcaaatctttcaatcatctcctccatcggaacaaaaaggtggatttcatcgaacagttcaatgagaagcttcttgtcaagcaggaaaatgagaatcttcagattctcgatgtccgtaattctgagctaacagaagttagcagaactgagttcatgaccccatccgcattcatatttctgtatgagaaccagctattcttgacattcagaaaccgaacagtggctgtttggaacttcaggggcgagcttgtgacttcatttgaggatcaccttctgtggcatcccgactgcaacaccaataacatttacatcactagtgatcaggacttaatcatctcctattgcaaagctgatactgatgatccattatcagaagcaaatgcgggctcgatcaatatcagcaacatactgactgggaaatgtctggccaaaataaaagcaagcaacagccttcccttggatgattgcacctgcaatgctgactgcggtgggagtgcttgcaacgcgaagaaacgagccaaagctgctagcatgaggagcactgttgcagaagccctggaagacattaccgcactcttttatgacgaagagcgcaatgagatttatactggaaataggcttggtctggtccatgtgtggtctaactagagtttgtggcagcatcttgctttccatccgtgctccatctatgatatagttcatagatatgaaactttgttatgcaaccttccttttgcaagtgttgtagtttccgtttccctagttcttttcatcagactgcgtagcttctatcctattccttttaagggagggattttctatttgctgctagacaatttccttattgtgaattaagtttgaaatctagagatgttgaatgatttatatagtttattagcagttgtttgctggaatttcgtttgcaggttggtttcttgactttatccatccaagttgatgctttagaatgaattatcagatcagatcaaataggtttctgacttgtattatttgtatcaactgctgtgtataactagttgtgaagctattgaatcatgtaacttctc

SEQ ID NO: 7646 - DNA, 1799 bp, Euonymus alatus
cggccgggagggtagtggcgaagaagagagctcggtcggatgttataatgaatagtgtgaaaaaactgcagaggcgcgagatttcctcaaagatagatcgaacttttactgtcagcaatgcccaggagagattccgcaacatgcgcttgacggttgaatatgacactcatgaccccaaggggcattgttcagtggtactcccctttttggcgaagagaacaaaagttattgagattgttgctgcccgcgatattgtctttgctcttgcacattctgatgtttgtgcagcttttagtagagagacaaacaagcggatatgttttttgaatgtgagccctgatgaagtcatccggagcttgttctacaataagaacaatgattcccttatcacagtctcagtttatgcttctgacaactttagttctttgaagtgcaggtccacaaggattgaatacataagaagaggcaagccagatgcaggatttgctctttttgagtctgagtccttgaagtggcctggatttgtggaatttgatgatgttaatgggaaggtgctgacttactctgcacaagatagtatatacaaggtgtttgatctgaaaaactacaccatgctctactctatatcagataaaaacgtacaggagatcaagatcagtcctgggataatgctgttgattttcaatagagcgagtagccatgtgcctcttaagattctatcgatagaagatggcacagttctcaaagctttcaaccatctgcttcatcgcaacaagaaggtggacttcattgaacaatttaatgaaaagcttctagttaagcaggaaaatgagaacctccaaattcttgatgttcgaacctctgagacgatggaagttaacagaaatgagtttatgactccttcagcatttatctttctatatgaaaatcagttgtttctaacattcagaaatagaactgttgctgtttggaactttcgtggggagcttgtaacttcatttgaggatcacttactgtggcatccagactgcaacacaaacaacatttatataacaagtgatcaggatcttatcatttcttactgccgggctgaatctgactatcaatggggagaaggaaatgccgggtctatcaatatcagcaatatcttgactgggaaatgcctgtctaaaataaatgtgacaagtgcaagtaccacagttgaagagtgcagcagcagtagtacgagcaattctaaaaggcggattattacagccccaatgagcagcaccgtttctgaggctttggaagacataactgctcttttctatgatgaagagcgcaatgagatatacacaggtaatagacatggtctggtgcatgtgtggtcgaattgaagagatgttttttcattctgatctttgatacgcacgtggaagaacacggagggttcatgtattgtcaaattggggcggatagctggcgctgaggaacggtagtgataggatggttattctgccctactggctccagtgcattttaaccttgcgagcactgtatcattagatgagtttcaaaaccattgtcagattgtatcattagatttgtagtgtagttcctgcatatggatgctgcccgactaagaagctctgagggcaggtaattgattcacgaagtagttaaatcttgtagagatatcatttacttgtacactcgatttttaattgtggtgttgcttgtagagcggaacaaagtttgccgataacttcttacttgttccttctgtgttcagattattcatcagattgtgagggagcttt

SEQ ID NO: 7647 - DNA, 1573 bp, Populus trichocarpa
aaatggatggtggaggagggaggaggataacggttagtccgaggccgtgtaatgggaaaagagttgtggcgaagaaacggggaaggagttttggtggcggagatgggtttgtaaacagtgtcaagaagcttcaaagaagggaaatttgttctaagcgtgaccgttcttttactatgactgatgcccaagaacgttttagaaacatccggttacaggaggaatatgatacttatgatccaaaaggtcactgtaccatggtactgccttttttaagaaagaggtcaaagatcattgagattgtagcagctcgtgacatagtatttgctcttgcacagtctggtgtctgtgcagcatttagccgagagaccaaccaaaggatatgctttttgaatgtcactcctgatgaagttatacgaagcttgttttataataaaaacaatgattcactcattacagtttcagtttatgcctcagacaatttcagttccttgaaatgcagaagcacaaggattgaatatataagaaggggtcaaccagatgctggctttgctctttttgaatctgagtcactgaaatggcctggttttgtagagtttgatgatgtaaatggcaaagtactcacatattctgcacaggatagtatatacaaggtgtttgacctaaagaattacacaatgttatactcgatagcagacaaaaatgttcaagagattaagatcagtccagggatcatgttgttgattttaactaaaagtagtggctgtgttcctcttgagattctttcaatagaggatggcactgttctcaaatcttttaatcatctccttcatcggaataagaaggtggatttcattgaacaattcaatgagaagcttcttgtcaagcaagaaaatgagaatctccagattcttgatgtgcgcaactttgacctaacagaagttagtagaaccgagtttatgacaccatctgcatttatatttctatatgaaaaccagctattcctgacttttagaaatcgaactgtggctgtttggaacttccggggagagcttgtaacttcctttgaggatcaccttttgtggcatcctgattgcaacactaataatatttacatcacaagtgatcaggatctcattatttcttactgcaaggctgattctgatgatcccttgtctgaaggcaatgcaggatccatcaatatcagtaatatcttgactgggaaatgtcttgctaaaataaaggcaagcaacagcttcccaaatgagaatgaatgcggtcagaattcaaagaagcataggcatgcctcaaggattagaagcacagctgcagaagctttggaagacataactgctctcttctatgatgaagagcgcaatgagatctatacaggcaataggcatggtctagttcatgtgtggtctaactgatgttttgattaatccttgtttgcttaaggttcataattgtttaatcagatggttgaatgagcatgcttcctggatgtgagagttcctagaaactgtaccgttgaccactcctgtaccatgttatattgcattttggcctttgaaga

SEQ ID NO: 7648 - DNA, 1979 bp, Glycine max
gggcaggatttctctttattttaattttacgtatttataagcgctcgcaaagcagtgaagacttgagagagggagagagagaatccaaattcggatttttgaaacgggatcgactccattcctcttcttcttcactgtcacacacactcacacactcctgtccatcgtttctccccactgattcacgaaaccctaatttttcgtggttcctcttctggggagcgaagatttagggttagattgagctgaggtggcagatgcagcagcatctcctctgagaaaaaaaatggaaggtggcaagagaattacggtgagccctcgaccttgctgcggccgcagaatcgttgccgcgaagaagagaccgcgtgcgaacgatggcttcgtcaacagcgtcaagaaactacagagacgcgaaatcagctccaagcgtgatcgcgctttcaccatgagcgacgctcaagagagattccggaatattcgcttgcaggaagaatatgatacgcatgatccgaaaggtccttcatctatggtgttgccgtttctgagaaaaagatcaaagattattgagattgtagcagcacgcgatattgtttttgctcttgcacaatcgggtgtttgtgcggcatttagccgagagaccaatcaacggatatgctttttgaatgttagtcctgatgaagttataagaagtctgttttataacaaaaataacgactcacttatcacagtttctgtatatgcttcagacagttacagttctttgaagtgcagaagcacaaggattgaatatataaggaggggtacaccagatgctggctttgctctttttgaatccgagtctctgaagtggccaggttttgttgagtttgatgatgtaaatgggaaggtattaacgtactctgctcaagacagcatatacaaggtatttgacctgaaaaactatacgatgctgtactctatttcggataaaaatgtccaagagattaagatcagcccgggaatcatgttgttgatttatgctaaagcaagtagccatgtcccccttaaaatcctttcaatagaagatggtactattttgaagtcattcagtcatctcctttatcggaataagaaggtagattttattgaacagttcaacgaaaagctacttgtaaagcaagaaaacgagaacctccaaattcttgatgtgcggacttttgaacatacggaagtttgcagaagtgaatttatgacaccgtctgcatttatttttctatatgagaaccaattgttcctaacatttcgaaatcgtactgtggctgtgtggaacttccgtggagagctggtaacttcttttgaggatcacctcttgtggcatcctgactgcaacaccaacaatatatatataaccagtgaccaggatcttatcatatcctactgtaaagctgattctgatgattcgttgtctgaaggaaatgcaggttccatcaacgtcagcaacatcttaactggcaagtgtctggccaaaataagagcaagtaacagctttccagtggataacagttgcagtgacaatccttcaggtagctgttgttgtaattcaaagaagcgaaaacatggatccaagacgaggagcactgttgcagaagccttggaagacattactgctctcttctatgatgaagagcgcaatgaaatctatacaggcaacaggcatggactagttcatgtctggtccaactaatggatatattattgaatgttctgttgcactttgtttttcttagtgggtacattgattattctgatctgctattgagaacttttggggggatgtaactataagtgcctttgaatcattcatttttttttctcttgacatttacgccttaggcgagtttgttcggtagttgtaagaggtgtatgaagatgctgttaactcaccggatgttgcttctgctgtaatctatatttttacattaatggagcggcttcgatgg

SEQ ID NO: 7649 - DNA, 2285 bp, Solanum lycopersicum
gatacataatacatgaaatatttctgtcgtaatacacctaagtgagactatcctaagtgaagtaatttggtgcatcgcaaaaacgctctttcaaattccgacaaattcatctttttactctcttgcccctccttccctccctccctcttcttccaaaatccaacagtgtttcactcactcttccaatttccggctgaaactggtgtactgtaggaagtaaagtaagctcgtatgcctgtagaactgtataccctcatgccaagttcccccaaaacagctaccaacaaagtttctcctctgatttttgctgtttggtgagtgagtttatctgtccgtgcaactaactactgtaaaaatctgacctttttcatgggtatttaaaagttagtgttttatacatggaaacccatgtttgttttttactctaaaccccagaaacctgaaattttgtgtacttagggtttgagatttttagtggaatctctttttagagctgtttttggggatttaagaatggatggaaggaggataactgctagtcctcgcccatgttgtgggaggagggtggtagcaaagaagcgcccacgcggtggaatggatgggttcgttaacagtgttaagaagcttcaacggagagagattggttccaagagagaccgttctttcagtatgagcgatgcccaagagcgttttcggaatatacacttacaggaggaatatgatacccatgatccaaaaggtcattgtgcgatggtacttccatttcttaagaaaaggtcaaagataattgagatagttgctgcccgcgatattgtttttgcccttgcacaatcaggtgtctgtgcagcatttagccgagaatcaaaccggaggatatgctttctgaatgtcagtccagacgaagttatacgaagcttgttttacaataaaaacaatgattcattaatcactgtttcagtctatgcttcagataatttcagctccttgaaatgcagaacaacaaggattgaatacttaagaaggggtaaaccagatgctgggtttgctctatttgagtccgaatcattaaaatggcctggttttgtggagtttgatgatgtgaatggaaaagttcttacttactctgcccaggatagcatatataaggtgtttgacctgaagaattatacgatgttatactcgatatcagacaagaatgttcaagagataaaaatcagtccaggaatcatgctgctaatatttaccaaagctagcggccatgttcctttaaagattctctccattgaggatggcactgttctcaaatctttcaaccatctgcttcaccgaaataagaaggtagatttcattgaacagttcaatgaaaagcttcttgtcaaacaggagaatgaaaatcttcagattcttgatgtccgcaattctgagttgacagaagtcagcagagccgaattcatgaccccatcagcattcatatttctgtacgagaatcagttattcttaacgttcagaaatagaacagtagctgtttggaacttccgtggggagcttgtaacttcatttgaggatcacttgttatggcaccctgactgcaatacaaacaacatttatattactagtgatcaggaccttattatttcatattgcaaagctgattctgatgatcccttatcagaagcaactgcgggatcgatcaatatcagcaacattttgacaggcaaatgcctcgctaaaataaaagcaaccgaaagacgtagatcagatgattgcagttgcagtaccaattgtaacgggcatggtggcagaagttgcaacgctaagaagcgtatccaagcttccagaactagaagcacagttgcagaagccctggaagatatcaccgcccttttctatgacgaagagcacaatgagatctatactggaaacagttttgggctgatccatgtatggtctaactgaaggtcgactgaatccccgttctctgaatatatcaaaaaggttacacatattgaatgccatttcctcttctggctcgctcactcgctgtgttcttttattttatttttactgttcccccgagaaggggagatgatttgatttgtgacatatatttacttcacagtgcatgtcagttaataatttggtttactcagtgatatttcttttgaactagactgagttgataatttctggtcttgggacttgggagtgtctttaactttagctgtctactgtgtctttaacgtacatttgtgtaaaattgaaaagcaaaccataatatagatgtg

SEQ ID NO: 7650 - DNA, 1978 bp, Lotus japonicus
attcggccgacccttaaggtattttgaaacgagatcgaccccaattgaaattgtgtgtggactccatttcactcactcactcactgtcttccaattcgtgctctataaaaccctaattcccctttcttcgttcttcggagcgaagaaattcagctatttagggttcagtgggtgagggtgaatggtggtgtagtgttgaattgagtgttggagtgagtgatggaaggtggtggtgggaggaggatcacggtgagccctcgaccttgctgtggtcggagggttgttgcgaagaaggggccgcggcgtggtggtgcggtcgatgggtttgtcaacagcgtcaagaagcttcagcggcgtgaaatcagctccaagcgtgatcgcgctttcactatgactgatgctcaggagagattccgcaacattcgcttgcaggaagaatatgatactcatgatcccaaaggtccttcttcggctgtggtattgccatttctgagaagaagatcgaagattatcgagattgtagcggcacaggacattgtttttgctctcgcccagtctggggtttgtgcagcatttagccgagagtcgaaccaaaggatttgctttttgaatgtcagtcctgatgaagttataagaagtctgttttataacaaaaataatgactctcttatcactgtttctgtctatgcttcagacagttacagttctttgaaatgcagaagcacaaggattgagtacataaggaggggaaaacctgatgctggctttgctctatttgaatccgagtctctcaagtggccaggttttgttgagtttgatgatgtaaatgggaaggttctcacattctctgctcaggatagcatatacaaggtgtttgacctgaaaaactatacaatgttgtactccatttctgataaaaatgtccaagagattaagatcagtccggggatcatgttgctgatttttgccaaagcaagtagccatgtgccgcttaaaatcctttcaatagaagatggtactgttttgaaatcattcaaccatctcctttatcgtaataagaaggtggattttattgagcagttcaatgagaagctacttgtgaagcaagaaaatgaaaaccttcaaattcttgatgtgcggacttttgagctaactgaagttagccgaagtgaatttatgacaccctctgcattcatctttctatatgagaaccagttattcctgacattccggaatcggactgtggctgtgtggaacttccgtggagagcttgttacttcctttgaggatcacctcttgtggcatcctgattgcaatacaaacaatatatacataaccagtgaccaggatcttatcatatcctactgcaaagctgattctgatgactcagtgactgaaggaaacgcaggctctatcaatgtcagcaacattttaactgggaagtgtcttgccaagataagagcaagcaacagcttcccaatggaggacaattgcagttgctgtgaaacttcttcaggtaacagttgtaattccaggaagcgaaagcatgcctccaaaattaggagcacagttgcagaagccctggaagatattactgctcttttctatgatgaagaccgcaatgagatctataccggcaacaggcacggtttagtccatgtctggtctaactgatgtattatggatttactaccctttgtaaacttcttgggtttttcttcatgtggacaaaagattttccggatctgctttatagaacttctgggagtagtagcgccattgagtgatcttgtaatgttcattttgttcatccgtactttggcgcatttgttatgtagttagtaacatatctgtatggaagtgctatgctggtaacagaccaggtgttgcttctgctgtaatctatatttggatttatagagcgacttttttggattgaaatttagtgaataatgcctatcctcttccctgcccaccc

SEQ ID NO: 7651 - DNA, 1701 bp, Amorphophallus konjac
tgtaaggtgagttttgtggcggggtctcggttcggatggagggaaggcggttctcggtcagccctcggccgtgctgcaaccgccggatcgtggccgggaagaggccgcggtcggatgggttcgtgaacagcgtgaagaagctgcagcggcgggagatgtgttcgaagagggaccgcgctttcaacacgagcagtgcgcaggagaggttcaggaacatacagttgcaggaggaatatgatactcatgatcccaagggacatagcttcttgcagcttcctttcctgaagaagaggtctagaattgttgaaattgttgctgcacgggacattgtttttgctttggcacagtctggtgtttgtgcagcatttagcagagaaacaaaccaaaggatatgcttcctgaatgtgagccctgatgaagtaattcgcagcctgttctataacaaaaacaatgagtcacttattacagtctcagtttatgatgcagacaacttcagttccctgaaatgcaggacgacaagaatcgaatatattaaaaggggaaagccggatgctggttttgcactttttgagtcagaatcattgaaatggcctggttttgtggagttcgacgatgtgaatggcaaagttctaacattttctgcccaggacagcatttacaaggtgtttgacctgaaaaactacacactactgtactctatatctgataagaacgtccaagaaatcaagattagtccaggtataatgttgttgatatttaaaagagctagcagccacgttcctctcaaagtactttctatagaggatggtactgttctcaaatccttcaatcatcttttgcatcggaacaagaaggttgattttatagaacagttcaatgagaagctcctggtcaagcaagaaaatgaaaatctccaaatacttgatgttcggaacttccagttaacggaagtaagcagaacagagtttatgactccatcagcatttatctttttatatgagaatcagttatttttgacatttcggaatcgcacagcagctgtttggaactttagaggtgaacttgttacttcttttgaggatcacctgttgtggcaccctgactgcaacaccaacaacatctacattacaagtgaccaggatcttataatttcttattgcaaggctgattctgatgaaacaacagatggcaatgctggatctataaacattagcaacatacttactggcaaatgtcttgcgaaaattcgtgcaagcaattccaaaaaggaactcttcccttccagatttaggaacacagttgcggaagcattggaggacgtaactgccctttattacgatgaagatcgcaatgagatctatacggggaatagacagggtctggtccatgtgtggtctaattgacgatgggatctttaattactctgaccaggcttctcaatgaggccccaacgtggctcttttaattatcttaaccccggggtttcagtctccacaaacacggagtcctttaggtgtaggggccttccctgccatctgtacctgcgtggtgtatctgcagtagccgtctggattaacagcctttcttgaacaaaatatctttgatgtacttgctgcagatcttgtgtaatcatcatattctttttgcccaaatatcaagagttaatcctcctaagctaagagaaacactcatatctgacaa

SEQ ID NO: 7652 - DNA, 1898 bp, Silene vulgaris
ttcttctctcccaaatcagagagaagaagtacaccaatctaatcaatatcaaatacccagataaccctagatcctgatttccaatacccccatgttttccccctctaatttccactaaaacccatgatttcagtttcatgaaaaccctaattctgctgggttgattactaatttccagcttttgctgcacaagttcgagacttttgggggggattttcaattgggtgtttggtggtgatttcaaatttgtcgaaataatggatggtaggaggatttctgctagccctagaccttgtacagtgcgacgggttgttgcgaaaaagcgacctcgaggcggcggtgtagatgggtttgtaaatagtgtcaggaagttgcaaaggagagagatttgctccaaacggtatcgtgcatttagcatgagtgatgcccaggagcgatttcgcaacattcttttgcaggaagagtatgacacacatgatcccaaaggccaatgcccaacagtattaccgtttttgcggaagagatcaaaaatcattgaaattgtagctgcacataatattgtatttgctcttgcacagtctggcatctgtgcagcatttagtcgagaaacaaaccagcggatatgctttttgaatgtcagttcggatgaagttataagaagtttgttctacaacaaaaataatgattccctaattaccgtctcggtttatgcttctgacaatttcagctctttgaagtgcagaacgacaaggattgagtacataaagagaggaaagcctgatgctgggtttgctctgtttgagtcagagtcactgaaatggcctggttttgttgagttcgatgatgtaaatggaaaggtgctcacttattctgctcaggacagtgtctacaaggtctttgacttgaagaactatacaatgctctattccatttctgacaaaaatgttcaggagattaagatcagccccggaatcatgctgttgatattcaacaaagaagctagccatgttcctctaaaaatcctgtccatcgaggatggtacggttctcaaatcattcactcacctcatccgtcgaaataagaaggttgacttcattgagcagttcaatgaaaaacttttagtgaagcaagaaaacgagaatcttcaaattcttgacgttcgcaactcagagctaactgaagtcagcaaaactgactttatgaccccttctgcgtttatatttctgtacgagaaccagttgttcctgacttttaggaacagaacagtggctgtgtggaactttagaggagagcttgtcacttctttcgaggatcacctcttgtggcatcccgactgcaacactaacaacatttacatcacaagtgaccaagaccttatcatttcttactgcaaagccgattctgatgatcctttgcctgaagcaaatgcaggttcaatcaatgtgagtaatatcttgaccgggaaatgcctggcaaagataaaaccagataactgctcaactgttgaagatgacggtagtagtagcagcaacagcaactcgaagaagcgcataagagcatcaaggatacagagcacgcctgctgaggctttggaagacatcaccgctctcttttatgatgaggagcgtaatgaaatatatactggaaataggcatgggcttgttcatgtatggtccaactgagtcttgtatctttacttaattgccctggaacattacgggcagttctttgagatatttaatcttgcgacattgatgtctgtttgagttcttctttttctttttcttttaggtgtttgtatttgtatccgtggtgtttttattcctgaagcacatggaaaagattgtagacatttccggatcaactcgtgctaattctttcatacctgtactggtttt

SEQ ID NO: 7653 - DNA, 2295 bp, Mimulus guttatus
ctcttctaaaatccgacaaatttctctctctctctctctctctctctctctcttctttctctctcctctctgtctcaggccccttttgaaatcaagcttcactctttgtctagttttcgcagagacacacatacacacacagagagaggattgagttacatacaaaacgtacatagatgcgagtgtgtataaacatacaagaactaattcaaaatctcagttgtaaaataaatggaataaactgagattttctccctcttttttttttcctcaatttcaattttctctggaccttgggcgttgaggagcctcaactatttcctcttcgggtccggagattttagggttttttttctctctctcctgattgatgcccaattttgtgtgtgtgtgtgtgtgtgtgtgtgtgtacaattaagctgagatacgtgtatgtgtgtttaatctgtgaatgattcgttttagggtttagatttatttgtaaaaaaaaaaaaacgttgtgtattagtgtaataaaatcagatatggacgggaggagaataacggctagtccgaggccgtgctctgggcggcgagtggtggcgaagaagcggccccgcggtggtttagatgggttcgttaacagcgtgaagaagctgcagagaagggagatatcatccaagcgagaccgctctttcagcatgagtgatgctcaagagcgcttccgcaacattcggctgcaggaggaatacgatacacatgatccgaagggatattgttctatgtcgttaccgtttctcaagaagaggtcaaaaatcatcgaaattgttgccgctcgtgatattgtctttgctcttgcacaatctggtgtctgtgcagcgtttagccgagagactaaccaaaggatatgcttcctcaatgtttgccccgacgaagtcattcggagcttattttacaacaaaaacaacgattcgctcatcacagtttccgtttatgcttctgataactttagttccttgaaatgcagaacaacgaggattgaatacatacggaggggcaaacccgatgctggtttcgcgctgtttgagtccgagtcattgaagtggcctggttttgtggaatttgacgacgtaaatggaaaggttcttacatattccgcccaagatagtatatacaaggtgttcgatttgaagaactatacaatgctgtactccatttccgataaaaatgttcaggagattaagatcagtccaggaatcatgctattaatattcactaaaggccaaggcggtgttcctctacagattctctcaatcgaggatggcactgttctgaaatccttcagccatctccttcacaaaggcaagaaggtcgatttcatcgaacagttcaacgaaaagctgcttgtcaagcaagaaaacgaaaacctccagatagttgacgtacgcaacactgagataacagaagtgagcaggacagaattcatgaccccatccgcattcatattcctgtacgagaatcagttatttctcacattcagaaaccgaacagtcgctgtttggaatttccgaggagaactcgtcactaaattcgaggatcacctcttatggcaccccgactgcaacactaacaacatatacatcacaagtgaccaggacctcatcatttcttactgcaaagccgactccgaggaaccattgtctgatggaaacgcggcggggtcgattaatataagcaatatactgacggggaagtgcttagcgaagataaaggcaagcaacagtcttccgattaacgagtgcaactgtagtgccagctgtggtgggaaaaagtgcaactcgaggaagcgcatacaagcttctagaatgaggagcacggtcgcggaggcgctcgaagatattactgctctcttctacgacgaggatagaaacgagatctacaccggaaataggctcggccttgtccatgtctggtccaactaaatttcactagtgtcaagtgggccccgtttccgtatatttcgaagtttttttttttttttttttttttctttttgaaagtgttgttttgttgatttgacttatttgggctgggactaagtaaagacggagctcgtatatttgtttgtgataattacttgaggctctcgacggagctatatcgatttgctatttgctgtaatttgtgttttgaggaacaatttgatgtgctgtggtagttatgaacttaaaactagttgtgggagatgaatctggattctttgtaaattacttcctgtgttagctgctgcagctgctgtttttatttatttattta

SEQ ID NO: 7654 - DNA, 1883 bp, Fagopyrum esculentum
aacgggtgtactcaactgagccctagatttctgcaagaattttcttctgtgcatagctctactgcctttactttaattcgttcttcaattcctagtccttcagagtcctacatttcactgttgttcttcttaaaaagatgctacatccgagctgcgcaattgtaaagatattttagggttttcgtgacggcgatattgagggacatataccggaggtgtaagtgtaaagattagcggggatggacgggagaaggatatcggcgagtccacggccctgcagtgttcgacgagtagtggcgaagaggaggccgcgagagatcgatgggttcgttaatagcgttaagaagcttcagcgaagggagatttcctccaagcgggatcgtgcttttagtatgagtaacgctcaagaacgattccggaacattcgtctccaggaagagtatgatacacatgatcctaaagggcattgcttcaccgtattgccatttttgaggaagagaacaaagattatagagattgtggctgctcatgacattgtctttgcccttgcaatgtctggtctctgtgcagcattcagtcgagacacaaatgaaaaagtgtgctttttgaatatcagtgaagatgaagtgatacggagcttgttctataacaaaaacaatgattcccttatcactgtttcagtttatgcttctgacagtttcagctcattgaaatgcagatcaacaaggatagagtacataaagagaggcaaacctgatgctggttttgcactgtttgaatctgagtcacttaaatggcctggatttgtagagtttgatgatgtaaatgggaaggtgctcacatattctgctcaggacagtgtttacaaggtgtttgacttgaagaactatagaatgctgtactcaatttctgaccaaaatgttcaagagataaaaatcagcccaggcattatgttactgatatttaataaaggagttagccatgttcctttgaaaatcctttctatagaggacggaactgttctcaaatcattcaatcatctcattcatcggaataaaaaggtggacttcatcgaacagttcaatgaaaagctccttgtaaagcaggagaatgagaatcttcagatccttgatgttcgtaattctgacttgaaggaagttagcagaactgaattcatgactccatcggcatttatcttcctttatgagaatcagttgtttttgacttttagaaatcgaactgtggctgtatggaatttccgtggggaacttgttacttcttttgaggatcatcttctgtggcattctgattgcaacactaacaatatatacattacaagtgatcaagatctcataatttcatattgtaaagcagatgcagacgatccaaaagcagaaggaactgcaggctcaatcaatgtaagtaacatcctgagtggaaaatgcctagccaagataagagtggaaaagaagtctgatgacggagaagatatcagcagcagcggtaacagcaatggcagcagcagcagcagcaggcggaggaacacaagaaagcgggcacatgcctcgaggatggggagaacagtggaggaagctctggaggacataacagccctcttttatgatgaagaaaggaatgagatttacactgggaatagtcgtggtcttttgcatgtatggtccaactgaggccttcccaaaggttgtaccattaatgctgtttagaactatctgtatgcgttgtggatgccaattttaaacattctcctttttgttgtactttgctaagtttacctttaattttattgtttttatagggaagttgcctctgtttggagtggattcattgttttgggtaaggtcgtaaggatttgtatgtcacct

SEQ ID NO: 7655 - DNA, 1868 bp, Populus trichocarpa
ttgtttgtgatttttttgaaaacagatcgaaatcgaactcacctgggaaactcgctcaaattcgaggcaacaagcactagaagtactaaacaaaacaaaacaagcatttcaggtttcttctagcttagcaacagcgtaagaatcgttctttgtggatttttgtttttctgggtgattattaagctttagagtggaaaacaggagatggatatgtgctaaaattggtttttttttagcaaaagtatagtttttgtttaaggtggagggagggtgggtggcagaaatggatggaggaggagggaggaggataacggctagtccgaggccgtgtaatgggaaaagagtggtggcgaggaaacggggaaggggttttggcggaggagatgggtttgttaacagtgtcaagaagcttcagcgaagggaaatttgttctaagcgcgaccgtacctttactatgactgatgcccaagaacgttttagaaacatccggttacaggaggaatatgatactcatgatccaaaaggtcactgtaccatggtactgccatttttaagaaagagatcaaagattattgagatcgtagcagctcgtgacatggtgtttgctcttgcacagtctggtgtctgtgcagcatttagccgagagaccaaccaaaggatatgctttttgaatgtcactcctgatgaagttatacgaagcttgttttataataaaaacaatgattcactcatcacagtttcagtttatgcctcagacaatttcagttccttgaaatgtagaagcacaaggattgaatacatacaaaggggtcagccagatgctggctttgctctttttgagtctgagtcactgaaatggcctggttttgtagagtttgatgatgtaaacagtaaagtacttacatattctgcacaggatagtatatacaaggtgtttgacctaaaaaattacacaatgttatactcaatagcaaacaaaaatgttcaagagattaagatcagtccagggatcatgttgttgattttaactaaaagtggtggctgtgttcctcttgagattctttcgatagaggatggcactgttctcaaatctttcaatcatctccttcatcggaataagaaggtggatttcattgaacagttcaatgagaagcttcttgtcaagcaagaaaatgaaaatctccagattcttgatgtccgcgactttcagctaatagaagttagcagaactgagtttatgacaccatcagcatttatatttctctatgaaaaccagctattcctgacatttagaaatcgaactgtggctgtttggaacttccgaggagagcttgtaacttcttttgaggatcaccttttgtggcatcctgattgcaatactaataatattcacatcacaagtgatcaggatcttataatttcttactgcaaggctgattctgacgatcccttgtctgaaggcaatggatccatcaatatcagcaatatcttgactgggaaatgtcttgctaaaataaaggcaggcaacagcttcccaaatgagaatgaatgcagtcagagttcaaagaagcacatgtgtgcctccacagtgagaagcacagcagcagaagctttggaagacatcactgctctcttctatgatgaagagcgcaatgagatctatacaggcaataggcttggtctagttcatgtgtggtctaactgattttttgacaaatccttgtttgcttaaggttgttaatgtttaaggttgaatgagcatgctgcctggatgtgagagttccctgaaactgtaacatttaccacacttgtaccatgtcatatttctttttggttttggaaattgatttccttgtgtctgtttccct

SEQ ID NO: 7656 - DNA, 1776 bp, Cephalotaxus harringtonia
cagggcagggaaaactcccgatgttgttgacggctcctgggatttcctttttcgactatgagaacacgatacgacacccaattgcgcgttctatccaaagatataattttctcccactgtcacgctgtccgtcgattcgaaatcccaaccaccttgtaacttagggtttggcctttcagaggctttgttggtgtttagttcggcgcggaaattaggaatgttataccaggggttttaggcgcaaatatgatgtttttagcatggtcgatcagttttcaagtgcaagttcgggatttagggttttatcctgttatatgacgatgagcaggggtttaagtgatgtcatttgtattgtaaaggtctgaggaaatttatttggatagatggagccgagaaagattgcggctagtcctcggccttgcagtggccggcgcgttgttgccggaaaacggcagcgtataggcgacactaccaactgcgtgcgaaagcttcagagacgggagatcggaaccagcggtaacagggccttcaatatctccaatgcacaagaaaagtttcgaaattttcagttgcaggaggaatttgacacctatgaccccaaggcacatggttttgagctgcaatttctaaagaagagatccaaaatcatagaaattgttgcagcacgtgatatcgtatttgcattggcgcagtccggtgtttgtgcagcatttagcagggaggcaaataagaaaatatgcttcctgaacataagcccagatgaagtgattcgcagtctcttttataataagaacaacgattcactcatcacagtttctgtatatgcttcagataacttcagttcactgaaatgcagaacgacccctattgagtatattcggaggggtcaaccagatgcaggatttgctttgttcgagtctgagtcactgaaatggcctggttttgtggagtttgatgatgtcaatggaaaggtccttacgtattctgctcaggacggcatttataaggtgttcgacttgaagaactatacaatgctatattcaatatcagatgaacatgtccaagagataaagatcagtccagggataatgttactgatattcgatagggctagtgggcatgttcctctaaaaatcttatctatagaggatggtactgttttaaaagcattcaatcacctgttgcatcgcaataaaaaagttgatttcattgaacagttcaacgagaagcttcttgtaaagcaagaaaatgagaacctccaaatacttgatgttcgaaatgcacaattgaccgaagtaagcagaacagagtttatgacaccatcagctttcatttttctttatgagaatcagttatttttgacgttccgcaatcgtacagttgctgtatggaattttcgaggagagctggttacatcatttgaagatcatttgttgtggcatccagattgtaacacgaataacatatatattactagtgatcaagatttgattatttcatactgcaaggcacatcctcattcttcagatgaagaagaaaatgttggttccataaatataagcaacatattaacggggaaatgccttgctaagattcgtgccaatgacccaaatgttcaaattagtcctagaaatcgtccaaatgcatctgcaatcagaagcactgtacaagaagctcttgaagacatcactgcccttttctacgacgaggaacggaatgaaatatatactggaaataggcatggattagttcatgtctggtcaaattgaggtaccc

SEQ ID NO: 7657 - DNA, 2128 bp, Sciadopitys verticillata
gtgatgttatcgttattttcaaggtcgaggaggtgagaagatttagggtttagaagatggaggcaaaaaagattggtgcgagtcctcgaccttgcagtggccggcgagtcgtggccggaaaacggcagcgtataggcgatactactaactgcgtgcgtaagcttcagagacgggagatcggcaccagcggtaatagggccttcaatatctccaatgcgcaggagaagtttagaaattttcagctgcaggaagaatttgacacttatgatcccaaggcgcattggtttttgaagcttcagtttctgaagaagagatctaaaatcatagaaattgttgcagcacgtgacattgtatttgctttggcacagtctggtgtttgtgcagcatttagcagggaagcaaacaaaaagatatgcttcctgaacataagcccagatgaagtgattcgaagccttttctataataagaataatgattcgctcattacagtttcagtatatgcttcagataacttcagttcactgaaatgcagaacaacacctattgagtatatacggaggggtcaacctgatgctgggtttgcattgtttgagtccgagtcattgaaatggcctggttttgtggagtttgatgatgtcaacggaaaggttcttacatattcagcccaggatggcatctataaagtgtttgatttgaagaactatacaatgttgtattcaatatcagacgaacatgtccaagagataaagattagtccagggataatgttattgatattcgacagagctagtgggcatgttcctctcaaaatcttatctatagaggatggtactgttttaaaagcatttaatcatctgttgcatcgcaacaaaaaagttgatttcattgagcagttcaatgagaagctccttgtaaagcaagaaaacgagaacctccaaatacttgatgttcgaaatgcccaattgactgaagtaagcagaacggagttcatgacaccatcagctttcatttttctttatgagaatcagttattcttgactttccgcaatcggacagttgctgtatggaatttccgaggagagctggttacatcatttgaagaccatttgttatggcatccagattgtaacacaaacaacatttatattacaagtgatcaagatctgattatttcttattgtaaggcacatcctcatagttcagatgaagaagaaaatgttggttccataaatataagcaacattttgacaggaaagtgtcttgctaagattcgtgccaatgacccaaatgttcaaattagtcctagaaatcggccaaatgcatctgcaatcagaagtactgtacaagaagctcttgaagacatcactgcccttttctatgatgaggagcggaatgaaatttatacaggaaataggcacggattggtccatgtctggtcaaattgagcaatccccaaaatgtgtaaatccagtcaattattaatggcaatgaatcttgaattgtcaaggaattggcaacaagttgaggacattgatgcttgctgttcaaggtgactggattatgtgtgatgccaacatatatgatatggaggagtctgtgagcatggatcagggaagtttaattttcttcagaactggcaataccacgatgaatttgactgtttttagggaatttgactttaggatagtattgaaatgcaaggagttgcaatagttgtagaaggattttcagtcctctgtatatctgtatttttgaagaatagttgtctgtttctactgtgtaattgttcctagccacgatttatgtttttccacgtggttcttaaacatgtgttgtaatgcacaagttttgttttggctaggggttcgcggactttatcgaagcaaaattgaatttgtttaatgccgaagaaagaatatccgttcaagtcaagggcattagtgaatgagaaaaatcaatactaggtttcaaatgtaatttatatttgaaaatagatgaatctgtactgtaactttgctgtttctgtaattaacaatatccatggattataggtggtgtattcaaggtacttgaccatggttgggcaccttgcatcagaagtgtgcactaatataaactgtaaagtgct

SEQ ID NO: 7658 - DNA, 1875 bp, Lactuca sativa
ttttttctcagagagcatcacacaaattggatatatacttctgcatattcatagatttagggcacaaatatggcgaattagtgccaggggattgcaaagttttccttacatatttgattgtactttgtgccaattattgctcagggccacgataatgcccacttaactaataatttgtactagggtcctgagatttagggttttctaaaagaatgttgaagctctattgtgatcaagtatcgactgtcttggtttcgagcacatgaacacaaaaagaaatgtataatacaagtttgtagaggcttaatttgtgttgttgtacgctagaggtgaaagaggaagcgatggacgggaggaggataacggcgagtccacgtccgtgcaatggccggagggtggtggcgaagaagcgaccgcgtggtggtgttgatgggtttgtgaatagtgttaagaagcttcagaggagagagatttgttcaaagcgggatcgttcttttagtatgtgtgatgctcaggagaggttcagaaatatccgcttacaggaggagtatgatacccatgatccaaaaggacactgctctatggtattaccatttctcaaaaagagatcaaaaatcgttgaaatcgttgctgctcgtgatatagtctttgctcttgcacaatctggaatctgtgctgcatttagtcgagaaactaaccaaaggatttgctttctgaatgtgagtcctgatgaagttataagaagcttgttttacaacaagaataacgattccctcattacagtttcagtgtatgcttcagacagtttcagttccttaaaatgtcgaacaacaggaattgaatatatacgaagaggtaaaccagatgctggttttgctctttttgaatcagaatctttaaaatggcctggatttgtggagtttgatgatgtcaatggtaaagtcctcacattctcagcacaagatagcatttacaaggtgtttgatttgaaaaactacatgatgttatactccatatcagataaaaatgttcaagaaatcaaaatcagccctggaatcatgttattgatattcaacaaagcaagtggtcatgtccctctcaagattctctcaattgaagatggaactgttttaaagactttcaatcatctccttcatagaaataaaaaggtggatttcatcgaacagtttaacgaaaagcttcttgtgaaacaagagaatgaaaatcttcagattcttgatgtacgtaattctgagttaacagaagtgagtagaacagaattcatgacaccatcagcattcatctttctgtatgagaatcagctgttcttgacattcagaaacagaacagttgctgtttggaattttcgtggggagcttgtgacttcatttgaagatcatttattatggcatccagattgcaacaccaacaatatatacatcacaagtgatcaggatcttattatctcatattgtaaagctgattctgatgatcctttaactgaaggaaatggatcgatcaacatcagcaatattctaacaggaaaatgtcttgcaaaagtgaaggcaataaatggtggtggaatcttggaagattgtatatgcagtgacagtgacaatgacataatgatgaaatctaagggtgggaaaaggtgcaggtgcagctcacaggatcaggtggtggggcggaggatcacaagctcagttacagaagctttggaggacataactgcacttttctatgatgaagagaggaatgagatttatactggtaataggcttggtttagtccatgtttggtctaactaattgtttcccactttatccattcagacgtgtctctactatatatatatatggatcaattatccatggt

SEQ ID NO: 7659 - DNA, 2229 bp, Mimulus guttatus
tgtcaatctggattttaaactccagtggacggcgaactcctcctctataatccgacacgctcccattcttctctctctctcttcaattttctctctctagctctaatctttgcctttgttcaaacacaaaacacagacaattttttttttctttttttttttgtgtatgaacgaacagtgaagaatttcttgagaaacccaattgtttgaagtgggttttctgtattgcttcttgtttgaagaagcccctgaaattctatttctgggtctggagatttagggttttattttttctcaccaaaagtgaatgcaaaactgagaggagggtgtgtgaaagctagcgttcggaaatagtcggcgatggatgggaggagaataacggcgagtccgcggccgtgcactgggcggcgggtggtggcgaagaagcggcgccgcggtggaatagatgggtttgttaacagcgtgaagaaactgcagaggagggagatatctacgaaacgggaccgagctttcagcatgtgtgatgctcaagagcggtttcggaatattcgcctgcaggaagaatatgatacccatgatccaaaggggtattctccctcgtcgttgccattcttaaagaaaaggtcgaaaattatcgagatagttgctgcccgtgatattgtatttgctcttgcgcaatctggtgtttgtgcagcatttagccgagagacgaaccagaggatatgctttctaaatgtcagtcacgatgaagtcatacggagcttattttacaacaaaaataacgattcgcttatcaccgtttcggtttacgcttcggacaattttagttccttaaaatgcagaaccacaaggatagaatacatacgacggggtaagcccgatgctggttttgcactctttgaatcggagtcgttaaagtggcctggttttgtggaatttgacgatgtaaacgggaaggttcttacctattccgcacaagatagcatctacaaggtgtttgacttgaaaaattatacgatgctgtactgcatttcggataaaaatgttcaagagattaagatcagtccaggaatcatgctattgatattgacaaaaactcatagcggtgttccgttgaagattctctcgatcgaggatggttccgttcttaaatctttcagccacctcctccataaaaccaagaaggtcgatttcatcgaacaattcaacgaaaagcttctcgtcaagcaagagaacgagaaccttcagattcttgatgtccgcaattcggagttgaccgaagtcagcagcacggagttcatgaccccatctgcgtttatatttctatacgagaaccagttattcttgacattcagaaacgggacagttgctgtttggaacttcagaggggagcgtgttacctcgttcgatgatcatcttttatggcaccccgattgcaatacgaacaatatctacattaccagcgatcaggatctcattatttcgtattgcaaatccgacaccgatgagtcgctgtctgatggaaatgctggctcgatcaatataagcaatatcttgaccggaaaatgcctagcgaaaatcaaggcgagcaacagccttcaagcggacgagtgctggtgcagcgcaaattgtggtggtagaaactgcaactctcggaagcgtgtagaagcttctagaatcaagagcaccgtcgcggaagctttggaagatatcacggctctcttctacgatgaagaccggaacgagatctacaccggcaataggctcggcctcatccatgtctggtctaactaaaagacgagagtgcatgtataaagttaggtgggcgccgctctgaatcatgggtaaaccctactagtttacaccatggtttgtaactgtggtgtttgtaatttcttctagaagtttctgctgtttgatttgatgagttgggggtttcgacccccctttattcggatttattggatcattttttagttgtgttgtaactttgggggtagtttcttaagagagcagcctgttcaagttgtggcatttgcatttgggtttggtttaatgtttgttgtaatagatgatgatgatttgtaaatttgctgacgtgtgctgaattctctaggcttccattgatttgcatttaatgtgtgtttcgaataatggtttagagatttagcccttttttcggttacttacatcggattaatttggattatatacgattatgtgttgttt

SEQ ID NO: 7660 - DNA, 2362 bp, Pinus taeda
cctcctcgttttggtttcaacaggtatcgaaaggtaccagccaatccgagctctcacgcctcttggatctccatgcccaagtcctctaggggacttctcaaacagcatgagaagcccatttgctcgtttcctctacaatgcgcagtttcccctttgaatggtggtcttgttttcgtctgcagaatgggcttggcaagggtctccgaagggttctgctacgccatctgtaatctataacacggcccggttggttttcaaatgcaaacggagtccctagggttcgatctgtgcaatatttgctgctgcgatggcgcggcgcagaggcttcttttgacgctgttgtttgctgcgaagggagaatagttatctttgaccttcttgaatatggagggcagaaggatcgcagcaagccctcgaccttgcagtggccggcgcatcgtcgctgccaaacgtcaacgggtggacgcttctgctaactgcgtgcgtaagctgcaaaggcgggagatcggcaccagtggcaacagggctttcaacatcactaattcccaggagaagtttcggaattttcagttgcaggaggaatttgacacttatgatcccaaggcacattggtttttgaagctgcagttcctgaaaaagaggtcgaaaatcatagaaattgttgcagcacgtgatattgtatttgctttggcccaatctggtgtttgtgcagcgtttagcagggaggccaataagaaaatatgctacctgaatataagcccggatgaagtgatacgcagcctcttttataataagaacaatgattctctaatcacagtgtcagtatatgcctcggataatttcagttcactgaaatgcagaacaacacccattgagtatatccggaggggtcaaccagatgcaggctttgccttattcgagtccgagtcattgaaatggcctggttttgtagagtttgatgatgtgaacggaaaagttctcacctactctgcccaggatggcatctataaggtgttcgacttaaagaactacacattattgtattcaatatcagatgaacatgttcaagagataaagatcagcccagggataatgttactaatattcgacagggccagtgggcatgttccgttaaaaattttatctatagaggatggcactgttttaaaagcatttaatcacctattgcatcgcaataagaaggttgactttattgagcagttcaatgagaaacttctcgtaaaacaagaaaatgagaacctacaaatactggatgttcgcaatacgcaattgactgaagtaagcagggcagagttcttgactccatcggcgtttatttttctttatgagaatcagttattcctgacattccgcaatcgtacagtggctgtatggaatttcagaggggagctggttacctcatttgaggaccatttgctatggcatcctgattgcaatacaaataacatttatattactagtgatcaagatttgattatttcttactgcaaggcacttcctctttcttctggagcagaagaaaatgttggttctataaatataagcaacatattaactggaaagtgcctggcgaagattcgtgcaaatgatccaaatgttcagattagtcctagaaatcgcccaaatgcctctacaatcagaagtaccgtagaagaagcacttgaagacatcactgccttattctacgatgaagagcggaatgaaatatatactggcaattggcatggcttggttcatgtctggtctaactgattaacgtctgtatgttgtgcatacccagtcaatcattcactggattttatgtcgaaatctcaagcactggggcctgacagtgttgctaattttcgagtgtttggattatgcttcttgatagcaagaaatatggaaatttaagatgcttgattaacagtgatataggaaggagctcgtggcaacataattcaaattatgaaagttttgattcttcaaatgtacacgccaagggcttgataggtcagttgtctgataatatgactcaatgggcaggtgctcaaattgcagaaaattgcgattgatacagtagatagtttagtctcctgtaaatctgtattctgaattgtaattgacccttaccatggaagggtctctaatttaatattttctttattttttgtagaagacttgttttctcatgtgcttttaaagctctgcagaacgttggaatcaagctctaaggatcgtagattttataaaaggcaaaagcttaatctctgcaatgctcaagagacatgcaattgaaatacttccctttatcttacaagtgtataaaatgaatatattatcaccaaatttttaaagattt

SEQ ID NO: 7661 - DNA, 2136 bp, Brassica napus
cagcatgaaggattctgaatccagtcggcgatgtgtggaggaatcagagaggagagtgatttggggtctgtgattggactctgtttctctagtcatgtttgattgggacgacgaagagcttactaatatgatatggggtgacgacggagagacaggcgaccatattgtgccttttaaagtaagaaacaggaaggaacagggcgatgaatctaataaggcagttaagccagctgagcagaagacaactcaccttcatgatagtaagctgggggggagcagttcagggcaaaatattgagtgtatgagctcatggcctgactcatcagtatctaatgctagaaaagctgatccaggaccaggttcgagtgagccagctagatatgattcaacaagaagtgagaaaacgtctgaacttgggaaaggccctgatatttttcatagcactgatgagagtaaagagcatggtgattttgatgagtatggatgggctaacattggtagctttgatgatcttgatcgaatgttcagtagtgatgtccctatatttggcgatggcagtctcagcggtgcagatgaattatggtcttcttctaaagatgtatccaagccgttaccatccattttggactctcaagatctaggattggacattagaactcagtttgagcaacaagagaaccagcagtttccattgactggagaaaccaatggtggtccatcatcccaaagtgcgcctagagttcgtgtaaccccaaaagctgagcaatatcatgagcataagagtcaatcctcagttgatgaccagccatatcaacaacacaaaatgatgaagctttcggaaatgttggggacttgtgaggcaggatcgtttcaagatccatacggtcagaggtcaaggggaaaatttgtaaaccagttggcaccgtcacgatcaactttgatgggtgtcaatctgcggagtgagtctcaagggtctgggacatcacattatccacagatgccaaaccaatacatggctacttctggttttggtaatccatattctgctgtgcatgtagtttcagccttccaatgtcctgatgttaacaagaatcagctgatgcatccttcctacaaccctgcttctgctatctctgcaaacacggtaacagatgactgtgcaccaccttcaacaatgacgccgcaggaaaaactagaaaaacttaggcgcagacagcaaatgcaggcgatgcttgctattcagagacaacaacagcaatttcgtcaccaggttcctgtagcagatcagtccattactcagcttgtcgacaaaactagtcttcaagggctaactgcaataccttcctttgatcccaattcatctctggaattagatgattctggaaactttgctgctgctgttgataatccatcagaattctcggttctttatcgacttcaagatgttgtagcaaagttagatatggaaacaaggacttgtataagggatagcttattccgtttggctgatagcgcaggtcagagacatcacactagtgatacaccccacagtaataagactagccaagatgaccgggaggttattcctcaagaaaaatccagatatagatatgcagggatgctagacacagaaacagtaaccaatcccacagacagaactgtggcttatttgctctttcataggccttttgatatgtatgcggcaaagcatacggaaggactagaatcaccatcttcttcgaagatgggagctgaagtaaaagggagttttcctagcacaagagagagtcgcatgattaagcagaaggcaaaagaggaagatgtacctgcagtttcacttgctttagggtatgcatccaactcaggatccagtagcactgttgctgagagggttgttgaagcatcccaaggaaacaaaagaaagttgtgaagtatataatattgtcccatgccatttcatattcgttcatatatgggcttgtatacagatgtattggtgactaatgttcaggtgttgcttttgtcaactatcagtttaggtttgcggtgttagagaggagcctgaggaaatctgcagcgtaggcaacatctctctgcattgctagaaacaatctcctgtttactcctttcatgtaa

SEQ ID NO: 7662 - DNA, 1532 bp, Brassica napus
gcacactctgctcccttctcacatctctcacacatccgagaagaaacttttcaaaaaatggcgttgcttgtagagaagacgtcgagtgggcgtgagtacaaggtcaaggacatgtctcaggccgacttcggccgtctcgagatcgagctcgccgaggtcgagatgcctggactcgtctcttgccgcaccgagttcggaccttctcagcccttcaaaggcgctaggatcaccggttctctccacatgacgatccaaaccgccgttctcatcgaaacgctaaccgctctcggcgcagaggtcaggtggtgctcctgcaacatcttctccacccaggaccacgccgccgcagccatcgcccgtgactccgccgccgtgttcgcgtggaaaggagagactctccaggagtactggtggtgcacggagagagctcttgattggggtccgggaggtggtcctgacctgattgttgacgatggtggtgacgcgacgctcttgatccatgaaggtgttaaggctgaagagatctttgccaagaccggtcaggtccctgatccgacatctactgataatcctgagtttcagattgtgttgtcgattattaaagatggtcttcaagttgatcccaagaagtaccataagatgaaggagagattggttggtgtttctgaggaaacgaccactggtgttaagaggctttaccagatgcaggagactggagctcttttgttccctgccattaacgtcaatgattccgtcactaagagcaagtttgacaacttgtatggatgtcgccactctctccccgacggtctcatgagagccactgatgtcatgatcgccggaaaggtcgctgttatctgcggttatggtgacgtcggaaagggttgtgctgcggccatgaaaaccgctggtgcccgtgtcatcgtcactgagatcgatccaatctgtgcccttcaggctctcatggaaggccttcaagttctaaccctcgaggacgttgtatcagaagctgacatcttttgcaccaccactggaaacaaagacatcatcatggtcgaccacatgaggaagatgaagaacaacgccattgtctgcaacattggtcactttgacaacgaaatcgacatgctcgggctcgagactttccctggtgtgaaacgtatcaccatcaagccgcagactgataggtgggtgtttcccgacaccaagacaggcatcattgtgctagcagagggtcgtctgatgaacttgggttgtgctactggacacccaagtttcgtgatgtcgtgctcgttcaccaaccaggtgattgcacagcttgagctctggaacgagaagtcgagtgggaagtatgagaagaaggtgtatgttctgcctaagcatttagatgagaaggtagctgcacttcacttgggcaagctcggtgctagactcaccaagctcaccaaggaccagtctgactacgtcagcatacccgttgaaggtccttacaagcctgttcactacaggtactgagaaggaaaaggaccaag

SEQ ID NO: 7663 - DNA, 1711 bp, Brassica napus
cttttcaaaaaatggcgttgcttgtagagaagacgtcgagtgggcgtgagtacaaggtcaaggacatgtctcaggccgacttcggccgtctcgagatcgagctcgccgaggtcgagatgcctggactcgtctcttgccgcaccgagttcggaccttctcagcccttcaaaggcgctaggatcaccggttctctccacatgacgatccaaaccgccgttctcatcgaaacgctaaccgctctcggcgcagaggtcaggtggtgctcctgcaacatcttctccacccaggaccacgccgccgcagccatcgcccgtgactccgccgccgtgttcgcgtggaaaggagagactctccaggagtactggtggtgcacggagagagctcttgattggggtccgggaggtggtcctgacctgattgttgacgatggtggtgacgcgacgctcttgatccatgaaggtgttaaggctgaagagatctttgccaagaccggtcaggtccctgatccgacatctactgataatcctgagtttcagattgtgttgtcgattattaaagatggtcttcaagttgatcccaagaagtaccataagatgaaggagagattggttggtgtttctgaggagaccaccactggtgttaagaggctttaccagatgcaggagactggagctctcttgttccctgccattaacgttaatgactccgtcaccaagagcaagtttgacaacttgtatggatgtcgccactctctccctgacggtctcatgagagccactgatgtcatgatcgccggaaaggtcgctgttatctgcggttacggtgatgtcggaaagggttgtgctgcagccatgaaaaccgctggcgcacgtgtgatcgtgactgagatcgatccaatctgtgcccttcaggctctcatggaaggccttcaagttctaacccttgaggacgtcgtctctgaagctgacatcttttgcaccaccactggaaacaaagacatcatcatggtcgaccacatgaggaagatgaagaacaacgccatcgtctgcaacattggtcactttgacaatgaaatcgacatgcaagggcttgagacttaccctggtgtgaaacgcatcaccatcaagccacagactgataggtgggtgttccctgacaccaaatcaggaatcattgtgttagccgagggtcgtctgatgaacttgggatgtgccactggacacccgagtttcgtgatgtcttgctcgttcaccaaccaggtgattgcacagcttgagctctggaacgagaagtcaagtgggaagtatgagaagaaggtatatgttttgcctaaacacttggatgagaaggttgctgcacttcacttgggcaagctaggtgctagactcaccaagctcaccaaggaccaatctgactacgttagcatacccgttgaaggtccctacaagcctgttagctacaggtactgagaagaaaaaaaaggatcaagctatggttcttcgtatggttttatgattttaccatttggttataatccaaatgacaattgtttgagttggttcgggtctggtggttggggaaatatgagatattggtcttcttatgaagttgatcaaatattggcatcaataaggggttgttgttctttggttttgagaggctgttttatgttttgttttgtttttcctttttaattttatataatctcaag

SEQ ID NO: 7664 - DNA, 1629 bp, Brassica napus
aaaaaatggcgttgcttgtagagaagacgtcgagtggccgtgagtacaaggtcaaggacatgtctcaggccgacttcggccgtctcgagatcgagctcgccgaggtcgagatgcctggactcgtctcttgccgcaccgagttcggaccttctcagcccctcaaaggcgctaggatcaccggttctctccacatgacgatccaaaccgccgtcctcatcgagaccctaaccgccctcggcgcggaggtcagatggtgctcctgcaacatcttctccacccaggaccacgccgccgcagcgatcgctcgtgactccgccgccgtgttcgcgtggaaaggagagactctccaggagtattggtggtgcacggagagagctcttgactggggtccgggaggtggtcctgacctgattgttgacgatggtggtgacgctacgcttttgatccacgaaggtgttaaggctgaagagatcttcgcgaagacaggtcaggtccctgatccgacgtctactgataatcctgagtttcagatcgtgttgtcgattatcaaagatggtcttcaagttgatcccaagaagtaccataagatgaaggagagattggttggtgtttctgaggagacgaccactggtgttaagaggctttatcagatgcaggagactggagctcttttgttccctgccattaacgttaatgactctgtcaccaagagcaagtttgacaacttgtatggatgtcgccactctctccccgacggtctcatgagagccactgatgtcatgatcgccggaaaggtcgctgttatctgcggttatggtgacgtcggaaagggttgtgctgcagccatgaaaaccgctggtgcccgtgtcatcgtcactgagatcgatccaatctgtgcccttcaggctctcatggaaggccttcaagttctaaccctcgaggacgttgtctctgaagctgacatcttttgcaccaccactggaaacaaagacatcatcatggtcgaccacatgaggaagatgaagaacaacgccattgtctgcaacattggtcactttgacaacgaaatcgacatgctcgggctcgagactttccctggtgtgaaacgtatcaccatcaagccgcagactgataggtgggtgtttcccgacaccaagacaggcatcattgtgctagcagagggtcgtctgatgaacttggggtgtgctactggacacccaagtttcgtgatgtcgtgctcgttcaccaaccaggtgattgcacagcttgagctctggaacgagaagtcgagtgggaagtatgagaagaaggtgtatgttctgcctaagcatttagatgagaaggtagctgcacttcacttgggcaagctcggtgctagactcaccaagctcaccaaggaccagtctgactacgtcagcatacccgttgaaggtccttacaagcctgttcactacaggtactgagaagaaaaaaaaggatcaagctatggttcttcgtatggttttatgattttaccatttggttataatccaaatgacaattgtttgagttggttcgggtctggtggttggggaaatatgagatattggtcttcttatgaagttgatcaaatattggtatcaataaggg

SEQ ID NO: 7665 - DNA, 1678 bp, Brassica napus
aaaatggcgttgcttgtagagaagacatcgagtggccgtgagcacaaggtcaaggacatgtctcaggccgacttcggccgtctcgagatagagctcgccgaggtcgaaatgcctggactcgtctcctgccgcaccgagttcggaccttctcagcccttcaaaggcgctaggatcaccggttctctccacatgacgatccaaaccgccgtcctcatcgaaacgctaaccgccctcggcgcggaggtcagatggtgctcctgcaacatcttctccacccaggaccacgccgccgcagccatcgcccgtgactccgccgccgtgttcgcgtggaaaggagagactctccaggagtactggtggtgcacggagagagctcttgactggggtccgggaggtggtcctgatctgatcgtcgacgacggtggtgacgctacgcttttgatccacgaaggtgttaaggcagaagagatcttcgcgaagacaggtcaggtccctgatccgacatctactgataatcctgagtttcagatcgtgttgtcgattatcaaagatggtcttcaagttgatcccaagaagtaccataagatgaaggagagattggttggtgtttcggaggaaacgaccactggtgttaagaggctttatcagatgcaggagactggagctcttttgttccctgccattaacgttaatgattccgtcaccaagagcaagtttgacaacttgtatggatgtcgccactctctccccgacggtctcatgagagccactgatgtcatgatcgccggaaaagtcgctgttatctgcggttatggtgacgtcggaaagggttgtgctgcagccatgaaaaccgctggtgcccgtgtaatcgtcactgagatcgatccaatctgtgcccttcaggctctcatggaaggccttcaagttctaaccctcgaggacgttgtctctgaagctgacatcttttgcaccaccactggaaacaaagacatcatcatggtcgaccacatgaggaagatgaagaacaacgccattgtctgcaacattggtcactttgacaacgaaatcgacatgctcgggctcgagactttccctggtgtgaaacgtatcaccatcaagccgcagactgataggtgggtgtttcccgacaccaagacaggcatcattgtgctagcagagggtcgtctgatgaacttggggtgtgctactggacacccaagtttcgtgatgtcgtgctcgttcaccaaccaggtgattgcacagcttgagctctggaacgagaagtcgagtgggaagtatgagaagaaggtgtatgttctgcctaagcatttagatgagaaggtagctgcacttcacttgggcaagctcggtgctagactcaccaagctcaccaaggaccagtctgactacgtcagcatacccgttgaaggtccttacaagcctgttcactacaggtactgagggaccaagctttggttgggaaaaacatgagatattggtcttcttatgaggttgaccaaatattggtatgaataaggggttgttgttattggctttgagaggctgtttctttgttttgtttttcattttctattttatatcatctcaagatgaattagtttatgtttttacactcttgttaggctttatctaattgatgttctttttaaaaaaaaaa

SEQ ID NO: 7666 - DNA, 1441 bp, Brassica rapa
  misc_feature (1382)..(1382): n is a, c, g, or t
atggcgttgcttgtggagaagacgtcgagtggccgtgagtacaaggtcaaggacatgtctcaggccgacttcggccgtctcgagatcgagctggccgaggtcgaaatgcctgggctcgtctcttgccgcaccgagttcggaccttctcagcccttcaaaggcgctagaatcaccggttctctccacatgacgatccaaaccgccgttctcatcgaaacgctaaccgctcttggcgccgaggtcaggtggtgctcatgcaacatcttctccacgcaagaccacgcagccgccgccatcgctcgtgactccgccgccgtgttcgcatggaaaggagagactcttcaggagtactggtggtgcacggagagggctctcgactggggtccgggaggtggtcctgatctgatcgttgacgacggtggtgatgctactctcttgattcacgaaggagttaaggctgaggagatctttgcgaagacgggtcaggtccctgatccgagttctactgataatcctgagtttcagatcgtgttgtcgattattaaagatggtcttcaagttgatcccaagaagtatcataagatgaaggagagattggttggtgtttcggaggagacgaccactggtgttaagaggctttaccagatgcaggagactggagctctcttgttccctgccattaacgtcaatgactccgttaccaagagcaagttcgacaacttgtatggatgtcgccactctctccctgacggtctcatgagagccactgatgtcatgatcgctggaaaggtcgctgttatctgcggttacggtgatgtcggaaagggttgtgccgcagccatgaaaacagctggtgcacgtgtgatcgtgactgagatagatccaatatgtgcccttcaggctctcatggaaggcctccaagtcctaacccttgaggacgtcgtctccgaagctgacatattttgcaccaccactggaaacaaagacatcatcatggtcgaccacatgaggaagatgaagaacaacgccattgtctgcaacattggccactttgacaacgaaatcgatatgcaaggacttgagaccttccctggtgtgaaacgcatcaccatcaagccgcagactgataggtgggtgttccccgacaccaagtcaggcatcattgtgctagcggagggtcgtctgatgaacttgggatgcgccactggtcacccgagtttcgtgatgtcgtgctcgttcaccaaccaggtgattgcgcagcttgagctatggaacgagaagtcgagcgggaagtatgagaagaaagtatatgttttgcctaagcacttggacgagaaggttgctgcacttcacttgggaaagctcggtgctagactcaccangctcaccaaggaccaatctgactatgtcagcatacccattgaaggtccttacaagcctg

SEQ ID NO: 7667 - DNA, 1717 bp, Brassica napus
atggcgttgcttgtagagaagacgtcgagtggccgtgagtacaaggtcaaggacatgtctcaggccgacttcggccgtctcgagatcgagctcgccgaggtcgaaatgcctggtctcgtctcttgcgtcaccgagttcggaccatctcagccgctcaaaggagcaagaatcaccggctctctccacatgaccatccaaaccgctgtcctcatcgaaacactaaccgctctcggcgcagaggtcagatggtgctcctgcaacatcttctccacccaggaccacgccgccgccgccattgcccgtgactccgccgccgtgttcgcgtggaaaggggagactctccaggagtactggtggtgcacggagagggctctcgactggggtcctggaggtggtcccgacctgatcgtcgacgacggtggtgacgctacgctccttatccacgaaggtgttaaggctgaggagatcttcgccaagaccggtcagctccccgacccgacttccaccgacaatcctgagtttcagatcgtgttgtcgatcatcaaagatggtcttcaggttgatcccaagaagtaccacaagatgaaggagagattggttggtgtctctgaggagaccaccactggtgttaagaggctttaccagatgcaggagactggtgctctcttgttccctgccattaacgttaatgactccgtcaccaagagcaagtttgacaacttgtatggatgtcgccactctctccctgacggtctcatgagagccactgatgtcatgatcgccggaaaggtcgctgttatctgcggttacggtgatgtcggaaagggttgtgctgcagccatgaaaaccgctggcgcacgtgtgatcgtgactgagatcgatccaatctgtgcccttcaggctctcatggaaggccttcaagttctaacccttgaggacgtcgtctctgaagctgacatcttttgcaccaccactggaaacaaagacatcatcatggtcgaccacatgaggaagatgaagaacaacgccattgtctgcaacattggtcactttgacaatgaaatcgacatgcaagggcttgagacttaccctggtgtgaaacgcatcaccatcaagccacagactgataggtgggtgttccctgacaccaagtctggcatcattgtgttagctgagggtcgtctgatgaacttgggatgtgccactggacacccgagtttcgtgatgtcttgctcgttcaccaaccaggtgattgcacagcttgagctctggaacgagaagtcaagtgggaagtatgagaagaaggtatatgttttgcctaaacacttggatgagaaggtcgctgcacttcacttgggcaagctaggtgctagactcaccaagctcaccaaggaccaatctgactacgttagcatacccgttgaaggtccctacaagcctgttagctacaggtactgagaagaaaaaaaagaggatcaagctatggttcttcgtatggttttatgattttaccatttggttataatccaaatggcaattgtttgagttggttcgggtctggtctggttggggaaatatgagatattggtcttcttatgaagttgatcaaatattggtatcaataaggggttgttgttctttggttttgagaggctgttttatgttttgttttgtttttccttttttaattttatataatctcaagataatttaatta

SEQ ID NO: 7668 - DNA, 1684 bp, Brassica napus
ccacattcacaaagaaacattcaaaacaatggcgttgcttgtagagaagacgtcgagtggccgtgagtacaaggtcaaggacatgtctcaggccgacttcggccgtctcgagatcgagctcgccgaggtcgaaatgcctggtctcgtctcttgcgtcaccgagttcggaccatctcagccgctcaaaggagcaagaatcaccggctctctccacatgaccatccaaaccgctgtcctcatcgagaccttaaccgctctcggcgcagaggtcagatggtgctcctgcaacatcttctccacccaggaccacgccgccgccgccattgcccgtgactccgcggccgtgttcgcgtggaaaggggagactctccaggagtactggtggtgcacggagagggctctcgactggggtcctggaggtggtcccgacctgatcgtcgacgacggtggtgacgctactctccttatccacgaaggtgttaaggctgaggagatcttcgccaagaccggtcagctccccgacccgacttccaccgacaatcctgagtttcagatcgtgttgtcgatcatcaaagatggtcttcaggttgatcccaagaagtaccacaagatgaaggagagattggttggtgtctctgaggagaccaccactggtgttaagaggctttaccagatgcaggagactggtgctctcttgttccctgccattaacgtcaatgactccgtcaccaagagcaagtttgacaacttgtatggatgtcgccactctctccctgacggtctcatgagagccactgatgtcatgatcgccggaaaggtcgccgttatctgcggttacggtgatgtcggaaagggttgtgctgcagccatgaaaaccgctggtgcacgtgtgatcgtgactgagatcgatccaatctgtgcccttcaggctctcatggaaggccttcaagttctaacccttgaggacgtcgtctctgaagctgacatcttttgcaccaccactggaaacaaagacatcatcatggtcgaccacatgaggaagatgaagaacaacgccatcgtctgcaacattggtcactttgacaatgaaatcgacatgcaagggcttgagacttaccctggtgtgaaacgcatcaccatcaagccacagactgataggtgggtgttccctgacaccaagtctggcatcattgtgttagccgagggtcgtctgatgaacttgggatgtgccactggacacccgagtttcgtgatgtcttgctcgttcaccaaccaggtgattgcacagcttgagctctggaacgagaagtcaagtgggaagtatgagaagaaggtatatgttttgcctaaacacttggatgagaaggtcgctgcacttcacttgggcaagctaggtgctagactcaccaagctcaccaaggaccaatctgactacgttagcatacccgttgaaggtccctacaagcctgttagctacaggtactgagaagaaaaaaagaggatcaagctatggttcttcgtatggttttatgattttaccatttggttataatccaaatggcaattgtttgagttggttcgggtctggtctggttggggaaatatgagatattggtcttcttatgaagttgatcaaatattggtatcaataaggggttgttgttctttggtttgagaggctgtt

SEQ ID NO: 7669 - DNA, 1537 bp, Brassica napus
acgtcgagtggccgtgagtacaaggtcaaggacatgtctcaggccgacttcggacgtctcgagatcgagctcgccgaggtcgaaatgcctgggctcgtctcttgccgcaccgagttcggaccttctcagccactcaaaggcgctagaatcaccggttctctccacatgaccatccaaaccgccgttctcatcgaaacgctaaccgctcttggtgccgaggtcaggtggtgctcatgcaacatcttctccactcaagaccacgccgcagcagccatcgctcgtgattcagccgccgtgttcgcatggaaaggggagactcttcaggagtactggtggtgcacggagagggctctcgactggggtcccggaggtggtcctgatctgatcgttgacgacggtggtgacgccacgctcttgatccacgaaggagttaaggcggaggagatctttgcgaagacgggtcaggtccctgatccgagttctactgataatcctgagtttcagatcgtgttgtcgatcattaaagatggtcttcaagttgatccgaagaagtatcataagatgaaggagagattggttggtgtttcggaggagacgaccactggtgttaagaggctttaccagatgcaggagactggagctctcttgttccctgccattaacgtcaatgactccgtcaccaagagcaagttcgacaacttgtatggatgtcgccactctctccctgacggcctcatgagagccactgatgtcatgatcgccggaaaggtcgctgttatctgcggttacggtgatgtcggaaagggttgtgctgcagccatgaaaaccgctggtgcacgtgtgatcgtgactgagatagatccaatctgtgcgcttcaggctctcatggaaggcctccaggttctaacccttgaggacgtcgtctcagaagctgacatcttttgcaccaccactggaaacaaagacatcatcatggtcgaccacatgaggaagatgaagaacaacgccattgtctgcaacattggtcacttcgacaacgaaatcgatatgcaaggacttgagactttccctggtgtgaaacgcatcaccatcaagcctcagactgataggtgggtgttccctgacaccaagtcaggcatcattgtgctagccgagggtcgtctgatgaacttgggatgcgccactggacacccgagtttcgtgatgtcgtgctcgttcaccaaccaggtgattgcgcagcttgagctctggaacgagaagtcgagcgggaagtatgagaagaaggtatatgttttgcctaagcacttggacgagaaggttgctgcacttcacttggggaaactcggtgctagactcaccaagctcaccaaggaccaatctgactatgtcagtatacccattgaaggtccttacaagcctggtcactacaggtactgagcgttggttcttcgtgtgggttttatgattaggccatttgagttggtttgggttctggttgaggaatgtgagatattggtcttctgatgaggttgaccaa

SEQ ID NO: 7670 - DNA, 1762 bp, Brassica rapa
ccatctccacattcacaaagaaacattcaaaacaatggcgttgcttgtagagaagacgtcgagtggccgtgagtacaaggtcaaggacatgtctcaggccgacttcggccgtctcgagatcgagctcgccgaggtcgaaatgcctggtctcgtctcttgcgtcaccgagttcggaccatctcagccgctcaaaggagcaagaatcaccggctctctccacatgaccatccaaaccgctgtcctcatcgaaaccttaaccgctctcggcgcagaggtcagatggtgctcctgcaacatcttctccacccaggaccacgccgccgccgccattgcccgtgactccgccgccgtgttcgcgtggaaaggggagactctccaggagtactggtggtgcacggagagggctctcgactggggtcctggaggtggtcccgacctgatcgtcgacgacggtggtgacgctacgctccttatccacgaaggtgttaaggctgaggagatcttcgccaagaccggtcagctccccgacccgacttccaccgacaatcctgagtttcagatcgtgttgtcgatcatcaaagatggtcttcaggttgatcccaagaagtaccacaagatgaaggagagattggttggtgtctctgaggagaccaccactggtgttaagaggctttaccagatgcaggagactggtgctctcttgttccctgccattaacgttaatgactccgtcaccaagagcaagtttgacaacttgtatggatgtcgccactctctccctgacggtctcatgagagccactgatgtcatgatcgccggaaaggtcgctgttatctgcggttacggtgatgtcggaaagggttgtgctgcagccatgaaaaccgctggcgcacgtgtgatcgtgactgagatcgatccaatctgtgcccttcaggctctcatggaaggccttcaagttctaacccttgaggacgtcgtctctgaagctgacatcttttgcaccaccactggaaacaaagacatcatcatggtcgaccacatgaggaagatgaagaacaacgccattgtctgcaacattggtcactttgacaatgaaatcgacatgcaagggcttgagacttaccctggtgtgaaacgcatcaccatcaagccacagactgataggtgggtgttccctgacaccaagtctggcatcattgtgttagccgagggtcgtctgatgaacttgggatgtgccactggacacccgagtttcgtgatgtcttgctcgttcaccaaccaggtgattgcacagcttgagctctggaacgagaagtcaagtgggaagtatgagaagaaggtatatgttttgcctaaacacttggatgagaaggtcgctgcacttcacttgggcaagctaggtgctagactcaccaagctcaccaaggaccaatctgactacgttagcatacccgttgaaggtccctacaagcctgttagctacaggtactgagaagaaaaaaaagaggatcaagctatggttcttcgtatggttttatgattttaccatttggttataatccaaatggcaattgtttgagttggttcgggtctggtctggttggggaaatatgagatattggtcttcttatgaagttgatcaaatattggtatcaataaggggttgttgttctttggttttgagaggctgttttatgttttgttttgtttttcctttttaattttatataatctcaagataatttaattatgttttacacta

SEQ ID NO: 7671 - DNA, 1726 bp, Brassica napus
catcgaaaaaaaccattcaaaacaatggcgttgcttgtagagaagacgtcgagtggccgtgagtacaaggtcaaggacatgtctcaggccgacttcggccgtctcgagatcgagctcgccgaagtcgaaatgcctggtctcgtctcatgcgtcaccgagttcggaccatctcagccgctcaaaggagcgagaatcaccggttctctccacatgaccatccaaaccgctgtcctcatcgagaccttaaccgctctcggcgcagaggtcagatggtgctcctgcaacatcttctccacccaggaccacgccgccgccgccattgcccgtgactccgcagccgtgttcgcgtggaaaggggagactctccaggagtactggtggtgcacggagagggctctcgactggggtcctggaggtggtcccgacctgatcgtcgacgacggtggtgacgctactctccttatccacgaaggtgttaaggctgaggagatcttcgccaagaccggtcagctccccgacccgacttccaccgacaatcctgagtttcagatcgtgttgtcgatcatcaaagatggtcttcaggttgatcccaagaagtaccacaagatgaaggagaggttggttggtgtctctgaggagaccaccactggtgttaagaggctttaccagatgcaggagactggagctctcttgttccctgccattaacgttaatgactccgtcaccaagagcaagtttgacaacttgtatggatgtcgtcactcactccctgacggtctcatgagagccaccgatgtcatgatcgccggaaaggtcgctgttatctgcggttacggtgatgtcggaaagggttgtgctgctgccatgaaaaccgctggtgcacgtgtgatcgtgactgagatcgatccaatctgtgcccttcaggctctcatggaaggccttcaagttctaacccttgaggacgtcgtctctgaagctgacatcttttgcaccaccactggaaacaaagacatcatcatggtcgaccacatgaggaagatgaagaacaacgccatcgtctgcaacattggtcactttgacaatgaaatcgacatgcaagggcttgagacttaccctggtgtgaaacgcatcaccatcaagccacagactgataggtgggtgttccctgacaccaaatcaggaatcattgtgttagccgagggtcgtctgatgaacttgggatgtgccactggacacccgagtttcgtgatgtcttgctcgttcaccaaccaggtgattgcacagcttgagctctggaacgagaagtcaagtgggaagtatgagaagaaggtatatgttttgcctaaacacttggatgagaaggttgctgcacttcacttgggcaagctaggtgctagactcaccaagctcaccaaggaccaatctgactacgttagcatacccgttgaaggtccctacaagcctgttagctacaggtactgagaagaaaaaaaaggatcaagctatggttcttcgtatggttttatgattttaccatttggttataatccaaatgacaattgtttgagttggttcgggtctggtggttggggaaatatgagatattggtcttcttatgaagttgatcaaatattggcatcaataaggggttgttgttctttggttttgagaggctgttttatgttttgttttgtttttcctttttaattttatataatctcaagat

SEQ ID NO: 7672 - DNA, 1450 bp, Brassica rapa
atggcgttgcttgtacagaagacgtcgagtggccgtgagtacaaagtcaaggacatgtctcaggccgacttcggccgtctcgagatcgagctcgccgaggtcgagatgcctggactcgtctcttgccgcaccgagttcggaccttctcagcccttcaaaggcgctaggatcaccggttctctccacatgacgatccaaaccgccgttctcatcgaaacgctaaccgctctcggcgcggaggtcagatggtgctcctgcaacatcttctccacccaggaccacgccgccgcagccatcgcccgtgactccgccgctgtgttcgcgtggaaaggagagactctccaggagtactggtggtgcacggagagagctcttgattggggtccgggaggtggtcctgatctgatcgtcgacgacggtggtgacgctacgcttttgatccacgaaggtgttaaggctgaagagatcttcgcgaagacaggtcaggtccccgatccgacgtctactgataatcctgagtttcagattgtgttgtcgattattaaagatggtcttcaagttgatcccaagaagtaccataagatgaaggagagattggttggtgtttctgaggaaacgaccactggtgttaagaggctttaccagatgcaggagactggagtcttttgttccctgccattaacgttaatgactctgtcaccaagagcaagtttgacaacttgtatggatgtcgccactctctccccgacggtctcatgagagccactgatgtcatgatcgccggaaaggtcgctgttatctgcggttatggtgacgtcggaaagggttgtgctgcagccatgaaaaccgctggtgcccgtgtgatcgtgactgagattgatccaatctgtgcccttcaggctctcatggaaggccttcaagttctaaccctcgaggacgttgtctctgaagctgacatcttttgcaccaccactggaaacaaagacatcatcatggtcgaccacatgaggaagatgaagaacaacgccattgtctgcaacattggtcactttgacaacgaaatcgacatgctcgggctcgagactttccctggtgtgaaacgtatcaccatcaagccgcagactgataggtgggtgtttcccgacaccaagacaggcatcattgtgctagcagagggtcgtctgatgaacttggggtgtgctactggacacccaagtttcgtgatgtcgtgctcgttcaccaaccaggtgattgcacagcttgagctctggaacgagaagtcgagtgggaagtatgagaagaaggtgtatgttctgcctaagcatttagatgagaaggtagctgcacttcacttgggcaagctcggtgctagactcaccaagctcaccaaggaccagtctgactacgtcagcatacccgttgaaggtccttacaagcctgttcactacag

SEQ ID NO: 7673 - DNA, 2170 bp, Eutrema halophilum
atcgaaaacagaactggctgaattggccacctttttcggaaaaacctaaaaaaagatgaaaagtctaattcttttaccagatccaccaaactctctctacaactaatctcagccgtccatctaaactcccgcttttatctatttaacctcactcgctacctttcgtttctcctcgcacacttactctcacatcttcaataatagatcggagaaaccaaaacaaaattcaaatctattccaatggcgttgcttgtggagaaaacctcgagtggccgtgaatacaaggtcaaggacatgtctcaggccgatttcggccgtctcgaaatcgagctcgccgaggtcgaaatgcccggactcgtctcttgccgtaccgaattcggaccttctcagccattgaaaggagctagaatcaccggatctcttcacatgacgatccaaactgccgttctcatcgaaaccctaaccgctctcggcgccgaggtcagatggtgctcttgcaacatcttctccacccaggaccacgccgccgccgcgatcgctcgcgattccgccgccgttttcgcctggaaaggggagactcttcaggaatactggtggtgcactgagagagctctcgattggggtcctggaggcggtcctgatctcatcgtcgacgacggtggtgacgcgacgctcttgatccatgaaggagtcaaggctgaggagatcttcgcgaagaccggtcagtttccagatccgacttccaccgataatcctgagttccagatcgtgttgtcgatcatcaaagatggtcttcaggttgatcctaagaagtatcacaagatgaaggagagattagtcggtgtttcggaggagacgaccactggtgttaagaggctttaccagatgcaggagactggtactctcttgttccctgccattaacgtcaacgattccgtcaccaagagcaagttcgacaacttgtatggatgtcgtcactctctccctgacggtctcatgagagccactgatgtcatgatcgccggaaaggtcgctgttatctgcggttacggtgacgtcggaaagggttgtgctgcagccatgaaaaccgccggtgcacgtgtcatcgtcaccgagatcgacccgatctgtgcgcttcaagctctcatggaaggcctacaagttctaaccctcgaggacgttctctcggaagctgacatctttgtcaccaccactggaaacaaagacatcatcatggtcgaccacatgaggaagatgaagaacaacgccatagtctgcaacattggtcacttcgacaacgagatcgacatgctcgggctcgagactttccctggtgtgaaacgcatcaccattaagccgcagaccgacaggtgggtgttcccggacaccaagacaggcatcattgtgttagccgaaggtcgtctgatgaacttgggatgtgccactggacacccgagtttcgtgatgtcgtgctcgttcacaaaccaggtgattgcacagcttgagctatggaacgagaagtcgagcgggaagtatgagaagaaggtgtatgttttgcctaagcacttggacgagaaagtggctgcacttcacttgggcaagctcggtgctagactcaccaagcttaccaaggaccaatctgactatgtcagcatacccattgaaggtccctacaagcctgttcactacaggtactgagaagaagaagcaaagcagaaaaaaaagaggccaaagctttggttttatggttaaaggccgtttattggctatgctataatcctaatggcatttaattatttgagttggttcgggtctggtttggttgggaaaatttgaggtgattggtcttctgattaggttgatcaaatattggtatgaataaggggttgttgttcttggttttgagaggcttctttttgttttttttttttttgtttttgttttttttatttatatattatctcaagataaattagtttttgttttacactgtttgttaggcttatttatgcgatgttctgtttaccggtttacttttcagaacacaagtgagaaaacaagatacgtaaagttattttggcaatattagtggaaaatcttgtcttctttgaattgtatgtatgctgaggagtgaggaggatggtcaatccaaacattcaacttttgacct

SEQ ID NO: 7674 - DNA, 1793 bp, Raphanus sativus
  misc_feature (3)..(3): n is a, c, g, or t
  misc_feature (5)..(5): n is a, c, g, or t
  misc_feature (37)..(37): n is a, c, g, or t
  misc_feature (49)..(49): n is a, c, g, or t
  misc_feature (160)..(160): n is a, c, g, or t
  misc_feature (166)..(166): n is a, c, g, or t
  misc_feature (178)..(178): n is a, c, g, or t
  misc_feature (182)..(182): n is a, c, g, or t
  misc_feature (199)..(199): n is a, c, g, or t
  misc_feature (217)..(217): n is a, c, g, or t
  misc_feature (259)..(259): n is a, c, g, or t
  misc_feature (262)..(262): n is a, c, g, or t
  misc_feature (271)..(271): n is a, c, g, or t
  misc_feature (406)..(406): n is a, c, g, or t
  misc_feature (453)..(453): n is a, c, g, or t
  misc_feature (475)..(475): n is a, c, g, or t
  misc_feature (624)..(624): n is a, c, g, or t
  misc_feature (811)..(811): n is a, c, g, or t
ggngnacactctgttcccatcttcacacagaacaganacattcaaaaanaaaacaatggcgttgcttgtagagaagacgtcgagtggccgtgagtacaaggtcaaggacatgtctcaggccgacttcggtcgtctcgagatcgagctcgccgaggtcganatgccnggtctcgtctcntgcntcaccgagttcggaccntctcagccactcaaaggngcaagaatcaccggttctctccacatgaccatccaaaccgcngtnctcatcganaccttaaccgctctcggcgcagaggtcagatggtgctcctgcaacatcttctccacccaggaccacgccgccgccgccattgctcgtgactccgccgccgtgttcgcctggaaaggggagactctccaggagtantggtggtgcacggagagggctctcgactggggtcctggaggtggtcncgacctgatcgtcgacgacggnggtgacgctacgctccttatccacgaaggtgttaaggctgaggagatctttgctaagaccggtcagctccccgacccgacttccacggacaatcctgagttccagatcgtgttgtcgattatcaaagatggtcttcaggttgatcccangaagtaccacaagatgaaggagagattggttggtgtttcggaggagacgaccactggtgttaagaggctttaccaaatgcaggagactggagctctcttgttccctgccattaacgtcaatgactccgtcaccaagagcaagtttgacaacttgtatggatgtcgccactctctccctgacggtctnatgagagccactgatgtcatgatcgccggaaaggtcgctgttatctgcggttatggtgatgtcggaaagggttgtgctgcagccatgaaaaccgccggtgcacgtgtgatcgtgactgagatcgatccaatctgtgccctccaggctctcatggaaggccttcaagttctaacccttgaggacgttgtctctgaagctgacatcttttgcaccaccactggaaacaaagacatcatcatggtcgaccacatgaggaagatgaagaacaacgccattgtctgcaacattggtcactttgacaatgaaatcgacatgcaaggacttgagactttccctggtgtgaaacgcatcaccatcaagccacagactgataggtgggtgttccctgacaccaaatcaggcatcattgtgctagccgagggtcgtctgatgaacttgggatgtgccactggacacccgagtttcgtgatgtcgtgctcgttcaccaaccaggtgattgcacagcttgagctctggaacgaaaagtcaagtgggaagtatgagaagaaggtatatgttttgcctaaacacttggatgagaaggttgctgcacttcacttaggcaagctaggtgctagactcaccaagctcaccaaggaccaatctgactacgttagcatacccgttgaaggtccctacaagcctgttagctacaggtactgagaagaaaaaacggatcaagctttggttctttgtatggttttatgattagaccatttggttataatccaaatggctattgtttgagttggttcgggtttggtatggttggggaaatatgagatattggtcttcttatgaagttgatcaaatattggtatcaataaggggttgttgttctttggttttgagaggctgttttatgttttgttttgttttctttttccctttcaattttatgtatctcaagataaattaatttttgtttacaccaaaaaaaaaa

SEQ ID NO: 7675 - DNA, 1836 bp, Arabidopsis thaliana
tcctccttcatcacacagatccacacatcaagaaactattcaaaaatggctttgcttgtagagaaaacctcaagtggccgtgaatacaaggtcaaggacatgtcccaagccgacttcggccgtctcgaaatcgagctagccgaagtcgaaatgcctggacttgtctcttgcgttaccgaattcggaccatctcagccactcaaaggagcaagaatcaccggttctctccacatgacgatccaaaccgcggttttaatcgaaaccttaaccgctctcggcgctgaagtcagatggtgttcttgcaacatcttctccactcaagaccacgccgcggccgctattgctcgtgattccgccgcggtgttcgcttggaaaggtgagactcttcaagaatattggtggtgtacagagagagctcttgactggggtcctggaggtggtcctgatctcatcgttgatgacggtggtgatgctacactgttgatccatgaaggagttaaagctgaagagatctttgccaagaatggtacgttccctgacccgacctctactgataatcccgagtttcagatcgtcctgtctattatcaaagacggtcttcaagttgatcccaagaagtaccataagatgaaggagagattggttggtgtctctgaggagactactactggtgttaagaggctttatcagatgcaggagactggagctctcttgttccctgccattaacgtcaatgactctgtcaccaagagcaagtttgacaacttgtacggatgccgacactcgcttcccgatggtctcatgagggctactgatgttatgattgctggaaaggttgctgttatctgtggttatggtgatgtaggaaaaggttgtgctgcagcaatgaaaaccgcgggtgctcgtgtcatagtgactgagattgatccaatctgtgctcttcaggctcttatggaaggtcttcaagttctgacccttgaggatgttgtctcagaagctgatatcttctgtaccactactggtaacaaagatattattatggttgatcacatgaggaagatgaagaacaatgccattgtctgtaacattggtcattttgacaatgaaatcgacatgcttggacttgagacctaccctggtgtgaaacgtattaccatcaagccacagaccgataggtgggtgtttcctgataccaactctggcatcattgttctagctgaaggtcgtttgatgaacttgggatgcgccactggacacccgagtttcgtgatgtcgtgctcattcaccaaccaggtgattgcacagcttgagctctggaacgagaagtcaagcgggaagtatgagaagaaggtctatgttttgcctaaacacttggatgagaaggtagctgcacttcacttaggcaagcttggtgcaagactcaccaagcttaccaaggaccaatctgactatgtcagcatacccgttgaaggtccttacaagcctgttcactacaggtactgagaggataaaagagccaagctttggttcttcgtttggttttctgattaagccgtttattggcaattgtttgagtcggattgggtctggtttggtcggagaaatatgagatattggtcttctgatgcgtgtgaccaaatattggtatgaataaggggttgtttttgatttatgagaggctgtttttttgttttcttcttcttctattttatatatcttcaacataaattagcttatgctttacattattgttaggcttatttatgctttgttctgtctacttttccaaacaagagtgaaaacaaaatacgcaaagttattttttggcttcatatt

SEQ ID NO: 7676 - DNA, 1680 bp, Brassica napus
cgaaaaaatggcgttgatcgttgagaagacgtcgagtggccgtgagtacaaggtcaaggacatgtctcaggccgacttcggtcgtctcgagctcgagctcgccgaggttgagatgcccggactcatggcttgccgtaccgagttcggcccagctcagcccttcaaaggcgctagaatcaccggatctctccacatgacgatccagaccgccgtcctcatcgaaaccctaaccgccctcggcgcggaagtcagatggtgctcctgcaacatcttctcaacccaagaccacgccgccgccgcaatcgcccgcgactccgccgccgttttcgcctggaaaggcgagacgctgcaggagtactggtggtgcacggagcgtgctctcgactggggcccaggcggtggtccagatctgatcgtcgatgacggtggcgacgccacgcttttgatccacgagggagtgaaggccgaggagatctttgagaagacgggccaggttcctgatcccacttccactgacaaccccgagttccagatcgtgctctccatcatcaaggaaggtctccaggttgatcccaagaagtaccacaagatgaaggagagactcgtcggtgtctctgaggagaccaccaccggtgtcaagaggctttaccagatgcaggaaagtggggccctcttgttcccagccattaacgtcaacgactccgtcaccaagagcaagttcgacaacttgtacggttgccgtcactctctacctgatggtctcatgagggccactgatgtcatgatcgccggaaaggttgcggttatctgtggttatggtgatgtcggaaagggttgtgcagctgccatgaaaaccgctggtgctagagtcattgtgaccgagatcgatcccatctgtgccctacaagctatgatggaagggcttcaagttctgacccttgaggatgtcgtctctgaagctgacatctttgtcaccaccaccggtaacaaagacatcatcatggttgaccacatgaggaagatgaagaacaacgctatcgtctgcaacattggtcactttgacaacgagattgacatgcaaggacttgagaccttccctggagtgaagcgtatcaccatcaagccccagaccgacaggtgggtgttcccagacaccaagtccggaatcattgttttggccgagggtcgtctcatgaacttgggttgtgccactggtcacccaagtttcgtcatgtcttgctctttcaccaaccaggtgattgcccagcttgagctttggaacgagaagtcgagcggtaagtacgagaagaaggtgtacgttctacccaagcatttggatgagaaggttgcggcacttcacttgggcaagcttggagctaagctcactaagctgacaaaggaccaatctgactacgtcagcattcccattgaaggaccttacaagcctgctcactacaggtactgagagctgtttggttctcgttgtggtttgtctggaagagtggaagatattggtccgctgatgaagttgaccaaatatccttctgaataaggggtgattggctttgaaggttgtgcttgttgttcttctttttcttgaaacttaaattagcttttggttatgagttccctcttgatttgcttttctgttgtgatcaccgttgtactcttaaactaaaa

SEQ ID NO: 7677 - DNA, 1828 bp, Brassica rapa
gacacacttctctctctctgcccccaaatctctagttccgaaaaaatggcgttgatcgttgagaagacgtcgagtggccgtgagtacaaggtcaaggacatgtctcaggccgacttcggtcgtctcgagctcgagctcgccgaggttgagatgcccggactcatggcttgtcgtaccgagttcggcccagctcagcccttcaaaggcgctagaatcaccggatctctccacatgacgatccagaccgccgtcctcatcgaaaccctaaccgccctcggcgcggaagtcagatggtgctcctgcaacatcttctcgacccaagaccacgccgccgccgcaatcgcccgtgactccgccgccgttttcgcctggaaaggcgagacgctgcaggagtactggtggtgcacggagcgtgctctcgactggggcccaggcggtggtccagatctgatcgtcgatgacggtggcgacgccacgcttttgatccacgagggagtgaaggccgaggagatctttgagaagacgggccaggttcctgatcccacttccactgacaaccccgagttccagatcgtgctctccatcatcaaggaaggtctccaggttgatcccaagaagtaccacaagatgaaggagagactcgtcggtgtctctgaggagaccaccaccggtgtcaagaggctttaccagatgcaggaaagtggggccctcttgttcccagccattaacgtcaacgactccgtcaccaagagcaagttcgacaacttgtacggttgccgtcactctctacctgatggtctcatgagggccactgatgtcatgatcgccggaaaggttgcggttatctgtggttatggtgatgtcggaaagggttgtgcagctgccatgaaaaccgctggtgctagagtcattgtgaccgagatcgatcccatctgtgccctacaagctatgatggaagggcttcaagttctgacccttgaggatgtcgtctctgaagctgacatctttgtcaccaccaccggtaacaaagacatcatcatggttgaccacatgaggaagatgaagaacaacgctatcgtctgcaacattggtcactttgacaacgagattgacatgcaaggacttgagaccttccctggagtgaagcgtatcaccatcaagccccagaccgacaggtgggtgttcccagacaccaagtccggaatcattgttttggccgagggtcgtctcatgaacttgggttgtgccactggtcacccaagtttcgtcatgtcttgctctttcaccaaccaggtgattgcccagcttgagctttggaacgagaagtcgagcggtaagtacgagaagaaggtgtacgttctacccaagcatttggatgagaaggttgcggcacttcacttgggcaagcttggagctaagctcactaagctgacaaaggaccaatctgactacgtcagcattcccattgaaggaccttacaagcctgctcactacaggtactgagagctgtttggttctcgttgtggtttgtctggaagagtggaagatattggtccgctgatgaagttgaccaaatatccttctgaataaggggtgattggctttgaaggttgtgcttgttgttcttctttttcttgaaacttaaattagcttttggttatgagttccctcttgatttgcttttctgttgtgatcaccgttgtactcttaaactaaaaatggaagagaggaaactattttccgtacccaaattttagagctttctttctctttcacggtttcacctttattatgttctttgcttcattaaatgtcgagctctcatttc

SEQ ID NO: 7678 - DNA, 1809 bp, Brassica napus
ctggaccctgcggaccggtccggaatttagggtcgagaaagcgtccgcctctctctgccccaatcttagatccgaaaaaatggcgttgatcgttgagaagacgtcgagtggccgtgagtacaaggtcaaggacatgtctcaggccgacttcggtcgtctcgagctcgagctcgccgaggttgagatgcccggactcatggcttgccgtaccgagttcggcccagctcagcccttcaaaggcgctagaatcaccggatctctccacatgacgatccagaccgccgtcctcatcgaaaccctaaccgccctcggcgcggaagtcagatggtgctcctgcaacatcttctcaacccaagaccacgccgccgccgcaatcgcccgcgactccgccgccgttttcgcctggaaaggcgagacgctgcaggagtactggtggtgcacggagcgtgctctcgactggggcccaggcggtggtccagatctgatcgtcgatgacggtggcgacgccacgcttttgatccacgagggagtgaaggccgaggagatctttgagaagacgggccaggttcctgatcccacttccactgacaaccctgagttccagatcgtgctctccatcatcaaggaaggtctccaggttgatcccaagaagtaccacaagatgaaggagagactcgtcggtgtctctgaggagaccaccaccggtgtcaagaggctttaccagatgcaggaaagtggggccctcttgttcccagccattaacgtcaacgactccgtcaccaagagcaagttcgacaacttgtacggttgccgtcactctctacctgatggtctcatgagggccactgatgtcatgatcgccggaaaggttgcggttatctgtggttatggtgatgtcggtaagggttgtgccgctgccatgaaaaccgctggtgctagagtcattgtgaccgagatcgatcccatctgtgccctacaagctatgatggaagggcttcaagttctgacccttgaggatgtcgtctctgaagctgacatctttgtcaccaccaccggtaacaaagacatcatcatggttgaccacatgaggaagatgaagaacaacgctatcgtctgcaacattggtcactttgacaacgagattgacatgcaaggacttgagaccttccctggagtgaagcgtatcaccatcaagccccagaccgacaggtgggtgttcccagacaccaagtccggaatcattgttttggccgagggtcgtctcatgaacttgggttgtgccactggtcacccaagtttcgtgatgtcttgctctttcaccaaccaggtgattgcccagcttgagctttggaacgagaagtcgagcggtaagtacgagaagaaggtgtacgttctacccaagcatttggatgagaaggttgcggcacttcacttgggcaagcttggagctaagctcactaagctgacaaaggaccaatctgactacgtcagcattcccattgaaggaccttacaagcctgctcactacaggtactgagagctgtttggttctcgttgtggtttgtctggaagagtggaagatattggtccgctgatgaagttgaccaactatccttctgaataaggggttattggctttgaaggttgtgcttgttgttcttctttttcttgaaacttaaattagcttttggttatgagttccctcttgatttgcttttctgttgtgatcaccgtgtactcttaaacgaaaaatggaagagaggaaactattttccgtacccaaattttagagctttctttctctttcac

SEQ ID NO: 7679 - DNA, 1875 bp, Raphanus sativus
ggcctcacacacacacctctctctctgtctgcccccaatcaaatctcaaatctcagatccgaaagaaatggcgttgatcgtagagaagacgtcgagtgggcgcgagtacaaggtcaaggacatgtctcaggcggacttcggtcgtctggagctcgaactcgcggaggtggagatgcccggactcatggcctgccgtacggagttcggcccatctcagcccttcaaaggcgcgagaatcaccggatctctccacatgacgatccaaaccgccgtgctcatcgaaaccctaacggccctgggcgcggaagtgagatggtgctcgtgcaacatcttctcgacccaagaccacgccgcggccgcgatcgctcgcgactccgccgccgtgttcgcgtggaaaggagagacgcttcaggagtactggtggtgcacggagcgtgctctggactggggtccaggcggtggtccggatctgatcgtggacgacggtggtgacgcgacgcttttgatccacgagggagtcaaggcagaggagatctttgagaagacgggtcaggttccggatccgagttccactgataaccctgagttccagatcgtgctttcgatcatcaaggaaggtcttcaggttgatcctaagaagtaccacaagatgaaggagagactcgttggtgtctctgaggagaccaccactggtgtcaagaggctttaccagatgcaggagactggcgctcttttgttccctgccattaacgtcaacgactccgtcaccaagagcaagttcgacaacttgtacggatgccgtcactctctacctgatggtctcatgagggccaccgatgtcatgatcgccggaaaggttgtcgttgtttgcggatatggtgatgtcggaaagggttgtgccgctgccatgaagaccgctggtgccagagtcattgtcaccgagatcgatcccatctgtgctttacaagctatgatggaaggacttcaagttctgacccttgaggatgtcgtctccgaagctgacatctttgtcaccaccaccggtaacaaagacatcatcatggttgaccacatgaggaagatgaagaacaacgccatcgtctgcaacattggtcacttcgacaacgagattgacatgcttggtctcgagaccttccctggtgtcaagcgtatcaccatcaagccccagaccgacaggtgggtgttccctgacaccaagtccggaatcattgttctcgctgagggtcgtctcatgaacttgggttgtgccactggtcacccgagtttcgtcatgtcttgctctttcaccaaccaggtcattgcccagcttgagctttggaatgagaagtcgagcggtaagtacgagaagaaggtgtacgttctacccaagcatttggatgagaaggttgcggctcttcacttgggcaagcttggagctaagctcactaagctcacaaaggaccaatctgactacgtcagcattcccattgaaggaccctacaagcctgctcactacaggtactgagaggagagctgtttggttctgtttgtggtttgtgtcgtttatggtgggaagactggaagatattggtccgctgatgaggttgatcaaatatcattctgaataaatggttattggctttgaaggttgtgcttgttgttcttctttttcttgaaacttaatttagcttttggttatcagttccttctcgatttgtttttgtgttttgatcaccgttgtactctttaaacgaaaaatggtaaaagaggaaactattttcctcaccaattttagagctttctttatcttttcaccttttactatgttctttgtttcgttgaatgtgatgtgaagctctcatttcaaatgtgggc

SEQ ID NO: 7680 - DNA, 2005 bp, Eutrema parvulum
atcgaaaacagaattggcacccattatttcggaaatctaagaaaaaggatgaaaagtctaattcttttaccagatccaccaaactctctccacaactaatctcagccgtccatctcatctcccgcttttatctatataacatcactcgctacctttcctttctcctcgcacaccacactccattctcacacagatccgagaaaattttcaaaaatggcgttgcttgtagagaagacgtcgagtggccgtgagtacaaggtcaaggacatgtctcaggccgatttcggtcgtctcgagattgagctcgccgaggtcgaaatgcctggactcgtctcttgcgttaccgaattcggaccttctcagccattgaaaggagctagaatcaccggatctctccacatgacgatccaaaccgctgtccttatcgaaaccctaaccaaacttggcgctgaggtcagatggtgctcctgcaacatcttctccacccaggaccacgccgccgccgcgattgctcgtgattccgccgccgtattcgcctggaaaggagagactctccaggagtactggtggtgcacagagagagctctcgattggggtcctggaggtggtcctgatctgatcgtcgatgacggtggtgacgccacgctcctgatccacgaaggagttaaggctgaggagattttcgcgaagaacggtcaattacccgatccgacttccaccgaaaatcctgagtttcagatcgtgttgtcgatcatcaaagatggtcttcaagttgatcccaagaagtaccacaagatgaaggagagattagtcggtgtttcggaggagacgaccactggtgttaagaggctttaccagatgcaggagactggaactctcttgttccctgctattaacgtcaatgactccgtcaccaagagcaagttcgacaacttgtatggatgtcgccactctctccctgacggtctcatgagggccactgatgtaatgatcgccggaaaggtcgctgttatctgcggttatggtgatgtcggaaagggttgtgctgcagccatgaaaaccgctggtgcccgtgtgatcgtgactgagatcgatccaatctgtgcacttcaggctctcatggaaggcctccaagttctaacccttgaggacgtcctctcagaagctgacatctttgttactaccactggaaacaaagacatcatcatggtggaccacatgaggaagatgaagaacaacgccattgtctgcaacattggtcactttgacaatgaaatcgacatgcacggactcgagactttccctggcgtgaaacgcatcaccatcaagccccagaccgataggtgggtgttcccggacaccaagaccggcattattgtcctagctgagggtcgtctgatgaacttgggatgtgccactggacacccgagtttcgtgatgtcgtgctcattcaccaaccaggtgattgcacagcttgagctctggaacgagaagtcgagcgggaagtatgagaagaaggtttatgttttgcctaagcacttggatgagaaggtcgctgcacttcacttgggcaagctcggtgctagactcaccaagctcaccaaggaccaatctgactacgtcagcatacccgttgaaggtccctacaagcctgttcactacaggtactgagaaggaaaaaaggccagagcttttgcttctacgtatggttctatggttaaggccgtttattggctttagtccaaatggaaattgtttgagttggttcgggtctggtctggttggggaaatatgagatattggtcttctgatgaggttgaccattggtttgaataagaggttcttcttggtttttgagaggctattttttgttttgtttttcttttctattatatccaaacataaattagtttttgttttacactgttgttaggtgcttatttatgcaatgttatgtttaccggtgagaaaactaaatacgcaaaactattttcgacttcatatt

SEQ ID NO: 7681 - DNA, 1982 bp, Brassica napus
cggtcactcgtggatgccgttctacggtaggtgaggttcgtagtagttccacttttgttttaattcttagttctcttacttcttcttctctgctccgtttcgtttggtagagacggcgacagtagattagcgttactgtatgacacactactctctacctactctctctacctgtccccaagtttctaaatactcagatcccgagaatatctagagatggcgttggtcgtcgagaagacgtcgagtggccgcgagtacaaggtcaaagacatgtctcaagccgacttcggtcgtctcgagctcgaactcgctgaggtcgagatgcccggactcatggcttgccgtaccgagttcggcccatctcagcccttcaaaggcgctagaatcaccggatctctccacatgaccatccaaaccgccgtcctcatcgagaccctaaccgccctcggcgctgaagtcagatggtgctcctgcaacatcttctccacccaagaccacgccgccgccgcaatcgctcgtgactccgccgccgttttcgcgtggaagggagagacgctccaggagtactggtggtgcacggagcgtgctcttgactggggtccaggtggtggtccagatctgatcgtcgatgacggtggtgacgccacgcttttgatccatgagggagttaaggctgaggagatctttgagaagactggtcaggttcctgatcccacttccactgacaaccctgagttccagatcgtgttgtccatcatcaaggaaggtcttcaggttgaccctaagaagtaccacaagatgaaggagagactcgttggtgtctctgaggaaaccaccactggtgtcaagaggctttaccagatgcaggagactggagctcttttgttcccagccattaacgtcaacgactccgtcaccaagagcaagttcgacaacttgtacggttgccgtcactctctccctgatggtctcatgagggccactgatgtcatgatcgccggaaaggttgtcgttgtctgcggatatggtgatgtcggaaagggttgtgccgctgccatgaagactgctggtgctagagtcattgtgacggagatcgatcccatctgtgccctacaggctatgatggaaggacttcaagttttgacccttgaggatgttgtttccgaagctgacatctttgtcaccaccaccggtaacaaagacatcatcatggttgaccacatgaggaagatgaagaacaatgctattgtttgcaacattggtcactttgacaacgagattgacatgctcgggctcgagaccttcccaggtgtgaagcgtatcaccatcaagccccagaccgacaggtgggtcttcccagacaccaagtccggaatcattgttttggctgagggtcgtctcatgaacttgggttgtgccactggtcacccgagtttcgtcatgtcttgctctttcaccaaccaggtgattgctcagcttgagctttggaacgagaagtcgagcggcaagtacgagaagaaggtgtacgttctacctaagcatttggacgagaaggttgcagcacttcacttgggaaagcttggagctaagctcaccaagttgacaaaggaccaatctgactacgtcagcattcccattgaaggaccatacaagcctgctcactacaggtactgagagaagaatggagagagcggtttatttctagtttggtcttctgatgaagttgaccgaatatccttctgaataaggattcttgtcttttgattgttgtgcttgttcttttttttctgaatttatcttgaaacttaaattagcctttggttatttgattttgtgttgtgttcattgttctactctttaaaaatagaaacaaaaaagttggataatcggaaactattttttcgcatcccacatttaaagagctttctttctatctttgcttttaatttgtttcattgaatgagatgtgaagtatgggttgt

SEQ ID NO: 7682 - DNA, 1829 bp, Brassica napus
atcaacgcagagtacgcggggacacacttctctctcacctctctctctgccctaatttcaaatctcagatcccgagaatatctagagatggcgttggtcgtcgagaagacgtcgagtggccgcgagtacaaggtcaaagacatgtctcaagccgacttcggtcgtctcgagctcgaactcgcggaggtggagatgcccggactcatggcttgccgtaccgagttcggcccatcgcagcccttcaaaggcgctagaatcaccggatctctccacatgaccatccaaaccgccgtcctcatcgagaccctaaccgccctcggcgctgaagtgagatggtgctcctgcaacatcttctccacccaagaccacgccgccgccgcaatcgctcgtgactccgccgccgtcttcgcgtggaagggagagacgctccaggagtactggtggtgcacggagcgtgctcttgactggggcccaggcggtggtccagatctgatcgttgatgatggtggtgacgccacgcttttgatccacgagggagtgaaggctgaggagatctttgagaagactggtcaggttcctgatcccacttccactgacaaccctgagttccagatcgtgctctccatcatcaaggaaggtcttcaggttgatcctaagaagtaccacaagatgaaggagagactcgttggtgtctctgaggaaaccaccactggtgtcaagaggctttaccagatgcaggagactggagctcttttgttccctgccattaacgtcaacgactccgtcaccaagagcaagttcgacaacttgtacggttgccgtcactctctacctgatggtctcatgagggccactgatgtcatgatcgccggaaaggttgtcgttgtctgcggatatggtgatgtgggaaagggttgtgccgctgccatgaagaccgctggtgctagagttattgtgacggagatcgatcccatctgtgccctacaggctatgatggaagggcttcaagttttgacccttgaggatgttgtttccgaagctgacatctttgtcaccaccaccggtaacaaagacatcatcatggttgaccacatgaggaagatgaagaacaatgctattgtttgcaacattggtcactttgacaacgagatcgacatgctcggactcgagaccttccctggtgtgaagcgtatcaccatcaagccccagaccgacaggtgggtcttcccagacaccaagtccggaatcattgttttggctgagggccgtctcatgaacttgggttgtgccactggtcacccgagtttcgtcatgtcttgctctttcaccaaccaggtgattgcccagcttgagctttggaacgagaagtcgagcggcaagtacgagaagaaagtgtacgttctacccaagcatttggacgagaaggttgcagctcttcacttgggaaagcttggagctaagctcaccaagttgacaaaggaccaatctgactacgtcagcattcccattgaaggaccatacaagcctgctcactacaggtactgagagaagaagaatggagagatcggtttgtttctagtttggtcttctgatgaagttgtccgattttccttctgaataaggattcttgtcttttgattgttgtgcttgttcttctttttctgaattcatcttgaaactttaattagccttttgttttttgattttgtgttgtgttcatcgttctactcttttaaaaatagaaacaaaaaggttggataattggaaactatttttcgcatcccacatttatagagctttctttctctttcgctttaaaaaaaaaagta

SEQ ID NO: 7683 - DNA, 1958 bp, Brassica napus
gattgtggcagctcctatcacaagggtatggacaatctattagcttaacttctgctctatcaaaataccaatctccaaccgctgtcgccaccgccttcttgttgataacaggcgaattatcagcgaaccaagtgtcttgccttcggtttggcaatgagcaaaacatgagtttataacaaaccgttctttcttgcattcacgaatccactcacagctctcacctctctctctgccctaatttcaaatctcagatcccgagaatatctagagatggcgttggtcgtcgagaagacgtcgagtggccgcgagtacaaggtcaaagacatgtctcaagccgacttcggtcgtctcgagctcgaactcgcggaggtggagatgcccggactcatggcttgccgtaccgagttcggcccatcgcagcccttcaaaggcgctagaatcaccggatctctccacatgaccatccaaaccgccgtcctcatcgagaccctaaccgccctcggcgctgaagtgagatggtgctcctgcaacatcttctccacccaagaccacgccgccgccgcaatcgctcgtgactccgccgccgtcttcgcgtggaagggagagacgctccaggagtactggtggtgcacggagcgtgctcttgactggggcccaggcggtggtccagatctgatcgttgatgatggtggtgacgccacgcttttgatccacgagggagtgaaggctgaggagatctttgagaagactggtcaggttcctgatcccacttccactgacaaccctgagttccagatcgtgctctccatcatcaaggaaggtcttcaggttgatcctaagaagtaccacaagatgaaggagagactcgttggtgtctctgaggaaaccaccactggtgtcaagaggctttaccagatgcaggagactggagctcttttgttccctgccattaacgtcaacgactccgtcaccaagagcaagttcgacaacttgtacggttgccgtcactctctacctgatggtctcatgagggccactgatgtcatgatcgccggaaaggttgtcgttgtctgcggatatggtgatgtgggaaagggttgtgccgctgccatgaagaccgctggtgctagagttattgtgacggagatcgatcccatctgtgccctacaggctatgatggaagggcttcaagttttgacccttgaggatgttgtttccgaagctgacatctttgtcaccaccaccggtaacaaagacatcatcatggttgaccacatgaggaagatgaagaacaatgctattgtttgcaacattggtcactttgacaacgagatcgacatgctcggactcgagaccttccctggtgtgaagcgtatcaccatcaagccccagaccgacaggtgggtcttcccagacaccaagtccggaatcattgttttggctgagggccgtctcatgaacttgggttgtgccactggtcacccgagtttcgtcatgtcttgctctttcaccaaccaggtgattgcccagcttgagctttggaacgagaagtcgagcggcaagtacgagaagaaagtgtacgttctacccaagcatttggacgagaaggttgcagctcttcacttgggaaagcttggagctaagctcaccaagttgacaaaggaccaatctgactacgtcagcattcccattgaaggaccatacaagcctgctcactacaggtactgagagaagaagaatggagagatcggtttgtttctagtttggtcttctgatgaagttgtccgattttccttctgaataaggattcttgtcttttgattgttgtgcttgttcttctttttctgaattcatcttgaaactttaattagccttttgttttttgattttgtgttgtgttcatcgttctactcttttaaaaatagaaacaaaaaggttggataattggaaactatttt

SEQ ID NO: 7684 - DNA, 1729 bp, Brassica oleracea
atggcgttgatcgttgagaagacgtcgagtggccgtgagtacaaggtcaaggacatgtctcaggccgacttcggtcgtctcgagctcgagctcgccgaagttgagatgccaggactcatggcttgccgtaccgagttcggcccagctcagcccttcaaaggcgctagaatcaccggatctctccacatgacgatccagaccgccgtcctcatcgaaaccctaaccgccctcggcgcggaagtcagatggtgctcctgcaacatcttctcaacccaagaccacgccgccgccgcaatcgcccgtgactccgccgccgttttcgcctggaaaggtgagacgcttcaggagtactggtggtgcacggagcgtgctctcgactggggcccaggtggtggtccagatctgatcgtcgatgacggtggcgacgccacgcttttgatccacgagggagtgaaggccgaggagatctttgagaagacgggtcaggttcctgatcccacttccactgacaaccctgagttccagatcgtgctttcgatcatcaaggaaggtctccaggttgatcctaagaagtaccacaagatgaaggagagactcgtcggtgtctctgaggagaccaccaccggtgtcaagaggctttaccagatgcaggaaagtggagcccttttgttcccagccattaacgtcaacgactccgtcaccaagagcaagttcgacaacttgtacggttgccgtcactctctacctgatggtctcatgagggccactgatgtcatgatcgccggaaaggttgcggttatctgtggttatggtgatgtcggtaagggttgtgccgctgccatgaaaaccgctggtgctagagtcattgtgaccgagatcgaccccatctgtgccctacaagctatgatggaagggcttcaagttctgacccttgaggatgtcgtctctgaagctgacatctttgtcaccaccaccggtaacaaagacatcatcatggttgaccacatgaggaagatgaagaacaacgctatcgtctgcaacattggtcactttgacaacgagattgacatgcaaggacttgagaccttccctggagtgaagcgtatcaccatcaagccccagaccgacaggtgggtgttcccagacaccaagtccggaatcattgttttggccgagggtcgtctcatgaacttgggttgtgccactggtcacccaagtttcgtgatgtcttgctctttcaccaaccaggtgattgcccagcttgagctttggaacgagaagtcgagcggtaagtacgagaagaaggtgtacgttctacccaagcatttggatgagaaggttgcggcacttcacttgggcaagcttggagctaagctcactaagctgacaaaggaccaatctgactacgtcagcattcccgttgaaggaccttacaagcctgctcactacaggtactgagagctgtttggttctcgttgtggtttgtctggaagagtggaagatattggtccgctgatgaagttgaccaactatccttctgaataaggggttattggctttgaaggttgtgcttgttgttcttctttttcttgaaacttaaattaacttttggttatgagttccctcttgatttgcttttgtgttgtgatcaccgtgtactctttatacgaaaaatggaagagaggaaactattttccgtacccaaattttagagctttctttctctttc

SEQ ID NO: 7685 - DNA, 1995 bp, Eutrema parvulum
aaatacgggatcatagctttctaccagatccaccaaaccctcaaaacaatctgagccgtccatttcatcctgacctcatctatttatactctctcactctctttcgtttctcctcgcacacttctctccatctctctctctctctgccctaatttcaaatctcagatccggaaaaaatggcgttgctcgttgagaagacgtcgagtggccgtgagtacaaggtcaaggacatgtctcaggccgatttcggtcgtcttgagctcgagctcgccgaagttgagatgcctggactcatggcttgccgtaccgagtttggtcctgctcagccattcaaaggcgctagaatcaccggatctctccacatgactatccaaaccgccgttctcattgaaaccctaaccgcactcggcgccgaagtcagatggtgctcttgcaacatcttctcaactcaagaccacgccgccgccgcaatcgctcgtgactccgccgctgttttcgcctggaaaggtgagacgctccaggagtactggtggtgcacggagcgtgctcttgactggggtccaggtggtggtccagatctgattgttgatgatggtggtgacgcgacgcttttgatccatgagggagttaaggctgaggagatctttgagaagactggtcaggttcctgatccgacttccactgacaaccctgagtttcagatcgtgttgtcaatcatcaaggaaggtcttcaagttgatcctaagaagtaccacaagatgaaggagagactcgttggtgtttctgaggaaaccaccactggtgtcaagagactttaccagatgcaggaaagtggagctcttttgttcccagccattaacgtcaacgactccgtcaccaagagcaagttcgacaacttgtacggttgccgtcactctctccctgatggtctcatgagggctactgatgtcatgatcgccggaaaggttgccgttatctgtggatacggtgatgtcggaaagggttgtgccgctgccatgaaaaccgctggtgccagagtcattgtgaccgagatcgatcccatctgtgccctacaagctatgatggaaggacttcaagttctgacccttgaggacgtcgtttcggaagctgacatctttgtcaccaccaccggtaacaaagacatcatcatggttgaccacatgaggaagatgaagaacaacgccattgtgtgcaacattggtcactttgacaacgaaatcgacatgctcggactcgagaccttccctggtgtgaagcgtatcaccatcaagccccagaccgacaggtgggtgttcccagacaccaagaccggaatcattgttttggctgagggtcgtctcatgaacttgggttgtgccactggtcacccaagtttcgtcatgtcgtgctctttcaccaaccaagtgattgcccagcttgagctttggaacgagaagtcaagcggtaagtacgagaagaaagtgtacgttctacccaagcatttggatgagaaagttgcagcacttcacttgggcaagcttggagctaagctcactaagttgtcaaaggaccaatctgactacgtcagcattcccattgaaggaccatacaagcctgctcactacaggtactgagagaagaatgaacaaagctggtttggttctggttgtgggagatattggtcttctgatgaagtgaccaaatattgttcttaataagggttcttggcttttgaaggttgtgcttgttcttcttctttttttctacatttatctttgaaacttaaaattagcatttggttattagttctccctcatgatttgattttgtgttgtgttcatcgttgtactctttaaacaaatgagaaaacaaaaaaaatggaaacagggaaactattttccgcatcccaattttaaatctttaattctctttcgccattattctgtttctttttgttccattgaatgtgatgtgaagttctcaatctcaaacgtg

SEQ ID NO: 7686 - DNA, 1853 bp, Arabidopsis lyrata
tcctccttcatcacacagatccacagatcaaaaaactattcaaaattcagcaaaaatggctttgcttgttgagaaaacctcaagtggccgtgaatacaaggtcaaagacatgtctcaggccgacttcggccggctcgaaatcgagctagccgaagtcgaaatgcctggacttgtctcttgccgtactgaattcggaccatctcagccactcaaaggagcaagaatcaccggatcactccacatgacgattcaaaccgctgttttgatcgaaacgttaaccgctctcggcgctgaagtcagatggtgttcttgcaacatcttctcaactcaagatcacgccgcggcagcgattgctcgtgattccgccgcggtgttcgcttggaaaggtgagactcttcaagaatattggtggtgtacggagagagctcttgattggggtcctggtggtggtcctgaccttatcgttgacgacggtggtgatgctacactgttgatccatgagggtgttaaagctgaagagatctttgagaagactggtacgttccctgacccgacgtctaccgataatcccgagtttcagatcgtgttggcgattatcagagacggtcttcaagttgatcccaagaagtaccataagatgaaggagagattggttggtgtttctgaagagactactactggtgttaagaggctttatcagatgcaggagactggaactctcttgttccctgccattaacgtcaatgactctgtcaccaagagcaagtttgacaacttgtacggatgccgacactcgctacccgatggtctcatgagggctactgatgtaatgattgctggaaaggttgctgttatctgtggttatggtgatgtaggaaaaggttgtgctgcagcaatgaaaaccgcgggtgctcgtgtcatagtgactgagattgatccaatctgtgctcttcaagctcttatggaaggtcttcaagttctaactcttgaggatgttcttccagaagctgatatctttgttaccactactggtaacaaagatattattatggttgatcacatgaggaagatgaagaacaatgccattgtctgtaacattggtcattttgacaacgaaatcgacatgcttggacttgagacttaccctggtgtgaaacgtatcaccatcaagccgcagactgataggtgggtgtttccagataccaagtctggcatcattgttctagctgagggtcgtttgatgaacttgggatgcgctactggacacccgagtttcgtgatgtcgtgctcattcactaaccaggtgattgcacagcttgagctctggaacgagaagtcgagcgggaagtatgagaagaaagtgtatgttttgcctaaacatttggatgagaaggtagctgcacttcacttaggcaagcttggtgcaagactcaccaagcttagcaaggaccaatctgactatgtcagcatacctattgaaggtccctacaagcctgttcactacaggtactgagaagataaaagagtcaagctttggttcttcgtatggtattatgattaagccgtttattggcaatttgtttgagtcgggttgggtctggtctggtcgaggaaatatgagatattggtcctctgatgagtgtgaccaattattggtatgaataaggggttgtttttgatttatgagaggctattttttttgttttcttcttcttcttctatttttatatatatctcaacataaattagcttctgttttacactattgttaggtttatttatgctttgttctgtttactttttgaaacaagagagaaaacaaaatattgcaaagctatttttggcttcatatt

SEQ ID NO: 7687 - DNA, 1789 bp, Brassica oleracea
  misc_feature (1044)..(1044): n is a, c, g, or t
cctcacacacttctctctacctctctctctctgccctaatttcaaatctcagatcccgagaatatctagagatggcgttggtcgtcgagaagacgtcgagtggccgcgagtacaaggtcaaagacatgtctcaagccgacttcggtcgtctcgagctcgaactcgctgaggtcgagatgcccggactcatggcttgccgtaccgagttcggcccatctcagcccttcaaaggcgctagaatcaccggatctctccacatgaccatccaaaccgccgtcctcatcgagaccctaaccgccctcggcgctgaagtcagatggtgctcctgcaacatcttctccacccaagaccacgccgccgccgcaatcgctcgtgactccgccgccgttttcgcgtggaagggagagacgctccaggagtactggtggtgcacggagcgtgctcttgactggggtccaggtggtggtccagatctgatcgtcgatgacggtggtgacgccacgcttttgatccatgagggagttaaggctgaggagatctttgagaagactggtcaggttcctgatcccacttccactgacaaccctgagttccagatcgtgttgtccatcatcaaggaaggtcttcaggttgaccctaagaagtaccacaagatgaaggagagactcgttggtgtctctgaggaaaccaccactggtgtcaagaggctttaccagatgcaggagactggagctcttttgttcccagccattaacgtcaacgactccgtcaccaagagcaagttcgacaacttgtacggttgccgtcactctctccctgatggtctcatgagggccactgatgtcatgatcgccggaaaggttgtcgttgtctgcggatatggtgatgtcggaaagggttgtgccgctgccatgaagactgctggtgctagagtcattgtgacggagatcgatcccatctgtgccctacaggctatgatggaaggacttcaagttttgacccttgaggatgttgtttccgaagctgacatctttgtcaccaccnccggtaacaaagacatcatcatggttgaccacatgaggaagatgaagaacaatgctattgtttgcaacattggtcactttgacaacgagattgacatgctcgggctcgagaccttcccaggtgtgaagcgtatcaccatcaagccccagaccgacaggtgggtcttcccagacaccaagtccggaatcattgttttggctgagggtcgtctcatgaacttgggttgtgccactggtcacccgagtttcgtcatgtcttgctctttcaccaaccaggtgattgctcagcttgagctttggaacgagaagtcgagcggcaagtacgagaagaaggtgtacgttctacctaagcatttggacgagaaggttgcagcacttcacttgggaaagcttggagctaagctcaccaagttgacaaaggaccaatctgactacgtcagcattcccattgaaggaccatacaagcctgctcactacaggtactgagagaagaatggagagagcggtttatttctagtttggtcttctgatgaagttgaccgaatatccttctgaataaggattcttgtcttttgattgttgtgcttgttctttttttttctgaatttatcttgaaacttaaattagcctttggttatttgattttgtgttgtgttcattgttctactctttaaaaaatagaaacaaaaaagttggataatcggaaactatttttcgcatcccacatttaaagagctttctttctg

SEQ ID NO: 7688 - DNA, 1750 bp, Brassica rapa
ctctctctctctctctctctctctctgccctaatttcaaatctcagatcccgagaatatctagagatggcgttggtcgtcgagaagacgtcgagtggccgcgagtacaaggtcaaagacatgtctcaagccgacttcggtcgtctcgagctcgaactcgcggaggtggagatgcccggactcatggcttgccgtaccgagttcggcccatcacagcccttcaaaggcgctagaatcaccggatctctccacatgaccatccaaaccgccgtcctcatcgagaccctaaccgccctcggcgctgaagtgagatggtgctcctgcaacatcttctccacccaagaccacgccgccgccgcaatcgctcgtgactccgccgccgtcttcgcgtggaagggagagacgctccaggagtactggtggtgcacggagcgtgctcttgactggggtccgggcggtggtccagatctgatcgttgacgatggtggtgacgccacgcttttgatccacgagggagtgaaggctgaggagatctttgagaagacgggtcaggttcctgatcccacttccactgacaaccctgagttccagatcgtgctctccatcatcaaggaaggtcttcaggttgatcccaagaagtaccacaagatgaaggagagactcgttggtgtctctgaggaaaccaccactggtgtcaagaggctttaccagatgcaggagactggagctcttttgttccctgccattaacgtcaacgactccgtcaccaagagcaagttcgacaacttgtacggttgccgtcactctctacctgatggtctcatgagggccactgatgtcatgatcgccggaaaggttgtcgttgtctgcggatatggtgatgtcggaaagggttgtgccgctgccatgaagaccgctggtgctagagttattgtgacggagatcgatcccatctgtgccctacaggctatgatggaagggcttcaagttttgacccttgaggatgttgtttccgaagctgacatctttgtcaccaccaccggtaacaaagacatcatcatggttgaccacatgaggaagatgaagaacaatgctattgtttgcaacattggtcactttgacaacgagatcgacatgctcggactcgagaccttccctggtgtgaagcgtatcaccatcaagccccagaccgacaggtgggtcttcccagacaccaactccggaatcattgttttggctgagggtcgtctcatgaacttgggttgtgccactggtcaccctagtttcgtcatgtcttgctctttcaccaaccaggtgattgcccagcttgagctttggaacgagaagtcgagcggcaagtacgagaagaaggtgtacgttctacccaagcatttggacgagaaggttgcagctcttcacttgggaaagcttggagctaagctcaccaagttgacaaaggaccaatctgactacgtcagcattcccattgaaggaccatacaagcctgctcactacaggtactgagagaagaagaatggagagatcggtttgtttctagtttggtcttctgatgaagttgaccgattttccttctgaataaggattcttgtcttttgattgttgtgcttgttcttctttttctgaattcatcttgaaactttaattagccttttgttttttgttttttgattttgtgttgtgttcatcgttctactcttttaaaaatagaaacaaaaaggttggataattgg

SEQ ID NO: 7689 - DNA, 1720 bp, Brassica napus
ctctctgccctaatttcaaatctcagatcccgagaatatctagagatggcgttggtcgtcgagaagacgtcgagtggccgcgagtacaaggtcaaagacatgtctcaagccgacttcggtcgtctcgagctcgaactcgccgaggtcgagatgcccggactcatggcttgccgtaccgagttcggcccatctcagcccttcaaaggcgctagaatcaccggatctctccacatgaccatccaaaccgccgtcctcatcgagaccctaaccgccctcggcgctgaagtcagatggtgctcctgcaacatcttctccacccaagaccacgccgccgccgcaatcgctcgtgactccgccgccgttttcgcgtggaagggagagacgctccaggagtactggtggtgcacggagcgtgctcttgactggggtccaggtgctggtccagatctgatcgttgatgacggtggtgacgccacgcttttgatccatgagggagttaaggctgaggagatctttgagaagactggtcaggttcctgatcccacttccactgacaaccctgagttccagatcgtgttgtccatcatcaaggaaggtcttcaggtggatcctaagaagtaccacaagatgaaggagagactcgttggtgtctctgaggaaaccaccactggtgtcaagaggctttaccagatgcaggaggctggagctcttttgttcccagccattaacgtcaacgactccgtcaccaagagcaagttcgacaacttgtacggttgccgtcattctctccctgatggtctcatgagggccactgatgtcatgatcgccggaaaggttgtcgttgtctgcggatatggtgatgttggaaagggttgtgccgctgccatgaagaccgctggtgctagagttattgtgacggagatagatcccatctgtgccctacaggctatgatggaaggacttcaagttttgacccttgaggatgttgtttccgaagctgacatctttgtcaccaccaccggtaacaaagacatcataatggttgaccacatgaggaagatgaagaacaatgctattgtttgcaacattggtcactttgacaacgagattgacatgctcgggctcgagaccttcccgggtgtgaagcgtatcaccatcaagccccagaccgacaggtgggtcttcccagacaccaagtccggaatcattgttttggctgagggtcgtctcatgaacttgggttgtgccactggtcacccgagtttcgtcatgtcttgctctttcaccaaccaggtgattgctcagcttgagctttggaacgagaagtcgagcggcaagtacgagaagaaggtgtacgttctacccaagcatttggacgagaaggttgcagcacttcacttgggaaagcttggagctaagctcaccaagttgacaaaggaccaatctgactacgtcagcattcccattgaaggaccatacaagcctgctcactacaggtactgagagaagaagaatggagagagcggtttgtttctagtttggtcttctgatgaagttggccgaatatccttctgaatgaggattcttgtcttttgattgttgtgcttgttcttctttttctgaattcatcttgaaacttaaattagcctttggttatttgaatttgtgttgtgttcatcgttctagtctttaaaaaatagaaacaaaaaagttggataat

SEQ ID NO: 7690 - DNA, 1882 bp, Brassica napus
acacatctctctacctctctctctgccctaatttcaaatctcagatcccgagaatatctagagatggcgttggtcgtcgagaagacgtcgagtggccgcgagtacaaggtcaaagacatgtctcaagccgacttcggtcgtctcgagctcgaactcgccgaggtcgagatgcccggactcatggcttgccgtaccgagttcggcccatctcagcccttcaaaggcgctagaatcaccggatctctccacatgaccatccaaaccgccgtcctcatcgagaccctaaccgccctcggcgctgaagtcagatggtgctcctgcaacatcttctccacccaagaccacgccgccgccgcaatcgctcgtgactccgccgccgttttcgcgtggaagggagagacgctccaggagtactggtggtgcacggagcgtgctcttgactggggtccaggtgctggtccagatctgatcgttgatgacggtggtgacgccacgcttttgatccatgagggagttaaggctgaggagatctttgagaagactggtcaggttcctgatcccacttccactgacaaccctgagttccagatcgtgttgtccatcatcaaggaaggtcttcaggtggatcctaagaagtaccacaagatgaaggagagactcgttggtgtctctgaggaaaccaccactggtgtcaagaggctttaccagatgcaggaggctggagctcttttgttcccagccattaacgtcaacgactccgtcaccaagagcaagttcgacaacttgtacggttgccgtcattctctccctgatggtctcatgagggccactgatgtcatgatcgccggaaaggttgtcgttgtctgcggatatggtgatgttggaaagggttgtgccgctgccatgaagaccgctggtgctagagttattgtgacggagatagatcccatctgtgccctacaggctatgatggaaggacttcaagttttgacccttgaggatgttgtttccgaagctgacatctttgtcaccaccaccggtaacaaagacatcataatggttgaccacatgaggaagatgaagaacaatgctattgtttgcaacattggtcactttgacaacgagattgacatgctcgggctcgagaccttcccgggtgtgaagcgtatcaccatcaagccccagaccgacaggtgggtcttcccagacaccaagtccggaatcattgttttggctgagggtcgtctcatgaacttgggttgtgccactggtcacccgagtttcgtcatgtcttgctctttcaccaaccaggtgattgctcagcttgagctttggaacgagaagtcgagcggcaagtacgagaagaaggtgtacgttctacccaagcatttggacgagaaggttgcagcacttcacttgggaaagcttggagctaagctcaccaagttgacaaaggaccaatctgactacgtcagcattcccattgaaggaccatacaagcctgctcactacaggtactgagagaagaagaatggagagagcggtttgtttctagtttggtcttctgatgaagttggccgaatatccttctgaatgaggattcttgtcttttgattgttgtgcttgttcttctttttctgaattcatcttgaaacttaaattagcctttggttatttgaatttgtgttgtgttcatcgttctagtctttaaaaaatagaaacaaaaaagttggataatcggaaactatttttcgcatcccacatttaaagagctttctttctatttcgctttaattttgtttcattgaatgagatgtgaagtttgggttgttgtaattatgggcagtacaatgtttattcaatagacttcgatttcatgagc

SEQ ID NO: 7691 - DNA, 1502 bp, Arabidopsis lyrata
caaatctcagatctagaaaaatggcgttgctcgtcgagaagacctcaagcggccgtgaatacaaggtcaaagacatgtctcaagccgatttcggtcgtctcgaactcgagctcgccgaagttgagatgcctggactcatggcttgtcgtaccgagttcggaccatctcaaccattcaaaggcgctagaatcaccggatctcttcacatgacgatccaaaccgccgtactcatcgaaaccctaactgctctcggtgctgaagtcagatggtgttcttgcaacatcttctccactcaagaccacgccgccgccgcaatcgctcgtgactccgccgctgttttcgcctggaaaggtgagacgcttcaggagtattggtggtgtacggaacgtgctcttgattggggtccaggtggtggtcctgatctgattgttgatgatggtggtgacgctacgcttttgattcatgaaggtgttaaagctgaggagatttttgagaagactggtcaagttcctgatcctacttctactgataaccctgagtttcagatcgtgttgtctattatcaaggaaggtcttcaggttgatcctaagaagtaccataagatgaaggagagacttgttggtgtctctgaggaaactactactggtgttaagaggctttatcagatgcaggaaaatggaactctcttgttccctgccattaacgtcaatgactctgtcaccaagagcaagttcgacaacttgtatggttgccgtcactcacttcctgatggtctcatgagggccactgatgttatgatcgctggaaaggttgctgttatctgtggatatggtgatgttggaaagggttgtgctgctgccatgaagactgctggtgctagagtcattgtgactgagattgaccccatctgtgcccttcaagctttgatggaaggacttcaggttcttacccttgaggatgttgtctcagaagctgatatctttgtcaccaccactggtaacaaagacatcatcatggttgaccacatgaggaagatgaagaacaacgctattgtgtgcaacattggtcactttgacaatgagattgacatgcttggattggagacttaccctggtgttaagcgtatcaccatcaagcctcagactgacaggtgggtgttcccagagaccaagaccggaatcattgtcttggctgagggtcgtctcatgaacttgggttgtgccactggtcacccgagtttcgtgatgtcttgctctttcaccaaccaggttattgcccagctcgagctctggaacgagaagtcaagcggtaagtacgagaagaaggtgtacgttcttcccaagcatttggatgagaaggttgcagcacttcacttgggcaagcttggagccaggcttacaaagctgtcaaaggaccaatctgactacatcagcattccgattgagggaccatacaagcctcctcactacaggtactgagagagagagagagtggacaaagcg

SEQ ID NO: 7692 - DNA, 2153 bp, Eutrema halophilum
atgatctttgattcgctgaaacgaattcgatgcagccacgtggccaccctttccataacaccgtccgatcaactccacaacagcttaaaacacgggtcacactgctcatgcagcgtgttccataaactacgggatcaaagcttctaccagatccaccaaaccctcaaaataatccgagccgtccatttcactttgacctcatctatttataccctctcagtcaccttcgtttctcctcgcacacttctctctaccacctctctctctgctccaaatcttagatccggcaaatatctaagagagagaaaaatggcgttgatcgttgagaagacgtcgagtggccgtgaatacaaggtcaaggacatgtcccaggccgatttcggtcgtctcgagctcgagctcgccgaggttgagatgcctggactcatggcttgccgtaccgagttcggtccagctcagccattcaaaggcgctagaatcaccggatctctccacatgacaatccaaaccgccgtcctcatcgaaaccctaacagctctcggcgccgaagtcagatggtgctcctgcaacatcttctcaactcaggaccacgccgccgccgcaatcgctcgcgattccgccgccgttttcgcctggaaaggtgagacgctccaggagtactggtggtgcacggagcgtgctcttgactggggtccaggtggtggtccagatctgattgttgacgatggtggtgatgcgacgctcttgattcatgagggagttaaagctgaagagatctttgagaagactggtcaggttcctgatcctaattccactgataaccctgagttccagatcgttttgtcgattatcaaggaaggtcttcaagttgatcctaagaagtaccacaagatgaaggagagactcgttggtgtttctgaggaaactaccactggtgtcaagaggctttaccagatgcaggaaagtggagctctacttttcccagccattaacgtcaacgactctgtcaccaagagcaagttcgacaacttgtacggatgccgtcactctctacctgatggtctcatgagggcaactgatgtcatgatcgccggaaaggtcgctgttatctgtggatacggtgatgtcggaaagggttgtgccgccgccatgaaaaccgctggtgctcgtgttatcgtgactgagatcgatcccatctgtgcccttcaagctttgatggaaggacttcaagttctgacactcgaggacgtggtctcagaagctgacatctttgtcaccaccaccggtaacaaagacatcatcatggtcgaccacatgaggaagatgaagaacaacgccattgtgtgcaacattggtcactttgacaacgagatcgacatgcttggactcgagacttaccctggtgtgaagcgtatcaccatcaagccccagacagacaggtgggtgttccctgagaccaagaccggaatcattgttttggctgagggtcgtctcatgaacttgggttgtgccactggtcaccctagtttcgtcatgtcttgctctttcaccaaccaggtgattgcccagcttgagctttggaacgagaagtcgagtggtaagtacgagaagaaggtttacgttttgcctaagcatttggatgagaaggttgctgcacttcacttgggcaagcttggagctaggcttactaagttgtcaaaggaccagtctgattacatcagcattcccattgaaggaccatacaagcctgctcactacaggtactgagagagagagattagacaaagcgggtttggttctgcttctggtttgtgtcgggttatggtggaagagtggaagatattggtcttctggtgaagttgatcaattatcgttcttaataagggttcttggcttttgaaggttgtgcttgtttcttcttcttcttcatttttcttgaaaacttaaattagtttttgattatagttctcctcttgattttatttttgtgtgttttgttcaacgttgtactctttaaacaaatcatacagaaaaatgaaaaaggggaaactgttttccgcatctcaatttattgatatctctctctttcgactttattctgttttttttttttttgcttttttgttccattgaatgtgatgtgaagtgttcat

SEQ ID NO: 7693 - DNA, 1799 bp, Brassica napus
gagaagacgtcgagtggccgtgagtacaaggtcaaggacatgtctcaggccgacttcggtcgtctcgagctcgagctcgccgaagttgagatgccaggactcatggcttgccgtaccgagttcggcccagctcagcccttcaaaggcgctagaatcaccggatctctccacatgacgatccagaccgccgtcctcatcgaaaccctaaccgccctcggcgcggaagtcagatggtgctcctgcaacatcttctcaacccaagaccacgccgccgccgcaatcgcccgtgactccgccgccgttttcgcctggaaaggtgagacgcttcaggagtactggtggtgcacggagcgtgctctcgactggggcccaggtggtggtccagatctgatcgtcgatgacggtggcgacgccacgcttttgatccacgagggagtgaaggccgaggagatctttgagaagacgggtcaggttcctgatcccacttccactgacaaccctgagttccagatcgtgctttcgatcatcaaggaaggtctccaggttgatcctaagaagtaccacaagatgaaggagagactcgtcggtgtctctgaggagaccaccaccggtgtcaagaggctttaccagatgcaggaaagtggagcccttttgttcccagccattaacgtcaacgactccgtcaccaagagcaagttcgacaacttgtacggttgccgtcactctctacctgatggtctcatgagggccactgatgtcatgatcgccggaaaggttgcggttatctgtggttatggtgatgtcggtaagggttgtgccgctgccatgaaaaccgctggtgctagagtcattgtgaccgagatcgaccccatctgtgccctacaagctatgatggaagggcttcaagttctgacccttgaggatgtcgtctctgaagctgacatctttgtcaccaccaccggtaacaaagacatcatcatggttgaccacatgaggaagatgaagaacaacgctatcgtctgcaacattggtcactttgacaacgagattgacatgcaaggacttgagaccttccctggagtgaagcgtatcaccatcaagccccagaccgacaggtgggtgttcccagacaccaagtccggaatcattgttttggccgagggtcgtctcatgaacttgggttgtgccactggtcacccaagtttcgtgatgtcttgctctttcaccaaccaggtgattgcccagcttgagctttggaacgagaagtcgagcggtaagtacgagaagaaggtgtacgttctacccaagcatttggatgagaaggttgcggcacttcacttgggcaagcttggagctaagctcactaagctgacaaaggaccaatctgactacgtcagcattcccgttgaaggaccttacaagcctgctcactacaggtactgagagctgtttggttctcgttgtggtttgtctggaagagtggaagatattggtccgctgatgaagttgaccaactatccttctgaataaggggttattggctttgaaggttgtgcttgttgttcttctttttcttgaaacttaaattaacttttggttatgagttccctcttgatttgcttttgtgttgtgatcaccgtgtactctttatacgaaaatggaagagaggaactattttccgtacccaaatttttagtagtcttttcttttctctttctacctttatttattggtttctttgttttcattgaatgtcagctctcatttcaaatgtgggcattgcaatttatggtaggtaa

SEQ ID NO: 7694 - DNA, 2033 bp, Arabidopsis thaliana
cctcgcacacacttctctctctctctctctctgcctcctttcggattcaaatctcagatctagctcaaccatggcgttgctcgtcgagaagacctcaagtggccgtgaatacaaggtcaaagacatgtctcaagccgatttcggtcgtctcgaactcgagctcgccgaagttgagatgcctggactcatggcttgtcgtaccgaattcggaccttctcagccattcaaaggcgctagaatcaccggatctcttcacatgaccatccaaaccgccgtactcatcgaaaccctaactgctctcggtgctgaagtcagatggtgttcctgcaacatcttttccactcaagaccacgccgccgcagccatcgctcgtgactccgccgctgttttcgcctggaaaggtgagactcttcaggagtactggtggtgtaccgagcgtgctctagattggggtccaggtggtggtcctgatctgattgttgatgatggtggtgacgctactcttttgattcatgagggtgttaaagctgaggagatctttgagaagactggtcaagttcctgatcctacttctactgataaccctgagtttcagatcgtgttgtctattatcaaggaaggtcttcaagttgatcctaagaagtaccacaagatgaaggagagacttgttggtgtctctgaggaaactaccactggtgttaagaggctttaccagatgcagcaaaatggaactcttttgttccctgccattaacgttaacgactctgtcaccaagagcaagttcgacaacttgtatggttgccgtcactcactccctgatggtctcatgagggccactgatgtcatgatcgctggaaaggttgctgttatctgtggatatggtgatgttggaaagggttgtgctgctgccatgaagactgctggtgctagagtcattgtgactgagattgatcccatctgtgcccttcaagctttgatggaaggacttcaggttcttacccttgaggatgttgtctcagaagctgatatctttgtcaccaccaccggtaacaaagacatcatcatggtcgaccacatgaggaagatgaagaacaacgctattgtgtgcaacattggtcactttgacaatgagattgacatgcttggacttgagacttaccctggtgtgaagcgtatcaccatcaagccacagactgacaggtgggtgttcccagagaccaaggctggaatcattgtcttggctgagggtcgtctgatgaacttgggttgtgccactggtcacccaagtttcgtgatgtcttgctctttcaccaaccaggtgattgcccagctcgagctctggaacgagaaagcaagcggaaagtacgagaagaaggtgtacgttcttcccaagcatttggatgagaaggttgcattacttcacttgggcaagcttggagccaggcttacaaagctgtcaaaggaccaatctgactacgtcagcattccaattgagggaccatacaagcctcctcactacaggtactgagagagagagagagtcgacaaagcggttcaggttcggatctacttgtggttttgtgttgggttgtggtgggagagtggaacagtttgagatattggtcttctgatgaagttgaccaaatatcagtattaataagggttattggcttttgaaggttgtgcttgttttctccatttttcatgaaacttaaattagtttttggtttagtttccctcttgattttattttgtgtgttctgtttagcgttgtactcttcaaacaaatgagaaaccaaaaaaaaaggggaaacttgttttcggcatcccagtgttagcgacttttgttgaatgaatgtctcaaatgctcatctttaataatgtgtgttaggacacgaacaacacatggttcgattcgtgggggattttatggttgtagttattatcgtacacgtttcaaagttctcttaagtattcaaaaaggcttttccaatataaatttttgatagcatttagctataagattcgttttc

SEQ ID NO: 7695 - DNA, 1666 bp, Eutrema halophilum
ttcaaaagccaagaacccttattaagaacgataattgatcaacttcaccagaagaccaatatcttccactcttccaccataacccgacacaaaccagaagcagaaccaaacccgctttgtctaatctctctctctcagtacctgtagtgagcaggcttgtatggtccttcaatgggaatgctgatgtaatcagactggtcctttgacaacttagtaagcctagctccaagcttgcccaagtgaagtgcagcaaccttctcatccaaatgcttaggcaaaacgtaaaccttcttctcgtacttaccactcgacttctcgttccaaagctcaagctgggcaatcacctggttggtgaaagagcaagacatgacgaaactagggtgaccagtggcacaacccaagttcatgagacgaccctcagccaaaacaatgattccggtcttggtctcagggaacacccacctgtctgtctggggcttgatggtgatacgcttcacaccagggtaagtctcgagtccaagcatgtcgatctcgttgtcaaagtgaccaatgttgcacacaatggcgttgttcttcatcttcctcatgtggtcgaccatgatgatgtctttgttaccggtggtggtgacaaagatgtcagcttctgagaccacgtcctcgagtgtcagaacttgaagtccttccatcaaagcttgaagggcacagatgggatcgatctcagtcacgataacacgagcaccagcggttttcatggcggcggcacaaccctttccgacatcaccgtatccacagataacagcgacctttccggcgatcatgacatcagttgccctcatgagaccatcaggtagagagtgacggcatccgtacaagttaaaatcaataccttgctcttggtgacagagtcgttgacgttaatggctgggaaaagtagagctccactttcctgcatctggtaaagcctcttgacaccagtggtagtttcctcagaaacaccaacgagtctctccttcatcttgtggtacttcttaggatcaacttgaagaccttccttgataatcgacaaaacgatctggaactcagggttatcagtggaattaggatcaggaacctgaccagtcttctcaaagatctcttcagctttaactccctcatgaatcaagagcgtcgcatcaccaccatcgtcaacaatcagatctggaccaccacctggaccccagtcaagagcacgctccgtgcaccaccagtactcctggagcgtctcacctttccaggcgaaaacggcggcggaatcgcgagcgattgcggcggcggcgtggtcctgagttgagaagatgttgcaggagcaccatctgacttcggcgccgagagctgttagggtttcgatgaggacggcggtttggattgtcatgtggagagatccggtgattctagcgcctttgaatggctgagctggaccgaactcggtacggcaagccatgagtccaggcatctcaacctcggcgagctcgagctcgagacgaccgaaatcggcctgggacatgtccttgaccttgtattcacggccactcgacgtcttctcaacgatcaacgccatttttctctctcttagatatttgccggatctaagatttggagcagagagagaggtggtagagagaagtgt

SEQ ID NO: 7696 - DNA, 1762 bp, Cleome gynandra
tcggggctcgcacatctctctctgtcgatttcgaatctcagattggtgtagatatctcagggagagagctttagatcggtaaaaatggctttgctcgttgaaaagacgtcgagtggtcgtgagtacaaggtcaaggacatgtctcaggctgactttggccgtctcgagatcgagcttgctgaggtggagatgcctggtctcatggcgtgtcgtaccgagttcggggcgtcgcagccgttcaagggtgccaagatcaccggatctctccacatgacgattcaaactgctgttcttatcgaaacccttactgcccttggcgccgaggttagatggtgctcctgcaacatcttctccactcaggaccacgccgccgctgccatcgctcgcgactccgctgctgtcttcgcctggaaaggtgagactctccaggagtactggtggtgtacggagagagctcttgactggggtcccggtggcggtcccgacctcatcgtcgacgatggtggtgacgctactctcttgatccacgagggagttaaggccgaggagatctatgaaaagaccggtcaggtcccggatccgtcgtccacagacaaccctgagttccagattgtgttgcagatcatcaaggacggcctcctggtcgacccgaagaagtaccgcaagatgaaagagagattggtcggtgtgtccgaggagaccaccactggagttaagaggctctaccagatgcaagaaaatggaactctcttgttccccgctattaatgtcaatgactccgtcaccaagagcaagtttgacaacttgtacggatgccgtcactctctccccgatggtctcatgagggccactgacgtcatgatcgccggaaaggtcggtgttgtctgtggttacggagatgttggaaagggttgtgctcttgccttgaaggctgccggtgcccgtgtcatcgtgaccgagatcgatcccatctgtgccctccaagcactcatggaaggtttccaggttctcaccctggaggacgttttatccgaggctgacatcttcgtcaccacgaccggaaacaaagacatcatcatggttgaccacatgaggaagatgaagaacaacgccattgtgtgcaacattggtcacttcgacaatgagatcgacatgcacggtcttgagaccttccctggtgtgcaacgcatcaccatcaagccccaaaccgaccggtgggtcttccctgataccaaaaccggaatcatcgtccttgccgagggccgtctcatgaacttgggttgtgccactggtcacccaagtttcgtgatgtcatgctccttcaccaaccaggtgattgcacagctcgagctgtggaaggagaaggcaacaggcaagtacgagaagaaggtgtacgttctccccaagcacttggacgagaaggtcgctgcgcttcacctgggcaagctcggagcgaggttgaccaagctctccaaggaccaagccgactatatcagcgtccctatcgagggtccatacaagcctcctcactacaggtactgagaggtaacgattaagagacggtgctcgaaggatggattatctggtggcttcattgagtggagaatgaatgtttcttttgtagggttttgattttgtattggtcttactggtgaagtagaccaaaatatttcggatatgaaataagggttttgctctttatttagtttgttttctaattcttggatttttattatgtcctgttttgtcaattgttttactt

SEQ ID NO: 7697 - DNA, 1714 bp, Cleome spinosa
acacttcgtcactctcttggtttcgaatctcagatcggaagaggattaagcgaggagagagtgagagagcttcagattggcgaaaatggcgttgcttgttgagaagacgtcgagtggtcgtgagtacaaggtcaaggatatgtctcaggccgacttcggtcgtctcgagatcgagctcgccgaggtggagatgcctggtctcatggcgtgccgcaccgagttcggtccgtcgcaacccttcaagggcgcgaagatcaccggatctctccacatgacgatccaaaccgccgttctcatcgaaaccctgacagccctcggagccgaggtcagatggtgctcctgcaacatcttctccactcaggaccacgctgccgcagccatcgctcgcgactccgccgctgtcttcgcctggaaaggcgagacactccaggagtactggtggtgcaccgagagggctctcgattggggtcctggtggtggtcctgacctcatcgtcgacgatggcggtgacgccactctgttgatccacgagggcgttaaggccgaggaaatctatgagaagaccggccaggttccggatccgtcgtccactgacaaccctgagttccagatcgtgttgcagatcatcaaggacgggctccaggtcgacccgaagaagtaccacaagatgaaggagagattggtcggtgtctccgaggagaccaccactggtgtgaagaggctttaccagatgcaggccaatggatctctcttgttccctgccatcaacgtcaatgactccgtcaccaagagcaagtttgacaacttgtacggatgccgccactctctccccgatggtctcatgagggccactgatgtcatgattgccggaaaggtcggtgttgtctgtggttatggagatgtcggaaagggctgtgctcttgccctgaaggcagctggtgcacgtgtcatcgttaccgagatcgaccccatctgtgccctccaggctctcatggaaggtttccaggttctaaccctagaggacatcgtatcagaggccgacatctttgtcaccacgaccggaaacaaggacatcatcatggtcgaccacatgaggaagatgaagaacaacgcaatcgtctgcaacatcggtcactttgacaacgagatcgacatgcacggtctcgagaccttcccgggcgtgaagcggatcaccatcaagccccagaccgacaggtgggtcttccccgacactaacagtgggatcatcgtcttggcagagggccggctcatgaacttgggttgcgccactggtcacccgagtttcgtgatgtcgtgctcgttcaccaaccaggtgattgcccagctcgagctgtggaaggagaagggaacaggcaagtacaagaaggaggtgtacgtcctgccgaagcacttggacgagaaagtggcggcgcttcaccttggaaagctcggggcgaagctgacgaagctaagcaaggaccaagccgactacatcagcgtccccatcgacggtccgtacaagccacctcactacaggtactgagagagagaaagaggacgaactgttttgttgttaggatatatatgcaggatgtgtcgggtcgggtcttgtttcggtcgggagaggtaaactgttatggttctactgatgaaggagaccataacagtggaaataagggatttgaatttgaggctctgtctctctggtctcgtt

SEQ ID NO: 7698 - DNA, 1630 bp, Euonymus alatus
tcgctcaaaatccactctctccatctttgtagctctgaaatctgaatctcataagtcatatctacatctccgaaatggctttactcgtcgaaaaaactgccggcggccgcgagtacaaggtcaaggacatgtccctcgccgactttggccgactcgagatcgagctcgctgaggtcgagatgcccgggctcatgtcctgccggactgaatacggtccctctcagccatttaagggtgccaagatcactgggtccctccacatgaccatccagaccgccgtacttatcgagacactcaccgcactcggcgcggaggtccgttggtgctcctgcaacattttctcgactcaggaccatgccgccgccgctattgctcgtgacagcgctgctgtgtttgcctggaagggcgagactcttcaggagtactggtggtgtaccgagcgtgctcttgattggggtcctggtggtggacctgacctgattgttgatgacggaggtgatgctactcttttgattcatgagggggttaaagccgaggagatctatgagaagacagggacgttcccggatcctgcatctactgacaatgctgagttccagatcgtcttgactataatcagagatggactcaagaccgatcccaagaagtaccacaagatgaaggagagattggttggtgtttctgaggagaccaccactggagttaagaggctttaccagatgcagatcaatgggactctcttgttccctgctatcaatgtcaacgactctgtcaccaagagcaagtttgataacttgtacggttgccgccactcactccctgatggcctgatgagggctactgatgtcatgattgctggcaaggttggtgttgtctgtggttatggagatgtgggcaagggctgtgctgctgctttgaagcaagctggagcccgtgtgatcgtgactgagatagaccctatttgtgcccttcaggctctgatggagggataccaagtcctgaccctggaggatgttgtttctgaggctgacatctttgtcaccaccaccggcaacaaggacatcatcatggttgaccacatgaggaagatgaagaacaatgccattgtttgcaacattggtcactttgataatgagattgacatgcttgggcttgaaaccttccctggtgtgaagagaatcaccatcaagccccaaactgataggtgggtcttccctgacaccaactcaggcatcattgtgttggctgaaggacgtctcatgaacctgggttgtgccactggccaccctagttttgtcatgtcatgctcattcacaaaccaggtgattgcacagctcgagctctggatggagaagagcagtggaaagtatgagaagaaggtgtatgttttgccgaagcaccttgatgagaaggtggctgctcttcaccttgggaagcttggggctaggcttactaagctcagcaaggaccaggctgactacatcagtgttcctgttgaaggtccatacaagccggctcattacaggtattgagggacaaactctcaacaagctgagaaaaatattatatgtggacggcttgattgtttcttatacaatatgaagttgatttgcagtagaatgctaggttt

SEQ ID NO: 7699 - DNA, 1945 bp, Populus trichocarpa
cctatttttgctcatcttctccaactttcaatctccgccgtccattcctcctatttatcccccactcttcctcttctctacactcgtccttccctgccctctcttctcagccgcatctttttcccttttctaagagagtgaaagcaagaaatttcttcttctctttctcttacaatggctttgcttgtagagaaaacaacaagcggtcgtgagtacaaggtcaaggacatgtctcaggctgacttcggccgtctcgaaatcgaactggccgaagttgaaatgcctggtttgatgtcctgccgtactgaattcggcccttcacaaccattcaagggagccaggatcactggttcccttcacatgactatccaaactgctgtcttgattgaaactttaactgccttaggtgctgaggttcgttggtgttcttgcaatattttctccactcaagatcatgccgctgccgctattgcccgtgattcggctgctgtttttgcctggaaaggggagaccctccaggagtactggtggtgtactgagagagctcttgactggggcccagatggtggtcctgatttgattgttgatgatggcggtgatgccactctcttgattcatgaaggtgtgaaggctgaggagatttatgagaagactggtgcttccccagatccagcttcgactgataatgctgagttccagattgttttgacaattattagagatggattgaagtctgatcctaagaagtatcacaagatgaaggaaagattggttggtgtttcggaagaaactacaactggtgtcaagagattgtatcaaatgcagattaatgggactttacttttccctgctattaatgtcaacgactctgtcaccaagagcaagttcgacaacttgtatggatgccgccactctctccctgatggtttgatgagagctactgatgtcatgattgccggcaaggttgctgttgtctgtggttatggtgatgttggcaagggctgtgctgctgccatgaagcaagctggagctcgtgtgattgtgaccgagattgatcccatttgcgcgcttcaggctctcatggagggtctacaggtcctgactcttgaagatgttatctccgaggctgatatctttgtcaccaccactggtaacaaggacattatcatggttgatcacatgaggaagatgaagaacaatgccattgtctgcaacatcggtcacttcgataatgaaatcgacatgcttggacttgagaccttccctggcgtgaagcgcatcaccatcaagccccaaactgacaggtgggtcttccctgacaccaactccggcatcattgtcctggctgagggacgtctcatgaacctgggatgtgccaccggtcaccccagctttgtgatgtcctgctcattcaccaaccaggtgatcgcccagcttgagctgtggaacgagaggaaaaccggcaagtacgagaggaaggtctatgtcttgcccaagcaccttgatgagaaggttgcttcccttcaccttggcaagctaggagctaggcttaccaagctctccaaggaccaggctgactacatcaacgtgccaatcgagggtccatacaagcctgctcagtacaggtactgagagatggaacttgaggcaaaacgtgattggaaacggcgctattgtttcttttgtattttcatgatgatttgtcctatattattaggcttcaatttttttcctaggatttgtgttttggtggtggggaagacatgggaggaaaatatatgaaacggtctatcttgaagaccacatgggattatctaataaggttttggattggggttgtgtgggataatattgtagctgttgccatttttcatttgagttttcttgctgcagcttatcttctttttaatcatgaaaaagattaaaaaataacctttttgtttca

SEQ ID NO: 7700 - DNA, 1727 bp, Cleome spinosa
tcgggggtcgacacttcctctctctcgctcgatttcggatctcatcggaaaagaaatctcacagagagttcagatcgtaaaaaatggcgttgctcgtggagaagacgtcgagtggccgtgagtacaaggtcaaggatatgtctcaggccgacttcggtcgtctcgagatcgagctcgcggaggtggagatgcctggtctcatggcgtgccgtaccgagttcgggccgtcgcagccgttcaaaggcgcgaagatcactggatctcttcacatgacgatccaaaccgcagttctcatcgaaaccctaaccgctctcggagccgaggtcagatggtgctcctgcaacatcttctccactcaggaccacgccgcggccgccatcgctcgcgattccgccgccgtattcgcctggaaaggtgagaccctccgggagtactggtggtgcacggagcgtgcgctcgattggggtcctggtggtggtcctgacctcatcgtcgacgatggtggtgacgccactctcttgatccacgagggtgttaaggccgaggagctctatgagaagactggtcaggtcccggatccgtcgtgcaccgacaaccctgagttccagatcgtcttgcagatcatcaaggacggcctccaggtcgacccgaagaagtaccgcaagatgagggagagattggtcggtgtctccgaggagacaaccactggtgtcaagaggctctaccagatgcaagccaatggaactctcttgttccctgccattaacgtcaatgactccgtcaccaagagcaagtttgacaacttgtacggatgccgacactctctccctgatggtctcatgagggccaccgacgtcatgatcgccggaaaggtcggtgtggtctgtgggtacggagatgtcggaaagggctgtgctctcgccttgaaagcagccggtgcccgagtcatcgtgaccgagatcgaccccatctgtgctctccaggctctcatggaaggtttccagattctaaccctcgaggacatcgtatcagaggccgatatcttcgtcaccacgacaggaaacaaggacatcatcatggtcgaccacatgaggaagatgaagaacaacgccattgtctgcaacatcggccactttgacaacgagatcgacatgcacggtctcgagaccttcccgggtgtgaaacgcataaccatcaagccccaaaccgacaggtgggtcttccccgacacgaagaccggaatcatcgttctggccgagggtcgtctcatgaacttgggttgcgccactggtcacccgagtttcgtgatgtcgtgttcattcacgaaccaggtgattgcacagctcgagctgtggaaggagaagggaacgggcaagtacgagaagaaggtgtatgttctcccgaagcatttagacgagaaggtcgcggcccttcacttgggcaagctcggggcgaagctgacaaagctctccacggaccaagctgactacatcagtgttcccattgaaggtccgtacaagcctcctcactacaggtactgagtaagaaagaggattgttttgtggtgtcagtggaacccaatgttttctttttagggttaaagtttgtctggttttgttttcgtcggagaggggaagctgtattggtcttactgatgaagtagacctaagtacttggggttctgcaataaggttgttttttttattgaagccgtctctctctctctc

SEQ ID NO: 7701 - DNA, 1786 bp, Ambrosia trifida
tacccaccttctcaagagcctctaagatctaatctacaaactcttaaccatggctctaaccgtcgagaaaacctcaactggccgtgaatacaaagtcaaggacatgtccttggctgacttcggccgcctcgaactcgagctagccgaagtcgaaatgcccggtctaatgtcctgcaggaccgaattcggcccgtcccagccttttaaaggcgcccgaatcaccggttcgctacacatgaccattcagaccggtgtccttattgaaaccctcaccgccttaggcgctgaggttagatggtgctcttgcaacatcttttccacccaggaccatgctgcggccgctatcgctcgcgattcggccgcagtgttcgcctggaagggcgagaccttacaggagtactggtggtgcactgagcgtgctctagactggggtcctggaggtggtccagatctgattgtggatgacggaggtgatgctactttgttgatccatgaaggagttaaggctgaggaggagtttgagaagacagggaaattgccggacccgagctcaactgataacgcggagtttcagattgtgttgtcgattattaaggaagggttgcaggttgatcctaagaagtatcataagatgaaggagagattggttggtgtgtctgaggagactaccactggtgttaagaggttgtaccagatgcaagctaatggtactctgttgtttcctgctattaacgttaatgactctgttaccaagagcaagtttgacaacttgtacggatgccgccactctctccctgatggtttgatgagagccactgatgtcatgattgccggaaaggttgccgttgtctgtggttacggagatgtcggaaagggttgtgctgctgccatgaaacaagctggtgcccgtgtcatcgtgactgaaatcgaccccatctgtgcccttcaggccaccatggaaggactccaagtccttacattggaagacgtcgtttcagaagctgacatcttcgtcaccaccaccggtaacaaagacatcatcatggtttctgacatgaagaagatgaagaacaacgccatcgtctgcaacattggtcacttcgacaatgaaatcgacatgcttggtcttgaaacttaccctggtgttcaaagaatcactatcaaaccccaaaccgacaggtgggtcttccctgaaaccaagaccggcatcattgttttggctgagggtcgtctcatgaacttgggttgtgccactggtcaccccagtttcgtgatgtcttgctcgttcaccaaccaagtgattgcccaactcgaactctggaacgagaagagcaccgggaagtacaagaaggaggtgtatgtcttgcccaagcatcttgatgagaaggttgctgcccttcatcttggaaagcttggagccaagctgaccaagttgaccaaggaccaggctgactacatcagtgtaccagttgagggaccatacaagcctgctcactacaggtactgagcgtgtcggttttgtggaggacgttgttgctttctttataagatacaacttgagtatgtgttagactctagttttgtttgttacttttatcggggtgttggcgaggatgaaactgatcggtcgtctcttgatgagacgactgatgtcggttcaaataagggctgtgtgtgaaggatgtgtggacttgtagtagtttttctggtttagaggttttgcttgctatggattttgcttcttattttatcaagcgattaaagaaaaaaatagtaattttgtgca

SEQ ID NO: 7702 - DNA, 1606 bp, Tripterygium wilfordii
atctctccctttctttatctcagatctacatctaccaaatggctttgctcgtcgagaaaaccgccgccggccgcgagtacaaggtcaaggacatgtccctcgctgactttggccgcctcgagatcgagctagccgaggtcgagatgcctgggctcatgtcctgccggactgagtatggcccctctcagccattcaagggtgccaagatcaccggctccctccacatgacaatccagaccgctgtcctcatcgagaccctaaccgcactcggcgctgaagtccgttggtgctcctgcaacattttctcgacccaggaccatgccgccgccgctattgctcgtgacagtgctgctgtgttcgcctggaagggcgagactcttcaggaatactggtggtgtaccgagcgtgctcttgattggggtcctggtggtggccctgacctgattgttgatgatgggggtgatgctactctcttgattcatgagggggttaaggccgaggagatctatgagaagacagggacgcttccggatcctgcatctaccgataatgcagagtttcaaatcgtcttgactatcatcagagacggactcaagaccgatcccaagagataccacaagatgaaggagagattagttggtgtttctgaggagaccaccactggagttaagaggctgtaccagatgcagatcaatgggactctcctgttcccggctatcaatgtcaacgactctgtcaccaagagcaagtttgataacttgtacggttgccgccactctctccctgatggtctgatgagggctactgatgtcatgattgccggcaaggttggtgttgtctgtggttatggggatgtgggcaagggctgtgctgctgctttgaagcaagctggagctcgtgtgatcgttaccgaaatagaccctatttgtgcgcttcaggctctgatggagggataccaagtcttgaccctggaggatgttgtttctgaggctgatatctttgtcaccaccaccggcaacaaggacatcatcatggttgaccacatgaggaagatgaagaacaatgccatagtttgcaacattggtcactttgataatgagattgacatgcttggacttgaaaccttccctggtgtgaagagaatcaccatcaagccccaaactgataggtgggtcttccctgacaccaactcaggcatcattgtgttggcggaaggacgactcatgaacttgggttgtgccactggccaccctagttttgtcatgtcatgctcattcacaaaccaggtgattgcacagctcgagctctggacagagaagagcactggaaagtatgagaagaaggtgtatgttttgcctaagcaccttgatgagaaggtggctgctcttcaccttgggaagcttggggctaggcttaccaagctcagcaaggaccaggctgactacattagtgttcctgttgaaggtccatacaagcctgcgcactacaggtattgagggataaactcttgagagtttgagaaaaagaagacacctggacggcttgactgtttcttctacaatatgaatgttgattcgcaatatggtgctgggatttgagtttttgt

SEQ ID NO: 7703 - DNA, 1799 bp, Tripterygium wilfordii
tcctctctttgtagttctgaatctgaatctgaatcttagatctactcttcacaaatggctttgctcgtcgagaagactgccggtggccgggagtacaaggtcaaggacatgtccctcgccgacttcggccgcctcgagattgatcttgctgaggttgagatgccagggctcatgtcctgccgcaccgagtacggcccttctcagccatttaagggtgccaaaatcaccggctcccttcacatgaccatccagacagccgttctcatcgagaccctcaccgcacttggtgccgaggtccgctggtgttcctgcaacattttctctactcaggaccacgctgctgccgccatcgcccgcgatagtgctgcggtcttcgcctggaagggtgagactcttcaggagtactggtggtgcaccgagcgtgctctcgattggggtcccggtggtggccctgatcttattgtcgatgatggaggtgatgctactctcttgatccacgagggtgtcaaggctgaggagatctatgagaagaccgggcagtttcccgaccctgcctccaccgacaatgctgagttccagatagtattgactatcatcagagatgggctcaaaaccgatcccaagaagtaccacaagatgaaggagagattggtgggtgtttctgaggagacaacaactggagtcaagaggctgtaccagatgcagatcaatgggactctgttgttccctgccatcaatgtcaatgactctgtcaccaagagcaagtttgataacttgtacggttgccgccactcgctccctgatggcctgatgagagctactgatgtcatgattgctggcaaggttggtgttgtatgcggttacggtgacgtgggcaagggctgcgctgctgcattgaagcaagctggagctcgtgtgattgtgacggagattgaccctatctgtgcccttcaggcccttatggagggatatcaagtcctgactttggaggatgtggtttctgaggctgacatctttgttaccaccactggcaacaaggacatcatcatggttgaccacatgaggaagatgaagaacaatgccattgtttgcaacattggccactttgataatgaaatcgacatgcttggacttgaaacctaccctggtgtgaagcgtatcaccatcaagccccaaactgataggtgggtcttcccagacaccaactcgggcatcattgtgttggctgaagggcggctcatgaacttgggttgtgccactggacaccccagctttgtgatgtcatgctcattcacgaaccaggtgattgcacagctggagctatggttggagaagagctctggcaagtatgagaagaaagtgtacgttttgcccaagcaccttgatgagaaggtggctgctcttcaccttgggaagcttggggctaagcttaccaagctcagcaaggaccaggctgactacatcagtgttcctgttgagggtccttacaagcctgctcactataggtactgaggggagaagattgccggagtctcagacaagatttacaaggggacggcttgattgttttcttttacattatgattgatgttgatttgcagcggaaggcgaggttttcaattttaatttctctagggttttggtgttttggtggtcaacgatttggagggaagtgaatgaactccaccctagggttttggtgttttggtggtcaacgatttggagggaagtgaatgaactccaccctttttgaggagtggaccaggtgagaaatgaataaatggtttgaattgggctgt

SEQ ID NO: 7704 - DNA, 1845 bp, Ricinus communis
ctcgcctcaaaccccccctctctctacgaaaaacccttaaacctcgtttttagagagagaacgtaaatcgaaagacattacagtacataatggctttgttggtggagaaaacaaccagcggccgtgagtacaaggtcaaagacatgtctcaggccgacttcggtcggctcgagatcgagcttgccgaagttgaaatgcccggtttaatggcttgccggaccgagttcggcccatcccagccattcaaaggagccaaaatcaccggttccctccacatgacaatccagaccgcagttctcatcgaaacccttacagctctaggcgcagaagtgcgttggtgctcatgcaacatcttcagcacccaagaccacgccgctgctgccatagcacgcgactcagcggccgtgttcgcctggaaaggagagactttgcaggagtactggtggtgcactgagcgcgcccttgactggggcccaggcggtggcccagatctgatcgttgacgacggtggggatgccactctgttgattcacgaaggtgttaaggctgaggagatttatgagaagaccggtcaggttcctgacccgacttctactgataatgcggagtttcagattgtgttgactataatcagagatgggctaaagacagatcctaaaaagtaccacaaaatgaaggaaagattggtgggtgtatctgaggagacaactaccggtgttaagagattgtatcagatgcaagctaatgggactttgttgttccctgctatcaatgttaacgactctgttactaagagcaagtttgacaacttgtatggatgccgccactccctccctgatggtttgatgagggctactgatgtcatgattgccggcaaggtttctgttgtctgtggttatggtgatgttggcaagggctgtgctgctgccttgaagcaagctggatctcgtgtgatcgtgactgagattgacccaatctgtgcccttcaggctcttatggagggctaccaagtcttgcctctggaagatgttgtctccgaagctgatatctttgtcaccaccacaggtaacaaggacatcgtcatggtcgatcacatgaggaagatgaagaacaatgccattgtctgcaacattggtcactttgacaatgaaattgatatgcacggtcttgagaccttccctggtgtgaagaggatcaccatcaagccccaaactgataggtgggtcttccctgataccaactcaggcatcattgtcttggctgaggggcgtctcatgaatttgggttgtgccactggtcacccaagtttcgtgatgtcttgctctttcaccaaccaggtcattgcacagctcgagttgtggagggaaaaggcaactggcaaatatgaaaagaaggtctacgtcttgcctaagcatcttgatgagaaggttgctgctcttcatcttggaaagcttggagccaagctcaccaagctctccaaggaccaggctgactacatcagcgtgccagttgagggtccttacaagcctgctcactacaggtactgaggtggaagagaagcttgagaaaaaactacataatggacggcttgattgttttctttttattttacattttgatgatgatttgtggtagaatattaggcttttgatttttgtaggattttgtgttttggtggggagtctctgttgaagaccaaatcggattgaataaagttaaggaatggaaggttgtgttggatgtgtactatagctgctgccatttcatttctggtgcagttgtttatcattttattcaccataaaacaaagcaaaaaaaattattattacctatcgtttttctttt

SEQ ID NO: 7705 - DNA, 2417 bp, Ricinus communis
aagaaaaaaacggtgaatcaatcagaaacccaaaataacggctctgataatctctcaggagttacctttacttttacccacaaaaggcttttaacagcaatcagaatgcgtctcctacgcaaacgattttcaacattttaccagatccaccaaccgagtttcaatctaagatctgagccgtccattttgcatctctaacctatttatacaccctcatctctaccttaattcctcgcctcaaaccccccctctctctacgaaaaacccttaaacctcgtttttagagagagaacgtaaatcgaaagacattacagtacataatggctttgttggtggagaaaacaaccagcggccgtgagtacaaggtcaaagacatgtctcaggccgacttcggtcggctcgagatcgagcttgccgaagttgaaatgcccggtttaatggcttgccggaccgagttcggcccatcccagccattcaaaggagccaaaatcaccggttccctccacatgacaatccagaccgcagttctcatcgaaacccttacagctctaggcgcagaagtgcgttggtgctcatgcaacatcttcagcacccaagaccacgccgctgctgccatagcacgcgactcagcggccgtgttcgcctggaaaggagagactttgcaggagtactggtggtgcactgagcgcgcccttgactggggcccaggcggtggcccagatctgatcgttgacgacggtggggatgccactctgttgattcacgaaggtgttaaggctgaggagatttatgagaagaccggtcaggttcctgacccgacttctactgataatgcggagtttcagattgtgttgactataatcagagatgggctaaagacagatcctaaaaagtaccacaaaatgaaggaaagattggtgggtgtatctgaggagacaactaccggtgttaagagattgtatcagatgcaagctaatgggactttgttgttccctgctatcaatgttaacgactctgttactaagagcaagtttgacaacttgtatggatgccgccactccctccctgatggtttgatgagggctactgatgtcatgattgccggcaaggtttctgttgtctgtggttatggtgatgttggcaagggctgtgctgctgccttgaagcaagctggatctcgtgtgatcgtgactgagattgacccaatctgtgcccttcaggctcttatggagggctaccaagtcttgcctctggaagatgttgtctccgaagctgatatctttgtcaccaccacaggtaacaaggacatcgtcatggtcgatcacatgaggaagatgaagaacaatgccattgtctgcaacattggtcactttgacaatgaaattgatatgcacggtcttgagaccttccctggtgtgaagaggatcaccatcaagccccaaactgataggtgggtcttccctgataccaactcaggcatcattgtcttggctgaggggcgtctcatgaatttgggttgtgccactggtcacccaagtttcgtgatgtcttgctctttcaccaaccaggtcattgcacagctcgagttgtggagggaaaaggcaactggcaaatatgaaaagaaggtctacgtcttgcctaagcatcttgatgagaaggttgctgctcttcatcttggaaagcttggagccaagctcaccaagctctccaaggaccaggctgactacatcagcgtgccagttgagggtccttacaagcctgctcactacaggtactgaggtggaagagaagcttgagaaaaaactacataatggacggcttgattgttttctttttattttacattttgatgatgatttgtggtagaatattaggcttttgatttttgtaggattttgtgttttggtggggagtctctgttgaagaccaaatcggattgaataaagttaaggaatggaaggttgtgttggatgtgtactatagctgctgccatttcatttctggtgcagttgtttatcattttattcaccataaaacaaagcaaaaaaaattattattacctatcgtttttcttttgcgtttgccttgatggatggctattacttgtcagcaaattaccttaaaacagttaagccatctttaatgtaaaaagtaggtctggtgtgcatatctctgaaaaccttattgaattggaattttggtgacttgacaagttgtagttatggcaaaggataaaaatggagcgagcctctttctttgcttttgtttttgctgtgcccgagtgggtcgttggcccttcatggaattgagcctaatctaggattggtggttggtggtaatgatgattgataattatttatttatttatttttatgaaaaagataaagagtctggtgaacaaagaagtgggagtgggg

SEQ ID NO: 7706 - DNA, 1838 bp, Quercus alba
atgggggtggtctcactctctctctctctctctctcccccaaattttatcagatccaattctcgactcacgttctcaacatggctttgttggtagagaaaaccacaagcggtcgtgagtacaaggtgaaggacatgtctcaggccgacttcggtcgcctcgagatcgagctggccgaagtcgagatgccaggtctcatgtcctgcagaaccgagttcggcccttcacagcccttcaagggagccagaatcaccggctctctccacatgaccatccaaaccgccgtcctcatcgagaccctgacggccctcggcgccgaggtccgttggtgttcatgcaacatcttctcgacccaggaccacgccgccgccgccatcgcccgtgactccgccgccgtgttcgcctggaaaggggagaccctccaggagtactggtggtgcaccgagcgtgctctcgactggggtcccggtggtgggcccgatctcatagtcgacgacggtggtgacgccactctgctcatccacgagggcgttaaggccgaggagttgtttgagaagaatgggacccttccggacccagcttccaccgacaatgccgagttccagattgtgctgaccattatcagagatgggttgaagacagatcccaagaggtaccacaagatgaagcaaagattggttggtgtgtctgaagagacaaccactggagttaagaggctttaccagatgcaggccaatggtaccctcttgttccctgctattaacgttaacgactccgtcaccaagagcaagtttgataacttgtatggatgccgccactccctccccgatggtttgatgagggctactgatgtcatgattgccggcaaggttgctgttgttgctggatatggtgatgttggcaagggctgtgctgctgccatgaagcaagctggtgcccgtgtgattgtgactgagattgatccaatttgcgctcttcaggcccttatggaaggcctccaagttctaacccttgaggatgttgtctctgaggctgacatctttgtaaccaccaccggtaacaaggacatcatcatggttgaccacatgaggaagatgaagaacaatgccattgtttgcaacattggtcactttgacaatgagattgacatgcttggccttgagaactatccaggtgtgaagcgcatcaccatcaagccccaaacagacaggtgggtcttccctgatacaaactcaggcatcattgtgttggccgagggtcggctcatgaacttgggttgtgccacagggcacccaagtttcgtgatgtcttgctcattcacaaaccaggtgattgcacagcttgagctgtggaaggagaggactaccgggaaatatgagaagaaggtctatgtcttgccaaagcatcttgatgagaaggttgctgcacttcaccttggcaaacttggggctagactcaccaagctcagcaaggaccaggctgactacattagtgtccctgtggagggtccatacaagcctgctcactacaggtactgagaagagtcaagaaaacaaggcatatcgagaaaaccaagatatattatatatttggatcggcttgatggtttcttttacaaatttatgacttttattaggatgttaggttttgaatttttttttggtaggggctttttgtgtttggtggtggatgttatggaggaaagaaaatggttggtctctgttgaaagaagaccaatttgggtttcaataagggttggatggggttgtgtgggaatatataatgctgttgagtttttgttgcgtttgttattaaaacctaaaaaaaaggactgctatt

SEQ ID NO: 7707 - DNA, 1801 bp, Quercus alba
atcagatccaattctcgactcactctcgtttctcaacatggctttgttggtagagaaaaccacaagcggtcgtgagtacaaggtgaaggacatgtctcaggccgacttcggtcgtctcgagatcgagctggccgaagtcgagatgcctggtctcatgtcctgcagaaccgagttcggcccttcacagcccttcaagggagccagaatcaccggctctctccacatgaccatccaaaccgccgtcctcatcgagaccctgacggccctcggcgccgaggtccgttggtgttcatgcaacatcttctcgacccaggaccacgccgccgccgccatcgcccgtgactccgccgccgtgttcgcctggaaaggggagaccctccaggagtactggtggtgcaccgagcgtgctctcgactggggtcccggtggtgggcccgatctcatagtcgacgacggtggtgacgccactctgctcatccacgagggcgttaaggccgaggagttgtttgagaagaatgggactattccggacccagcttccaccgacaatgccgagttccagattgtgctgaccattatcagagatgggttgaagacagatcccaagaggtaccacaagatgaagcaaagattggttggtgtgtctgaagagacaaccactggagttaagaggctttaccagatgcaggccaatggtaccctcttgttccctgctattaacgttaacgactccgtcaccaagagcaagtttgataacttgtatggatgccgccactccctccccgatggtttgatgagggctactgatgtcatgattgccggcaaggttgctgttgttgctggatatggtgatgttggcaagggctgtgctgctgccatgaagcaagctggtgcccgtgtgattgtgactgagattgatccaatttgcgctcttcaggcccttatggaaggcctccaagttctaacccttgaggatgttgtatctgaggctgacatctttgtaaccaccaccggtaacaaggacatcatcatggtcgaccacatgaggaagatgaagaacaatgccattgtttgcaacattggtcactttgacaatgagattgacatgctcggccttgagaactatccaggtgtgaagcgcatcaccatcaagccccaaacagacaggtgggtcttccctgatacaaactcaggcatcattgtgttggccgagggtcggcttatgaacttgggttgtgccacagggcacccaagtttcgtgatgtcttgctcattcacaaaccaggtgattgcacagcttgagctgtggaaggagaggactaccgggaaatatgagaagaaggtctatgtcttgccaaagcatcttgatgagaaggttgctgcacttcaccttggcaaacttggggctaggctcaccaagctcagcaaggaccaggctgactacattagtgtccctgtggagggtccatacaagcctgctcactacaggtactgagaagagtcaagaaaacaaggcatatcgagaaaaccaagatatattatatatttggatcggcttgatggtttcttttacaaatttatgacttttattaggatgttaggttttgaattttttttttggtaggggctttttgtgtttggtggtggatgttatggaggaaagaaaatggttggtctctgttgaaagaagaccaatttgggtttcaataagggttggatggggttgtgtgggaatatataatgctgttgagtttttgttgcgtttgttattaaaacctaaaaaaaaggactgctatttcct

SEQ ID NO: 7708 - DNA, 1839 bp, Quercus alba
atggggtgtctcactctctctctctctctctcccccaaaattttatcagatccaattctcgactcactctcgtttctcaacatggctttgttggtagagaaaaccacaagcggtcgtgagtacaaagtgaaggacatgtctcaggccgacttcggtcgtctcgagatcgagctggccgaagtcgagatgcctggtctcatgtcctgcagaaccgagttcggcccttcacagcccttcaagggagccagaatcaccggctctctccacatgaccatccaaaccgccgtcctcatcgagaccctgacggccctcggcgccgaggtccgttggtgttcatgcaacatcttctcgacccaggaccacgccgccgccgccatcgcccgtgactccgccgccgtgttcgcctggaaaggggagaccctccaggagtactggtggtgcaccgagcgtgctctcgactggggtcccggtggtgggcccgatctcatagtcgacgacggtggtgacgccactctgctcatccacgagggcgttaaggccgaggagttgtttgagaagaatgggactattccggacccagcttccaccgacaatgccgagttccagattgtgctgaccattatcagagatgggttgaagacagatcccaagaggtaccacaagatgaagcaaagattggttggtgtgtctgaagagacaaccactggagttaagaggctttaccagatgcaggccaatggtaccctcttgttccctgctattaacgttaacgactccgtcaccaagagcaagtttgataacttgtatggatgccgccactccctccccgatggtttgatgagggctactgatgtcatgattgccggcaaggttgctgttgttgctggatatggtgatgttggcaagggctgtgctgctgccatgaagcaagctggtgcccgtgtgattgtgactgagattgatccaatttgcgctcttcaggcccttatggaaggcctccaagttctaacccttgaggatgttgtatctgaggctgacatctttgtaaccaccaccggtaacaaggacatcatcatggtcgaccacatgaggaagatgaagaacaatgccattgtttgcaacattggtcactttgacaatgagattgacatgctcggccttgagaactatccaggtgtgaagcgcatcaccatcaagccccaaacagacaggtgggtcttccctgatacaaactcaggcatcattgtgttggccgagggtcggcttatgaacttgggttgtgccacagggcacccaagtttcgtgatgtcttgctcattcacaaaccaggtgattgcacagcttgagctgtggaaggagaggactaccgggaaatatgagaagaaggtctatgtcttgccaaagcatcttgatgagaaggttgctgcacttcaccttggcaaacttggggctaggctcaccaagctcagcaaggaccaggctgactacattagtgtccctgtggagggtccatacaagcctgctcactacaggtactgagaagagtcaagaaaacaaggcatatcgagaaaaccaagatatattatatatttggatcggcttgatggtttcttttacaaatttatgacttttattaggatgttaggttttgaattttttttttggtaggggctttttgtgtttggtggtggatgttatggaggaaagaaaatggttggtctctgttgaaagaagaccaatttgggtttcaataagggttcgatggggttgtgtgggaatatataatgctgttgagtttttgttgcgtttgttattaaaacctaaaaaaaaggactgcta

SEQ ID NO: 7709 - DNA, 1899 bp, Quercus alba
atgggggtgtctcactctctctctctctcctacccctaaattttatcagatccaattctcgactcactctcgttctcaacatggctttgttggtagagaaaaccacaagcggtcgtgagtacaaggtgaaggacatgtctcaggccgacttcggtcgtctcgagatcgagctggccgaagtcgagatgcctggtctcatgtcctgcagaaccgagttcggcccttcacagcccttcaagggagccagaatcaccggctctctccacatgaccatccaaaccgccgtcctcatcgagaccctgacggccctcggcgccgaggtccgttggtgttcatgcaacatcttctcgacccaggaccacgccgccgccgccatcgcccgtgactccgccgccgtgttcgcctggaaaggggagaccctccaggagtactggtggtgcaccgagcgtgctctcgactggggtcccggtggtgggcccgatctcatagtcgacgacggtggtgacgccactctgctcatccacgagggcgttaaggccgaggagttgtttgagaagaatgggactattccggacccagcttccaccgacaatgccgagttccagattgtgctgaccattatcagagatgggttgaagacagatcccaagaggtaccacaagatgaagcaaagattggttggtgtgtctgaagagacaaccactggagttaagaggctttaccagatgcaggccaatggtaccctcttgttccctgctattaacgttaacgactccgtcaccaagagcaagtttgataacttgtatggatgccgccactccctccccgatggtttgatgagggctactgatgtcatgattgccggcaaggttgctgttgttgctggatatggtgatgttggcaagggctgtgctgctgccatgaagcaagctggtgcccgtgtgattgtgactgagattgatccaatttgcgctcttcaggcccttatggaaggcctccaagttctaacccttgaggatgttgtatctgaggctgacatctttgtaaccaccaccggtaacaaggacatcatcatggtcgaccacatgaggaagatgaagaacaatgccattgtttgcaacattggtcactttgacaatgagattgacatgctcggccttgagaactatccaggtgtgaagcgcatcaccatcaagccccaaacagacaggtgggtcttccctgatacaaactcaggcatcattgtgttggccgagggtcggcttatgaacttgggttgtgccacagggcacccaagtttcgtgatgtcttgctcattcacaaaccaggtgattgcacagcttgagctgtggaaggagaggactaccgggaaatatgagaagaaggtctatgtcttgccaaagcatcttgatgagaaggttgctgcacttcaccttggcaaacttggggctaggctcaccaagctcagcaaggaccaggctgactacattagtgtccctgtggagggtccatacaagcctgctcactacaggtactgagaagagtcaagaaaacaaggcatatcgagaaaaccaagatatattatatatttggatcggcttgatggtttcttttacaaatttatgacttttattaggatgttaggttttgtaattttttttggtaggggctttttgtgtttggtggtggatgttatggaggaaagaaaatggttggtctctgttgaaagaagaccaatttgggtttcaataagggttggatggggttgtgtgggaatatataatgctgttgagtttttgttgcgtttgttattaaaacctaaaaaaaggactgctatttcctgaaaaaaaaaaaaaaagtaaactctgcgttcccctaccgttgtagaggacgacagat

SEQ ID NO: 7710 - DNA, 2035 bp, Populus trichocarpa
cactcgctctttccttcacagccgctacgcttctattttcgctatcgagggtgaaggaaaataactcttctcatcttcccttctttctcctacaatggctttgcttgtcgagaaaacaacaagcggtcgtgcgtacaaggtgaaggacttgtcccaggctgacttcggccgtctcgaaattgagctggccgaagttgaaatgcctggattgatgtcctgccgcgctgaattcggcccctcacaaccattcaagggagccaagattaccggatctcttcacatgactatccaaaccgctgtcttgatcgaaaccttgaccgccttgggtgctgaggttcgttggtgttcttgcaatatcttctccactcaagatcatgccgccgcagctattgcacgtgactcagctgctgtttttgcctggaaaggggagaccctccaggagtattggtggtgcactgagagagctcttgattggggcccgggtggtggtcctgatttgattgttgatgatggtggtgatgctactctcttgattcacgagggtgtgaaagctgaggagatttatgagaagactggtgttttgccagatccagcttcgactgataatgtagagtttcagcttgttttgacaattattagagatgggttgaagagtgatcccatgaagtatcacaagatgaaggaaagattggttggtgtttcagaggaaaccacaactggtgttaagagattgtatcaaatgcaggctaatgggactttgcttttccctgccattaatgttaacgactctgtgaccaagagcaagtttgataacttgtatggatgccgtcactctctccctgatggtttgatgagagctactgatgtcatgattgccggaaaggttgctgtggtctgtggttatggtgatgttggcaagggctgtgcagctgccatgaagcaagctggagctcgtgtgatcgtgactgagattgatcccatttgcgctcttcaggctctcatggagggtctccaggtcttgacccttgaagatgttgtctccgaggctgatatctttgtgaccaccaccggtaacaaggacatcatcatggttgaccacatgaggaagatgaagaacaatgccattgtctgcaacattggtcacttcgataatgaaatcgacatgcacggacttgagaccttccctggtgtgaaacgcatcaccatcaagccccaaactgataggtgggttttccctgataccaaatcgggcatccttgtcctggccgagggacgtctcatgaacctgggttgtgccactggtcaccccagttttgtgatgtcctgctcattcaccaaccaggtgattgctcagcttgagctgtggaacgagaagacatccggcaagtatgagaagaaggtctatgttttgcccaagcaccttgatgagaaggttgcttcccttcaccttggcaagcttggagccaggctcaccaagctctccaaggaccaggcagactacatcaacgttccagttgagggtccctacaagcctgctcagtacaggtactgagagatggaatttgaggaaagaccatctgtttggacggcgctattgtttcttttgtatcttgctgatgatttgtcctagaatatcaggctttggattttttaggatttgtgttttggtggggaagatttgggaggaaaatatatgatctgcgatctcggagaaaagaccacatgggatttaatttaataaggttttggatgggggtgcgtgggataatattgtaacggctagtagaatgagttttctctgctgctgcttatcttttttcttcttatccacaaaaggaaaaaaaacgagaactgttttattcttgttttggtctctatcatttatattattttctaaactaggtaaaatgaagcagaaggtactgtaaatcacgaggtatcttctgtcttcagctacaacgcgtatgtcaaaatgagctgccgccatttttatcacttgatcttcgtaataaacagagtcgacccttttgctgca

SEQ ID NO: 7711 - DNA, 1930 bp, Manihot esculenta
ctcgctcaaacccctctctctgtattcataaaccccatagagagagagtgtgcgcgtcttcttcttccttctactctcattctaaagtctcggatctaaacctctaacaaccttaactatggctttgttggtggagaagaccactagcggccgtgagtacaaggtcaaggacatgtctcaggccgacttcggtcgcctcgagatcgaattagccgaggttgaaatgcctggtcttatggcttgcagagctgagtttggccctgctcagcctttcaagggcgccagaattaccggctcccttcacatgaccattcagaccgccgttctcatcgagactctaaccgccttgggcgccgaggtccgctggtgctcttgtaatatttttagcactcaggaccacgccgccgctgccatagcccgtgactccgccgctgtatttgcttggaagggtgagaccctccaagagtactggtggtgtaccgagcgcgctcttgactggggtcccggcggtggcccagatctgattgtggatgatggtggtgatgctacccttttgatccatgagggtgttaaggctgaggagatttatgagaagactggacaggttcctgatccgtcttccaccgacaatgctgagtttcagattgttttgacgattattagggatgggttgaagacagatcccaaaaggtatcacaagatgaaggaaagactggtgggtgtctctgaggagactaccactggagttaagaggttgtaccagatgcaagctaatggaactctgttgttctctgctattaatgttaatgactctgtcaccaagagcaagtttgataacttgtatggatgccgccactctctccctgatggtttgatgagggctactgatgtcatgattgctggcaaggttgctgttgtctgcggttatggtgatgtgggcaagggctgtgctgccgccttgaagcaggctggggctcgtgtgatagtgactgagattgatcccatttgtgcccttcaggctcttatggaaggtctgcaagtgttgacccttgaagatgttgtttccgaggctgatatctttgtcaccaccactggtaacaaggacatcatcatggttgatcacatgaggaagatgaagaacaatgccattgtttgcaacattggtcactttgataatgaaattgatatgcatggacttgagacctaccctggcgtgaagcgcgtcaccatcaagccccagactgataggtgggtgttccctgagaccaaaacaggcatcattgtgttggctgaggggcgtctcatgaatttgggttgtgccactggtcaccccagcttcgtgatgtcatgctctttcaccaatcaggtgattgcacagcttgagttgtggagggagaagggaactggcaaatatgagaagaaagtgtatgttttgcctaagcaccttgatgagaaggttgctgctcttcacctagggaagcttggagctcacctcactaaactcaccaaggagcaagctgattacatcagcgttcccgttgagggtccttacaagcctgctcactacaggtactaagaagggacgagagaagaaaacaatatattgggacaatgtgattgtttttacaaattgaagattgagttgtggtagaatgttaggcattttaatttttgtaggatttgtgttctggtggggaaaagttggttggaaagaaatggattggtctctctatttgaaggccacaagggaatgaataaggttttggatggggttgtgtgggacgtgtactgtaactccagcagccaatcgagttctgctgcagctggttatcatttttattcccccaaaaaaaaaggatgaaaagatagtattaaaatatgatttgcaattttgtttttgagtggaattgctttctacggtttttctttt

SEQ ID NO: 7712 - DNA, 1752 bp, Ambrosia trifida
cctgacccactctcacccctctcttctaacagatcagatctaagatatccaaaaccctaaccatgtctctgacagtcgagaaaacctcaaccggccgtgaatacaaggttaaggacatgtccttagccgacttcggccgcctcgaactcgagctggccgaagtcgaaatgcccggtttgatgtcatgccggaccgaattcggaccctcgcaaccattcaagggtgccaggatcaccggttcactccacatgacaattcaaactggtgtcctcatcgaaaccctgaccgccttaggcgcagaggtcagatggtgctcctgcaacattttctctactcaggaccacgcggccgctgccatcgcccgtgactcggccgctgtgttcgcctggaaaggagaaacgctgcaggagtactggtggtgtacggaacgagcccttgattggggtcctggtggtggacctgatcttattgttgatgatggtggtgatgccacgcttttgatccatgaaggagtaaaagctgaagaggagtttgcgaaaaccgggaaattgcccgatccgagctccaccgataacgctgagtttcagattgtgttgtctattattaaggatgggttgcagagtgaccccaagaagtaccacaggatgaaggataggttggttggtgtgtctgaggaaaccaccactggtgttaagaggttgtaccagatgcaagctaatggtaccttgcttttccctgccatcaatgtcaatgactctgtcaccaagagcaagtttgacaacttgtatggatgccgccattcactccccgacggactgatgagagccactgatgtcatgattgctggaaaggttgcagtagtgtgcgggtatggtgatgtcggcaagggttgtgccgctgccatgaaacaagctggtgcgcgtgtcatagtcacagaaatcgaccccatctgtgcccttcaagctctgatggaaggtctccaagttctaaccctagaagatgttctctcagaggctgacatctttgtaaccaccacaggtaacaaagacattatcatggttgaccacatgaaaaagatgaaaaacaacgccattgtctgcaacattggacatttcgacaatgaaatcgacatgcttggtttagaaacataccctggtgtgaaaagaatcaccatcaaaccacaaaccgacagatgggtgtttcctgaaaccaacagtgggatcattgtgttagctgagggtcggctcatgaatttgggttgcgccacgggtcatccaagctttgttatgtcgtgctcgtttaccaatcaagtgatcgcccagcttgagctgtggaaggaaaagtcgagcgggaagtataagaaggaagtttatgtgttacctaaacatctagatgagaaagtggctgcacttcatcttgggaaacttggagccaagctgactaagcttacccaggaccaagctgattacatcagtgtgccagttgagggaccgtacaagccggctcagtacaggtattgatcatttagatcaagaaaattgttggttggtagttgggaaggtggttggagtgaattgattggtttctttaaatatcgtctatctatatatggtggcttgaataagggtggtgtgtgttataaggtgctgtaaaacatccaagttactatttttgttggctttgtttatgttccattgacaaaatcaaatgaggaaatggttttcgttaaaaaagaaaaagtaaccgactgcg

SEQ ID NO: 7713 - DNA, 1891 bp, Amsonia hubrichtii
gtgccgctctctccttccccaaaaaatcctctcagaagagagtttactcatttttctccaaattcttaagccatggccttgttagtcgagaaaaccagctcaggcagagaatacaaggtcaaggatatgtcccaggctgacttcggaaggctcgaaatcgagcttgccgaggttgaaatgcctgggttgatgtcttgcaggactgagtttggtcctagccaacccttcaagggtgcaaggattaccgggagtttgcatatgacaattcaaacagcggtgctgatcgagacattgacagcactcggtgcggaggttagatggtgttcttgcaatattttctcaactcaagatcatgccgccgccgccattgctcgtgatagcgctgccgtgttcgcctggaagggtgagacccttcaagaatactggtggtgcactgagagggccttggattggggtcctggtggtggcccagatcttattgttgatgatggtggtgatgccacattattgatccatgagggtgttaaggcagaggaggagtataagaaatcagggaccttacctgatccaacttctactgataatgctgagtttcagattgttttgacaattatcagggatggactcaagtctgatcccaccaagtatgcaaggatgaaggagagacttatgggtgtgtctgaagagaccaccactggtgtcaagaggctttaccagatgcaggctaatggaactttgttgttccctgccatcaatgtcaatgactctgtcacaaagagcaagtttgacaacttgtatggatgccgccactcgctccctgacgggctcatgagagccacagatgtgatgattgctggcaaggttgcagttgtctgtggctatggtgatgtcggaaagggctgtgcagctgccttgaagcaagctggtgctcgtgtcattgttactgagattgatccaatctgtgcccttcaggcactcatggaaggtctccaggttcttaccctcgaggatgtggtctctgaggccgatatctttgtaaccaccactggtaacaaggacatcgtcatggttgatcacatgagaaagatgaagaacaatgccattgtgtgcaacattggccactttgacaacgaaattgacatgctaggccttgagacctacccaggtgtgaagagaatcacaattaagcctcaaacagacagatgggtcttccctgatacaaattcaggcattattgtcttagccgagggtcgtctcatgaacttgggttgcgccacagggcaccctagctttgtcatgtcctgctctttcactaatcaagtgattgcccagctcgaattgtggaatgagaggactacagggaagtacgagaagaaggtttatgtcttgcccaagcaccttgatgagaaggttgctgcactccacctcggcaagcttggtgctaagctcactaagcttagcaaggatcaggctgactacattagcgtacccattgagggtccttacaagcctcctcactataggtactgagggatggatggcattatttctgatgtaacacggcgaaacaatatattttgacagcattgcaatttctttcatactgtattagattggcaggttttttatgtgtatttggagggttggtgatgatcagaggaaaacacggtctctgtcaagaccaagatgtgtttgaataaggctattgtgggggtgtggtatgatattttagttgcttcagttagatttattgttttttgcttctattttgttgcagaaaaggaaacaagaatatattaattgtttccagtgagtttttatatttatacaatattttcttctccatcttctcctcctttaagtaatttaatggggttggaggcctgttttt

SEQ ID NO: 7714 - DNA, 1934 bp, Catharanthus roseus
ttgggagatatttcaggtttcgctctttcttcttacctaaaaccccactgaagagagagagaaacctgaaatatctcccaaattcttcaaccatggctttgttagtcgagaaaaccagctccggaagagaatacaaagtcaaggacatgtcccaggccgacttcggaaggctcgaaatcgagcttgccgaggtagaaatgcctgggttgatgtcttgccgggctgaatttggtcctagccagccctttaaaggtgcaaagatcaccggaagtttgcatatgacaatccaaactgcagtgctgatcgagacattgacagcactcggtgcggaggttagatggtgttcttgcaacattttctctactcaagatcacgctgccgccgccatagctcgtgatagcgccgccgtatttgcctggaaaggggaaacccttcaggaatactggtggtgtacagagagggctttggattggggtcctgatggtggcccagatcttattgttgatgatggcggtgatgctacattgttgatccatgagggtgttaaagctgaggaggagtacaagaaaaatggtgctctcccagatcccagttctacagataatgctgagtttcagattgttttgacaattattagggatggattgaaatctgatcctaccaagtacacaaggatgaaggagagacttgttggtgtctctgaagaaaccaccaccggtgttaagaggctttatcagatgcaggctaatggaactctgttgttccctgccattaatgtcaacgactctgtcaccaagagcaagtttgacaacttgtatggatgccgccactcactccccgatggtctcatgagagccactgatgtgatgattgctggcaaggtagctgttgtcgccggatatggagatgttggaaagggctgtgccgctgccctgaaacaagctggagctcgtgtaattgttactgagattgacccaatctgtgcccttcaggcactcatggaaggtctccaagtcctcaccctggaagatgttgtctccgaggctgatatctttgttaccaccaccggtaacaaggatatcattatggtagaccacatgaggaagatgaagaacaatgccattgtttgtaacattggtcactttgacaatgaaatagatatgctaggccttgaaacctacccaggtgttaagaggatcacaatcaagcctcaaacagaccgatgggtattcccggatacaaattctggcatcattgtcttggccgaaggtcggctgatgaacttgggatgtgccacaggacatcctagctttgtaatgtcctgttctttcaccaaccaagtcattgcccagctagagttatggaatgagaggaagactgggaaatacgagaagaaagtgtatgttttgcctaagcatcttgatgagaaggttgctgctcttcatcttggaaagcttggtgctaagctcactaagcttacaaaggatcaagctgactacattagtgtacccattgaaggtccttacaagcctgctcactataggtactgagaggagaagagaatgatgatgagattgaattgatacacaattgctgtttcttttttttttctctttactgtattagattatttaggctttttgatgaattttggatgtgtttttggggtgtggagagatgatgatgatgattatgagaaggaaaagatttggttggtctctttgatggaagaccaaggaaatgtttgaataataagaaggatagtctgggggagttttgtgggatgatttttaattgtttcaattaggttttattattgtttttctttggctcttattattattgcagaaggaaaaagaaacaagaatatattcattgtttcccgtgcattcttatattcatttaattaatgtgggttatattttggtttttca

SEQ ID NO: 7715 - DNA, 1795 bp, Cirsium arvense
gggggcctaacccacccctctcttctaaacagagagtgtattcagatctgatctgatctgaaaaattcaaaaccctaacgaacgccatggctctcaccgtcgagaaaacctccaccggccgtgaattcaaggtcaaggatatgtccttagctgatttcggcagacttgaacatcaattggccgaagttgaaatgcccggtttgatgtcttgccggacggaattcggaccttcacaaccgttcaaaggtgctaggatcactggttcactccacatgactattcagaccggtgttctcatcgaaaccctaaccgctttaggcgctgaggtgagatggtgttcatgcaacattttctcgactcaggatcacgccgctgctgcaattgctcgtgattctgcagctgtgttcgcatggaagggtgagacgttgcaggagtattggtggtgtacggagagagctcttgattggggtcctggtggtggacctgacctgattgttgatgatggaggtgatgcgacgcttttgatccatgaaggagtgaaagctgaggaggagtttgcgaaaacagggaaattgcctgatccgagttcgactgataacgctgagttccagatcgtgttgtcgatcattaaggaaggtttacagatcgacccgaagaagtaccacaagatgaaagataggttggttggtgtatcggaggaaaccaccaccggtgtgaagagattgtaccagatgcaagccaatggtaccttgctgttcccagccattaatgtcaatgactccgttaccaagagcaagtttgacaacttgtacggatgccgccactccctccccgacggcttaatgagagccaccgacgtcatgatcgccggaaaagttgcagtagtctgcggttacggagacgtcggaaaaggttgtgccgccgccatgaaacaagccggtgcccgtgtcatagtaaccgaaatcgatcccatctgtgcccttcaagctctaatggaaggtctccaagtcttaaccctagaagacgttctttcagaagccgatatcttcgtaaccacaaccggcaacaaagacatcatcatggtcaaccacatgaaaaagatgaaaaacaacgccattgtttgcaacatcggccatttcgacaacgaaatcgacatgctcggtttagaaacgtacccgggtgtgaaacggatcacgatcaaaccacaaacagaccgatgggtgtttcccgatactaaaagtggagtcatcgtgttagccgagggtcggctaatgaacctgggctgtgccacgggccacccgagctttgtgatgtcgtgttcgtttacgaaccaagttatagctcagctcgagctgtggaacgagaagtcgagtgggaaatataagaaggaagtttatgtgttgcctaaacatcttgatgaaaaagtggctgcacttcatcttaacaagcttggagctaagctgactaagctgagtaaggatcaagccgattacattagtgttccagtcgagggtccttacaagccggctcattacaggtactgagccagatactgagccgacaagaaacacgaaatatcttttgattttattatgtggggggttgtgaaagggtagagaatgggaaagttggttggagagaattgattggtttttattgaaaagatcatcaatgaataagaggtggagtatgaatgaaggtggtgtaaaaacattatgtagcttgtttgtttttcatttttattcacaaaatcaaaggggcccaagaggtttgcaatatacaatggttatggaaa

SEQ ID NO: 7716 - DNA, 1701 bp, Platanus occidentalis
gcactgtcccatttccccagatttgaatttgcagccatggctctcctcgtcgagaagacttcctccggtcgcgaatacaaggtgaaagacatgtctcaggcggatttcggccgtctggagatcgagctcgccgaggtcgaaatgcccggcttgatgtcttgccggactgaattcggtccctcccagcccttcaagggtgctcggatcaccggttccctccacatgactatccagaccgccgtcctcatcgaaaccctcaccgccctcggcgccgaggtccgctggtgctcctgcaacatcttctccacgcaggaccatgccgccgccgccatcgcccgcgatagcgccgccgtcttcgcctggaagggcgagacccttcaggagtactggtggtgtaccgagagggctctcgattggggccctggtggcggtccagatctgatcgtcgatgacggtggtgatgctacccttctcatccatgagggggtgaaagccgaagaggagttcgccaggtcgggaaaggttcccgatccggcttccaccgacaacgccgagttccagatcgtgctcgcgatcatcagagacggtttgaagaccgatccgaagaagtatcacaagatgaaggatagattggtcggtgtttctgaggagaccaccaccggtgttaagaggctttaccagatgcaagccaacggcacattgctcttccccgctatcaacgttaacgattctgtcaccaagagcaagtttgataacctctacggatgccgtcactccctccccgatggtctgatgagggccacagatgtcatgatcgccggcaaggttgcagtggtctgcgggtacggagatgtcggcaagggctgtgctgctgccctcaagcaagctggtgcccgtgtcatcgttactgaaatcgaccccatctgtgccctccaagctctaatggaaggtatccaagtcctgaccctggaggatgtggtttcagaggcggacatcttcgttaccaccaccggtaacaaggatattatcatggtcgaccacatgaagaagatgaagaacaacgccatcgtctgcaacatcggacacttcgacaatgagattgacatgctcggattggagacttaccccggcgtgaagaggatcacaatcaagccccagacggataggtgggtcttccctgataccaagtctggtgtcattgtcttggcagaagggcgtctcatgaacttgggttgcgccacaggccaccccagctttgtcatgtcctgctcattcacgaaccaggtgattgcccagcttgaattgtggaaggagaagaagaccggcaaatataagaaggaggtatacgtgctacccaagcaccttgatgagaaggttgctgcacttcaccttggaaagcttggggccaagcttaccaagctttcccaggaccaggctgactacattagcgtccctgttgagggaccctacaagcctgctcactacaggtattgagagagacgaaagaagagaactttggtcaggattatttgttctcattttggtttgttgcagttttttatttttacagtgttaagaagttgggaaggagaggggagggcattggtctctgttagaatatgttaacaagaagaccatgggtttaaataaggctgagctgaatgggggttgagtgaattgtgttgatgcagtggagatttt

SEQ ID NO: 7717 - DNA, 1870 bp, Mimulus guttatus
gccttacgatcccttcttctttctcacccccactcccaataacagcgcgtgcagttcaaaccccgagtttccattctccaatttccataatggcgctactagtggagaagacaacctccggccgcgagtacaaggtcaaggacatgactcaggccgatttcggccgactcgagctcgaactcgccgaggtcgagatgccgggactcatgtcctgccgcaccgagttcggcccgtctcagccgttcaagggcgccaggatcaccggcagcctccacatgacgatccagaccgccgtcctcatcgaaaccctaaccgccctcggcgccgaggtgaggtggtgctcctgcaacatcttctccacccaggaccacgccgccgccgccatcgcccgcgacagcgccgccgtgttcgcctggaagggggagaccctccaggagtactggtggtgcacggagcgcgccctcgactggggccccgacggcggccccgatctgatcgtggacgacggcggcgacgccaccctgctgatccacgagggcgtgaaggccgaggaggagttcgagaagaccggcaaattgcccgacccgagctccaccgacaatgccgagttccagattgttctgacgatcatcagagacgggcttaaaaccgaccccaaaaggtacgccaagatgaaggagagattggtcggagtttcggaggaaaccaccaccggagttaagaggttgtaccagatgcagctcaacggcactctgctcttccctgctatcaacgtcaacgactccgtcaccaagagcaagttcgacaacttgtacgggtgccgccactcactccccgacggtctcatgagagccaccgacgtcatgatcgccggaaaggtcggcgtggtctgcggttacggagacgtcggaaagggttgcgcaatctccctcaaacaagctggggcccgcgtgatcgtgaccgagatcgaccccatctgcgcgctgcaagccctcatggaagggttccaagtcctcaccctagaggatgtcctctccgaagccgacatcttcgtcaccaccaccggaaacaaggatatcataatggtcgaccacatgaggaagatgaagaacaacgcaatcgtctgcaacatcggccactttgacaacgagatcgacatgcacggcctcgagactttccccggagtgaagagaatcacgatcaagccacaaaccgaccgatgggttttccccgacaccaaatcgggtattatcattctggcggagggtcgcctgatgaacttgggttgtgcgacgggtcatcctagttttgtgatgtcgtgctcgttcaccaaccaggtgatcgcacagttggagctctggaacgaaaggaagagtggcaagtatgggaaggaggtttacgtgttgccgaagcatcttgacgagaaagttgcggcgcttcatctcggaaagcttggtgctaagctgactaagcttactaaggatcagtccgattacgttagcattcctgtcgagggtccttacaagccacctcactacaggtactgagacgataaaatgtcgaatttggaagagaatttatttatatacttcgatccgtgttatttgttttctatttttttttttcctttccttgaatcatgtttagtgatttgggagttcgtttgatgaccgaaataagttcgatagcaatcgggtcgtccggtttttttttttttttttttatcgaagtgtattttgctacggctatattgtatttgctttctggcatctgtttttttttcggtgaaatgatatattatatagtaccaagaaatgtttccgttgtggtgtttgtgatggaaaattttaatatatgtttttttgcattt

SEQ ID NO: 7718 - DNA, 1842 bp, Capsicum annuum
gcacgaggcttcttcttccctaacaaaccctcgaagaaagaagagtaaaaccctctcagatctcatctctaagccctacattttccccattttctctcaccatggctctccttgttgagaagacaacctctgggcgtgagtacaaggtcaaggacatgtctcaggctgacttcggcaggctcgaaatcgagcttgccgaagtcgaaatgcctggtcttatggcttgtcgtactgaatttggaccttcacagccttttaaaggtgctaagattactggatctctgcacatgaccattcaaaccgctgtgcttattgagactcttactgctcttggtgctgaagttagatggtgttcttgtaacatcttctccacccaagatcacgccgcggctgccatagccagggatagcgcagcggtgtttgcttggaagggtgagactctgcaggagtattggtggtgtacggagagggcacttgattggggtccaggtggtggacctgatttgattgttgatgatggtggtgatgctacgctgttgattcacgagggtgttaaggcggaagaggagtttgccaagaatgggactgtgcccgatccaagttctactgacaatgttgagtttcagcttgtgcttgggattatcaaggagagtttgaaggttgatcctttgcggtatactaagatgaaggagaggcttgttggtgtttctgaggagacaactactggtgttaagaggctttatcagatgcaggccaatggaaccttgctttttcctgctattaatgttaatgactctgttaccaagagcaagtttgacaacttgtatggatgccgccactcactccctgatggtctcatgagggcgactgatgttatgattgctggaaaggttgcctttattgctggttatggagatgtcggcaagggatgtgctgctgccatgaaacaagcaggtgcccgcgtgattgtttctgagattgacccaatctgtgctctccaggctaccatggaaggcctccaggttcttcctctcgaggacgttgtttctgatgttgatatctttgtcaccaccaccggtaacaaggacatcatcatggttgaccatatgaggaagatgaagaacaacgccattgtctgcaacattggtcactttgacaatgaaatcgacatgcatggtcttgagaccttccctggtgtgaagaggatcacgatcaagcctcagactgacaggtgggttttcccagacaccaacagtggtatcattgtcttggccgagggtcgtctcatgaacttgggatgtgccacgggacaccccagttttgtgatgtcctgctctttcaccaaccaagtcattgcccagctcgagttgtggaatgagaagagcagtggcaaatacgagaagaaggtgtatgtcttgccaaagcacctcgacgagaaggttgctgcccttcaccttggaaagctcggagccaagctcaccaaacttaccaaggaacaagctgattacattagcgtaccagttgagggtccttacaagccagctcactacaggtactgaggggaatagaaactgacagcagctgattacattatcgcggcattcttgttttgtccttaatacttttgagtttgtttaggtagtattgtttttattattgttggggatattttggaggtggttggcatgttttgcgggaaagaaatggagtgtgtttgaataatattatttttagttatggttggggtggtgtggtatggtattgtactaaaatcaaatttgtgttttgctcttatattgttcgcttcaagtaaatcaaagaaacatgcttttttcccttttc

SEQ ID NO: 7719 - DNA, 1902 bp, Catharanthus roseus
agagagagagagagagagagagagagagatcgtgccgaattcggaacgagctaaaaccccactgaagagagagagaaacctgaaatatctcccaaattcttcaaccatggctttgttagtcgagaaaaccagctccggaagagaatacaaagtcaaggacatgtcccaggccgacttcggaaggctcgaaatcgagcttgccgaggtagaaatgcctgggttgatgtcttgccgggctgaatttggtcctagccagccctttaaaggtgcaaagatcaccggaagtttgcatatgacaatccaaactgcagtgctgatcgagacattgacagcactcggtgcggaggttagatggtgttcttgcaacattttctctactcaagatcacgctgccgccgccatagctcgtgatagcgccgccgtatttgcctggaaaggggaaacccttcaggaatactggtggtgtacagagagggctttggattggggtcctgatggtggcccagatcttattgttgatgatggcggtgatgctacattgttgatccatgagggtgttaaagctgaggaggagtacaagaaaaatggtgctctcccagatcccagttctacagataatgctgagtttcagattgttttgacaattattagggatggattgaaatctgatcctaccaagtacacaaggatgaaggagagacttgttggtgtctctgaagaaaccaccaccggtgttaagaggctttatcagatgcaggctaatggaactctgttgttccctgccattaatgtcaacgactctgtcaccaagagcaagtttgacaacttgtatggatgccgccactcactccccgatggtctcatgagagccactgatgtgatgattgctggcaaggtagctgttgtcgccggatatggagatgttggaaagggctgtgccgctgccctgaaacaagctggagctcgtgtaattgttactgagattgacccaatctgtgcccttcaggcactcatggaaggtctccaagtcctcaccctggaagatgttgtctccgaggctgatatctttgttaccaccaccggtaacaaggatatcattatggtagaccacatgaggaagatgaagaacaatgccattgtttgtaacattggtcactttgacaatgaaatagatatgctaggccttgaaacctacccaggtgttaagaggatcacaatcaagcctcaaacagaccgatgggtattcccggatacaaattctggcatcattgtcttggccgaaggtcggctgatgaacttgggatgtgccacaggacatcctagctttgtaatgtcctgttctttcaccaaccaagtcattgcccagctagagttatggaatgagaggaagactgggaaatacgagaagaaagtgtatgttttgcctaagcatcttgatgagaaggttgctgctcttcatcttggaaagcttggtgctaagctcactaagcttacaaaggatcaagctgactacattagtgtacccattgaaggtccttacaagcctgctcactataggtactgagaggagaagagaatgatgatgagattgaattgatacacaattgctgtttcttttttttttctctttactgtattagattatttaggctttttgatgaattttggatgtgtttttggggtgtggagagatgatgatgatgattatgagaaggaaaagatttggttggtctctttgatggaagaccaaggaaatgtttgaataataagaaggatagtctgggggagttttgtgggatgatttttaattgtttcaattaggttttattattgtttttctttggctcttattattattgcagaaggaaaaagaaacaagaatatattcattgtttcccgtgc

SEQ ID NO: 7720 - DNA, 1910 bp, Castanea mollissima
tctccccccctccccccccaaaaatctcatcagatccaattctcgaccctcattctcaacatggctttgttggtagagaaaaccacaagcggtcgtgagtacaaggtgaaggacatgtctcaggccgacttcggtcgtctcgagatcgagctggccgaagtggagatgccaggtctcatgtcctgcagaactgagttcggcccttcacagcccttcaagggagccagaatcacaggctccctccacatgaccatccaaaccgctgtcctcatcgagaccctgacggccctcggcgccgaggtccgttggtgttcatgcaacatcttctcgacccaggaccacgccgctgccgctacagcccgtgactccgccgccgtgttcgcctggaaaggggagacccttcaggagtactggtggtgcaccgagcgtgctctcgactggggtcccggtggtgggcccgatctcattgtcgatgacggcggtgacgccactctgctcatccacgagggtgttaaggccgaggagttgttcgagaagaatgggactctcccagaccctgcttccaccgataatgccgagttccagattgtgctgactattatcagagatgggttgaagacagaccccaagaggtaccacaagatgaagcaaagattggttggtgtgtccgaagagacaaccaccggagttaagaggctttaccagatgcagttcaatggttccctcttgttccctgctattaacgttaacgactccgtcaccaagagcaagtttgataacttgtatggatgccgccactccctccccgatggtttgatgagggcaactgatgtcatgattgccggcaaggttgctgttgttgctggatatggtgatgttggcaagggctgtgctgctgccttgaagcaagctggtgcccgtgtgattgtgactgagattgatccaatttgcgctcttcaggcccttatggaaggcctccaagttctaacccttgaggatgttgtatctgaggctgacatctttgtaaccaccactggtaacaaggacatcatcatggtcgaccacatgaggaagatgaagaacaatgccattgtttgcaacattggtcactttgacaatgagattgacatgcttggccttgagaactatccaggtgtgaagcgcatcaccatcaagccccaaacagacaggtgggtcttccctgatacaaactcaggcatcattgtgttggccgagggtcggctcatgaacttgggttgtgccacagggcacccaagtttcgtgatgtcttgctcattcacaaaccaggtgattgcacagcttgagctgtggaaggagaggactagcgggaaatatgagaagaaggtctatgtcttgccaaagcaccttgatgagaaggttgctgcacttcaccttggcaaacttggggctaggctcaccaagctcagcaaggaccaggctgactatattagtgtccctgtggagggtccatacaagcctgctcactacaggtactgagaagagtcaagaaagcaaggcatatcaagaaaaccaatatatttgatatttggaccggcttgaattacaaatttatgacttttattaggatgttaggttttgaatttcttttttggtaggggctttttgtgtttggtggtggatgttatggaggaaagaaattggttggtctctgttgaaaggagaccaattggggtatcaataagggttggatggggctgtgtgggaatatattattgacagatgctgtttgagtttttgttgcgtttgttattaaaacctaaaaaaaaggactgctatttccttaggtttctgtcttgttttggtggctctctactcttgaccttctggtctattttcatatgcaatgtgactttttttgttaaatgcca

SEQ ID NO: 7721 - DNA, 2003 bp, Cannabis sativa
tcgtctcactctcatttctctctctctctctctctcttctcagatcgaatcagagctcagatcagatctgaaaacatgtctctctccgtcgagaaaaccaccgccggccgtgaatacaaggtcaaggacctttctcaggccgatttcggtcgtctcgagatcgaactagcggaggttgaaatgccaggtctcgtctcgtgccgtactgaattcggtccatctcagccatttaagggagccagaatcactggttctcttcacatgactattcagactgctgttcttatcgaaaccctaaccgcactcggtgctgaggtgagatggtgctcctgcaacattttctcgactcaggatcacgctgcggccgccatagctcgtgattcggctgctgtttttgcttggaaaggtgagactcttcaagagtattggtggtgtactgagcgtgctcttgattggggtccaggtggtggtccagatctgattgttgatgatggtggtgatgctacgcttttgattcatgagggagttaaggctgaggagatctatgaaaagactggtcagttgcctgatcctacttctactgataatgttgagtttcaacttgttcttgggattattaaggaaggtttgaagactgatcctaagagataccacaagatgaaggatagacttgttggtgtttctgaagaaactactactggtgttaagaggctttaccagatgcaagctaatggaactttgttgttccctgctattaatgttaacgactctgttactaagagcaagttcgacaacttgtacggatgccgtcactctctcccagatggtcttatgagggccactgatgttatgattgctggaaaggttgccgttgtttgcggttacggagatgtcggaaagggttgtgctgctgctctcaagcaagccggagcccgtgtgatcgtgaccgagatcgaccccatctgtgcccttcaggctctcatggaaggtctccaagtcttgacactcgaagacgttgtctccgatgccgatatcttcgttaccaccaccggtaacaaagacatcatcatggttgaccacatgaggaagatgaagaacaatgccattgtctgcaacatcggtcacttcgacaacgaaatcgacatgttgggtctcgagacctaccccggtgttaagagaatcaccatcaagccacaaaccgacaggtgggtcttccccgagaccaacgtcggtatcattgtcttggccgagggacgtttgatgaacttgggttgtgccactggacaccctagtttcgtcatgtcttgctcattcaccaaccaagtcatcgcccaactcgagctctggaacgagaagtcatctgggaaatacaagaaggaggtttacgtcttgcctaagcatctcgacgagaaggttgccgctcttcacttgggcaaactcggagctagactcaccaagctctccaaggaccaagctgactacatcagtgtgccagttgagggaccatacaagcctgttcactacaggtactgagcaattgtttggtcaattgaatgacctctctgagttgagaaaccataaaaatttcgaagaattgatttgtttactttgtcacaatttgatgtggtagtagaatactagaactttgatttttgtagggtgtgttttttatatttggtggtggtggtggttttggggtgaagtgtatggaaattggtctctgataaagaagacctttttaatatggatttgggtttttaataaggaatggattttgggttgtgttggggaatcaatatatatataatatgatatgatataatatagagaaaatggtaaaaggaatgaatttactttttgcccacattgagtgtgttttttctttcatatgcttttcttatgaatttctggttcgaaatcaaaatcaaccatttttattattgttgagttttaaaatgaggtaataatctaaagaatggacttgcattcctgtaatatttttg

SEQ ID NO: 7722 - DNA, 1969 bp, Flaveria ramosissima
tcaccctgttaaccacatcctctgctctaaaacagagtgtgtgtgtgtgtgatcaccggaaccctaactccgatcagacttactggaaccctaactccggccaccatgtctctcacagtcgagaaaacctccaccggccgtgaatacaaggtcaaagacatgtctttggctgactttggtcgtctcgagctcgaattagccgaggtcgaaatgccggggttgatgtcttgccggacggaatttggaccctcacagccgttcaagggcgcgagaatcaccggatcactgcacatgacgattcaaaccggtgtgttgatcgaaaccctaactgctttgggcgctgaagtgagatggtgctcgtgcaacatcttctcgacgcaggatcacgctgcggctgcgatcgctcgtgattccgctgcggtgttcgcgtggaaaggagagacgctgcaggagtactggtggtgtacggaacgagcgcttgattgggggcccggtggtggaccggatctgattgttgatgatggtggtgatgcgacgttgttgattcatgaaggtgtgaaggctgaagaggagtttgagaagacggggaagctgccggatccgacgtcgactgataacgctgagtttcagatcgtgttgtctattattaaggaggggttgcagagtgacccgaagaagtatcacaagatgaaggagaggttggttggtgtgtctgaagagaccactactggtgttaagaggttgtatcagatgcaagctaatggtaccttgctgttccctgcgatcaacgttaatgattctgtcaccaagagcaagtttgacaacttgtatgggtgccgtcactcgctcccagacggactgatgagagccactgatgttatgattgctggaaaggttgcagtagtctgcggttatggtgatgtcggcaagggttgtgccgccgccatgaaacaagcaggtgcacgtgtcatagtgacagaaatcgaccccatttgtgcccttcaagctctcatggaaggtctccaagtcctaaccctagaagacgttctctcagaagccgacatctttgtcaccaccacaggcaacaaagacataatcatggttgaccacatgaaaaaaatgaaaaacaacgcgatcgtctgcaacattggtcacttcgacaatgaaatcgacatgcttggtttagaaacataccctggtgtgaagagaatcaccatcaaaccacaaaccgacaggtgggtattccctgaaaccaacactggcatcatcgtgctagccgagggtcggctcatgaacttgggctgtgccactggtcaccctagtttcgtgatgtcgtgctcgtttacaaaccaagtgatcgcgcagctcgagctgtggaaagagaagtcatcagggaagtacaagaaggaagtttatgtgttgcctaagcatcttgatgagaaagtggctgcacttcatcttggaaagcttggagccaagctgactaagcttactcaagaccaagctgattacatcagtgtgccagttgagggtccatacaagcctgctcactataggtactgataatgtttgaataatgaattgctctatatgcctattgattaatatgtggtttggtggttgagttcttgaaagatcatcatatgtggtggtgattcgagtatgaaggtggtgtaagacattatgattgttgttttatgttggattgttatgttttattgagaatcaaaagggaaaaccaagttgacactagtttattatttagaattattactatccaagcaatgagttagacccttaccttaaagataaaaatgatgaggactccgaagagattgagacatcatgatcaaagactgacgatgctgttgttagtttgttgcacataatgaggatgatatagagtcatttagtttggtttagtattaataggaggacgacagagtcggtggtactaccgaaacactta

SEQ ID NO: 7723 - DNA, 1591 bp, Tripterygium wilfordii
actcttctctctttgtagttctgaatctgaatctgaatcttacatctactcataacaaatggctttgctcgtagagaagactgccggtggccgggagtacaaggtcaaggacatgtccctcgccgatttcggccgcctcgagattgatcttgctgaggttgagatgccggggctcatgtcctgccgcaccgagtacggcccttctcagccatttaagggtgccaggatcaccggatcccttcacatgaccatccagacagccgtcctcatcgaggccctcaccgcacttggtgccgaggtccgctggtgttcctgcaacattttctctactcaggaccacgctgctgccgccatcgcccgcgatagtgctgctgtcttcgcctggaagggtgagactcttcaggagtactggtggtgcaccgagcgtgctctcgactggggtcccgatggcggccctgaccttattgtcgatgatggaggtgatgctactctcttgatccacgagggtgtcaaggctgaggagatctatgagaagaccgggcagtttcccgatcctgcctccaccgacaacgcggagttccagatcgtattgactatcatcagagatgggctcaagaccgatcccaagaagtaccacaagatgaaggagagattggtgggtgtttctgaggagacaacaacaggagtcaagaggctgtaccagatgcagattaatgggactctgttgttccctgcgattaatgtcaatgactctgtcaccaagagcaagtttgataacttgtatggttgccgccactcgctccctgatggcctgatgagagctaccgatgtcatgattgctggcaaggttggtgttgtatgcggttacggtgatgtgggcaagggctgtgctgctgccttgaagcaagctggagctcgtgtgattgtgacggagattgaccctatttgtgcccttcaggcccttatggagggatatcaagtcctgactttggaggatgtggtttctgaggctgacatctttgttaccaccactggcaacaaggacatcatcatggttggccacatgaggaagatgaagaacaatgccattgtttgcaacattggccactttgataatgaaatcgacatgcttggacttgaaacctaccctggtgtgaagcgtatcaccatcaagccccaaactgataggtgggtcttcccggacaccaactcgggcatcattgtgttggctgaagggcggctcatgaacttgggttgtgccactggacaccccagctttgtgatgtcatgctcattcacgaaccaggtgattgcacagctggagctatggttggagaagagctctggcaagtatgagaagaaagtgtacgttttgcccaagcaccttgatgagaaggtggctgcccttcaccttgggaagcttggggctaagcttaccaagctcagcaaggaccaggctgactacatcagtgttcctgttgagggtccttacaagcctgctcactataggtactgaaggggagaatgccagagtctgagacaagatttattctcgtcgcagatgattatcatatcatttcattcaccaaaa

SEQ ID NO: 7724 - DNA, 1967 bp, Citrullus lanatus
ctatttatagggcctcagttcgctctatctttcgtgcgctcacatttctctcttccttctgcgatacccttcttctcgcagaaacagagagatttttgtgttctttcttccccaaatctctcacaatgtctctcatcgtcgagaagactgccggcggccgtgagtacaaggtcaaggacatgtctcaggccgactttggtcgtctcgagatcgagctcgcagaggtcgaaatgcccggtctcatggcctgccgagccgaattcggcccttcccagccattcaagggagctcgcatcaccggttccctccacatgaccatccagaccgccgttctcatcgaaaccctcactgctctcggcgccgaggtccgttggtgctcctgcaatattttctccactcaggaccacgccgccgccgcgattgctcgcgacagcgctgctgtatttgcctggaaaggggagactcttcaggagtactggtggtgcactgagcgcgccttggattggggccctggtggtggtccggatctgattgttgatgatggcggtgatgcaactctcttgattcatgagggagttaaggctgaggagatttttgagaagaccggtgctcttcctgatccttcttctactgataatgctgagtttcagatcgtgttgacgattatcagagatggattgaaatctgaccctaagaggtatcacaagatgaaggagagattggttggtgtttctgaagagactaccactggtgttaagaggctttaccagatgcagtctagtggaaccttgttgttccctgccattaatgtcaatgactctgtcactaagagcaagtttgacaacttgtatggatgccgtcactctctccctgatggtttgatgagagctactgatgtcatgattgccggtaaggtcgcggttgtgtgcggttatggagatgttggaaagggttgtgctgctgccctcaagcaagctggagctcgtgtgatcgtgactgagatcgatccaatttgtgcccttcaggctcttatggaaggccttcaagtcctcacccttgaagatgtcgtctcggaggctgatatcttcgtcaccaccaccggtaacaaggatatcatcatggttgatcacatgaggaagatgaagaacaatgccattgtttgcaacattggtcactttgacaatgagattgacatgcttggtcttgagaattaccccggtgtgaagcgtatcaccatcaagcctcaaacagacaggtgggtcttccctgaaaccaacactggcatcatcgtgttggcagaggggcgactcatgaacttaggttgtgccactggacaccctagctttgtgatgtcctgctcattcacaaaccaagtgattgcacagctcgagctatggaacgagaaggcatccgggaagtatgagaagaaggtctacgtgttgccaaagcaccttgacgagaaggtagccgcccttcaccttggcaaacttggggctaagctgacgaagctgagcaaggaccaagctgactacatcaatgtgccagttgagggtccatacaagcctgctcactacaggtactgagggggaagtgtggaggcttgattttcacaacttagtgatttatggttaggaaaattttaagggttttgttttactttttgaagtgttttggggttggtggtttgaaggggaaaagggtctgtatgttgaagaaagacccattgtatgggatgaataaggaaggttagatttggctgtgtgtgaaaaacattactggtttttgtttgttgttttatttttttgctgaatctgtgtcatcgtttttatcggtgagaaagaaagagggagaaaaaaaaaaaaaaaagcaaaacaaattgctgccttcattattattattaatatttttttctttttgaaatgtagctgtcccgaaatttatggatattttgtactttctctttattt

SEQ ID NO: 7725 - DNA, 2415 bp, Vitis vinifera
ggaatccggattccacgtaaacgatttcaccagatccaccaaacagtgacccatcatcgaaaggaatcgtgaccgtccatctccttcaaatctatttataccccttttcagcactctccccatcgtgtccacagcccacttctctctcttatttgcgtgagatccagagagtgagtttgttagaaatttgatcggtatcagcagcagccatgtctttgcttgttgagaagaccagttctggccgggagtacaaggtcaaggacatgtctcaggcggacttcggccgtctggagatcgagcttgcggaggttgagatgccaggcctcatgtcttgcaggactgagttcggaccccagcagccattcaagggtgccaagatcactggctcactccacatgaccatccagactgccgtccttatcgagaccctcaccgcccttggcgccgaggtccgctggtgctcctgcaatatcttctccacccaggaccacgccgccgctgccattgcccgcgacagcgccgccgtcttcgcctggaagggcgagaccctacaggagtactggtggtgcacggagcgggccctcgactggggtcccggtggcggccccgatctcatcgtggacgacggcggcgacgctaccttgttgatccacgagggggtcaaggctgaggaggagtacgccaagagcggcaagttaccggacccctcctccaccgacaatgctgagtttcagatcgttttgaccattattagggacggattgaagacagatccgaagagatatcacaagatgaaggggagattggttggtgtttctgaggagaccaccaccggtgttaagaggctttaccagatgcaagctaacggcactttgcttttccctgctattaatgtcaatgactctgtcaccaagagcaagttcgacaatttgtatggatgccgccattcactccctgatgggctgatgagagctacggacgtgatgattgccggaaaggttgcagttgtatgcggatacggagatgtgggcaagggctgcgctgctgccctgaagcaagctggagcccgggtgatcgtgacggagatagatccgatctgtgctctgcaggccctgatggagggtatcccggttcaaaccattgaggatgtcgtctctgaagcagacatcttcgtgaccaccaccggtaacaaggacatcatcatggttgaccacatgaggaagatgaagaacaatgcaattgtttgcaacattggccacttcgacaacgagattgacatgttagggctggagacatacccgggtgtgaagagaatcaccatcaagccccaaactgataggtgggtgttccctgataccaattcgggcatcatagtgttggcagaggggcgactcatgaacttgggttgcgccactggccaccccagctttgtgatgtcatgctcgttcaccaaccaggtgattgcacagctggagctgtggaaggagaaggccagtggcaagtatgagaagaaggtgtatgtgttgccaaagcacctcgacgagaaggttgctgcgcttcaccttgggaagcttggggccaagctcaccaagcttagcaaggaccaggctgactacatcagtgtgcccattgagggtccttacaagcctcctcactacaggtactgagagagaagacccacagatatgtggatgggcttgatttgccttcttttacaatctgatttatgttagaattataggtttgatttttgcattttttttttcctgtcatgggggttgtttggggttgttgggggtttgggaagaaaaagaagagagagaaaaaaccgagatcggtgtcttccgttgaagaagatgagcagatgtggggattcaataaggattgtgattgagggctgtgtgtgagagagtattctggttaaaaaccaaaaaagagagaaaaaaatattttatatgtcagttgttttcacttatgcttttcgtttatttcaagatgaaataagtcaattacacaaattacacaaaattatgatctggtttatttttccaacgattgcctaagaggattcacttttattctcataatctttttgggtgagtttagcatttttgtgaagaattttagccttggaaagccttggcctacatagtgggtgtgaacaggcaggtcatcctatcataaaacccctcacatctcttctcccataacactcaaaaagtgaagcatctcatgccgacaccgagtcaccgacagccactatcttgataaccatgggccaaacttctccccatttccggcgaccatatccaccataaatgaacccttttgggtaattggtaaaaaagtattgttagaatagacaactcaccaaacctactatcataaataaagcatgtaactcacattttgttt

SEQ ID NO: 7726 - DNA, 1896 bp, Vitis vinifera
cccacttctctctcttatttgcgtgagatccagagagtgagtttgttagaaatttgatcggtatcagcagcagccatgtctttgcttgttgagaagaccagttctggccgggagtacaaggtcaaggacatgtctcaggcggacttcggccgtctggagatcgagcttgcggaggttgagatgccagggctcatgtcttgcaggactgagttcggaccccagcagccattcaagggtgccaagatcactggctcactccacatgaccatccagaccgccgtccttatcgagaccctcaccgcccttggcgccgaggtccgctggtgctcctgcaatatcttctccacccaggaccacgccgccgctgccattgcccgcgacagcgccgccgtcttcgcctggaagggcgagaccctacaggagtactggtggtgcacggagcgggccctcgactggggtcccggtggcggccccgatctcatcgtggacgacggcggcgacgctaccttgttgatccacgagggggtcaaggctgaggaggagtacgccaagagcggcaagttaccggacccctcctccaccgacaatgctgagtttcagatcgttttgaccattattagggacggattgaagacagatccgaagagatatcacaagatgaaggggagattggttggtgtttctgaggagaccaccaccggtgttaagaggctttaccagatgcaagctaacggcactttgcttttccctgctattaatgtcaatgactctgtcaccaagagcaagttcgacaatttgtatggatgccgccattcactccctgatgggctgatgagagctacggacgtgatgattgccggaaaggttgcagttgtatgcggatacggagatgtgggcaagggctgcgctgctgccctgaagcaagctggagcccgggtgatcgtgacggagatagatccgatctgtgctctgcaggccctgatggagggtatcccggttcaaaccattgaggatgtcgtctctgaagcagacatcttcgtgaccaccaccggtaacaaggacatcatcatggttgaccacatgaggaagatgaagaacaatgcaattgtttgcaacattggccacttcgacaacgagattgacatgttagggctggagacatacccgggtgtgaagagaatcaccatcaagccccaaactgataggtgggtgttccctgataccaattcgggcatcatagtgttggcagaggggcgactcatgaacttgggttgcgccactggccaccccagctttgtgatgtcatgctcgttcaccaaccaggtgattgcacagctggagctgtggaaggagaaggccagtggcaagtatgagaagaaggtgtatgtgttgccaaagcacctcgacgagaaggttgctgcgcttcaccttgggaagcttggggccaagctcaccaagcttagcaaggaccaggctgactacatcagtgtgcccattgagggtccttacaagcctcctcactacaggtactgagagagaagacccacagatatgtggatgggcttgatttgccttcttttacaatctgatttatgttagaattataggtttgatttttgcattttttttttcctgtcatggggggtttggggttgttgggggtttgggaagaaaaagaagagagagaaaaaaccgagatcggtgtcttccgttgaagaagatgagcaataaggattgtgattgagggccgtgtgtgagagagtattctggttaaaaaccaaaaaagagagaaaaaaatattttatatgtcagttgttttcacttatgcttttcgtttatttcaagatgaaataagtcaattacacaaattacacaaaattatgatctggtttattt

SEQ ID NO: 7727 - DNA, 1909 bp, Capsicum annuum
cttccctaaaaccccaataggaagaagagaaaaaccacctctttacttctctttcacccccattttctcttaccatggctctccttgttgagaagacaacctctgggcgtgagtacaaggtcaaggacatgtctcaggctgacttcggcaggctcgaaatcgagcttgccgaagtcgaaatgcctggtcttatggcttgtcgtactgaatttggaccttcacagccttttaaaggtgctaagattactggatctctgcacatgaccatccaaactgctgtgcttattgagactcttactgctcttggtgctgaagttagatggtgttcttgtaacatcttctccacccaagatcacgccgcggcggctatagccagggatagcgccgcggtgtttgcttggaagggtgagactctgcaggagtattggtggtgtacggagagggcacttgattggggtccaggtggtggacctgatttgattgtggatgatggtggtgatgctacgctgttgattcatgagggtgttaaggcggaagaggagtttgccaagaatgggactgtacctgatccaagttctactgacaacgttgagtttcagctcgtgcttgggattatcaaggagagcttgaaggttgatcctttgaggtatactaagatgaaggagagacttgttggtgtttctgaggagacaactactggtgttaagaggttgtatcagatgcaggctaatggaactttgcttttccctgctattaatgttaatgactctgttaccaagagcaagtttgacaacttgtatggatgccgccactcactccctgacggtctcatgagggctactgatgttatgattgccggaaaggttgcctttattgctggttatggagatgtcggcaagggatgtgctgctgctatgaaacaagcaggtgcccgtgtgattgtttctgagattgacccaatctgtgctctccaggctaccatggaaggtcttcaggttcttcctcttgaggacgttgtttctgatgttgatatctttgtgaccactaccggtaacaaggacatcatcatggttgaccacatgaggaagatgaagaacaatgccattgtctgcaacatcggtcactttgacaatgaaattgacatgcatggtcttgagaccttccctggtgtgaagaggatcacaatcaagcctcaaaccgacaggtgggtcttcccagacaccaacagtggcgtcattgtattggccgagggtcgtctcatgaacttgggatgtgccaccggacaccccagttttgttatgtcctgctctttcaccaaccaagtcattgcccagctcgagttgtggaatgagaagagcagtggcaaatacgagaagaaggtgtacgtcttgccaaagcacctcgacgagaaggttgctgcccttcaccttggaaagctcggagctaagctcaccaaacttaccaaggaacaagctgattacattagcgtaccagttgaaggtccttacaagcctgctcactacaggtactgagcgaagacaagttgacagtggaactaaattgtcacggcatgattgtttgctttgaatactttacttttgcttaggataatagtgttttgattattgttgggatatttgggatgaactaggcatgttttgctggaaagagttggtctcgtatgaaaaaagacctaaataagttcgttttagggttggtggtaatgctatgttattgtagtattttgatccccatttgccgtttggtgtatgacttttgtttcaacaattcaaagcaaacatgttttccttcttgagcttatctttgaccatcaaactctatatatgtaataccttcttaattatttttatccaatctcgatagaactctaaagctttgtgggtggagt

SEQ ID NO: 7728 - DNA, 1639 bp, Panax ginseng
ctatttctcagatctagagagatagaaatggccttgctagtggagaaaaccgccaccggccgtgagtacaaggtcaaggacatgtccttggctgacttcggccggctcgaactcgagctggctgaggtcgaaatgcccggactcatgtcctgtcggactgagttcggaccttcacagccgttcaagggagcgaaaatcaccggatcccttcatatgactatccagaccggagttttgattgaaaccctgacggccctcggcgcggaggtgagatggtgctcttgcaacatcttctccacccaggaccacgccgccgctgccattgctcgtgacagcgccgccgtttttgcctggaaaggggagacccttcaggagtactggtggtgcaccgagcgggctcttgactggggccctggcggcgggccggatctgattgtggatgatggtggtgatgcaactttgttgattcacgagggagtgaaggccgaggaggagtatgccaagaccggtgctgttcctgatccggcttccactgataatgctgagttccagattgtattgactattatccgagatgggttgaagaccgacccgaaaaagtaccacaaaatgaaggaaagattggttggagtttctgaggagactaccactggagtgaagaggttgtaccagatgcaactaaatggaacccttttgttccctgctattaatgtcaatgactctgtcactaagagcaagtttgataacttgtatggatgccgccactcactccctgatggtttgatgagagccactgatattatgattgctggcaaggttgcagttgttgctggttacggagatgtcggaaagggctgtgccgcagccatgaagcaagctggagcccgtgtggttgttactgagattgatccgatctgtgctcttcaagctactatggaaggtctccaagttcttaccttggaagatgtcgtctctgaagctgatatctttgtcaccaccaccggtaacaaggacatcatcatggttgaccacatgaggaagatgaagaacaatgccattgtttgcaacattggtcactttgacaatgaaattgacatgcttggtcttgagacattcccgggtgtgaagagaattaccatcaagccccaaaccgacaggtgggtcttccccgacacccaatcgggcatcattgttttagccgagggacgtctgatgaacttgggttgcgccactggtcaccccagctttgtgatgtcttgctcgttcacgaaccaagtgattgcccagcttgagttgtggaaggaaaggagcaccgggaagtacgagaagaaggtgtacgtcttgcccaagcaccttgacgagaaggtagcagctcttcatcttggaaaacttggtgctaagctcactaagctcagcaaggaccaggctgattacattagtgtaccagttgagggaccatacaagcctgttcactacaggtactgagaaggaaatgattgtgagaaattgagaaaaacagaatgttcaacggcttgattgtttaattttaatacttttgcttttgtttagaacactagtagttgcgagttttatgggggtaagaaagtgggagaaaatggattggtctctgttgaaataa

SEQ ID NO: 7729 - DNA, 1801 bp, Quercus alba
attttatcagatccaattctcgactcactctcgtttctcaacatggctttgttggtagagaaaaccacaagcggtcgtgagtacaaagtgaaggacatgtctcaggccgacttcggtcgtctcgagatcgagctggccgaagtcgagatgcctggtctcatgtcctgcagaaccgagttcggcccttcacagcccttcaagggagccagaatcaccggctctctccacatgaccatccaaaccgccgtcctcatcgagaccctgacggccctcggcgccgaggtccgttggtgttcatgcaacatcttctcgacccaggaccacgccgccgccgccatagcccgtgactccgccgccgtgttcgcctggaagggggagaccctccaggagtactggtggtgcaccgagcgtgctctcgactggggtcccggtggtgggcccgatctcatagtcgacgacggtggtgacgccactctgctcatccacgagggcgttaaggccgaggagttgtttgagaagaatgggacccttccggacccagcttccaccgacaatgccgagttccagattgtgctgaccattatcagagatgggttgaagacagatcccaagaggtaccacaagatgaagcaaagattggttggtgtgtctgaagagacaaccactggagttaagaggctttaccagatgcaggccaatggtaccctcttgttctctgctattaacgttaacgactccgtcaccaagagcaagtttgataacttgtatggatgccgccactccctccccgatggtttgatgagggctactgatgtcatgattgccggcaaggttgctgttgttgctgggtatggtgatgttggcaagggctgtgctgctgccttgaagcaagctggtgcccgtgtgattgtgactgagattgatccaatttgcgctcttcaggcccttatggaaggcctccaagttctaacccttgaggatgttgtatccgaggctgacatctttgtaaccaccaccggtaacaaggacatcatcatggtcgaccacatgaggaagatgaagaacaatgccattgtttgtaacattggtcactttgacaatgagattgacatgcttggacttgagaactatccaggtgtgaagcgcatcaccatcaagccccaaacagacaggtgggtcttccctgatacaaactcaggcatcattgtgttggccgagggtcggctcatgaacttgggttgtgccacagggcacccaagtttcgtgatgtcttgctcattcacaaaccaggtgattgcacagcttgagctgtggaaggagaggactaccgggaaatatgagaagaaggtctatgtcttgccaaagcatcttgatgagaaggttgctgcacttcaccttggcaaacttggggctaggctcaccaagctcagcaaggaccaggctgactacattagtgtccctgtggagggtccatacaagcctgctcactacaggtactgagaagagtcaagaaaacaaggcatatcgagaaaaccaagatatattatatatttggatcggcttgatggtttcttttacaaatttatgacttttattaggatgttaggttttgaattttttttggtaggggctttttgtgtttggtggtggatgttatggaggaaagaaaatggttggtctctgttgaaagaagaccaatttgggtttcaataagggttggatggggttgtgtgggatatataatgctgttgagtttttgttgcgtttgttattaaaacctaaaaaaaggactgctatttcc

SEQ ID NO: 7730 - DNA, 1991 bp, Mimulus guttatus
atgaatacaagacaaagttggggttgtagagaatatctagctatctatggatctactgtgttcgccaaaatatctcattccaaaaccccaaatctcagatctaaaaccaaaaaaatggcgctcgtagtagagaagacaacctccggccgtgagtacaaggtcaaggacatgtcccaggcggacttcggccgactcgagctcgaactcgccgaggtcgagatgccgggactcatgtcctgccgcaccgagttcggcccgtctcagccgttcaagggcgccaggatcaccggcagcctccacatgacgatccagaccgccgtcctcatcgaaaccctaaccgcactcggcgccgaggtgaggtggtgctcctgcaacatcttctccacccaggaccacgccgccgccgccatcgcccgcgacagcgccgccgtgttcgcctggaagggggagacgctccaggagtactggtggtgcacggagcgcgccctcgactggggccccggcggcggccccgatctgatcgtggacgacggcggcgacgccaccctgctgatccacgagggcgtgaaggccgaggaggagttcgagaagtccgggaaggtgcccgacccgagctccaccgacaacgccgagttccagattgtgctgacaattatcagagatggtttgaaggaggaccctaagaagtatcacaagatgaaggagagattggtcggagtttcggaggaaaccaccaccggagttaagaggttgtaccagatgcagctcaacggcactctgctcttcccggctatcaatgtcaacgactctgtcaccaagagcaagtttgacaacttgtacgggtgccgccactcactccccgacggtctcatgagagccaccgatgtcatgattgccggaaaggtcggcgtagtctgcggctacggagacgtcggaaagggttgtgcaatctccctcaaacaagccggggcccgcgtgattgtgaccgagatcgaccccatctgcgcactgcaagccctcatggaaggcttccaagtcctcaccctagaggatgttgtctccgaagccgacatcttcgtcaccaccaccggaaacaaagacatcataatggtcgaccacatgaggaagatgaagaacaacgcaatcgtctgcaacatcggccatttcgacaacgagatcgacatgcacggtctcgagacttaccccggagtgaaaagaatcacgatcaagccacaaaccgaccgatgggttttcccagagaccaaaacgggtattatcattttggcagaggggcgtttgatgaatttgggttgtgcaacgggtcatccgagttttgtgatgtcgtgctcgttcaccaaccaggtgatcgcgcagttggagctctggaacgagaggaagagtggcaagtatgggaaggaggtttacgtgttgcccaagcatcttgatgagaaagttgcagcgcttcatcttggaaagcttggtgctaagctgactaagcttactaaggagcagtccgattatattagcattcctgttgagggtccgtacaagccacctcactacaggtactgaggggttgatttgtgattttagggtttgagattgtttcttgattttgtgttggtctttttgtgatggcagtttggtttatttgttgcactcttattgtttttgcattagcagtaacttaaatgtgaggattattattatgttgtttgttttgtatttgcttttgcgacttttcgtgggagctacttgtcattggttgaactcattatttccctaaattatatgtattgtaccacttttgtcttctcccctacacccggtgatgtagatttttcctaacgaaacgtagattttctgaagttgaattctgattcgaactttctgaatcaaaatgaacgtgttaataggaaaacagtggctgtagggttgaagaagacaggttaagttggtttcttatttaagcaactcttgccagaagcata

SEQ ID NO: 7731 - DNA, 1602 bp, Ricinus communis
tccccaccaaaacacaaaatcctacaaaaatcaaaagcctaatattctaccacaaatcatcatcaaaatgtaaaataaaaagaaaacaatcaagccgtccattatgtagttttttctcaagcttctcttccacctcagtacctgtagtgagcaggcttgtaaggaccctcaactggcacgctgatgtagtcagcctggtccttggagagcttggtgagcttggctccaagctttccaagatgaagagcagcaaccttctcatcaagatgcttaggcaagacgtagaccttcttttcatatttgccagttgccttttccctccacaactcgagctgtgcaatgacctggttggtgaaagagcaagacatcacgaaacttgggtgaccagtggcacaacccaaattcatgagacgcccctcagccaagacaatgatgcctgagttggtatcagggaagacccacctatcagtttggggcttgatggtgatcctcttcacaccagggaaggtctcaagaccgtgcatatcaatttcattgtcaaagtgaccaatgttgcagacaatggcattgttcttcatcttcctcatgtgatcgaccatgacgatgtccttgttacctgtggtggtgacaaagatatcagcttcggagacaacatcttccagaggcaagacttggtagccctccataagagcctgaagggcacagattgggtcaatctcagtcacgatcacacgagatccagcttgcttcaaggcagcagcacagcccttgccaacatcaccataaccacagacaacagaaaccttgccggcaatcatgacatcagtagccctcatcaaaccatcagggagggagtggcggcatccatacaagttaactttaccttgctcttagtaacagagtcgttaacattgatagcagggaacaacaaagtcccattagcttgcatctgatacaatctcttaacaccggtagttgtctcctcagatacacccaccaatctttccttcattttgtggtactttttaggatctgtctttagcccatctctgattatagtcaacacaatctgaaactccgcattatcagtagaagtcgggtcaggaacctgaccggtcttctcataaatctcctcagccttaacaccttcgtgaatcaacagagtggcatccccaccgtcgtcaacgatcagatctgggccaccgcctgggccccagtcaagggcgcgctcagtgcaccaccagtactcctgcaaagtctctcctttccaggcgaacacggccgctgagtcgcgtgctatggcagcagcggcgtggtcttgggtgctgaagatgttgcatgagcaccaacgcacttctgcgcctagagctgtaagggtttcgatgagaactgcggtctggattgtcatgtggagggaaccggtgattttggctcctttgaatggctgggatgggccgaactcggtccggcaagccattaaaccgggcatttcaacttcggcaagctcgatctcgagccgaccgaagtcggcctgagacatgtctttgaccttgtactcacggccgctggttgttttctccaccaacaaagccattatgtact

SEQ ID NO: 7732 - DNA, 1770 bp, Ambrosia trifida
ccacccaccttctcaagagcctctaagatctaatctacaaaacccttaaccatggctctaaccgtcgagaaaacctcaactggccgtgaatacaaagtcaaggacatgtccttggctgacttcggccgcctcgaactcgagctagccgaagtcgaaatgcccggtctaatgtcctgcaggaccgaattcggtccgtcccagccctttaaaggcgcccgaatcaccggttcgctacacatgaccattcagaccggtgtccttattgaaaccctcaccgccttaggcgctgaggttagatggtgctcttgcaacatcttttccacccaggaccacgctgcggccgctatcgctcgcgattcggccgctgtgttcgcctggaagggcgagaccttacaggagtactggtggtgcactgagcgtgctctagactggggtcctggaggtggaccagatctgattgtggatgacggaggtgatgctactttgttgatccatgaaggagttaaggctgaggaggagtttgagaagacagggaaattgccggacccgagctcgactgataacgcggagtttcagatcgtgttgtcgattattaaggaaggattgcaggttgatcctaagaagtatcataagatgaaggagagattggttggtgtgtctgaggagactaccactggtgttaagaggttgtaccagatgcaagctaatggtactctgttgtttcctgctattaatgttaatgactctgttaccaagagcaagtttgacaacttgtacggatgccgtcactctctccctgatggtttgatgagagccactgatgtcatgatcgccggaaaggttgctgtcgtctgtggttatggagatgtcggaaagggttgtgctgctgccatgaaacaagctggtgcccgtgtcatcgtgactgaaattgacccaatctgtgcccttcaggccaccatggaaggactcgaagtccttaccttggacgatgtagtttctcaagctgacatcttcgtcaccaccaccggtaacaaagacatcatcatggtttccgacatgaagaagatgaagaacaacgctatcgtctgcaacattggtcacttcgacaatgaaatcgacatgcttggtcttgaaacttaccctggtgttcaaagaatcaccatcaaaccccaaaccgacaggtgggtcttccctgaaaccaaaaccggcatcattgttttggctgagggtcgtctcatgaacttgggttgtgccactggtcaccccagtttcgtgatgtcttgctcgttcaccaaccaagtgatcgcccaactcgaactctggaacgagaagagcaccgggaagtacaagaaggaggtgtatgtcttgcccaagcatcttgatgagaaggttgctgcccttcatctcggaaagcttggagccaagctgaccaagttgaccaaggaccaggctgactacatcagtgtaccagttgagggaccatacaagcctgctcactacaggtactgagcgtgtcggtttttggggaggacgttgttgctttctttataagatacaacttgagtatgtgttagactctagttttgtttgttacttttattggggtgttggcgaggatgaaactgactggtcgtctcatgagacgactgatgtcggttcaaataagggctgtgtgtgaaggatgtgtggacttgtagtagtttttctggtttagaggttttgcttgctatggattttgcttcttattttatcaagcgattaaagaaaaaa

SEQ ID NO: 7733 - DNA, 1845 bp, Ambrosia trifida
tacccaccttctcaagagcctctaagatctaatctacaaacccttaaccatggctctaaccgtcgagaaaacctcaactggccgtgaatacaaagtcaaggacatgtccttggctgacttcggccgtctcgaactcgagctagccgaagtcgaaatgcccggtcttatgtcgtgccggaccgaattcggcccatcccagccgtttaaaggcgcccgaatcaccggttcgctacacatgaccattcagaccggtgtccttattgaaaccctcaccgccttaggcgctgaggttagatggtgctcttgcaacatcttttccacccaggaccacgctgcggccgctatcgctcgcgattcggctgcagtgttcgcctggaagggcgagaccttacaggagtactggtggtgcactgagcgtgctctagactgggggcctggtggtggtccagatctgattgttgatgacggaggtgatgctactttgttgatccatgaaggagttaaggctgaggaggagtttgagaagacagggaaattgccggacccgagctcaactgataacgcggagtttcagatcgtgttgtcgattattaaggaaggattgcaggttgatcctaagaagtatcataagatgaaggagagattggttggtgtgtctgaggagactaccactggtgttaagaggttgtaccagatgcaagctaatggtactctgttgtttcctgctattaatgttaatgactctgttaccaagagcaagtttgacaacttgtacggatgccgccactctctccctgatggtttgatgagagccactgatgtcatgatcgccggaaaggttgctgtcgtctgtggttatggagatgtcggaaagggttgtgctgctgccatgaaacaagctggtgcccgtgtcattgtgactgaaattgacccaatctgtgcccttcaggccaccatggaaggactcgaagtccttaccttggacgatgtagtttctcaagctgacatcttcgtcaccaccaccggtaacaaagacatcatcatggtttctgacatgaagaagatgaagaacaacgccatcgtctgcaacattggtcacttcgacaatgaaatcgacatgcttggtcttgaaacttaccctggtgttcaaagaatcaccatcaaaccccaaaccgacaggtgggtcttccctgaaaccaaggccggcatcattgttcttgctgagggtcgtctcatgaacttgggttgtgccactggtcaccccagtttcgtgatgtcttgctcgttcaccaaccaagtcatcgcccaactcgaactctggaacgagaagagcaccgggaagtacaagaaggaggtgtatgtgttgccaaagcatcttgatgagaaggttgctgcccttcatcttggaaagcttggagccaagctaaccaagttgaccaaggaccaggctgactacatcagtgtaccagttgagggaccatacaagcctgctcactacaggtactgagcggttcggtttttgggcggaggtggttgctttctttataagacgcaacttgagtatgtgtttaagactttagttttgttttgttactttgaccgggggtgttggcgaggatgaaaccgacaggttgtttcttgatgagacggctgttgatgttggttcaataagggctgtgtgtgaaggttgtgtggacttgtagttgtttttctggtttagaggttttgcttgctatggattttgcttcttattttatcaagcgattaaagaaaaaatagtaattttgtgtaccaaaaaagaaaaaaaattatacataccaaaatttgtgaacctatagaatgaat

SEQ ID NO: 7734 - DNA, 2021 bp, Arnica chamissonis
cctactataatgaaaagtacaccaggatatcactggacaactgtctaaccgtttttttcttcttatctagatgggacccactcttaccatattagaataaaaaattaccacacagatgaaatctcgaccgttaactctaccccttaaaccctactttataaccctccatcccctcactctgttcttgccttaccacccccctctgagacactgttaagatccgatctacaaacccttcgacgacatggctctcaccgtcgaaaaaacctccaccggccgtgagtacaaagttaaggacatgtccttagctgatttcggccgtctggagctcgaattagccgaagttgaaatgcccggtctcatttcatgccgtacggaattcggtccctctcagccgttcaaaggtgcgagaatcaccggctccctccacatgacaatccagaccggagtcctcatcgaaaccttaactgccttgggcgctgaagtcagatggtgctcatgtaacattttctcaactcaagaccacgctgccgccgccatcgcccgtgattcagccgccgtgttcgcttggaaaggggaaacgctacaggagtactggtggtgcacggaacgtgctctagattggggacctggtggtggtcctgatttgattgttgacgatggtggtgatgcgacgttattgatccatgaaggagtcaaggctgaggaggagtttgcgaagaccggaaaattgcccgatccgacttctaccgataacgctgagttccagatcgttttgtcaatcatcaaggaagggcttcagaccgatccgaagaagtaccacaaaatgaaggatagattagtcggtgtatctgaagaaactaccaccggtgttaagagactgtaccagatgcaagctaatggtactctgctgttccccgccattaacgtcaatgactctgtcaccaagagcaagtttgacaacttgtatggatgccgccactctctccctgacggtttaatgagagcaaccgatgtcatgattgccggaaaggttgcagttgtctgtggatacggagatgtcggaaagggttgtgctgccgccatgaaacaagctggtgcccgtgtcattgtgacagaaattgaccccatctgcgcgcttcaggccaccatggaaggactccaagtcctcaccttggaagatgtagtttcagaagctgacattttcgtcaccaccaccggcaacaaagacatcatcatggtttccgacatgaagaagatgaaaaacaacgcaatcgtctgcaacatcggtcatttcgacaatgaaatcgacatgcttgggcttgaaacataccctggcatccaaagaattacaatcaaaccacaaactgacaggtgggtcttccccgaaaccaagactggcatcatcgtgttagccgagggtcggctcatgaacttgggttgtgcgacgggtcaccctagtttcgtgatgtcgtgttctttcacaaaccaagttattgcccaactggagctatggaaagagaagaactcagggaagtacaagaaggaagtgtatgtgttgccaaaacatcttgatgagaaggtggctgcacttcatcttggaaagcttggagccaagttgaccaagttgaccaaggaccaggctgattacatcagtataccagttgaaggtccctacaagcctgctcactacaggtactaaaagtgttggtttttggttggtcggttagtgggtgggtgtggttggggggtggggttatctagaagagggtgatgtgatggttgcttgctttacaagtaacactttgattgtgttgttgagaactgagaaagatcattgatggtggtttgaataaggggttgagtgtgaagtttatgcaacaccttttgcttcttaattcatggagagatatcaaagatgtatttctctatttcttgggtttcactttttgttttcttatatatctagtgaatcgaatctatgtcgttttgatcatcttatttcggacttatactcgtgt

SEQ ID NO: 7735 - DNA, 1919 bp, Platanus occidentalis
agcctcctcatttgcagagagcgggagcgagagagatcgaccgatttccagatctgaatctttgcagccatggatctgcttgtggagaagacctcctccggcatcgaatataaggtcaaggacatgtctcaggcggatttcggccgcctcgagattgagctcgccgaggtcgaaatgcccggcttgatgtcttgccgcacagagttcggcccttcccaacccttcaagggcgcccggatcaccggatccctccacatgaccatccaaaccgccgttctcatcgaaaccctcaccgcgcttggcgccgaggtccgctggtgctcctgcaacattttctccacgcaggaccacgccgctgcggccatcgcccgtgacagcgccgccgtctttgcttggaagggggagactcttcaggagtactggtggtgtactgagagggctcttgattggggccccggtggtggtccggatctgatcgtggatgatggtggtgatgcgaccttgctcatccatgagggggtgaaggccgaggaagagtttgagaagtcggggaagatccccgatccggcttccaccgacaacgctgagttccagatcgtgctcgggatcattagagatggattgaagaccgatcccaagaagtatcacaagatgaaggagagattggttggtgtttctgaggagactaccactggtgtgaagaggctttaccagatgcaagtcaacggaacattgcttttccctgctatcaacgttaacgactctgttacaaagagcaagttcgataacctctatgggtgccgacactctctccccgatggcctgatgagggccaccgatgtcatgatcgccggaaaggttgcagttgtctgcggttatggagatgtcggcaagggctgcgctgctgccctcaagcaggctggtgctcgtgtcatcgtaactgagatcgaccccatctgcgccctccaggctctgatggaaggcatccccgtcctcacccttgaagacgtggtatcagaagcggacatcttcgtcaccaccaccggcaacaaggacatcatcatggtcgaccacatgaagaagatgaagaacaacgccattgtctgcaacatcggtcacttcgacaatgagatcgacatgcacggtctagagaatttccctggcgtgcagaggatcacgatcaagccacagacggacaagtgggtcttccctgaaaccaagtctggcatcatcgtcttggcagaggggcggctcatgaaccttggatgcgccacaggccaccccagctttgtcatgtcctgctcgttcacgaaccaggtgattgctcagcttgagctgtggaaggagaagagcaccggcaagtacgagaagaaggtgtacgtgcttcccaagcaccttgacgagaaggttgctgctcttcaccttggaaagcttggtgctaagcttacaaagcttacgccggagcaggccgactacattagcgtcccagtggagggtccatacaagcctgcacactacaggtactgagagagaggagagaacagaacactgggatggccatgatcttctttccattttggttttgcagtgggtttgatttttacatggtgggggagttgggtagggggaggagggcattggtctctgttagaatatatgttgagactttaagagacaaagctatgggttttgaataaggttgagagaggatgtgtttgatgtgttttccttcggttttcggcggggtcttttcttacaaagaagatatgcttttgctttcaacatgttaagtcttttgtttggtgggattggaaaatcaggcaaggtgtctagttcagaggttgctctaaacattcttgggtttgaccaatgaaggcctcagcttataagggtttttgggggtgggatagttactccag

SEQ ID NO: 7736 - DNA, 1854 bp, Hordeum vulgare
cactcctccctccctcccaatcactcttcttcctcctccgccagatccgatccaccaaccttctccatggcgctctccgtggagaagacctcgtctggccgggagtacaaggtcaaggacctctcccaggccgacttcggccgcctcgagctcgagctggccgaggtcgagatgcccggcctcatggcctgccgcaccgagttcggcccctcgcagcccttcaagggcgcccggatctccggctccctccacatgaccatccagaccgccgtgctcatcgagaccctcaccgccctcggcgccgaggtccgctggtgctcctgcaacatcttctccacccaggaccacgccgccgccgccatcgcccgcgactcggccgccgtcttcgcctggaagggcgagaccctcgaggagtactggtggtgcaccgagcgctgcctcgactggggcgccggcggcggccccgacctcatcgtcgacgacggcggcgacgccacgctgctcatccacgagggcgtcaaggccgaggaggagttcgagaagtccggcaaggtccccgacccggagtccaccgacaaccccgagttcaagatcgtcctcaccatcatccgcgacggcctcaagaccgacgccagcaagtaccgcaagatgaaggagaggctcgtcggtgtctccgaggagaccaccaccggcgtcaagaggctctaccagatgcaggagtccggcaccctccttttccccgccatcaacgtcaacgactccgtcaccaagagcaagtttgacaacctttacggttgccgtcactctctccctgacggtctcatgagggccactgatgttatgattgccggtaaggtcgccgtggtctgcggttatggtgatgttggcaagggctgtgccgccgcactcaagcaggctggtgcccgtgtgatcgtgacagagatcgaccccatctgtgctcttcaggccctgatggagggcatccagatcctcaccttggaggatgttgtctctgaggctgatatctttgtgaccaccaccggaaacaaggacatcatcatggttgaccacatgaggaagatgaagaacaacgccattgtctgcaacattggtcactttgacaacgagatcgacatgaacggccttgagacctaccccggtgtcaagcgcatcaccatcaagccccagactgaccgctgggtcttccctgagaccaagaccggcatcattgttcttgctgagggtcgtctgatgaaccttggatgtgccactggccaccccagctttgtcatgtcctgctctttcactaaccaggttattgcccagctcgagttgtggaacgagaaggccagcggcaagtacgagaagaaggtgtacgttctccccaagcacctcgacgagaaggttgcggccctccacttgggcaagctcggcgccaggctgaccaagctcaccaagtcccagtctgactacattagcatcccgatcgagggtccctacaagcccgcggcctaccggtactagtgtgtccagcacgactagcggctggcctgagcctgagtctgagcagcggcgccaacgggaactctgccacggcgacctatcaactatcctgtttcccttccattatcttacatgctgtctcttaggcggaggatttgttattacggttatgttttgagccttgtgagggttgggagaggctgcgtttgcttttgcccagaaataatgccattatcattggtttatgtgaggtggtgtgcttttccatatgcggttctgtctcgcttgttctaccatgtctgaaatcctttgcaagttgctgtcgtttattgtaaaaaaaaaaaaaaaaaa

SEQ ID NO: 7737 - DNA, 1762 bp, Hordeum vulgare
ctcctccctccctcccaatcactcttcttcctcctccgccagatccgatccaccaaccttctccatggcgctctccgtggagaagacctcgtctggccgggagtacaaggtcaaggacctctcccaggccgacttcggccgcctcgagctcgagctggccgaggtcgagatgcccggcctcatggcctgccgcaccgagttcggcccctcgcagcccttcaagggcgcccggatctccggctccctccacatgactatccagaccgccgtgctcatcgagaccctcaccgccctcggcgccgaggtccgctggtgctcctgcaacatcttctccacccaggaccacgccgccgccgccatcgcccgcgactcggccgccgtcttcgcctggaagggcgagaccctcgaggagtactggtggtgcaccgagcgctgcctcgactggggcgccggcggcggccccgacctcatcgtcgacgacggcggcgacgccacgctgctcatccacgagggcgtcaaggccgaggaggagttcgagaagtccggcaaggtccccgacccggagtccaccgacaaccccgagttcaagatcgtcctcaccatcatccgcgacggcctcaagaccgacgccagcaagtaccgcaagatgaaggagaggctcgtcggtgtctccgaggagaccaccaccggcgtcaagaggctctaccagatgcaggagtccggcaccctcctcttccccgccatcaacgtcaacgactccgtcaccaagagcaagtttgacaacctttacggttgccgtcactctctccctgacggtctcatgagggccactgatgttatgattgccggtaaggtcgccgtggtctgcggttatggtgatgttggcaagggctgtgccgccgcactcaagcaggctggtgcccgtgtgatcgtgacagagatcgaccccatctgtgctcttcaggccctgatggagggcatccagatcctcaccttggaggatgttgtctctgaggctgatatctttgtgaccaccaccggaaacaaggacatcatcatggttgaccacatgaggaagatgaagaacaacgccattgtctgcaacattggtcactttgacaacgagatcgacatgaacggccttgagacctaccccggtgtcaagcgcatcaccatcaagccccagactgaccgctgggtcttccctgagaccaagaccggcatcattgttcttgctgagggtcgtctgatgaaccttggatgtgccactggccaccccagctttgtcatgtcctgctctttcactaaccaggttattgcccagctcgagttgtggaacgagaaggccagcggcaagtacgagaagaaggtgtacgttctccccaagcacctcgacgagaaggttgcggccctccacttgggcaagctcggcgccaggctgaccaagctcaccaagtcccagtctgactacattagcatcccgatcgagggtccctacaagcccgcggcctaccggtactagtgtgtccagcacgactagcggctggcctgagcctgagtctgagcagcggcgccaacgggaactctgccacggcgacctatcaactatcctgtttcccttccattatcttacatgctgtctcttaggcggaggatttgttattacggttatgttttgagccttgtgagggttgggagaggctgcgtttgcttttgcccagaaataatgccattatcattggtttatgtgaggtggtgtgct

SEQ ID NO: 7738 - DNA, 1797 bp, Ocimum basilicum
gcacccttatattcttcttcttcttcactccccaagaagaaagaaacagaatccccccaatttcccctcctacaatggcgctccttgtcgagaaaaccagctccggccgcgaatacaaggtcaaggacatgtctcaggccgacttcggccgcctcgaaatcgacctcgccgaggtcgagatgcccggcctcatgtcgtgccgcaccgaattcggcccctcccagccattcaagggcgccaagatcactggaagcctccacatgaccatccagaccgccgtcctcatcgaaaccctaaccgcgctcggcgccgaggtccgctggtgctcctgcaacatcttctccacgcaggaccacgccgccgccgtcatcgcgcgcgacagcgccgccgtcttcgcctggaagggggagactctccaggaatactggtggtgcaccgagcgcgcgctcgattggggccccggcggcggaccggatctgatcgtcgacgacggcggcgatgcgacgctgttgattcacgagggggtgaaggcggaggaggagtacgcgaagagcgggaagctgccggatccgagctccaccgacaacgccgaatttcagatcgtgttgacgattatcagagatggattgaaggagaatccaacgaagtatacgaagatgaaggagagattggtgggcgtttcggaggagacgacgactggcgttaagaggctgtatcagatgcaggctaatggcactctgcttttccccgccattaacgttaacgactctgtcactaagagcaagttcgacaacttgtacggatgccggcactcgctccccgacggcctgatgagggcgaccgacgtgatgatcgccggaaaggtgggcgttgtcttcggctacggagatgtcggcaaggggtgcgcagccgccctgaagcaagccggggcccgcgtgatcgtgaccgagatcgaccccatctgcgccctgcaagccctcatggagggcttccaggtgctccgccttgaggatgtggtctcggaggcggacatcttcgtcaccaccaccggcaacaaggacatcatcatggtgagtgacatgcgcaagatgaagaacaacgccatcgtctgcaacatcggtcactttgacaacgagatcgacatgcacgggctggagacgtacccaggggtgaagcggatcaccatcaagccgcagacggaccggtgggtgttccctgacaccaaatcgggtatcatcgtgctggcggaagggcggctgatgaacctggggtgcgccacggggcaccccagcttcgtgatgtcgtgctccttcaccaaccaggtgatcgcccagctggagctgtggaacgagaggagctccggcaagtacgagaagaaggtgtacgttttgccgaagcacctggacgagaaggtggcggccctccaccttggaaagctgggtgcgaagctcaccaagctttccaaggatcaggccgactacattagcgtcccgatcgagggaccctacaagccggctcactataggtactgagctttgagaggatcaacaatgaaattaaattgggggaaaacacaatatatttatgagctttttttttttttttttttgaatttgggagctgatttgatgaattggaaaataagttggacgatggtttttagctagcgcggtggtttttttttgttcttttatatactcgatgaaatataaaaaggaaatttttgttccattacgctcccttgtatactattatgtttatgtttatctataaaagtacgttttgcgattttttctt

SEQ ID NO: 7739 - DNA, 1751 bp, Triticum aestivum
cctcctctgccagatccaatccaccaaccttctccatggcgctctccgtggagaagacctcgtcgggccgggagtacaaggtcaaggacctctcccaggccgacttcggccgcctcgagctcgagctcgccgaggtcgagatgcccggcctcatggcctgccgcaccgagttcggcccctcgcagcccttcaagggcgcccggatctccggctccctccacatgaccatccagaccgccgtcctcatcgagaccctcaccgccctcggcgccgaggtccgctggtgctcctgcaacatcttctccacccaggaccacgccgccgccgccatcgcccgcgactccgcggccgtcttcgcctggaagggcgagaccctcgaggagtactggtggtgcaccgagcgctgcctcgactggggcgtcggcggcggccccgacctcatcgtcgacgacggcggtgacgccacgctgctcatccacgagggcgtcaaggccgaggaggagttcgagaaatccggcaaggttcccgacccggagtccaccgacaaccccgagttcaagatcgtcctcaccatcatccgcgacgggctcaagaccgacgccagcaagtaccgcaagatgaaggagaggctcgtcggtgtctccgaggagaccaccaccggcgtcaagaggctctaccagatgcaggagtccggcaccctcctcttccccgccatcaacgtcaacgactccgtcaccaagagcaagtttgacaacctttacggttgccgtcactcgctccctgatggtcttatgagggccactgatgttatgatcgccggcaaggtcgccgtggtctgcggttacggtgatgttggcaagggctgtgccgccgcactcaagcaggctggtgcccgtgtgatcgtgacagagattgaccccatctgtgcccttcaggccctgatggagggtatccagatcctcaccttggaggatgttgtctctgaggctgacatctttgtgaccaccaccggaaacaaggacatcatcatggtcgaccacatgaggaagatgaagaacaacgccattgtctgcaacattggtcactttgacaatgagatcgacatgaacggccttgagacctaccctggtgtcaagcgcatcaccatcaagccccagactgaccgttgggtcttccccgagaccaagactggcatcattgttcttgctgagggtcgtctgatgaaccttggatgtgccactggccaccccagctttgtcatgtcctgctcattcaccaaccaggttattgctcagcttgagttgtggaacgagaaggccagtggcaagtatgagaagaaggtgtacgttctccccaagcacctggacgagaaggtcgcggccctccacttgggcaagctcggcgccaggctgaccaagctcaccaagtcccagtctgactacattagcatcccaattgagggtccttacaagcctgcggcttaccggtactagtgtgtccagcatgactagcggctggcctgagcctgagtcggagcagcggcaccaacgggaactctatcaactatcctgtttcccttctattatcttacatgctgtctcttaggcggaggatttgttattatggttatgttttgagccttgtgagggttgggagaggcggcgtttgcttttgcccagaaataatggcattattattggtttaaaaaaaaaaaaacctcggccgcgaccacgctaatcactagtgaattc

SEQ ID NO: 7740 - DNA, 1844 bp, Linum usitatissimum
cttatccctcttctccctcatttctcagatcccaaagcgccggtaattgttttcgtgctagaatggctctcatcgtcgacaaaaccaccaccggccgtgagtacaaggtcaaggacatgtcccaggccgacttcggccgcctcgagctcgagcttgccgaggttgagatgcctggactcatgtcctgccgtactgagttcggcccatcacagccgttcaagggtgccaggatcaccggatccctccacatgaccatccagaccgctgtcctaatcgagaccctcaccgccttgggagctgaggtccgttggtgttcgtgcaacatcttcagcacccaggaccacgctgccgccgccatcgcccgtgactccgccgctgtcttcgcctggaagggagagaccctccaggagtactggtggtgtaccgagagggctcttgactggggtcccgatggaggccctgatctgattgttgacgatggaggtgatgccactctcttgatccacgagggtgtcaaggcggaggaggagtatgagaagtctggaaaggtcccagaccctgcttccaccgacaacgccgagttccagattgttctcaccatcatcagggacggtttgaagactgaccccaagaagtaccgcaagatgagggacagattggttggcgtttctgaggagaccaccactggtgtcaagaggctctaccagatgcaagagaatggaacacttctcttccctgctatcaatgtcaacgactctgtcaccaagagcaagttcgataacttgtatggttgccgtcactccctccccgatggtctgatgagggctactgatgttatgattgccggaaaggttgctgttgttttgggatatggtgatgttggaaagggatgtgctgctgccatgaagcaggctggagctcgcgtcattgtgaccgagattgatcccatctgtgcccttcaggctcttatggaaggtctccaggtgttgacccttgaggattgcgttgctgaggctgacatcttcgtcaccactactggaaacaaggacatcatcatggttgacgacatgaggaagatgaagaacaacgccattgtatgcaacatcggtcactttgacaatgagattgacatgaatggtcttgagaccttccctggagtgaagcgcatcaccataaagccccagaccgacaggtgggtgttcccagacaccaagagcggcatcattgtgttggcagagggacgtctcatgaatttgggatgtgcaactggtcaccccagctttgtgatgtcctgctccttcaccaaccaggtgattgctcagcttgagctctggaacgagagatccagtggcaagtatgagaagaaggtgtacgttctgcccaagcaccttgacgagaaggtggctttgctccatcttggaaagcttggagctaggctcacaaagttgtccaaggaccaggctgactacatcagcgttccagttgagggtccttacaagcctgctcactacaggtactgagcaaacgaagttataaggggattggagtggaagaagaaccagatttgcttttggtggaaaatgcggcgatccgttggtttgttttccatttgtgttagaatgtgtttaggttttggttttaatgttgatggtgttatggtctgggaagggaagggtgagagggctttcgggggaatggatgaataagggcatctgggaatgggggttgtgtctgacagaattcttttggttttattttcgcgaatttggattttctgccatgctgcctgaggcgctggctttatcatataaaattttagaatgaaaatgaagagttgtttgcct

SEQ ID NO: 7741 - DNA, 3320 bp, Setaria italica
ctcacccacccccaccaatcccccactcagatccgatggccgctgatcgccgcgtccggaaaccaacggccccgcgccttcgtctctctccataaaaacatcgtctccccctcccttcccattccgccagccgtctcctcccctcctccgattccctcccagatccaatccgcgagctctccctccaccagcccgctgccatggcgctctccgtggagaagacctcgtcgggccgggagtacaaggtcaaggacctgtctcaggcggacttcggccgcctcgagatcgagctggcggaggtcgagatgcccgggctcatggcctgccgcaccgagttcggcccgtcccagcccttcgccggcgccaggatctcgggctccctccacatgaccatccagaccgccgtcctcatcgagaccctcaccgcgctcggcgccgaggtccgctggtgctcctgcaacatcttctccacgcaggaccacgccgccgccgccatcgcgcgggactccgccgcggtcttcgcctggaagggggagacgctcgaggagtactggtggtgcaccgagcgctgcctcgactggggcgagggcggcggccccgacctcatcgtcgacgacggtggtgacgccaccctcctcatccacgagggcgtcaaggccgaggaggagtatgagaagtccggcaagatccccgacccggagtccaccgacaacgccgagttcaagatcgtgctcaccatcatccgcgacgggctcaagtctgaccccaagaagtaccgcaagatgaaggagaggctcgtcggcgtctcggaggagaccaccaccggagtcaagaggctctaccagatgcaggagaccggcaccctactcttccccgccatcaacgtcaacgactccgttaccaagagcaagtttgacaacctgtatggttgccgccactccctccctgatggtttgatgagagccaccgatgttatgatcgctggcaaggttgcagttgtctgcggttatggtgatgttggcaagggctgtgctgctgccctcaagcaggctggtgcccgtgtcatcgtgactgagatcgaccccatctgtgcccttcaggccctgatggagggtcttcaggtccttaccttggaagatgtcgtctctgaagctgacatctttgtgactaccaccggcaacaaggacatcatcatggttgaccacatgaggaagatgaagaacaacgcaatcgtctgcaacattggtcactttgacaatgagattgacatgcacggtcttgagacctaccctggtgtcaagcgcatcaccatcaagccccagactgaccgctgggtgttccctgagaccaagactggcatcattgtcctcgctgagggtcgtctgatgaaccttgggtgcgctactggccaccccagctttgtcatgtcctgctcattcactaaccaggtcattgctcagcttgagctgtggaaggagaagagctctggcaagtatgagaagaaggtgtacgtgctccccaagcaccttgatgagaaggttgctgctctccacttgggcaagcttggtgccaggctcaccaagctcagcaagtctcaggctgactacatcagtgtcccgattgagggtccctacaagcctgctcactaccggtactaggcagcacgacaagaagttcactcggctggccggttgtgttgtgtgccggtatgaagttcgctacaccggcttgtcaattaacttttgcatggatatcaaatgcgccgttggcgtaggagggtcatcgcttgagcctggttgagtggggagaggagggaagagctatttgcttttgcggaagaataatggcgtaattggtcgtggggtgaagcgggtgtgcgttgccagaaactataccgtttctgattatcatttgcaagcgatttattctagttatgtgtctttcatgaataacttgctttctttaagagcatatttagtcagatactaagttttgcatatgtctgtttcgttgagttatccagcaagctcgtcgtgccttctcggttcattctcttctattgtgtctctgtatgccgtttaggaaatgcattaattcatgcctgttctacgaattctgatagcatgtggatgggtcagctgagctttgctagagtttttgaatggtggtgtcatgtgcttcagcttgcctgtcgggggtggcatttccgttgccaatgtgtgcaagttccttgaagaacctggtctgccacagccatttctaccaactgcttgtctgggctactgtagtcgctgttcgagaacaatgcagcagctgaatatatgggcgcttggcaccggagatgtccatggaggaatttaatcccggtcaaagtatttccttgtttagagttaggtgctcctacgaaatctgaataataaagtgcagagataatttagtctcaaacgatgaaatgctcaacctcagaatggggatgaacatgacaatgattgtttcttctgagttctgatcaacaacaatttcctgtgctttgcctgaagatgggagtagtgggagtgcaagcagtgtcaatagtattcagtcacaaacaaatcattgtttcatgttcacagcctacgaaacaatgtactgaacagtatcggcaggacacgagcaactgacacagattttgttggtctgaccattaatcgagattcgaattccagtacagttactggtactctggtagcagcagcagcagccagcattaatggagacaaacggtaaagccaaagacttctctgcaaattcgtagaaggattcaatctccacagtagaacagcactggagagcagacgtgtgttgccgtgcacaacaaacttcaagagaatggagagagactcgacaacatcacgtctggggaccttgcagtgaaaaactgaggtatccaaaggcaagagcatgctacgggtaattttcatcttaatctggcaaacagacagtacatattgtacatgtgctcaattcaaccatgctggatgattgacatcacaggatccacatcggagcttggcactgactacaattagtctgagggactgagggagaaccctttcgtgttccttagtctttgactcttgtggtccttatattgtacaaaagtggtggtgtacaatacaatatgatacacagaatgcgaacctactacaaacttcaggatgacgagccgtctgtgttcaggagcaccacaaggaaaattgcagctgaggggccaagttaactcgtcacaagtagtcttagctttctgtcgtgctttatcattgaacctacactctctacaa

SEQ ID NO: 7742 - DNA, 1985 bp, Panicum virgatum
gtccgcttcctcccctcctcccatccctcccactcccagatccaatccgcgagctctcccgcccgctgcaatggcgctctccgtggagaagacctcgtcggggcgggagtacaaggtcaaggacctgtcccaggccgacttcggccgcctcgagatcgagctggccgaggtcgagatgcccgggctcatggcctgccgcgccgagttcggcccgtccaagcccttcgccggcgcaaggatctccggctccctccacatgaccatccagaccgccgtcctcatcgagaccctcaccgcgctcggcgccgaggtccgctggtgctcctgcaacatcttctccacgcaggaccacgccgccgccgccatcgcgcgggactccgccgcggtcttcgcctggaagggggagacgctcgaggagtactggtggtgcaccgagcgctgcctcgactggggcgagggcggcggccccgacctcatcgtcgacgacggtggcgacgccacgctcctcatccacgagggcgtcaaggccgaggaggagtacgagaagaccggcaaagtcccagacccggagtccaccgacaacgccgagttcaagatcgtgctcaccatcatccgcgacgggctgaagtctgaccccaagaagtaccgcaagatgaaggagaggctcgttggagtctcggaggagaccactaccggagtcaagaggctctaccagatgcaggagaccggcactctactcttccctgccatcaacgtcaatgactccgtcaccaagagcaagtttgacaacctgtatggttgccgccactccctccctgatggtctgatgagggccaccgatgttatgattgctggcaaggttgcggtagtgtgcggttatggtgatgttggcaagggctgtgctgctgccctcaagcaggctggtgcccgtgtcatcgtcactgagattgaccccatctgtgcccttcaggccctgatggagggtcttcaagtacttaccttggaggatgtcgtttctgaagctgacatctttgtgaccaccaccggcaacaaggacatcatcatggttgaccacatgaggaagatgaagaacaatgcaattgtctgcaacatcggccactttgacaatgagatcgacatgctcggtcttgagacctaccctggtgtgaagcgtatcaccatcaagcctcagacagaccgctgggtgttccctgagactaagactggcatcattgtcctcgctgagggtcgtctgatgaaccttggatgcgctactggtcaccccagctttgtcatgtcctgctcattcactaaccaggtcattgctcagcttgagctttggaaggagaagagctctggtaagtatgagaagaaggtgtacgtgctccccaagcaccttgatgagaaggttgctgctctccacttgggcaagcttggtgccaaactcaccaagctcaccaagtctcaggctgactacatcagcgtcccgatcgagggtccctacaagcccgctcactaccggtactaggctgcccagcacaactagaacatcactttgctggctggctgtgttatgtgcccatgcaaagttcgccacaccggcgtgccaattatcctttgaatgctcatatgcgcctttgcctagaaggattttttatggtcattgcttgagcggttgagtctggttgagtggggagaggttggaagagctgtttgcttttgcggaagaataatggcgtaattggttgtaggctgaggtggtgtgcgttgccagaaactacatagtttctgattatcatttgcaagcgatttgctcaagttatgtgtctttcatgaataacttgctttcttgaagagcatatttagtctgatcctgaattttgcttacgtctggttggtttgtgttcagcaagctcgttgagcggcccctactcatttcagtgtcttttattatactctcagggtcgtgttttaagaattctgat

SEQ ID NO: 7743 - DNA, 1870 bp, Malus domestica
ggcaaagacaagccctagttttgcagagtgagagagattaccacctccgatacccgcaatggctctctccgtcgagaaaagtagcagcggccgcgagtacaaggtcaaggacatgtcccaggccgacttcggccgcctcgagatcgagctcgccgaggtcgaaatgcccggcctcgtctcctgccgcaccgaattcggaccctcccaacccttcaagggggcccgcatcaccggatccctccacatgaccatccagaccgccgtcctcatcgaaaccctcaccgccctcggcgccgaggtccgctggtgctcctgcaacattttctccacccaggaccacgcagccgccgccatcgcccgtgacagcgccgccgtctttgcctggaagggcgagaccctccaggagtactggtggtgcaccgagcgcgccctcgactggggccccggtggtggacccgatctgatcgtcgacgacggcggtgacgccaccctcttgatccacgagggagtcaaggccgaggaggagttcgcgaagtccgggactctccccgacccgtcttccaccgataaccaggagttccagctcgttctgaccatcatcagagatggcttgaagaccgaccccaagaggtaccacaagatgaaggacaggttggtcggagtctcggaggagaccaccaccggcgtcaagagattgtatcagatgcaggccagcggcgctctcttgttccccgccatcaatgtcaacgactctgttaccaagagcaagtttgacaacttgtacggatgccgtcactctctccccgatggtttgatgagagccactgatgttatgattgccggaaaggtttccgttgtctgtggatatggagatgtcggaaagggttgtgctgctgccctcaagcaagctggatcccgcgtggttgtgactgagattgatccaatctgtgccctccaggctcttatggaaggccttcaggttcttccccttgaggatgttgtcgctgaggccgatatctttgttaccaccaccggtaacaaggacatcatcatggttgaccacatgaagaagatgaagaacaatgccattgtttgcaacattggtcattttgacaatgagattgacatgcatggtcttgagacataccccggagtgaagcgcatcaccatcaagcctcaaaccgacaggtgggtcttccccgagaccaaatccggcatcattgtgttggctgagggccgtctcatgaacttgggctgtgccactggacaccccagctttgtgatgtcctgctctttcaccaaccaagtgattgctcagctcgagttgtggaatgagaggaagtccggcaagtacgagaagaaggtgtatgtcttgcccaagcaccttgatgagaaggttgctgcccttcatcttggaaagcttggagctaagctcaccaagctcaccaaagagcaggctgactacatcagcgtgccggtcgagggtccatacaagccagctgcctacaggtactgaagaggggtcgtcaatgagacgagaaatgagaaaaagaaaactatatctggacgacgggttgttttttgcttttgattattttcacttgtgatgaaatgcggtagattttctaggtttataaattttgtaggagtttgtgtcggtgggtttcggagggtatgggatgtgtgagggaaagggatgatttaggtctcaatggaagacctaggggcttgaataagggaatgggacgggggttgtgtgggataatttctgctgcagcatcacttgtgtgctgcatccggttatctatcgttttactaccaagaaatggatcagaaaaaaaaaaaactatttaccgtcatttcgagtatt

SEQ ID NO: 7744 - DNA, 2018 bp, Manihot esculenta
gctcgaacccctctctctatttactcttaaacctcagagagagagtgtgtgcgtctatctcttcttcctctctctcaaaaatctcagatccaaaccccaatcgacctctcccgatggctttgttggtggagaagaccactagcggccgtgagtacaaggtcaaggacatgtctcaggctgactttggtcgcctcgagattgaattggccgaggttgaaatgcctggtcttatggcttgcagagctgaattcggccctgcgcagccttttaagggagctaagatcaccggttccctccacatgaccattcagaccgccgtcctcatcgagacacttaccgctttgggcgctgaggtccgctggtgctcttgcaacatctttagcactcaggaccatgctgccgctgccatcgcccgtgactctgctgccgtcttcgcctggaagggtgagactctccaggagtactggtggtgtacagagcgtgctcttgactggggtcccggtggtggcccagatctgatcgtggatgatggtggtgatgctacccttttgatccatgagggcgttaaagctgaggaggtttatgagaagactgggaagcttcctgatccgtcttccacagataatgctgagtttcagattgttttgaccatcattagagatgggttgaagacagatcccaagaggtatcacaagatgaaggaaagattggtgggtgtttctgaggagacgaccactggagttaagaggttgtaccagatgcaagctaatggaactttgttgttccctgctatcaacgttaatgactctgtcaccaagagcaagtttgataacttgtatggatgccgccactccctccctgatggtttgatgagggctactgatgtcatgattgctggcaaagttgctgttgtctgtggttatggtgatgttggcaagggctgtgctgctgccttgaagcaggctggagctcgtgtgattgtgaccgagattgatcccatttgtgcccttcaagctcttatggaaggcctccaagtcttgactctagaggatgttgtctctgcagctgacatcttcgtcaccaccaccggtaacaaggacatcatcatggttgatcacatgaagaagatgaagaacaatgccattgtttgcaacattggtcacttcgataatgaaattgatatgcacggacttgagacctaccctggtgtgaagcgcatcactatcaagccccagactgataggtgggtgttccctgaaaccaactcaggcatcattgtgttggctgaggggcgtctcatgaatttgggttgtgccacaggtcaccccagcttcgtgatgtcgtgctctttcaccaaccaggtgatcgcacagcttgagttgtggagggagaagggaactggaaaatatgagaagaaggtctatgttttacctaagcacctggatgagaaggttgctgctcttcaccttggaaagcttggagctaagctcactaaactcaccaaggatcaggctgactacatcagtgtgcccgttgagggtccttacaagccacctcactacaggtactaagatggagggaagagtttttgagaaaaaactacaaattgggacggcttgattgtttcttttacaatttgaagatgatttgaaatagaatgttaggctttttcttcctttttaaaaattttttgtaggatttgtgttttggtggggaagttgggaggaaagaaatgttggtctctgtcgaaaaagaccacatgggattaaataaaggtttcggatggggttgtgtgtgattttgttggctgccatttgtgtttcctgcagctcgttatcattttattcaacaaaaagaaaaaagaggaaaaaataggatagctatttgttttctacagtttctcttgtcaacttttggttttataatgaaattaggattagcaaacttggatcaaacataatctcctgcaatgttgtaccctaaaacataattgcaaacaagcttcattgttggatttc

SEQ ID NO: 7745 - DNA, 1728 bp, Actinidia deliciosa
  misc_feature (1209)..(1209): n is a, c, g, or t
  misc_feature (1224)..(1224): n is a, c, g, or t
  misc_feature (1239)..(1239): n is a, c, g, or t
  misc_feature (1287)..(1287): n is a, c, g, or t
  misc_feature (1362)..(1362): n is a, c, g, or t
  misc_feature (1425)..(1425): n is a, c, g, or t
  misc_feature (1488)..(1488): n is a, c, g, or t
  misc_feature (1550)..(1550): n is a, c, g, or t
  misc_feature (1553)..(1553): n is a, c, g, or t
  misc_feature (1615)..(1615): n is a, c, g, or t
  misc_feature (1619)..(1619): n is a, c, g, or t
attcttcactctagagagagaagcgagcttttccccgatccacatctagatctagagagagtgaaaatggctcttctagtcgagaaaaccaccactggccgcgagtacaaggtcaaggacatgtctcaggccgacttcggcaggctcgagatcgagctggccgaggtcgaaatgcccggtctgatgtcgtgccgggccgagtttgggccgtcccagcccttcaagggggcccggatcaccgggtctctccacatgaccatccagacggcggtcctgatcgagacgctgacggcgttgggtgcggaggtgcggtggtgctcctgcaacatcttctccacacaggaccacgccgcctccgccatagctcgcgactccgctgccgtcttcgcctggaagggcgagaccctccaggagtactggtggtgcaccgagcgcgccctcgactggggccccggcggcggccccgacctcatcgtcgacgacggaggcgacgccaccctcctcatccacgagggggtcaaggctgaggaggagtacgagaagaccggggccgtgcccgacccggcgtccaccgacaacgccgagttccagatcgtgctcaccatcatcagggacggactcaagaccgacccgaagaggtaccacaagatgaaggagagattggtgggggtgtcggaggagaccaccaccggcgtcaagaggctctaccagatgcaggccagtgggaccctgctgttcccggctatcaatgtcaatgactccgtcaccaagagcaagtttgataacttgtatggatgccgccactccctccccgatggtctgatgagagccactgatgttatgattgccggaaaggttgcagttgtctgcggttatggggatgtcggcaagggctgtgcggctgccttgaagcaagcaggagcccgggtgattgtgactgagattgatcctatttgtgctcttcaggctcttatggagggcctccaagttctaacccttgaagacgtggtctcagagaccgatattttcgttactaccaccggtaacaaggacatcatcatggtggaccacatgaaaaagatgaagaacaatgccattgtctgtaacattggtcattttgacaacgaaattgacatgcacgggcttgagacctacccaggcgtgcagagaatcacaattaaaccccaaactgacaggtgggttttcccngacaccaagtcaggnatcattatcttggcngaggggcggctcatgaacttgggttgtgccaccgggcatcccagcttngtgatgtcttgctctttcaccaatcaagtgattgcgcagctcgagctgtggaaggagaaggctaccggcaagtangagaagaaggtttatgtcttgcccaagcaccttgatgagaaggttgccgcacttcacctcgcnaagcttggagctaggcttaccaagctcagcaaggaccaggctgattacattagcgtgccggtngagggtccttacaagcctgctcactacaggtactgaggagagagagagggagaagagagagntcnaaagatacaatattttatcggcatgattgtttcccattgtcaccctttgatttgaagtaganttanagtttttgaatttttatgattgtattgtgttgtggttgggaggtttggaggaggaaggaaaaatggtttcttctttgtgaaggagacccaatgggttgcaataacgttt

SEQ ID NO: 7746 - DNA, 1836 bp, Glycine max
atcccagctcgcagagagagagagagagagagagagagagagagagagagagagagatctatctatctatcaagatggcgttgttggttgagaaaacaagcagtggaagggagtacaaggtgaaggacatgacgcaagccgatttcggaagattggaaatcgagctggcggaggttgaaatgcccggcctcatgtcctcccgcaccgagttcggcccctctcaacccttcaagggcgctaggatcaccggctccctccacatgaccatccaaaccgccgtcctcatcgagaccctcaccgccctcggcgccgaggtccgctggtgctcctgcaacatcttctccacccaggaccatgccgccgccgccatcgcccgcgacagcgcctccgtcttcgcctggaagggtgagaccctccaggaatactggtggtgcaccgagcgcgccctcgactggggccccggcggcggccccgatctcatcgtcgacgacggcggcgacaccactcttctcattcacgagggcgtcaaggccgaggagatctttgagaagaccggccagttccccgacccggcttcctccgacaatgcggagttccagatcgtgctgagcatcatcagggatggcttgaagaccgatcccaagaggtaccacaagatgaaggacagaatcgtcggtgtctccgaagaaaccaccaccggtgtcaagaggctctaccagatgcaggccaatggctccctcttgttccctgccatcaacgtcaatgactcggtcaccaagagcaagtttgataacttgtatggatgccgtcactcgcttcccgatggactgatgagagccactgatgtgatgattgccggaaaggtagctgttgtgtgtggctacggagacgttggcaagggttgtgcttcggccatgaagcaagccggggctcgtgtcattgtcaccgagattgatcccatttgtgcccttcaggctctaatggagggtcttcaggttctcaccctggaagatgttgtctccgaggccgacatcttcgtcaccaccacagggaacaaggacattatcatgcttgaccacatgaagaagatgaagaacaatgccatcgtgtgcaacattggccacttcgacaacgaaatcgacatgctggggcttgagacctgccctggtgtgaagcgcatcaacatcaagcctcaaacagacagatgggttttccccgataccaagagggggatcatcgtgttggcagagggtcgtttgatgaacttggggtgtgccacgggacaccccagctttgtgatgtcgtgctccttcaccaaccaggtcattgctcagcttgaattgtggaaagagaagggttctgggaagtatgagaagaaggtgtatgtgttgcccaagcaccttgacgagaaagtggcttctctccaccttggccagcttggagctaggctcaccaagctttccaaagaccaagctgattacatcagtgtgcctgttgagggtccatacaagcctgctcactacaggtactgatccatcctattgggggagaataaacctaaactatcctatcaattcccgaggcgtcattgttacactttcctttttggatttttcccattacaatttacatttgtggtagcataggagcttcttttttctttttttagtaggatcacaatgccattgggctgaaggttaagaccaaaattactcattgctttcaataaggctttggctgcggctgtctgggttatgatttagcagctttcatattaatttgttcctttccatctttgatatccgaaacataataagcaaaaaaatattgtttttt

SEQ ID NO: 7747 - DNA, 1962 bp, Cucumis melo
acatttctctcttccttctgcgatactcttctcttcttactcgcagaaacagagagttttttgtgttctttcttcccccaaatctctcacaatgtctctcatcgtcgagaagaccgccgccggccgtgagtacaaggtcaaggacatgtctcaggctgacttcggtcgtctcgagatcgagctcgccgaagttgaaatgcccggtctcatggcctgccgtaccgaatttggcccttcccagccattcaaaggagctcgcatcaccggttccctccacatgaccatccagaccgctgttctcatcgaaaccctcaccgctcttggcgcagaagtccgttggtgctcctgcaacattttctccactcaggaccacgccgctgctgcgattgctcgtgacagtgctgctgtcttcgcctggaaaggagagactcttcaggagtactggtggtgcactgagcgcgccttggattggggtcctggtggtggtccggatctgattgttgatgatggcggtgatgcaactctcttgattcacgagggagttaaggcggaggagatttatgagaagactggtgcccttcctgatcccgcttctactgataacgctgagtttcagatcgtgttgacaattattagagatggattgaaatctgaccctaagaggtaccacaagatgaaggagagattggttggtgtttctgaagagactaccactggtgttaagaggctttaccagatgcagtcaagtggaaccttgttgttccctgccattaatgtcaatgactctgtcactaagagcaagtttgacaacttgtatggatgccgtcactctctccctgatggtctgatgagagctaccgatgtcatgattgccggtaaggtagctgttgtgtgcggttatggagatgtaggaaagggttgtgctgctgccctcaagcaagctggagctcgtgtgatcgtgactgagatcgatccaatctgtgccctccaggctcttatggaaggccttcaagtactcaccctggaagatgttgtctcggaggctgatatcttcgtcaccaccaccggtaacaaggatatcatcatggttgatcacatgaggaagatgaagaacaatgccattgtttgcaacattggtcactttgacaacgagatcgacatgcttggtcttgagacttaccccggtgtgaagcgtatcaccatcaagcctcaaacagacaggtgggtcttccctgaaaccaatgtcggcatcattgtgttggccgaggggcgactcatgaacttaggttgtgccaccggacatcccagctttgtgatgtcctgctcattcacaaaccaagtgattgcacagctcgagctatggaacgagagggcatcaggaaagtatgagaagaaggtgtacgtgttgccaaagcacctcgacgagaaggtggctgcacttcacctgggcaaactgggggctaagctaaccaagctgagcaaggatcaagctgactacatcaatgtgccagttgagggaccatacaagcctgctcactacaggtactgagaggagaattgtggaggcttcattttcacaacttagtgatttatggttaggaaaagttttaaggggttttgtgtgtgatttttaatgtgtttggggttagtggtttgaaggaaggggaaaagggtctgaatgttgaagaaagaccaatggggggggggggggtaacggggacgaataaggaaggtaagatttggttgtgtgaaaaatattactttgttcttcgttgtagttttattgtgaaattttttgctaaatccgtgtcatcgtttttatcggtgagaaagaaatgagaatgaaaaagcaaaaggaattactgcctttaatttaattgtttctctctgtggctgtcccgtaatttatggatattttgttccttccctttttctggcttaattttgagtttatttgtttac

SEQ ID NO: 7748 - DNA, 1679 bp, Helianthus annuus
ctctctctctgctttaacaaacagagagtgtttcagattggatcttaaaaccctaacccaccatgtctctaaccgttgagaaaacctccaccggccgtgaatacaaggtcaaggacatgtcgttggccgacttcgggcgtctggagctcgaattggccgaggttgagatgcccgggttgatgtcttgtcggactgaattcggaccttctcagccatttaagggagctaaaattaccggatcacttcatatgacaatccagaccggtgttcttattgagaccctaaccgctttgggcgcggaggtcagatggtgctcctgcaacattttctccacacaggatcatgcagcggctgccattgctcgtgattcggctgccgtgttcgcttggaaaggggaaactctccaggaatactggtggtgcacggagcgggcactcgactggggtcccggtggcgggcccgatctgattgtggacgatggtggtgatgcgacactgttgattcatgaaggagtgaaggctgaggaggagtttgcgaagacaggtaaattgcctgacccgacttccactgacaatgcagagttccagatcgtgttgtcgatcatcaaggaaggattgcaaaccgacccgaaaaaatatcacaaaatgaaggagagattagttggagtgtctgaagagaccaccactggtgtcaagaggttgtatcagatgcaggctaatggtacattgctgtttcctgccatcaatgtcaatgactctgtcaccaagagcaagtttgataacttgtacggatgccgccactctctgcccgatggtttaatgagagccactgatgtcatgatagccggaaaggtagcagtggtctgcggttacggagatgttggaaagggttgcgctgctgcaatgaaacaagccggtgcgcgtgtcatcgttacagaaatagaccccatctgcgcccttcaggctctcatggaaggtctccaagtcctaaccttagaagatgtcctttctgaagccgatatcttcgtgaccaccaccggtaacaaggatatcatcatggttgaccacatgaagaaaatgaagaacaacgcaatcatctgcaacatcggtcacttcgacaatgagatcgacatgctcggtctggaaacataccctggtgtcaaacgaatcaccatcaagccccaaacggaccgatgggtgttccctgagaccaagagtggtgtcattgttttagctgagggtcggctcatgaacttgggttgtgcaacgggtcacccgagttttgtgatgtcgtgctcgtttactaaccaagtgatcgcgcagcttgagctgtggaacgagaaggggaaggggaagtacaagaatgaagtgtatgtgttgcctaagcatcttgatgagaaagtggctgcacttcatcttggtaagcttggagccaggctcactaagctcaccaaggaccaggctgattacattagtgtgccggttgatggtccatacaagcctgctcactacaggtattgagcgatgaggattcaggggagcaatgtgtgcttgttttctttattaaatacatgttgaattatgggagagggtcatgatatgagtgtttctacacatgtactaatacaaatttgatgattttgttgaataacccaaaatgagaatggaaatgctttaatg

SEQ ID NO: 7749 - DNA, 1990 bp, Malus domestica
gcactaatccctcactcgcaaagacaagccctagttttgcagagtgagagagattaccacctccgatacccgcaatggctctctccgtcgagaaaagtagcagcggccgcgagtacaaggtcaaggacatgtcccaggccgacttcggccgcctcgagatcgagctcgccgaggtcgaaatgcccggcctcgtctcctgccgcaccgaattcggaccctcccaacccttcaagggggcccgcatcaccggatccctccacatgaccatccagaccgccgtcctcatcgaaaccctcaccgccctcggcgccgaggtccgctggtgctcctgcaacattttctccacccaggaccacgcagccgccgccatcgcccgtgacagcgccgccgtctttgcctggaagggcgagaccctccaggagtactggtggtgcaccgagcgcgccctcgactggggccccggtggtggacccgatctgatcgtcgacgacggcggtgacgccaccctcttgatccacgagggagtcaaggccgaggaggagttcgcgaagtccgggactctccccgacccgtcttccaccgataaccaggagttccagctcgttctgaccatcatcagagatggcttgaagaccgaccccaagaggtaccacaagatgaaggacaggttggtcggagtctcggaggagaccaccaccggcgtcaagagattgtatcagatgcaggccagcggcgctctcttgttccccgccatcaatgtcaacgactctgttaccaagagcaagtttgacaacttgtacggatgccgtcactctctccccgatggtttgatgagagccactgatgttatgattgccggaaaggtttccgttgtctgtggatatggagatgtcggaaagggttgtgctgctgccctcaagcaagctggatcccgcgtggttgtgactgagattgatccaatctgtgccctccaggctcttatggaaggccttcaggttcttccccttgaggatgttgtcgctgaggccgatatctttgttaccaccaccggtaacaaggacatcatcatggttgaccacatgaagaagatgaagaacaatgccattgtttgcaacattggtcattttgacaatgagattgacatgcatggtcttgagacataccccggagtgaagcgcatcaccatcaagcctcaaaccgacaggtgggtcttccccgagaccaaatccggcatcattgtgttggctgagggccgtctcatgaacttgggctgtgccactggacaccccagctttgtgatgtcctgctctttcaccaaccaagtgattgctcagctcgagttgtggaatgagaggaagtccggcaagtacgagaagaaggtgtatgtcttgcccaagcaccttgatgagaaggttgctgcccttcatcttggaaagcttggagctaagctcaccaagctcaccaaagagcaggctgactacatcagcgtgccggtcgagggtccatacaagccagctgcctacaggtactgaagaggggtcgtcaatgagacgagaaatgagaaaaagaaaactatatctggacgacgggttgttttttgcttttgattattttcacttgtgatgaaatgcggtagattttctaggtttataaattttgtaggagtttgtgtcggtgggtttcggagggtatgggatgtgtgagggaaagggatgatttaggtctcaatggaagacctaggggcttgaataagggaatgggacgggggttgtgtgggataatttctgctgcagcatcacttgtgtgctgcatccggttatctatcgttttactaccaagaaatggattaaaaaaaaaaaaactatttaccgtcatttggagttttggttcgattcgtcctcggtgttacgattggattcattttgtttgtttttgcgtttgcctatccgattgcttttgatgtttgtgaatttataaggtttttttagct

SEQ ID NO: 7750 - DNA, 1787 bp, Euonymus alatus
ggcgtcaaacactccccactctcctcttttcttacttctgaatctgaatctcagatctatcatcacaaatggctttgctcgtcgagaagacagacggtggccgggagtacaaggtcaaggacacgtccctcgccgacttcggccgcctcgagattgatcttgccgaggttgagatgccggggctcatgtcctgccgtacagagtacggcccttctcagccctttaagggtgccaagatcactggatccctccacatgaccatccagaccgccgtcctcattgagaccctcaccgcacttggcgccgaggttcgctggtgttcctgcaacattttctctactcaggaccacgctgctgctgcaatcgcccgagacagtgctgcggtcttcgcctggaagggtgagactcttcaggagtactggtggtgcaccgagcgtgctctcgattggggtcccggtggtggccctgacctaattgtcgatgacggaggtgatgctactctcttgatccacgagggtgttaaggctgaggagatctatgagaagaccggacagtctcccgaccctgcctccaccgacaatgctgagttccagatcgtattgactatcatcagagatggcctcaagaccgatcccaagaagtaccacaaaatgaaggagagattggtgggtgtttcagaggagacaacaactggagtcaagaggctgtaccagatgcagataaatgggactctgttgttccctgccattaatgtcaatgactctgtcaccaagagcaagtttgataacttgtatggttgccgccactcgctccccgatggcctgatgagagctaccgatgtcatgattgctggcaaggttggtgttgtatgcggtttcggtgatgtgggcaagggctgtgctgctgccttgaagcaagctggagctcgtgtgattgtgacagagattgaccccatttgtgcccttcaggcccttatggagggataccaagtcctgactttggaggatgtggtctctgaggctgacatctttgttaccaccactggcaacaaggacatcatcatggtcgatcacatgaggaagatgaagaacaatgcaattgtttgcaacattgggcactttgataatgaaattgacatgcttggacttgaaacctaccctggtgtgaagcgtatcaccatcaagccccaaactgataggtgggtcttcccggacaccaactcaggcatcattgtattggctgaagggcggctcatgaacttgggttgtgccactggacaccccagctttgtcatgtcatgctcattcacaaaccaggtgattgcacagcttgagctatggcttgagaagagctctggcaagtatgagaagaaagtgtatgttttgcccaagcaccttgatgagaaggtggctgcccttcacctcgggaagcttggggctaagcttaccaagctcagcaaggaccaggctgactacatcaatgttccggttgagggtccttacaagcctgctcaatacaggtactgagtggaggaaattgccagtcttgagacaagattttacaaggggacggcttggttgttttcttttacaatatgatgttgatttgcagtagaacgctaggttttcaattagggtttttgtgttgaacgatgtggagggaagtgaatgaacttcccaccccgtctgtgagaggaatgggccaggtgagaactgaataagggtttgaaggctgtgtggggtggagtaccaattttttttgcagtttgtctttgtttatgttttcaa

SEQ ID NO: 7751 - DNA, 1905 bp, Euonymus alatus
ccctacgtctacatcatttaccagatccaccaacttctctcaccaaatctctcagctgccaaccactagtctcgacttgcctatatatacatcctcactcgtcctcctaaacactcgctcaaaacccactctccctctctgcggctccgaaatcagaatctcatatctacgtctccgaaatggctttgctcgtcgagaaaaccgccggaggccgcgagtacaaggtcaaggacacgtcccttgctgacttcggccgcctcgaaatcgagctcgccgaggtcgagatgcctgggctcatgtcctgccggaccgagtacggtccctctcagccattcaagggtgccaagatcaccggctccctccacatgactatccagacagccgttctcatcgagaccctcaccgcactcggggccgaggtccgttggtgctcctgcaatattttctcgactcaggaccacgccgccgccgctattgctcgtgacagcgctgctgtgttcgcttggaagggtgagactcttcaggagtactggtggtgtaccgagcgtgcccttgattggggtcctgatggtggccctgacctgattgttgatgacggaggtgatgctactctgttgattcatgagggggttaaggccgaggagatttatgagaagacagggacgttcccggatccggcatctactgacaatgctgagttccagatcgtcttgactatcatccgagatgggctcaagaccgatcccaagaggtaccacaagatgaaggagagattggttggtgtttctgaggagaccacaactggagttaagaggctgtaccagatgcagatcaacgggactctcttgttccctgctatcaatgtcaacgattctgtcaccaagagcaagtttgataatttgtatggttgccgccactcactccctgatggcctgatgagggctactgatgtcatgattgccggcaaggttggtgttgtctgtggttttggagatgtgggcaagggctgtgctgctgctttgaagcaagccggagcgcgtgtgatcgtgaccgagatagaccctatttgtgctcttcaggctctgatggagggataccaagtcctgacccttgaggatgttgtttctgatgctgacatcttcgtcaccaccaccggcaacaaggacatcatcatggttgaccacatgaggaagatgaagaacaatgccattgtttgcaacattggtcactttgataatgagattgacatgcttgggcttgaaaccttccctggtgtgaagagaatcaccatcaagccccaaactgataggtgggtcttccctgacaccaactcaggcatcattgtgttggctgaaggacgactcatgaacttgggttgtgccactggccaccctagttttgtcatgtcatgctcattcacaaaccaggtgattgcacagctcgagctctggacggagaagagcactggaaagtatgagaagaaggtgtatgttttgcctaagcaccttgatgagaaggtggctgctcttcaccttgggaagcttggggctaggcttaccaagctcagcaaggaccaggctgactacatcagtgttccagttgaaggtccatacaagcctgctcattacaggtattgagggataaactctcaataatttgtgagaaaaaaaacacccttgcggcttgattgtttcttttacaagatgaagttgatttgcagtagaatgctaggttttgagttttgtagggcttttttttgtgtgtttttgtttggaagttttggagggaaggaactgaattccgcttctgtttaagtaaagtaaggttgtttatcgcggaattgagtaaagtttgcattttgcggtgcagacaattatgaaatatgaactacttcacttgaggtta

SEQ ID NO: 7752 - DNA, 1825 bp, Solanum lycopersicum
cttgccacacttcttcttcttccctgaaaaaccccaaaggaagaagagaaaagcctctcagatctcatcttaaaccttttcttttctcttatactcgccttacccatggctctactcgttgagaagaccacctctggccgcgagtacaaggtgaaggacatgtctcaggctgacttcggcaggctcgaaattgagcttgctgaagttgaaatgcctggtctcatggcttcacgtgctgaatttggcccttcacagccctttaaaggtgcaaagatcactggatctctgcatatgactatccaaactgctgtccttattgaaaccctaactgctttgggtgctgaagttagatggtgttcttgcaacatcttctcaactcaggaccatgctgcagcagccattgcacgtgacagtgctgctgtttttgcctggaaaggtgagactttgcaggagtactggtggtgtactgagagggcacttgactggggtccaggtggtggtcctgatctgattgttgatgatggaggtgatgctactctgttgattcatgagggagttaaggctgaagaggagtttgctaagaatggaacagtcccagatcccacttctactgacaatgttgagtttcaacttgtgcttactattattaaggagagcttaaagactgatcctttaaggtacactaagatgaaggagagacttgttggtgtttctgaggaaactaccactggtgttaagaggctttaccaaatgcaggctaatggatctttgcttttccctgctatcaatgttaatgactctgttaccaagagcaagtttgacaacttgtatggatgccgccactcacttcccgatggtctcatgagggctactgatgttatgattgctggaaaggttgctcttgttgctggttatggagatgtcggcaagggatgtgctgctgccatgaaacaagctggtgcccgtgtgattgtgactgagattgacccaatctgtgctctccaggctaccatggaaggcctccaggttcttcctcttgaggatgttgtttctgaggttgatatctttgtgaccaccactggtaacaaggacatcattatggttgaccacatgaggaagatgaagaacaatgctattgtctgcaacattggtcactttgacaacgaaatcgacatgcatggtcttgagaccttccctggtgtgaagaggatcacaatcaagccacaaaccgacagatgggtcttcccagacaccaacagtggcatcattgtgttggccgagggtcgtctcatgaacttgggatgtgccactggacaccctagttttgtgatgtcttgctctttcactaaccaagtcattgctcaactcgagttgtggaatgagaggagcagtggcaaatacgagaagaaggtgtacgtcttgccaaagcaccttgacgagaaggttgctgcccttcatcttggaaagctcggagccaagcttaccaaactcaccaaggatcaagctgactacattagtgtaccagttgagggtccttacaagcctgctcactacaggtactgaggggaagagacgctcacagtggaacaacgatacggcggcatgattgttttgtttttaatacttttattttgtttaggtagtgtgtttttatttttgttgggggatgttttgcgggaaagttgacctaaatgtgtttgaataatatttgaattatggttggggtggtgtcatatgatattgtaccaagttagattcatttgctttcttgtttctataaaatttgcttcaaggaaacaaagcatcatgtttttcattttcacta

SEQ ID NO: 7753 - DNA, 1830 bp, Linum usitatissimum
ctcatttctcagatcccaaagcgccggtaattgttttcgtgctagaatggctctcatcgtcgacaaaaccaccaccggccgtgagtacaaggtcaaggacatgtcccaggccgacttcggccgcctcgagctcgagcttgccgaggttgagatgcctggactcatgtcctgccgtactgagttcggcccatcacagccgttcaagggtgccaggatcaccggatccctccacatgaccatccagaccgctgtcctaatcgagaccctcaccgccttgggagctgaggtccgttggtgttcgtgcaacatcttcagcacccaggaccacgctgccgccgccatcgcccgtgactccgccgctgtcttcgcctggaagggagagaccctccaggagtactggtggtgtaccgagagggctcttgactggggtcccgatggaggccctgatctgattgttgacgatggaggtgatgccactctcttgatccacgagggtgtcaaggcggaggaggagtatgagaagtctggaaagatcccagaccctgcttccaccgacaacgccgagttccagattgttctcaccatcatcagggacggcttgaagactgaccccaagaagtaccgcaagatgagggacagattggttggcgtttctgaggagaccaccactggtgtcaagaggctctaccagatgcaagagaatggaacacttctcttccctgctatcaatgtcaacgactctgtcaccaagagcaagttcgataacttgtatggttgccgtcactccctccccgatggtctgatgagggctactgatgttatgattgccggaaaggttgctgttgttttgggatatggtgatgttggaaagggatgtgctgctgccatgaagcaggctggagctcgcgtcattgtgaccgagattgatcccatctgtgcccttcaggctcttatggaaggtctccaggtgttgacccttgaggattgcgttgctgaggctgacatcttcgtcaccactactggaaacaaggacatcatcatggttgacgacatgaggaagatgaagaacaacgccattgtatgcaacatcggtcactttgacaatgagattgacatgaatggtcttgagaccttccctggagtgaagcgcatcaccataaagccccagaccgacaggtgggtgttcccagacaccaagagcggcatcattgtgttggcagagggacgtctcatgaatttgggatgtgcaactggtcaccccagctttgtgatgtcctgctccttcaccaaccaggtgattgctcagcttgagctctggaacgagagatccagtggcaagtatgagaagaaggtgtacgttctgcccaagcaccttgacgagaaggtggctttgctccatcttggaaagcttggagctaggctcacaaagttgtccaaggaccaggctgactacatcagcgttccagttgagggtccttacaagcctgctcactacaggtactgagcaaacgaagttataaggggattggagtggaagaagaaccagatttgcttttggtggaaaatgcggcgatccgttggtttgttttccatttgtgttagaatgtgtttaggttttggttttaatgttgatggtgttatggtctgggaagggaagggtgagagggctttcgggggaatggatgaataagggcatctgggaatgggggttgtgtctgacagaattcttttggttttattttcgcgaatttggattttctgccatgctgcctgaggcgctggctttatcatataaaattttagaatgaaaatgaagagttgtttgccttc

SEQ ID NO: 7754 - DNA, 1801 bp, Solanum tuberosum
gagaaaatcgcctctttctctcaatttcatctcaaattcacccaatttctctcagtttttcgcctatactcgccttacccatggctctacttgttgagaagaccacctctggccgcgagtacaaggtgaaggacatgtcccaggctgacttcggcaggctcgaaatcgagcttgccgaagtcgaaatgcctggtctcatggcttcccgtactgaatttggcccttcacagccctttaaaggtgcaaagatcactggatctctgcatatgactatccaaactgctgtccttattgaaaccctaactgcgttgggtgctgaagttagatggtgttcttgcaacatcttctcaactcaggatcatgctgcagcagccattgcacgtgacagtgctgctgtttttgcctggaaaggtgagactttgcaggagtactggtggtgtactgagagagcacttgattggggtccaggtggtggacctgatctgattgttgatgatggaggtgatgctactctgttgattcacgagggagttaaggcagaggaggagttcgctaagaatgggacaatcccagatcctacttctactgacaatgttgagtttcaacttgtgcttactattattaaggagagcttaaagactgatcctttaaggtacactaagatgaaggagagacttgttggtgtttctgaggaaactaccactggtgttaagaggctttaccaaatgcaggctaatggaactttgcttttccctgctattaatgttaatgactctgttaccaagagcaagtttgacaacttgtatggatgccgccactcacttcccgatggtctcatgagggctactgatgttatgattgctggaaaggttgctcttgttgctggttatggagatgtcggcaagggatgtgctgctgccatgaaacaagctggtgcccgtgtgattgtgactgagattgacccaatctgtgctcttcaggctaccatggaaggactccaggttcttcctcttgaggatgttgtttctgaggttgatatctttgtgaccaccactggtaacaaggacatcatcatggttgaccacatgaggaagatgaagaacaatgccattgtctgcaacattggtcactttgacaatgaaatcgacatgcatggtcttgagaccttccctggtgtgaagaggatcacaatcaagccacaaaccgacagatgggtcttcccagacaccaagagtggcatcattgtcttggccgagggtcgtctcatgaacttgggatgtgccactggacaccccagttttgtgatgtcttgctctttcactaaccaagtcattgcccaactcgagttgtggaatgagagaaccagtggtaaatacgagaagaaggtgtacgtcttgccaaagcaccttgacgagaaggttgctgccttgcatcttggaaagctcggagctaagcttaccaaactcaccaaggatcaagctgactatattagcgtaccagttgagggtccttacaagcctgctcactacaggtactgagggcaagagacactcacagtggaacaacgatatcgcggcatgattgttttgtttttaatactttgattttgtttaggtagtgtgtttttattattgttggggggaagttggcatgttttgctggaaagtttacctaaatgtgtttgaataatatttgaattatggttggggtggtgtcatatgatgatattgtactaagttagattcatttgcttttattttttctataaaatttgcttcaaggaaacaaagcatcatgtttt

SEQ ID NO: 7755 - DNA, 1811 bp, Solanum phureja
gcaacactcttcttcttcccttaaaacccaaaggaagaaaagaaaatcgcctctttctctgaatttcatctcaaattcacccattttctctcagtttttctcttatactcgccttacccatggctctacttgttgagaagaccacctctggccgcgagtacaaggtgaaggacatgtcccaggctgacttcggcaggctcgaaatcgagcttgccgaagtcgaaatgcctggtctcatggcttcccgtactgaatttggcccttcacagcccttcaaaggtgcaaagatcactggatctctgcatatgactatccaaactgctgtccttattgaaaccctaactgctttgggtgctgaagttagatggtgttcttgcaacatcttctcaactcaggatcatgctgcagcagccattgcacgtgacagtgctgctgtttttgcctggaaaggtgagactttgcaggagtactggtggtgtactgagagggcacttgattggggtccaggtggtggtcctgatctgattgttgatgatggtggtgatgctacactcttgattcatgagggtgttaaggcagaggaggagtttgctaagaatggggcaatcccagatcctacttctactgataacgttgagtttcaacttgtgcttactattattaaggagagtttaaagactgatcctttaaggtacactaagatgaaggagagacttgttggtgtttctgaggaaactaccactggtgttaagaggctttaccaaatgcaggctaatggaactttactattccctgctattaatgttaatgactctgttaccaagagcaagtttgacaacttgtatggatgccgccattcacttcccgatggtctcatgagggcgactgatgttatgattgctggaaaggttgcccttgttgctggttatggagatgtcggcaagggatgtgctgctgccatgaaacaagcaggtgcccgtgttattgtgactgagattgacccaatctgtgctctccaggctaccatggaaggcctccaggttcttcctcttgaggatgttgtttctgaggttgatatctttgtgaccacaaccggtaacaaggacatcatcatggttgaccacatgaggaagatgaagaacaatgccattgtctgcaacattggtcactttgacaatgaaatcgacatgcatggtcttgagaccttccctggtgtgaagaggatcacaatcaagcctcaaaccgacagatgggttttcccagacagcaagagtggcatcattgtcttggccgaaggtcgtctcatgaacttgggatgtgccacaggacaccccagttttgtgatgtcctgctctttcactaaccaagtcattgcccaactcgagttgtggaatgagaagaaaagtggcaaatacgagaagaaggtgtatgttttgccaaagcacctcgacgagaaggttgctgcccttcatcttggaaagcttggagccaagcttaccaaacttaccaaggatcaagccgactacatcagcgtaccagttgagggtccttacaagcctgctcactacaggtactgagggaagacaatttgacagaggaacaatattgtcgcggcatgattattttgctttgaatactttgagtttgtttaggataatagtgttttgattattgttggggatatatttgggaggaagttggcatgttttgctgaaaaaaatggtctcatttgaaagaagaccaaaatgttttaataatatttgagttatggttggtggtgtgctaagttacctccatttgccttttggtta

SEQ ID NO: 7756 - DNA, 2042 bp, Nicotiana tabacum
gcggccgcgggggcaacgctcttctcctctaaaaacccctttagaagaagagaaaaaagcctctcaaatctcatctctaaccacccaatttctcatactcgctctacccatggctctattagtcgagaagaccacctctggccgcgagtacaaggtcaaggacatgtctcaggccgatttcggccggcttgaaatcgagctggccgaagttgaaatgcctggtctcatggcttgtcgtactgaatttggcccttcacagccatttaaaggtgctaagattactggatctttacatatgaccattcaaactgcagttttgattgaaacccttactgctttgggtgctgaagttagatggtgttcttgcaacatcttctccactcaagatcacgccgctgctgccattgcacgtgacagcgccgccgtgttcgcgtggaagggtgagactctgcaggagtattggtggtgtactgagagggcacttgactggggtccaggtggtgggcccgacttgatcgtcgacgatggtggtgatgctacactcttgattcatgagggtgttaaggcagaagaagagtttgctaagaatgggacaatcccagatcctaactctaccgataatgctgagtttcagcttgtacttactattattaaggaaagtttgaagactgatcctttaaaatataccaagatgaaggaaagactcgtcggtgtttctgaggaaactaccactggagttaagaggctttatcagatgcaggctaatggaactttgcttttccctgctattaatgttaatgattctgttaccaagagcaagttcgacaacttgtacggatgccgccactcactgcccgatggtctcatgagggctactgatgttatgattgccggaaaggttgcccttgttgctggttatggagatgtcggcaagggttgtgctgctgccttgaaacaagccggtgcccgtgtgattgtgaccgagattgaccctatctgtgctctccaggctaccatggaaggcctccaggtccttactctagaggatgtcgtttctgatgttgatatctttgtcaccacgaccggtaacaaggacattatcatggttgaccacatgaggaagatgaagaacaatgccattgtttgcaacattggtcactttgacaacgaaatcgacatgcttggtctcgagacctaccctggtgtcaagaggatcacaattaagcctcaaaccgacagatgggtcttccctgacaccaacagtggcatcattgtcttggctgagggtcgtctcatgaacttgggatgtgccacaggacaccctagttttgtgatgtcgtgctcgttcactaaccaagtcattgcccaactcgagttgtggaatgaaaagagcagtgggaagtatgagaagaaagtgtatgtcttgccaaaacacctcgacgagaaggttgctgcacttcatctcggaaagctcggagccaagcttaccaaactttcgaaggatcaagctgactacattagcgttccagttgagggtccttacaagcctgctcactacaggtactgagcgaaaacaaatcgacagaggagaacagcattgtcgcggcatgattgttttgcatttaatactttgattttgtttaggatactagtattttgaatattggtggtgatatatttgggaggaagtggcatgttttgctggaaaagaaatgggtcttatttgaaagtaagaccaaaatgtgttgaataagattatggttggtggtgtgatatgatattgtagtaagttagaaccatttgctttttggtgtatggtttttgtttcaagaaatcaaagcaacacttttaccaaaaaaaaaaaaaaaaaaaaaaaaaaaaaaaaaaaaaaaaaaaaaaaaagaaaaaaaaaaaaaaaaaaaaaaaaaaaacttgtcccccagggggaaaaattttagctcggccgaattggccaattccccccataggggggcgtataaaaattcacggggcgccgtttttcaacgccgggacggggaaaa

SEQ ID NO: 7757 - DNA, 1823 bp, Solanum lycopersicum
tgccacacttcttcttcttccctgaaaaaccccaaaggaagaagagaaaagcctctcagatctcatcttaaaccctttcttttctcttatactcgccttacccatggctctactcgttgagaagaccacctctggccgcgagtacaaggtgaaggacatgtctcaggctgacttcggcaggctcgaaattgagcttgctgaagttgaaatgcctggtctcatggcttcacgtgctgaatttggcccttcacagccctttaaaggtgcaaagatcactggatctctgcatatgactatccaaactgctgtccttattgaaaccctaactgctttgggtgctgaagttagatggtgttcttgcaacatcttctcaactcaggaccatgctgcagcagccattgcacgtgacagtgctgctgtctttgcctggaaaggtgagactttgcaggagtactggtggtgtactgagagggcacttgactggggtccaggtggtggtcctgatctgattgttgatgatggaggtgatgctactctgttgattcatgagggagttaaggctgaagaggagtttgctaagaatggaacagtcccagatcccacttctactgacaatgttgagtttcaacttgtgcttactattattaaggagagcttaaagactgatcctttaaggtacactaagatgaaggagagacttgttggtgtttctgaggaaactaccactggtgttaagaggctttaccaaatgcaggctaatggatctttgcttttccctgctatcaatgttaatgactctgttaccaagagcaagtttgacaacttgtatggatgccgccactcacttcccgatggtctcatgagggctactgatgttatgattgctggaaaggttgctcttgttgctggttatggagatgtcggcaagggatgtgctgctgccatgaaacaagctggtgcccgtgtgattgtgactgagattgacccaatctgtgctctccaggctaccatggaaggcctccaggttcttcctcttgaggatgttgtttctgaggttgatatctttgtgaccaccactggtaacaaggacatcattatggttgaccacatgaggaagatgaagaacaatgctattgtctgcaacattggtcactttgacaacgaaatcgacatgcatggtcttgagaccttccctggtgtgaagaggatcacaatcaagccacaaaccgacagatgggtcttcccagacaccaacagtggcatcattgtgttggccgagggtcgtctcatgaacttgggatgtgccactggacaccctagttttgtgatgtcttgctctttcactaaccaagtcattgctcaactcgagttgtggaatgagaggagcagtggcaaatacgagaagaaggtgtacgtcttgccaaagcaccttgacgagaaggttgctgcccttcatcttggaaagctcggagccaagcttaccaaactcaccaaggatcaagctgactacattagtgtaccagttgagggtccttacaagcctgctcactacaggtactgaggggaagagacgctcacagtggaacaacgatacggcggcatgattgttttgtttttaatacttttattttgtttaggtagtgtgtttttatttttgttgggggatgttttgctggaaagttgacctaaatgtgtttgaataatatttgaattatggttggggtggtgtcatatgatattgtaccaagttagattcatttgctttcttgtttctataaaatttgcttcaaggaaacaaagcatcatgtttttcattttcacta

SEQ ID NO: 7758 - DNA, 1815 bp, Cenchrus ciliaris
  misc_feature (227)..(227): n is a, c, g, or t
  misc_feature (308)..(308): n is a, c, g, or t
  misc_feature (368)..(368): n is a, c, g, or t
  misc_feature (407)..(407): n is a, c, g, or t
  misc_feature (944)..(944): n is a, c, g, or t
  misc_feature (956)..(956): n is a, c, g, or t
  misc_feature (989)..(989): n is a, c, g, or t
ctcccccctccttccatcacctctcagatccaatccgcgagctctccctccaccagtccgctgccatggcgctctccgtggagaagacctcgtcggggcgggagtacaaggtcaaggacctgtcccaggccgacttcggccgcctcgagatcgagctggctgaggtcgagatgcccgggctcatggcctgccgcaccgagttcggcccgtccaagcccttcgccggngccaggatctcgggctccctccacatgaccatccagaccgccgtcctcatcgagaccctcaccgcgctcggcgccgaggtncgctggtgctcctgcaacatcttctccacgcaggaccacgccgccgccgccatcgcgcgngactccgccgcggtcttcgcctggaagggggagaccctngaggagtactggtggtgcaccgagcgctgcctcgactggggcgagggcggcggccccgacctcatcgtcgacgacggtggtgacgctacgctcctcatccacgagggcgtcaaggccgaggaggagtatgagaagactggcaagatccccgacccggagtccaccgacaacgccgagttcaagatcgtgctcaccatcatccgcgacgggctcaagtctgaccccaagaagtaccgcaagatgaaggacagactcgtcggcgtctcggaggagaccaccaccggagtcaagaggctctaccagatgcaggagaccggcaccctcctcttccccgccatcaacgtcaacgactccgttaccaagagcaagtttgacaacctgtacggttgccgccactccctccctgatggtttgatgagggccactgatgttatgatcgctggcaaggttgcggttgtctgcggttatggtgatgttggcaagggttgtgctgctgccctcaagcaggctggtgcccgtgtcatcgtgactgagatngaccccatctgngcccttcaggccctgatggagggtcttcaggtncttaccttggaggatgtcgtctctgaagctgacatctttgtgaccaccactggcaacaaggacatcatcatggttgatcacatgaggaagatgaagaacaatgcaatcgtctgcaacattggtcactttgacaatgagattgacatgcacggtcttgagacctaccctggtgtcaagcgcatcaccatcaagccccagactgaccgctgggtgttccctgagaccaagactggcatcattgtccttgctgagggtcgtctgatgaaccttgggtgtgctactggccaccccagctttgtcatgtcctgctcattcactaaccaggtcattgctcagctcgagctgtggaaggagaagagctctggcaagtatgagaagaaggtgtacgtgctccccaagcaccttgatgagaaggttgctgctctccacttgggcaagcttggtgccaggctcaccaagctcaccaagtctcaggctgactacatcagcgtcccggttgagggtccctacaagcctgctcactaccggtactaggcttcccagcatgacgagaagctcattttgttggccggttgtgttgtgtgcccgtatgaagtttgctacaccggctgttcggttaacttttccatcgatatcaaatgcgccattggcgtaggaggggtcatcgcttgagcctggttgagtggggagaggagggaagagctgtttgcttttgcagaacaataatggcgaattggtcgtggggtgaggctgtgtgcgttgccagaaactataatcgtttctgattatcatttgcaagcgatttattatagttatctgtctttca

SEQ ID NO: 7759 - DNA, 1896 bp, Sorghum bicolor
atcgcgccctcgtctctccccataaaaccctcctcacccctgcctcccaacgccgccgtctcctcccctcctcccattccgtcccccctgcccagatccaattctcgacttctccgtccgccgctgccatggcgctctctgtggagaagacctcgtctgggcgggagcacaaggtcaaggacctctcgcaggcggacttcggccgcctggagatcgagctggccgaggtcgagatgcccggtctcatggcgtgccgcgccgagtttggcccgtccaagcccttcgccggcgctaggatctctgggtcgctccacatgaccatccagactgccgtcctcatcgagaccctcaccgcgctcggcgcggaggtccgctggtgctcctgcaacatcttctccacgcaggaccacgccgccgccgccatcgcgcgtgactcggccgccgtgttcgcctggaagggggagaccctcgaggagtactggtggtgcaccgagcgctgcctcgactggggcgagggcggcggtcccgacctcatcgtcgacgacggaggtgacgcaacgctgctcatccacgagggtgtcaaggccgaggaggagtacgagaagaccggcaagatccccgacccggagtccacagacaacgctgagttcaagatcgtgctcaccatcatccgcgacgggcttaaggctgaccctaagaagtaccgcaagatgaaggagaggcttgtcggcgtctctgaggagaccaccaccggagtcaagaggctctaccagatgcaggagaccggcgccctcctcttccctgctattaacgtcaacgactccgtcaccaagagcaagtttgacaacctgtatggttgccgccactccctccctgatggtctgatgagggccacagacgttatgattgctggcaaggttgccgtggtctgtggatacggtgatgttggcaagggctgtgctgctgcactcaagcaggctggtgcccgtgtcattgtgactgagatcgaccccatctgtgccctccaggctctgatggagggtcttcaggtccttacattggaggatgttgtctctgaggctgacatctttgtgaccaccaccggcaacaaggatatcatcatggttgaccacatgaggaagatgaagaacaatgccattgtctgcaacattggccactttgacaatgaaattgatatgcttggtctcgagacctaccctggtgttaagcgcatcaccatcaagccccagactgaccgctgggtgttccctgagaccaaaactggcatcattgtccttgctgagggtcgtttgatgaaccttgggtgtgctactggccatcctagctttgtaatgtcctgctcattcactaaccaggtcattgcccagcttgagctctggaaggagaagagctctggcaagtatgagaagaaggtgtatgtgctccccaagcaccttgatgagaaggttgctgctctccacttgggcaagcttggtgccaagctgaccaagctcaccaaatcccaggctgactacatcagcgtgccgatcgagggcccctacaagcctgcccactaccggtactaggcagcccagcacgacttccagctcactaggccggttgtgtgatatgaagtttgctacaccggctgtcagttatcttttgcatgcatatgcattgtcatatacgagctgaggggggatgcggtgaggtaaggggctgtttgcttcagctgaagaataatggtgttatcggcttggatgaggcgatgtgcgttgccagatacagttttgtcatgttgactctacttatctgattatcatttgtaagcgatttgctcaagttatgtgtcatttatgaataactttgcttttctcaagagcatacttagtctta

SEQ ID NO: 7760 - DNA, 2140 bp, Sorghum bicolor
ccccaacggcactcccacatggcctcacctcacccacccccaccaatcccccgctcagatccgacggccgctaatcgtcgcatccgcaaactaacggtatcgcgccctcgtctctccccataaaaccctcctcacccctgcctcccaacgccgccgtctcctcccctcctcccattccgtcccccctgcccagatccaattctcgacttctccgtccgccgctgccatggcgctctctgtggagaagacctcgtctgggcgggagcacaaggtcaaggacctctcgcaggcggacttcggccgcctggagatcgagctggccgaggtcgagatgcccggtctcatggcgtgccgcgccgagtttggcccgtccaagcccttcgccggcgctaggatctctgggtcgctccacatgaccatccagactgccgtcctcatcgagaccctcaccgcgctcggcgcggaggtccgctggtgctcctgcaacatcttctccacgcaggaccacgccgccgccgccatcgcgcgtgactcggccgccgtgttcgcctggaagggggagaccctcgaggagtactggtggtgcaccgagcgctgcctcgactggggcgagggcggcggtcccgacctcatcgtcgacgacggaggtgacgcaacgctgctcatccacgagggtgtcaaggccgaggaggagtacgagaagaccggcaagatccccgacccggagtccacagacaacgctgagttcaagatcgtgctcaccatcatccgcgacgggcttaaggctgaccctaagaagtaccgcaagatgaaggagaggcttgtcggcgtctctgaggagaccaccaccggagtcaagaggctctaccagatgcaggagaccggcgccctcctcttccctgctattaacgtcaacgactccgtcaccaagagcaagtttgacaacctgtatggttgccgccactccctccctgatggtctgatgagggccacagacgttatgattgctggcaaggttgccgtggtctgtggatacggtgatgttggcaagggctgtgctgctgcactcaagcaggctggtgcccgtgtcattgtgactgagatcgaccccatctgtgccctccaggctctgatggagggtcttcaggtccttacattggaggatgttgtctctgaggctgacatctttgtgaccaccaccggcaacaaggatatcatcatggttgaccacatgaggaagatgaagaacaatgccattgtctgcaacattggccactttgacaatgaaattgatatgcttggtctcgagacctaccctggtgttaagcgcatcaccatcaagccccagactgaccgctgggtgttccctgagaccaaaactggcatcattgtccttgctgagggtcgtttgatgaaccttgggtgtgctactggccatcctagctttgtaatgtcctgctcattcactaaccaggtcattgcccagcttgagctctggaaggagaagagctctggcaagtatgagaagaaggtgtatgtgctccccaagcaccttgatgagaaggttgctgctctccacttgggcaagcttggtgccaagctgaccaagctcaccaaatcccaggctgactacatcagcgtgccgatcgagggcccctacaagcctgcccactaccggtactaggcagcccagcacgacttccagctcactaggccggttgtgtgatatgaagtttgctacaccggctgtcagttatcttttgcatgcatatgcattgtcatatacgagctgaggggggatgcggtgaggtaaggggctgtttgcttcagctgaagaataatggtgttatcggcttggatgaggcgatgtgcgttgccagatacagttttgtcatgttgactctacttatctgattatcatttgtaagcgatttgctcaagttatgtgtcatttatgaataactttgcttttctcaagagcatacttagtcttatcctcaattgtcttgggtttggttggttgagtactttgattgtttgagttgcgttcaccaggatcgctgatatgttatttagcggttattgcatggttggtattcacgcgtgttttataaaatctgctagaaggcagacgcgttgt

SEQ ID NO: 7761 - DNA, 1486 bp, Triticum aestivum
gccagatccaatccaccaaccttctccatggcgctctccgtggagaagacctcgtcgggccgggagtacaaggtcaaggacctctcccaggccgacttcgggcgcctcgagctcgacctcgccgaggtcgagatgcccggcctcatggcctgccgcaccgagttcggtccctcgcagcccttcaagggcgcccggatctccggctccctccacatgaccatccagaccgccgtgctcatcgagaccctcaccgccctcggcgccgaggtccgctggtgctcctgcaacatcttctccacccaggaccacgccgccgccgccatcgcccgcgactccgccgccgtcttcgcctggaagggcgagaccctcgaggagtactggtggtgcaccgagcgctgcctcgactggggcgccggcggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaag

SEQ ID NO: 7762 - DNA, 1854 bp, Gossypium hirsutum
ttcaattcctcatttcaagggagagagtgtatcagtgtttcttcccctctttacttaatttctctccgccatggctctctccgtcgagaaaaccgccgccggccgtgagtacaaggtcaaagacatgtctcaggctgacttcggtcgtctcgagatcgagttagctgaggttgaaatgcctggtttaatggcttgtagaaccgagttcggccctgcccaacctttcaaaggagccaaaattactggttctcttcacatgaccatccaaaccgccgttcttattgaaacccttaccgccctcggagctgaagtccgttggtgctcttgcaacattttctctacccaagaccacgctgccgctgccatcgctcgtgactccgccgctgttttcgcttggaaaggggagaccctccaggaatactggtggtgtactgagagagcccttgattggggtcctactggtggacctgatctgatcgtcgatgatggtggtgatgctactttgttgatccacgaaggtgttaaagctgaggaagtttatgagaaaactggtcaactcccagatccggcttcgactgataacgctgagtttcagattgttttaaccattatcagagatgggttgaaagcagatcccaagaagtatagaaggatgaaggagagattggtaggtgtttctgaagaaactacaactggagttaagaggctttatcagatgcaggccaatggtaccttgttgttccctgccattaatgtcaacgactctgttactaagagcaagttcgataacttgtatggatgccgtcactcacttcccgatggtttgatgagagctactgatgtgatgattgccggcaaggtcgccgttgtctgtggttatggtgatgtcggaaagggttgtgctgctgccttgaagcaagccggtgctcgtgtcattgttactgagattgatcccatctgtgcccttcaggctctcatggaaggacttcaggttttgaccctagaagatgttgtctccgaggctgatatcttcgtcaccacaaccggtaacaaggacatcatcatggttgatcacatgaggaagatgaagaacaatgccattgtttgcaacattggtcactttgacaatgaaatcgatatgctcggtcttgagacctatcctggtgttaaacgcatcaccattaagcctcaaaccgataggtgggtcttccctgaaaccaaaactggcatcattgtgttggctgaaggacgtctgatgaacttgggatgtgccactggacacccaagttttgtcatgtcctgctcgttcactaaccaggtgattgcccagctcgagctatggaaggagaaggcaactggaaaatatgagaagaaggtttacgtattgccaaagcacctcgacgagaaagttgctgcacttcacctcggcaagctcggagctaagctcactaagctcactaaagatcaagctgattacattagtgtgcctgttgaaggtccttacaagcctcctcattacaggtactgagggggacagttaatgagtttttatcgagaaagaaaaagcatccggatggtttgattgtttcttgttttactgaaatttcatgatggttaggtttttgttttatttttagagttcttttttgtgtttgggtgatgggaaagtgtctggggatgggaaaatgatgtgggatttggtctcttcttgtttgaagatgaccaaatgggtttgaaataaaagtgtttgagggatgtgtggaagattatatagtatttgccattaatgcagtcttgttttgctgcattgctttttttaaagcaatttcattttatatacttcaataccaacat

SEQ ID NO: 7763 - DNA, 1831 bp, Actinidia deliciosa
ctccctctcattcttcactttagagagcgaagcgagcttttctcagatccacatctagatctagagagagaaaatgtctcttctagtcgagaaaaccaccagtggccgcgagtacaaggtcaaggacatgtctcaggccgacttcggccggctcgagatcgagcttgccgaggtcgaaatgcctggtctgatgtcgtgccggaccgagttcgggccgtcccagcccttcaagggggcccggatcaccggctccctccacatgaccatccagacggcggtcctgatcgagaccctgacagcgcttggggcggaagtgcggtggtgttcctgcaacatcttctccacgcaggaccatgccgcctccgccatcgcccgcgactccgccgccgtcttcgcctggaagggagagaccctccaggagtattggtggtgcaccgagcgcgccctcgactggggccccggcggcggccccgacctcatcgtcgacgacggtggcgacgccaccctcctcatccacgagggggtcaaggccgaggaggagtacgagaagtccggggccgtgcccgacccggcgtccaccgacaacgccgaattccagatcgtgctcaccatcatcagggacggactcaagaccgacccgaagaggtaccacaagatgaaggcgagattggtgggggtgtcggaggagaccaccaccggcgtcaagaggctctatcagatgcaggctagtgggaccctgctgttcccggcgattaatgtcaatgactccgtcaccaagagcaagtttgataacttgtatggatgccgtcactcgctccccgatggtctgatgagagccaccgatgttatgattgccggaaaggtcgcagtcgtctgcggttatggtgatgttggcaagggctgtgcagctgccttgaagcaagcaggagcccgtgtgatcgtgactgagattgatccaatttgtgctcttcaggctctcatggagggcctccaagttctaaccctcgaagatgtggtctcagaaaccgatatttttgtcaccaccaccggtaacaaggacatcatcatggtggaccacatgaggaagatgaagaacaatgccattgtctgcaacattgggcattttgacaacgaaattgatatgcacgggctggagaactacccaggtgtgcagagaatcacaattaaacctcaaactgacaggtgggttttccccgacaccaagtccggcatcattatcttggccgaggggcggctcatgaacttgggttgtgccaccgggcatcctagcttcgtgatgtcttgctctttcaccaaccaagtgatcgcgcagctcgagctgtggaatgagagggctacaggcaagtatgagaagaaggtttatgtcttgcccaagcacctcgatgagaaggttgccgcacttcacctcgccaagcttggagctaggcttaccaagctcagcaaggaccaggctgattacattagcgtgcccgttgagggtccttacaagcctgctcactacaggtactgaggagagagagacaagaggagcgaggtcggatgatacaatatttcatcggcgtgattgtttccctttgtcccccttcgatttgaagtagaattgtattttttgagattttccgattgtgtttttgtggttgggatgtttggaggaggaaagaaaactggtttcttctgtgtgaaggagacccaatgggttgcaataaggttttgagattgaggttgcgtgggataggagatagctgctgcagtttagcgaatgctgcgcttgattatgacttttattaacaaatatatttttgtttgtttt

SEQ ID NO: 7764 - DNA, 1838 bp, Quercus alba
cccccaaatttcatcagatccaattctcgactcactctcatctctcaccatggctttgtcggtagagaaaaccacaagtggtcgtgagtacaaggtgaaggacatgtctcaggccgacttcggccgtctcgagatcgagctggccgaagtcgagatgccaggtctcatgtcctgcagaaccgagttcggtccttcacagccctttaagggagccagaatcaccggctctctccacatgacaatccaaaccgccgtcctaatcgagaccctgacggccctcggcgccgaggtccgttggtgttcatgcaacatcttctcgacccaggaccacgccgccgccgccatcgcccgtgactccgccgccgtgttcgcctggaagggggagaccctccaggagtactggtggtgcaccgagcgtgctctcgactggggtgccggtggtgggcccgatctcatagtcgatgacggtggtgacgccactctgcttattcatgagggcgttaaggccgaggagttgtttgagaagaatgggactcttccggacccagcttccaccgacaatgccgagttccagattgtgctgaccattatcagagatgggttgaagacagatcccaagaggtaccacaagatgaagcaaagattggttggtgtgtctgaagagacaaccactggagttaagaggctttaccagatgcaggccaatggtaccctcttgttctctgctattaacgttaacgactccgtcaccaagagcaagtttgataacttgtatggatgccgccactccctccccgatggtttgatgagggctactgatgtcatgattgccggaaaggttgctgttgttgctggatatggtgatgttggcaagggctgtgctgctgccttgaagcaagctggtgcccgtgtgattgtgactgagattgatccaatttgtgctcttcaggctcttatggaaggcctccaagttctaacccttgaggatgttgtatctgaggctgacatctttgtgaccaccaccggtaacaaggacatcatcatggtcgaccacatgaggaagatgaagaacaatgccattgtttgcaacattggtcactttgacaatgagattgacatgctcggacttgagaactatccaggtgtgaagcgcatcaccatcaagccccaaacagacaggtgggtcttccctgatacaaactcaggcatcattgtgttggccgagggtcggctcatgaacttgggttgtgccacagggcacccaagtttcgtgatgtcttgctcattcacaaaccaggtgattgcacagcttgagctgtggaaggagaggactaccgggaaatatgagaagaaggtctatgtcttgccaaagcatcttgatgagaaggttgctgcacttcaccttggcaaacttggggctagactcaccaagctcagcaaggaccaggctgactacattagtgtccctgtggagggtccatacaagcctgctcactacaggtactgagaagagtcaagaaaacaaggcatatcgagaaaaccaagatatattatatatttggatcggcttgatggtttcttttacaaatttatgacttttattaggatgttaggttttgaattttttttttggtaggggctttttgtgtttggtggtggatgttatggaggaaagaaaatggttggtctctgttgaaagaagaccaatttgggtttcaataagggttggatggggttgtgtgggaatatataatgctgttgagtttttgttgcgtttgttattaaaacctaaaaaaaaggactgctatttccttaggttcctgtcttgttttggtggc

SEQ ID NO: 7765 - DNA, 1883 bp, Oryza sativa
actccgcctcctcctcctcctccctcctctctacccacccaccctctcgccgtcgcagatccgatccaggaagagctcgccgccgccgctgccatggcgctctccgtggagaagacctcgtcggggagggagtacaaggtgaaggacctctcccaggcggacttcggccgcctcgagatcgagctcgccgaggtcgagatgccggggctcatggcgtgccgcgccgagttcggcccctcccagccgttcaagggcgcccggatctccgggtccctccacatgaccatccagaccgccgtcctcatcgagaccctcaccgcccttggcgccgaggtccgctggtgctcctgcaacatcttctccacgcaggaccacgccgccgccgccatcgccagggactccgccgccgtgttcgcctggaagggggagaccctcgaggagtactggtggtgcaccgagcgctgcctcgactggggcgtcggcggcggccccgacctcatcgtcgacgacggcggcgacgccacgctgctcatccacgagggcgtcaaggccgaggaggagttcgagaagtcaggcaaggtccccgacccggagtccaccgacaacgccgagttcaagatcgtgctcaccatcatccgcgacggcctcaagtccgaccccagcaagtaccgcaagatgaaggagaggctcgtcggagtctccgaggagaccaccaccggtgtcaagaggctctaccagatgcaggagaccggcgccctcctcttccccgccatcaacgtcaacgactccgtcaccaagagcaagtttgacaacctgtatggttgccgccactctctccctgatggtctcatgagggctaccgatgttatgatcgctggcaaggttgccgtggtctgcggttatggtgatgttggcaagggctgtgctgctgctctcaagcaggctggtgcccgtgtcattgttactgagattgaccccatctgtgccctccaggcccttatggagggtctccaggtcctcaccttggaggatgttgtctcggaggctgacatctttgtgaccaccactggcaacaaggacatcataatggttgaccacatgaggaagatgaagaacaatgccatcgtttgcaacattggtcactttgacaatgagattgacatgctcggccttgagacctaccctggtgtcaagcgcatcaccatcaagcctcagaccgaccgctgggtcttccctgagaccaacactggcatcattgtccttgctgagggtcgtctcatgaaccttgggtgcgctactggccaccccagttttgtcatgtcctgctcattcactaaccaggtcattgctcagcttgagctgtggaaggagaagagcactggcaagtacgagaagaaggtgtacgttcttcccaagcacctcgacgagaaggtggccgccctccacttgggcaagcttggtgccaggctgaccaagctctccaagtcgcaggctgactacatcagcgttccagttgagggtccctacaagcccgcgcactaccggtactaggctgcccagcacgactagcggctgtggcatgagaagtgtcaacttgaagttcgccatgacgactctggagtatcctgctttgttttcatcatcttatatgccgtcacttaggaggatttgttgtggggtttatggtttgagactggtgaaggggaggaatgggaagccgtttgcttttgcccagaaataatggcgtaattgggtggagttggggaggtgtgctttggcagatacagttttgtcttgttgactctacttatctgatatcatttgcaagcgttttgataaaaatcatgcgtcatttatgaataatattcttgcctttaaagata

SEQ ID NO: 7766 - DNA, 1886 bp, Nicotiana tabacum
cgctacactctcttctttcaaaaacccattgaagagaggcctccatttccactttctctctgtaccttttttttttctctctctctctctctctaaccatggctttgctcgtcgagaaaactacctctggccgtgagtacaaggtcaaggacatgtctcaggccgacttcggccggctcgaaatcgagcttgccgaagtcgaaatgcctggtcttatggcttgccggaccgaatttggtccgtcacagccatttaaaggtgctaaaatcaccggatctctacacatgacaattcaaaccgctgtccttatcgaaaccctaactgctctaggcgctgaggtcagatggtgctcttgcaacattttctctacccaggaccacgccgcggctgcgatagcgcgtgatagcgccgccgtgtttgcgtggaagggcgagacgttgcaggagtactggtggtgtactgaacgcgcccttgactggggcccgggaggtggacccgatttgattgttgatgatggtggtgatgctacacttttgattcatgaaggtgtaaaagctgaagaggaatatgctaaatctggtaaattaccagatccaagttctaccgataatgttgagtttcagcttgtacttactattattagggacgggctaaaaactgatcctttaaaatacactaagatgaaggagagacttgttggtgtttctgaggaaactactacccggtgttaagaggctttaccaaatgcaggctaatggaactttgcttttccctgctattaatgttaatgactctgttaccaagagcaagtttgataacttgtacgggtgccgccactcactgcccgatggtctcatgagggctactgatgttatgattgccggaaaggttgcgcttgttgccggttacggagatgttggcaagggttgtgctgctgccttgaagcaagctggtgcacgtgtgatcgtgaccgagattgatccaatctgtgctctccaggccaccatggaaggtcttcaggtccttacccttgaggatgttgtttcagatgttgatatctttgttaccacaaccggtaacaaggacatcatcatggttgaccacatgaggaagatgaagaacaatgccattgtctgcaacattggtcactttgacaatgaaatcgacatgctcggtcttgagaccttccctggagtgaagaggatcacaatcaagccccagactgacagatgggtcttcccagacaccaacagtggtatcattgtcttagccgagggtcgtctcatgaacttgggatgcgccaccggacaccccagcttcgtcatgtcatgctctttcactaaccaagtcattgcccagctcgagttgtggaaggaaaagagcaccggcaagtatgagaagaaggtctacgttttgccaaagcaccttgacgagaaggttgctgcacttcatctcggaaagcttggtgcaaggctcactaagcttagcaaggatcaagctgactacattagtgtaccagttgatggtccttacaagcctcctcactacaggtactaagcgaagacaaagaagagactgcaaaaacagcacattcttactgctttaattgttatgcttttcatgctttggattttgttaggacaatagtgtcttgttcctttaaactattgttggggatattttgggatttttggaatgttgttgctggaaaagaattggtctcatttcatctgatggaagaccaaaatgtgctgaataagttttgaggaatggaggtggtgtgcttgatattgtagcagttagatttcttttgcttttggtttatccttgttatttcgaggaatcacagagtaacatgtttgcctttatcagcggccgcatgaggg

SEQ ID NO: 7767 - DNA, 1618 bp, Cannabis sativa
ccaccaccaaatataaaaaacacaccctacaaaaatcaaagttctagtattctactaccacatcaaattgtgacaaagtaaacaaatcaattcttcgaaatttttatggtttctcaactcagagaggtcattcaattgaccaaacaattgctcagtacctgtagtgaacaggcttgtatggtccctcaactggcacactgatgtagtcagcttggtccttggagagcttggtgagtctagctccgagtttgcccaagtgaagagcggcaaccttctcgtcgagatgcttaggcaagacgtaaacctccttcttgtatttcccagatgacttctcgttccagagctcgagttgggcgatgacttggttggtgaatgagcaagacatgacgaaactagggtgtccagtggcacaacccaagttcatcaaacgtccctcggccaagacaatgataccgacgttggtctcggggaagacccacctgtcggtttgtggcttgatggtgattctcttaacaccggggtaggtctcgagacccaacatgtcgatttcgttgtcgaagtgaccgatgttgcagacaatggcattgttcttcatcttcctcatgtggtcaaccatgatgatgtctttgttaccggtggtggtaacgaagatatcggcatcggagacaacgtcttcgagtgtcaagacttggagaccttccatgagagcctgaagggcacagatggggtcgatctcggtcacgatcacacgggctccggcttgcttgagagcagcagcacaaccctttccgacatctccgtaaccgcaaacaacggcaacctttccagcaatcataacatcagtggccctcataagaccatctgggagagagtgacggcatccgtacaagttgtcgaacttttttaccttgctcttagtaacagagtcgttaacattaatagcagggaacaacaaagttccattagcttgcatctggtaaagcctcttaacaccagtagtagtttcttcagaaacaccaacaagtctatccttcatcttgtggtatctcttaggatcagtcttcaaaccttccttaataatcccaagaacaagttgaaactcaacattatcagtagaagtaggatcaggcaactgaccagtcttttcatagatctcctcagccttaactccctcatgaatcaaaagcgtagcatcaccaccatcatcaacaatcagatctggaccaccacctggaccccaatcaagagcacgctcagtacaccaccaatactcttgaagagtctcacctttccaagcaaaaacagcagccgaatcacgagctatggcggccgcagcgtgatcctgagtcgagaaaatgttgcaggagcaccatctcacctcagcaccgagtgcggttagggtttcgataagaacagcagtctgaatagtcatgtgaagagaaccagtgattctggctcccttaaatggctgagatggaccgaattcagtacggcacgagacgagacctggcatttcaacctccgctagttcgatctcgagacgaccgaaatcggcctgagaaaggtccttgaccttgtattcacggccggcggtggttttctcgacggagagagacat

SEQ ID NO: 7768 - DNA, 1720 bp, Flaveria ramosissima
gccttacccaccccaaccggagatccaatattctccgataaaccaccgtactccggcaaccatggctctcaccgtcgagaagacctccaccggccgtgaatacaaagtcaaagacatgtccttagccgacttcggccggctcgagctcgagctagccgaggtcgaaatgcccggcctcatgtcctgccggaccgagttcggcccctctcagccgttcaaaggcgccagaatcaccggctcactccacatgaccatccaaaccgacgtcctcatcgaaaccctaccgccttgggcgccgaagtccgctggtgctcctgcaacatcttctcgactcaggaccacgccgccgccgccatcgcacgtgactccgccgccgtgttcgcctggaagggtgagacgttgcaggagtactggtggtgtacggagcgtgccttggattggggccccggtggtggacccgatctgatcgtcgacgacggtggcgatgcgacgctgctgattcatgaaggtgtgaaggcggaggaggagtttgcgaagacgggaagctgcccgatccggcgtccaccgataacgcggagtttcagatcgtgttgtcgatcattaaggagggtttgcagagtgatccgaagaagtatcataagatgaaggagagattggttggtgtctcggaggagaccaccactggtgttaagaggctgtatcagatgcaagcgaatgggactctgttgttccctgctattaacgtcaatgactctgttactaagagcaagtttgacaatctgtatggttgtcgtcactctctccctgatggtttgatgagagccactgatgtcatgatcgccggaaaggttgccgtggtctgtggttatggtgatgtcggaaagggttgtgctgctgcgatgaaacaagctggtgcgcgtgtgatcgttacagaaatcgaccccatctgcgcacttcaggccaccatggaaggactccaagttcttactttggatgatgtagtttcagaagctgatatcttcgtcaccaccaccggcaacaaagacatcatcatggtttccgacatgaagaagatgaaaaacaacgcgatcgtgtgcaacattggtcattttgataatgaaatcgacatgcttggacttgaaacctacccgggtgtcaagagaatcaccatcaagccccaaaccgacaggtgggtcttcccagaaaccaacactggcatcattgtgttagccgagggtcggctcatgaacctagggtgtgctactggacaccccagtttcgtgatgtcgtgctcgttcactaaccaagtgatcgcccagcttgagctctggaaggaaaaaacaccggcaagtacaagaaggaagtgtatgtgttgccgaagcatcttgatgagaaggtggctgcacttcatcttaggaaagcttggagccaaattgaccaagttgaccaaggaccaggctgattacatcagtgtgccggttgagggcccatacaagcctgctcactacaggtactagacgggtcggttttttgggcgaatttgcagagggggtgatgtgattgttgctttctttataagatacgagtatgtgttagggtttgttttgtttgttacgttgattgggatgttggcgaggaagaaaccgaggggtcgtttcatgatgagtcgatgtcggtttgaataaggattgcgtgtgaaggttgtgtaaactcttatggt

SEQ ID NO: 7769 - DNA, 1807 bp, Arnica chamissonis
acccaccctcttcagagcctctaagatccgatctacaaacccttcttcgacatggctctcaccgtcgagaaaacctccaccggacgggaatacaaagtcaaggacatgtccttggctgatttcggtcgtctggagctcgaattagccgaagttgaaatgcccggtctcatgtcttgccggacggaattcggcccttctcagcctttcaaaggtgcgagaatcaccggttccctccacatgacaattcagaccggagttctcatcgaaaccctaaccgccttgggtgccgaagtcagatggtgctcgtgtaacattttctcaactcaagatcacgccgccgccgccatcgcccgtgattcggccgccgtgttcgcctggaagggggaaaccttgcaggagtactggtggtgcacggaacgtgccctagattggggccctggtggtggccctgacttgattgttgacgatggcggtgacgcaacgctattgattcacgaaggagttaaggctgaggaggagtttgaaaagaccggaaaattgcccgatccgacttccactgacaacgctgagttccagatcgtgttgtcaatcatcaaagaaggactacaaaccgatccgaagaagtaccacaagatgaagacgagattggtcggtgtctctgaggagaccaccaccggtgttaagaggttgtaccagatgcaagctaacggtactcttctttttcccgccattaacgtcaatgactctgttaccaagagcaagtttgacaacttgtatggatgtcgccactctctccctgatggtttgatgagagccaccgatgtcatgatcgccggaaaggttgcagtcgtctgtggttatggagatgtcggaaagggttgtgctgccgccatgaaacaagctggtgctcgtgtcatcgtaactgaaattgaccccatctgtgcccttcaggccaccatggaaggaatccaagtccttactctggaggatgttgtttcagaagctgatatcttcgtcaccaccaccggtaacaaagacatcatcatggtctccgacatgaaaaagatgaaaaacaacgcgattgtgtgcaacattggtcactttgacaatgaaatcgacatgcttggacttgaaacataccctggtgttcaaagaatcaccatcaaaccccaaaccgacaggtgggtcttccctgaaaccaagaccgggatcataattctagctgagggtcgtctcatgaacctgggttgtgccacaggtcaccccagtttcgtgatgtcgtgttctttcactaaccaagtgatcgcccaactcgaactatggaacgaaaagaacactgggaagtacaagaaggaagtgtacgtgttgccaaaacatcttgatgagaaggtggctgcacttcatcttggaaagcttggagccaagttgaccaagctgaccaaggaccaggctgattacatcagtattccggttgagggtccatacaagcctgctcactacaggtactaaacgggtcggtttttgggtgagtttgaagagggggtgatgggattgttgctttctttacaagatacgagtcgagtatgtgttagggtttagttttgtttgttgcttttgtcgggggtgttggcgaggaagcaaccgactggtggtttcttgatgagacgaccgttgatgtcggtttgaataagggttcagtgtgaaggttgtgtaaacaccatttagttttttggattagaggttttgcttgctatgtcttttgcttcttaattcaccaagagattaaagaaacaagggtaattttgtg

SEQ ID NO: 7770 - DNA, 1830 bp, Cucurbita pepo
cgcacgaggctctcttctgcgatcttcttcgttatcgcagaaacaagagatttttgtgttctttcttcccccaatctctcaccatgtctctcattgtcgagaagaccgctggcggccgtgagtacaaggtcaaggacatgtctcaggccgacttcggtcgcctcgagatcgagctcgccgaggtcgaaatgcccggtctcatggcctgccgtaccgaattcggcccctcccagccattcaagggagctcgcattaccggctccctccacatgaccatccagaccgcggttctcatcgaaacccttaccgctctcggtgctgaggtccgttggtgctcctgcaacattttctccactcaggaccacgccgctgccgcgattgctcgcgacagcgcggctgtgttcgcctggaagggggagactcttcaggagtactggtggtgtaccgagcgtgccttggattggggtcccggtggtggtccggatctgattgttgacgatggtggtgatgcgactctcttgattcatgagggagttaaggctgaggagatttatgagaagagcggcgctcttcctgatccttcttctactgataacgctgagtttcagatcgtgttgacgattattagagatggattgaaatctgaccctaagaggtatcacaagatgaaggagagattggttggtgtctcggaagagactaccaccggtgttaagaggctataccagatgcaggccagtggaaccttgttgttccccgccattaatgtcaatgactctgtcactaagagcaagttcgataacttgtatggatgccgacactctctccccgatggtttgatgagagctaccgatgtcatgattgccggtaaggttgctgttgtgtgcggttatggagatgttggaaagggttgtgcttctgctcttaagcaagctggagctcgtgtgatcgtgaccgagatcgatccaatttgtgccctccaggctcttatggaaggacttccagtcctcacattggaagatgtcctctccgaggctgatatcttcgtcaccaccaccggtaacaaggatatcatcatggtcgaccacatgaggaaaatgaagaacaatgccattgtctgcaacatcggtcactttgacaatgagatcgacatgctcggtcttgagagctaccctggtgtgaagcgtatcaccatcaagcctcaaaccgacaggtgggtcttccccgaaaccaactccggcatcatcgtgttggccgagggtagactcatgaacttgggttgtgccactggacaccccagctttgtcatgtcctgctcattcacaaaccaagtcattgcacagctcgagctctggaacgagaggaaatctgggaagtatgagaagaaggtttacgtgttgcccaagcaccttgatgagaaggtggctgcccttcacctgggcaaactaggtgctaggcttaccaagctcagcaaggaccaagctgactacatcaatgtgccagttgagggtccatacaagcctgctcactacaggtactgagaggaacattctggttttacagtagggttttttttgaagtgtttggggttagtggtctgaaggggaaaagggtctgtgttgaagaaagaaagacgcgttgtatgggttgaataaggaagggtagatttggctgtgtgaaaaatatcttttgttttgtttttttagctgaatctgttgtatcgttttttattggtgaggaagaagagaaaaggcagaagaaatttcttcttttattttatgtgttttaggaaatgtatccgtcccggattttatggatattttgttggtt

SEQ ID NO: 7771 - DNA, 1956 bp, Eucalyptus grandis
tctctcttctcttctttctctctcttcgacgttcagatctcgatccgatccagaacccgccggagaagatggcgttgatcgtcgagaagaccgccggcggccgggagtacaaggtgaaggacatgtcgcaggccgacttcgggcgcctcgagatcgagctggcggaggtggagatgccggggctcatggcctgccgcgccgagtacggccccgcccagcccttcaagggcgcccgcatcaccggctccctccacatgaccatccagaccgccgtcctcatcgagaccctcaccgccctcggcgccgaggtccgctggtgctcctgcaacatcttctccacccaggaccacgccgccgccgccaccgcccgcgactccgccgccgtcttcgcctggaagggcgagacgctccaggagtactggtggtgcaccgagcgcgccctcgactggggccccggcggcgggcccgacctcatcgtcgacgacggcggcgacgccacgctgctgatccacgagggcgtcaaggccgaggaggagttcgagaagaccgggaaggtccccgacccggcctccaccgacaacgccgagttccagatcgtgctgaccatcatcaaggatgggctgaaggcggaccccaagaagtaccgcaagatgagggaccggctggtcggcgtctcggaggagactaccaccggcgtcaagaggctgtaccagatgcagcagaacgggacgctcttgttccctgccatcaacgtcaacgactccgtcaccaagagcaagtttgataacttgtatggttgtcgccactctctccctgatggtctgatgagggctactgatgtcatgattgctggaaaagttgccgtggtctgtggatatggagatgtcggcaagggctgtgccgccgccctcaagcaggctggtgctcgtgtcattgttactgaaattgatcccatctgtgccctccaagctctcatggaaggtctccaggtcctaccgcttgaggatgttgtgtccgaggctgacatctttgtgaccaccaccggaaacaaggacatcatcatggttcatcacatgaagaagatgaagaacaatgccattgtctgcaacatcggtcactttgataacgagattgacatgctcggtcttgagaccttccccggtgttaagcgcatcacgatcaagccccaaacggacaggtgggtcttccccgacaccaaatcgggcatcattgtgttggctgaggggcgtctcatgaacctgggttgcgccaccgggcaccctagtttcgtgatgtcctgctccttcacaaaccaggtgattgctcagcttgagctgtggaaggagaaggctacgggcaagtatgagaagaaggtctatgtcttgcccaagcacctggatgagaaggtggctgctcttcacctcggcaagctgggtgccaagctcaccaagctctccaaggaccaagctgactacattagcgtgcctgtcgagggtccctacaagcctcctcactacaggtactgagcaactttatgaggagaaaaagcatgtctcctccaagaagcttcgctgtgtctttcttgtattgattcagcgaagagcggtaggattttggctttgattttttcttatgggcggcggggtgggtcgggtggctggtgaatgattcggaggggaacaagacggactgatacagtttgaagatggctgagaagtctggagaatggggatgaataaaaagatgggaggagaaggcctggggcatcatatatattctaagtgctgcaatttgaattttgttgcaagtgttttttactatatctacaggagtttttcttttttgttgtggtctggttctgtgaagaaccggacgagagggtattagttgcggtttgtcaaactatatgttttcatgctaatctatccatattctagttgattttgcttactatta

SEQ ID NO: 7772 - DNA, 1687 bp, Olea europaea
ctcttcttgctaaaaccgcaaaagaagagaatcaatggcactttttgtagagaaaaccacctctggccgcgagtacaaggtcaaggacatgtcccaagctgatttcggccgcctcgagatcgagctagccgaggtcgaaatgcctgggctcatgtcttgccgtaccgaatttggcccctcacagcccttcaagggagctaagatcactggcagccttcacatgaccattcaaaccgctgttttgatcgaaactttgactgccttgggtgccgaggtgagatggtgttcttgcaacattttttccactcaggaccacgccgccgccgctattgctcgtgacagcgccgccgtgtttgcctggaagggggagaccctccaggagtactggtggtgcactgaaagggcacttgattggggcccaggtggagggcctgatctgattgttgatgatggaggagatgcaactctcttgatccatgaaggggtcaaggctgaggaggagtatgaaaaaactgggaaggtgcccgacccaaattcgactgacaatgcggagttccagatcgtgcttacgattatccgagatggactgaagtcggatccgaagaagtacaccagaatgaagaagagacttgttggtgtctctgaggaaactaccactggagtgaagaggctttaccagatgcaggctaatggaacactgcttttccctgctattaatgtcaatgactctgtcaccaagagcaagtttgataacttgtatggatgccgccactctctacccgatggactgatgagggccactgatgtgatgattgccggaaaggttgctgttgtcgctggttatggagacgttggcaagggctgtgctgctgccttgaagcaagcaggtgctcgtgtgattgtgaccgagattgaccccatttgtgctctccaggctctcatggaaggtctccaggttctaacgctcgaagatgttgtctctgaagctgatatctttgtcaccaccactggtaacaaagacatcatcatggttgaccacatgaaaaagatgaaaaacaatgccattgtttgcaacatcggtcactttgacaatgaaattgacatgcacggtctcgagacctaccctggggttaagagaatcaccattaagccacaaacagatagatgggtattccctgaaacaaaatccggtattattgtcttggcagaaggtcgtctcatgaacttgggatgtgccaccggtcaccctagctttgtgatgtcttgctcttttaccaaccaagttattgcacaacttgagctctggaatgagaggaaaactggcaagtacgagaagaaggtttacgttttgcccaagcaccttgatgagaaagttgctgctcttcatcttgggaagcttggtgctaagctcactgagctttcaaaggaccaggctgattacattagcgtaccagtcgagggtccttacaagccccctcgttacaggtattaagtggaaagcagacactgatttccaggatacgttctgtcaccgtgaatctttctttttcaaaattgtgttttcatgttatattgtagttttcttgggggagtttttgggagttggtatgttgggaaagaaatggtctctgtcgaaagaccaaaatatgttacaataaggttgatgaagggctgtttgatgttaaat

SEQ ID NO: 7773 - DNA, 1942 bp, Solanum lycopersicum
ttccacaatttatcaatctaaagatttgatcaaacaaatcctagccgtccattttccattcttcatctctatataaatcactcaaaaactccatttcattcctctgtgccactcttcttcccaaaaaaaacttcaaaattctctcaatttcttcacttttttcactctactctctctacccatggcgttaatcgtcgagaaaaccacctccggccgcgagtacaaggtcaaggacatgtcccaggccgattttggccgcctcgaaatcgagctagctgaagttgaaatgcctggtttaatggcttgtcgtactgaatttggtccatcacagccattcaaaggtgcaaaaatcaccggaagtctacatatgacgatccaaaccgctgtcttaatcgaaaccctcaccgcattgggtgctgaagttcgatggtgttcctgcaacattttctcaactcaagatcacgcggcagctgctacagcgcgtgacagcgctgcagttttcgcgtggaaaggggaaacattgcaggagtattggtggtgtacggagagagcacttgattggggtccaggtggtggacccgatctgattgttgatgatggtggtgatgctacattgttgattcatgaaggtgttaaagccgaagaagaatacgcgaaaactggtaaatttccagatcctaattctactgataatgttgaatttcagcttgtgcttacgattattaaggacggattgaaaagcgatccattgaagtatacgaagatgaaggagagacttgttggtgtttctgaagaaactactactggtgttaagagattgtatcagatgcaggctaatggaactttgcttttccctgccattaacgttaatgactctgtcaccaagagcaagtttgacaacttgtatggatgtcgccactcactgcccgatggactcatgagggctactgatgttatgattgcgggaaaggtggcccttattgccggttatggtgatgttggcaaaggttgtgctgctgcaatgaagcaagcaggtgcgcgtgtgattgtgactgagattgacccaatctgtgctctccaggctactatggaaggtctacaggttcttcctctcgaggatgttgtttccgaaattgatatctttgttacaacaactggtaacaaggatatcatcatggttgaccacatgaggaagatgaagaacaatgccattgtctgcaatattggtcactttgacaatgaaatcgacatgcttggtcttgagacctaccctggagtgaagagaatcacaatcaagcctcaaaccgacagatgggtttttcccgacactaagagtggcatcattgtcttagctgagggtcgtctcatgaacttgggatgcgctactggacaccctagttttgtcatgtcgtgctctttcactaaccaagtcattgctcagctcgagttgtggaaggagaaggcaagtggcaagtatgagaagaaggtgtacgtcttgccaaagcacctcgatgagaaggttgctgcccttcatctcggacagctcggagtcaagctcactaagctctctaaggatcaagctgattacattagtgtaccagttgagggtccttacaagcctgctcactacaggtactaaggagacagacaaagtgagactgcaaaaagatacacaatcttatagcatgatgttttcttctctttttttttttacactttgatcctgttttcctttggttttggtttatgttttctttgaggttatttaagtaacatttccattcaaattttagcgctagcgtttgattatacattttgaaaggtcatcctcaaatatctgttaggtacttcaactattttcaagtgccctttcgggacttgcactcacaaaacttcaaaaataaatccaaataaaatgcatgtccaagtataacctcaaatt

SEQ ID NO: 7774 - DNA, 1759 bp, Tripterygium wilfordii
ctcatatctacatctacgaaatggctttactcgtcgagaaaaccgccggcggccgcgagtacaaggtcaaggacatgtccctcgccgatttcggccgcctcgagatcgatcttgccgaggtcgagatgcctgggctcatgtcctgccggacagagtacggtccctctcaaccattcaagggcgccaagatcaccggctccctccacatgaccatccagaccgccgtcctcattgagaccctcaccgcacttggcgccgaggtccgttggtgttcctgcaacattttctcgactcaggaccatgccgctgcagctattgctcgtgacatcgccgctgtgttcgcctggaagggtgagactcttcaggagtactggtggtgtaccgagcgtgctcttgattggggtcctggtggtggccctgacctgattgttgatgacggaggtgatgctactctgttgattcatgagggggttaaggccgaggagatctatgagaagacagggacgctcccggatcctgcatccatcgacaatgcagagttccagatcgtcttgactatcattagagatggactcaagaccgatcctaagaagtaccacaagatgaaggagagattggttggtgtttctgaggagaccaccactggagttaagcggctgtaccagatgcagatcaatgggactctcttgttccccgctatcaatgttaacgactctgtcaccaagagcaagtttgataacttgtatggttgccgtcactcactccctgatggcctgatgagggctagtgatgtcatgattgccggcaaggttggtgttgtctgtggttatggagacgtgggcaagggctgtgctgctgctttgaagcaagctggagcccgcgtgattgtgactgagatagaccctatttgtgcccttcaggctctgatggagggataccaagtcctgacgctggaggatgttctttctgaggccgacatctttgtcaccaccaccggcaacaaggacatcatcatggttgaccacatgaggaagatgaagaacaatgccattgtttgtaacattggtcactttgataatgagattgacatgcttgggcttgaaaccttccctggcgtgaagagaatcaccatcaagcctcaaactgataggtgggtcttccctgacaccaacttgggcatcattgtgttggcggaaggacgactcatgaacttgggttgtgccactggccaccctagttttgtcatgtcatgctcattcacaaaccaggtgattgcacaactcgagctctggatggagaagagcactggaaagtatgagaagaaggtgtatgttttgcctaagcaccttgatgagaaggtggctgctcttcaccttgggaagcttggggctaggcttacgaaactcagcaaggaccaggctgactacatcagtgttcctgttgaaggtccatacaagcctgctcattacaggtattgaaggacaaactctcaagaacttgagaaaaagactacatttcgaaggcttgattgttttttttacaatatggcattgaataaggttttgaatgggactttgagcggctgctgcagggttagtattcttgcagcagatgattatcatatcttttatgcaccaagcggagggaaaaaacaaggatatatctctctctttttcactacctttgattttttgtattcttgaagacaacaattaattaagggtgtttatcgcggatttgagtaaagttttgtgcattt

SEQ ID NO: 7775 - DNA, 1893 bp, Mimulus guttatus
aatccctagaaatcctatttaaacacctctttctcactcctcttcacttgcactcatctagagagagaaacacaaatccaaattcaaatctcagatccattttctcgctcctctctctctttccaccaatggctctcctagtagagaagaccacctccggccgcgagtacaaggtcaaggacatgtcccaggccgatttcggccgcctcgagctcgagctcgccgaggtcgagatgcccggactcatgtcctgccgcaccgagttcggcccctcccagccgttcaagggcgcaaggatcaccggcagtctccacatgaccatccagaccgccgtcctcatcgaaaccctaaccgccctcggcgccgaggtccgttggtgctcctgcaacatcttctccacccaggaccacgccgccgccgccatcgcccgcgacagcgccgccgtgttcgcctggaagggggagacccttcaggagtactggtggtgcacggagcgcgcccttgactggggccccggcggcggccccgatctgatcgtggacgacggcggcgacgccactctgctgatccacgagggcgtgaaggcggaggaggagttcgagaagaacgggaccgtacccgacccgaattcgaccgacaatgccgagttccagatcgttctcaccattatcagggacgggctgaagaccgatcccaagaggtacacgaagatgaaggagagattggttggtgtttccgaggagacgaccaccggcgtgaagaggctgtaccagatgcaggccaatggcactctcctcttccctgctattaacgtcaatgattccgtcaccaagagcaagttcgacaacttgtacggatgccgccactcactccccgacgggctaatgagagccaccgacgtaatgatcgccggaaaggtcggcgtggtctgcggttacggagatgtcggcaaaggctgcgccatctcactcaaacaagccggtgcccgtgtaatcgtcaccgaaatcgaccccatctgcgccctccaagccctaatggaaggcttccaagtcctaaccctagaagatgtcctctccgaagctgacatctttgtcaccaccactggcaacaaagacatcatcatggttgaccaaatgaagaggatgaagaacaacgcaatcgtctgcaatatcggccacttcgacaatgaaatcgacatgcaggggctcgagaactacccgggtgtcaagagaatcacgattaagccacaaaccgacaggtgggtatttccggagactaaatctggaatcattgtgttggccgaggggcgtttgatgaacttggggtgtgcaactgggcatccgagtttcgtgatgtcatgctcgtttacgaaccaggtgattgcacagctggagctttggaatgagaggaagagcggcaagtacggtaaagaagtttacgtattgcccaagcatcttgatgagaaagttgctgcacttcatctcggaaagcttggagctaagctgactaagcttacaaaggatcagtcggattatatcagcattccggttgaaggtccttacaagcctcctcattacaggtactgaggaacgaaaaaatgcagtgacggttatcggatttgtcgttgtcttctttcttcaatttattgagcacttttacgttcggttgatgtttttgttttagagggtttttttcgggttttttcggttattattttggaagtggatttcgatgacaagaataagttcgaaggtgttctgttttttcttgagggattatttattttcttttttcgaggctatgatgaaagtgttattttgtgttgggttacagatttgttgttgtttttggtatctacattctataaaagaatattcccattcatttctgccc

SEQ ID NO: 7776 - DNA, 1781 bp, Solanum tuberosum
cttccctgaaaaaccccaaaggaagaagagaaaagcctctcagatctcatctcaaaccctttcatttctcttatactcgccttacccatggctctactcgttgagaagaccacctctggccgcgagtacaaggtgaaggacatgtcccaggctgacttcggcaggctcgaaatcgagcttgccgaagttgaaatgcctggtctcatggcttcccgtactgaatttggcccttcacagcccttcaaaggtgcaaagatcactggatctctgcatatgactatccaaactgctgtccttattgaaaccctaactgctttgggtgctgaagttagatggtgttcttgcaacatcttctcaactcaggaccatgctgcagcagccattgcacgtgatagtgctgctgtttttgcctggaaaggtgagactttgcaggagtactggtggtgtactgagagggcacttgattggggtccaggtggtggtcctgatctgattgttgatgatggaggtgatgctactctcttgattcatgagggagttaaggcagaggaggagtttgctaagaatgggacaatcccagatcctacttctactgacaatgttgagtttcaacttgtgcttactattattaaggagagcttaaagactgatcctttaaggtacactaagatgaaggagagacttgttggtgtttctgaggaaactaccactggtgttaagaggctttaccaaatgcaggctaatggaactttgctattccctgctatcaatgttaatgactctgttaccaagagcaagtttgacaacttgtatggatgccgccactcactgcctgatggtctcatgagggctactgatgttatgattgctggaaaggttgctcttgttgctggttatggagatgttggcaagggatgtgctgctgccatgaaacaagctggtgcccgtgtgattgtgactgagattgacccaatctgtgctcttcaggctaccatggaaggactccaggttcttcctcttgaggatgttgtttctgaggttgatatctttgtgaccaccactggtaacaaggacatcatcatggttgaccacatgaggaagatgaagaacaatgccattgtctgcaacattggtcactttgacaatgaaatcgacatgcatggtcttgagaccttccctggtgtgaagaggatcacaatcaagcctcaaaccgacagatgggtcttcccagacaccaacagtggcatcattgtcttggctgaaggtcgcctcatgaacttgggatgtgccacaggacaccccagttttgtgatgtcctgctctttcactaaccaagtcattgcccaactcgagttgtggaatgagaggaccagtggtaaatacgagaagaaggtgtacgtcttgccaaagcacctagacgagaaggttgctgccctacatcttggaaagctcggagctaagcttaccaaactcaccaaggatcaagctgactacatcagcgtaccagttgaaggtccttacaagcctgctcactacaggtactgagggaagagacactcatggtggaacaacgatatcgcggcacgattgttttgtttttaatactttgattttgtttaggtagtctgtttttattattgttgggggaagttggcatggtttgctggaaagttgacctaaatgtgtttgaataatattcgaattatggtgttggggttgtgtcatatgatattgtactaagattcatttgcttttttttctctataaattttgcttcaagg

SEQ ID NO: 7777 - DNA, 2045 bp, Coffea canephora
ggtcccgctctcttctttaccgcagaaaaccccccaaaagaagagagagtgcacaaaaagaccagacactaaatccaacccggcccgagcccatttcaccccatcagctttaagccatggctttgctagtagagaaaactacctccggtagggagtacaaagtcaaggacatgtcccaagccgacttcggccggctcgaaatcgagctagccgaggtcgaaatgcccgggctcatgtcttgtcgggctgagttcgggcccagccagcccttcaagggtgccaagatcaccggcagcttgcacatgaccatccaaaccgccgtcttgatcgaaaccctaacggcattgggcgccgaggtcagatggtgctcctgcaacatcttctccacccaggaccacgctgctgccgccattgcccgcgacagcgccgccgtttttgcctggaaaggcgagaccctccaggaatactggtggtgcacggagcgggcccttgattggggtcccggcggtggcccggatctcattgtcgatgatggtggtgatgccacattgttgattcatgagggagtgaaggcggaggaagagtacaagaagtccgggaagttgcccgatccagcctccactgataacgctgagttccagattgtcttgactattattcgagatgggttgaagaccgatcccacgaaatatgccaaaatgaaggagagactagttggagtgtctgaagagaccaccactggtgttaagaggctttaccaaatgcaggctaatgggactcttctgttccctgccattaatgtgaacgactctgttaccaagagcaagtttgataacttgtatggatgccgccactcactccctgatgggctgatgagagccactgatgtgatgattgctggaaaggttggagttgtttgcggttacggagatgttggaaagggctgtgctgctgccttgaagcaagctggtgctcgtgttatcgtgactgagattgatccaatttgtgctcttcaggccctcatggaaggcttccaagttttgaccctggaagatgttgtctccgaagctgatatttttgtcaccaccaccggcaacaaagacatcatcatggttagccacatgaagaagatgaagaacaacgctattgtttgcaacattggccactttgacaatgaaattgacatgcttggtcttgagacatacccaggtgttaagaggatcacaattaagccccaaacagaccgatgggtcttccctgaaacaaaatcaggcatcattgtcttggctgagggtcgtctcatgaacttgggttgtgccacagggcaccctagctttgtgatgtcctgctctttcactaaccaagtgattgcccagcttgagctctggaaagagaagagtaccggaaagtacgagaagaaggtctatgtcttgcccaagcatcttgatgagaaggttgctgcactccatcttggtaagcttggtgctaagctcactaagctctccaaggatcaggctgactatattagcgtgcccgttgagggtccttacaagcctcctcactataggtactgagggagagatgtcaacactttgcaacgatcttgtttaacagcatggatttttttctgttacattgcgggtttacaatagggatttagtttttttttttttctgatttttggaggtgttgttgggagtgttgaaatgatcggaagaaagaaatatggtctctgaccaagaaatgttgaataagggcattgtatgggggtgtggaatgatcataattttagctgctccagcttaggtcgattgcttttttcttcttgtttgcacgagaaaacaaaagaaaaagaattttgttggtttctctagtaaagtcttttacataatggcatcaatgttttaccaaggctgtttgtgttggtgaatgttttgaattgatttctttggcagcagacgtaggcaagtatttaccgaggctgtagatcctttcggcattcattctgtaacatggaatgcatataatgatagaattgaatggtg

SEQ ID NO: 7778 - DNA, 2023 bp, Setaria italica
ctccggccctccctccacctccactccccccgccgtctcctcccctcctcccattccctcccagatccaatccgcgagctctccctccgcccgctgccatggcgctctccgtggagaagacctcgtcggggcgggagtacaaggtgaaggacctgtcccaggccgacttcggccgcctcgagatcgagctggcggaggtcgagatgccgggtctcatggcgtgccgcgccgagttcggcccgtccaagcccttcgccggcgccaggatctcgggctccctccacatgaccatccagaccgccgtcctcatcgagaccctcaccgcgctcggcgccgaggtccgctggtgctcctgcaacatcttctccacgcaggaccacgccgccgccgccatcgcgcgggactcagccgccgtcttcgcgtggaagggggagacgctcgaggagtactggtggtgcaccgagcgatgcctcgactggggtgagggcggcggccccgacctcatcgtcgacgacggcggcgacgccacgctactcatccacgagggcgtcaaggcggaggaggagtacgagaagaccggcaaggtccccgacccggagtccactgacaacgccgagttcaagatcgtgctcaccatcatccgcgacggcctcaagtccgaccccaagaggtaccgcaagatgaaggagaggctcgtcggcgtctccgaggagaccaccaccggagtcaagaggctctaccagatgcaggagaccggcaccctcctcttccccgccatcaacgtcaacgactccgtcaccaagagcaagttcgacaacctctacggttgccgccactccctccctgatggtttgatgagggccaccgatgttatgatcgctggcaaggtcgcagtggtctgcggttatggtgatgttggcaagggctgtgctgctgccctcaagcaggctggtgcccgtgtcatcgtgactgagatcgaccccatctgtgcccttcaggccttgatggagggtcttcaggtccttaccttggaggatgtcgtctctgaagctgacatctttgtgaccaccaccggcaacaaggacatcatcatggttgaccacatgaggaagatgaagaacaacgccattgtctgcaacattggtcactttgacaatgagatcgacatgcacggtcttgagacctaccctggtgtcaagcgcatcaccatcaagccccagacagaccgctgggtgttccctgagaccaacactggcatcattgtcctcgctgagggtcgtctgatgaaccttgggtgcgctactggccaccccagctttgtcatgtcctgctcattcactaaccaggtcattgctcagcttgaactgtggaaggagaagagctctggcaagtatgagaagaaggtgtatgtgcttccgaagcaccttgatgagaaggttgccgctctccatttgggcaagcttggtgccaagctcaccaagctctcgaagtctcagtctgactacatcagcgtcccaatcgagggtccctacaagcccgctcactaccggtactaggctgcccagcatggcaggaagctcattcggccagccggttgtgtggtgtgcccgtacgaagacgctgatgtgccgttgcttaggaggaattattatggtcatcgcttgagcctggttgagtagtggggagaggagggaagagatgtttgcttttgcggaagaataatggcgtaattggtcgttggttgaggtggcgcgcgttgccagaaacagtttctgattatcaattgcaagcgatttgctctggttatgtgtttttcatgaataacttgctttcttcgaagcatattttagttggatcctgagttttgcttacgtttgttttgtagagttgtgtccagcaatttcgttgggccttctcagctcagtgtcttttgtgtctccttatgccgttctggaaatgcattgattcatgcctgttttgcgaattccgatagaatatggatggattcagatgagttttgctg

SEQ ID NO: 7779 - DNA, 1719 bp, Solanum phureja
tcttcttcccaaaaaacttcaaaattctctcaatttttcacattttccactttactctctctacccatggcgttaatcgtcgagaaaaccacctcgggccgcgagtacaaggtcaaggacatgtcccaggccgatttcggccgcctcgaaatcgagctagccgaagtcgaaatgcctggattaatggcttgtcgtactgaattcggtccatcacagccattcaaaggtgcaaaaatcaccggaagtttacacatgacgatccaaaccgctgtcctaatcgaaactctcactgcattgggtgctgaagttcgatggtgttcctgcaacattttctcaacgcaagatcacgcggctgctgcgacagcgcgtgacagcgccgccgttttcgcgtggaaaggggaaacattgcaggagtattggtggtgtacggagagggcacttgattggggtccaggtggtggacccgatctgattgttgatgatggtggtgatgctacattgttgattcatgaaggtgttaaagctgaagaggaatacgcgaaaactggtaaatttccagatcctcattctactgataatgttgaatttcagcttgtgcttactattattaaggatgggttgaaaagcgatccgttaaagtatacgaagatgaaggagagacttgttggtgtttcggaagaaactactactggtgttaagagattgtatcagatgcaggctaatggaactttgcttttccctgctattaatgttaatgactctgtcaccaagagcaagtttgacaacttgtatggatgtcgccactcactgcccgatggactcatgagggctactgatgttatgattgctgggaaggttgcccttattgccggttatggtgatgttggcaagggttgtgctgctgcaatgaagcaagcaggtgcgcgtgtgattgtgactgagattgacccaatctgtgctctccaggctactatggaaggtctccaggttcttcctctcgaggatgttgtttccgaaattgatatctttgttaccacaactggtaacaaggatatcatcatggttgaccacatgaggaagatgaagaacaatgccattgtctgcaacattggccactttgacaatgaaatcgacatgcttggtcttgagacctaccctggagtgaagagaatcacaatcaagcctcaaactgacagatgggtcttccccgacaccaagagtggcatcattgtcttagctgagggtcgtctcatgaacttgggatgcgctactggacaccccagttttgtcatgtcgtgctctttcactaaccaagtcattgctcagcttgagttgtggaaggagaaggcaagtggcaagtatgagaagaaggtgtacgtcttgccaaagcacctcgatgagaaggttgctgcccttcatctcggacagctcggagtcaagctcactaagctctccaaggaccaagctgattacattagtgtaccagttgagggtccttacaagcctgctcactacaggtactaaggagaaagacaaagtgagactggaaaaacacacaatcttatagcatgatgttttctctttttatgctttgattctgttttcctttggtttttgtttatgtttttctttgaggatattgaagtaacatttccattcaaattgtagcgctagcgtttgactatacattttgaaagttcatcctcaaatatctgttag

SEQ ID NO: 7780 - DNA, 1842 bp, Solanum lycopersicum
cctctgtgccactcttcttcccaaaaaaaacttcaaaattctctcaatttcttcacttttttcactctactctctctacccatggcgttaatcgtcgagaaaaccacctccggccgcgagtacaaggtcaaggacatgtcccaggccgattttggccgcctcgaaatcgagctagctgaagttgaaatgcctggtttaatggcttgtcgtactgaatttggtccatcacagccattcaaaggtgcaaaaatcaccggaagtctacatatgacgatccaaaccgctgtcttaatcgaaaccctcaccgcattgggtgctgaagttcgatggtgttcctgcaacattttctcaactcaagatcacgcggcagctgctacagcgcgtgacagcgctgcagttttcgcgtggaaaggggaaacattgcaggagtattggtggtgtacggagagagcacttgattggggtccaggtggtggacccgatctgattgttgatgatggtggtgatgctacattgttgattcatgaaggtgttaaagccgaagaggaatacgcgaaaactggtaaatttccagatcctaattctactgataatgttgaatttcagcttgtgcttacgattattaaggacggattgaaaagcgatccattgaagtatacgaagatgaaggagagacttgttggtgtttctgaagaaactactactggtgttaagagattgtatcagatgcaggctaatggaactttgcttttccctgccattaacgttaatgactctgtcaccaagagcaagtttgacaacttgtatggatgtcgccactcactgcccgatggactcatgagggctactgatgttatgattgcgggaaaggtggcccttattgccggttatggtgatgttggcaaaggttgtgctgctgcaatgaagcaagcaggtgcgcgtgtgattgtgactgagattgacccaatctgtgctctccaggctactatggaaggtctacaggttcttcctctcgaggatgttgtttccgaaattgatatctttgttacaacaactggtaacaaggatatcatcatggttgaccacatgaggaagatgaagaacaatgccattgtctgcaatattggtcactttgacaatgaaatcgacatgcttggtcttgagacctaccctggagtgaagagaatcacaatcaagcctcaaaccgacagatgggtttttcccgacactaagagtggcatcattgtcttagctgagggtcgtctcatgaacttgggatgcgctactggacaccctagttttgtcatgtcgtgctctttcactaaccaagtcattgctcagctcgagttgtggaaggagaaggcaagtggcaagtatgagaagaaggtgtacgtcttgccaaagcacctcgatgagaaggttgctgcccttcatctcggacagctcggagtcaagctcactaagctctctaaggatcaagctgattacattagtgtaccagttgagggtccttacaagcctgctcactacaggtactaaggagacagacaaagtgagactgcaaaaagatacacaatcttatagcatgatgttttcttctctttttttttttacactttgatcctgttttcctttggttttggtttatgttttctttgaggatatttaagtaacatttccattcaaattttagcgctagcgtttgattatacattttgaaaggtcatcctcaaatatctgttaggtacttcaactattttcaagtgccctttcgggacttgcactcacaaaacttcaaaaataaatccaaataaaatgcatgtccaagtataacctcaaatt

SEQ ID NO: 7781 - DNA, 1802 bp, Artemisia annua
agtactccgacgggggtcaaaaacccacttctctctctctctgcttcttttatcattaaaagaaacagtgagtgtttcagatcagatctcaaaaaaacccaaaccttaaaccatgtctctcaccgtagagaaaaccacctctggccgtgaatacaaggtcaaggacatgtccttggctgacttcgggcgtctcgaactcgagttagccgaggtcgagatgcccgggcttatgtcctgcaggaccgaattcggcccttctcagccttttaagggagccagaatcactggatcccttcacatgaccatccagaccggtgttcttattgaaactctgactgctttgggtgctgaggttagatggtgctcctgcaacatcttttcgacccaagaccatgctgctgcagccattgctcgtgactctgctgcggttttcgcctggaagggggagactcttcaggagtactggtggtgtactgagcgatcacttgactggggtccaggtggtggtccagatttgattgtggatgatggtggtgatgctacgctattgatccatgagggagttaaggctgaggaagagttcgccaagagcggtaaattgcctgaccccacttctactgacaatgctgagttccagattgtgttgtcgattattaaggaaggactttcgaccgacccattgaagtaccacaagatgaaggaaagactagttggtgtctctgaggaaaccaccactggtgtcaagaggttgtaccaaatgcaagccaatggtactttgttgttccctgccatcaatgttaacgattccgtcaccaagagcaagtttgacaacttgtacggatgccgtcactcactccctgatggtttgatgagagctaccgatgtcatgatcgccggaaaggttgcagtcgtctgcggttacggagatgttggaaagggttgtgcttcagccatgaagcaagctggtgctcgtgtcattgtgacagaaattgatcccatctgtgctcttcaggctaccatggaaggtctccaagtgctaactttggaagatgtcgtatccgaagctgatatctttgttaccaccaccggtaacaaggacattatcatggttgatgacatgaggaagatgaagaacaatgccatcgtctgcaacattggtcactttgacaatgaaatcgacatgcttggtcttgagacttaccctggtgtcaagaggatcaccatcaagccccaaaccgacaggtgggtgttccccgagaccaagagtggtgtcattatcttggctgagggtaggctcatgaacttgggttgtgctactggtcaccctagtttcgtgatgtcttgctctttcactaaccaagtgattgctcaacttgagttgtggaacgagaagggaaccggcaagtacaagaacgaggtgtatgtgttgcccaagcaccttgacgagaaggtggctgcacttcatcttggaaagcttggagccaagctcactaagctcaccaaggaccagtctgactacctcagcattcctattgaaggtccttacaagcctgctgcctacaggtactgatcaaagaggatatctgctgttcggcaagactttgaagaacctatgggattgctttctttataaaatacaagtttgattatgtatccagttttcttttttatttttgttggggttgtttgttggattaatggtgttatgccattacttgaatgaggatattaagaggaaaaaaagtgtttttacactaatacttagcatttatcaataacaatttgatgatgattttaactga

SEQ ID NO: 7782 - DNA, 1832 bp, Helianthus annuus
gagtacgcgggggtacccacccctcttgagagcctctaaaaccagatctacaaactcttcttcaccatggctctcaccgtcgagaaaacctctactggccgtgaatacaaagtcaaggacatgtccttagccgacttcggccgcctcgaactcgagctagccgaagtcgaaatgcccggacttatgtcctgcaggaccgaattcggcccatcgcagcccttcaaaggcgctcgcatcaccggttcactccacatgactattcaaaccggtgtccttatcgaaacccttaccgccttgggcgctgaggtcagatggtgctcttgcaacatcttctccacccaggatcacgctgcggccgctatcgctcgcgattcggctgctgtgttcgcctggaagggggaaacactacaggaatactggtggtgtactgagcgtgctttggactggggccctggtggtggtccagatctgattgttgatgacggtggtgatgctactttgttgatccatgaaggagttaaggctgaggaggagtttgagaagactggaaagttgccggatcctacctcgactgataatgcagagttccagattgtgttgtcgattattaaggaaggattggcgactgacccgaagaagtaccacaagatgaaggagagattggtaggtgtgtctgaggagactaccactggtgttaagaggttgtaccagatgcaagctaacggtactctgttgttccctgctattaatgtcaacgactctgttaccaagagcaagtttgacaacttgtatggatgccgtcactctctccctgatggtttgatgagagccaccgatgtcatgatcgctggaaaggtagctgtcgtctgcggttacggagatgtcggaaagggttgtgccgccgccatgaaacaagctggtgcccgtgtcatcgtcacagaaatcgaccctatctgcgctctccaggccaccatggaaggactccaagtcctcaccttggacgacgtagtttccgaagctgacatcttcgtcaccaccactggtaacaaagacatcatcatggtttctgacatgaagaagatgaagaacaacgccatcgtctgcaacatcggtcacttcgacaacgaaatcgacatgcttggacttgaaacctaccccggtgttcaaagaatcaccatcaaaccccaaaccgacaggtgggtcttccccgaaaccaagaccggcatcattgttttggctgagggtcgtctcatgaacttgggttgtgccactggtcaccccagtttcgtgatgtcgtgctcgttcaccaaccaagtgattgcccaactcgaactgtggaacgagaagaacaccgggaagtacaagaaggaggtgtacgtgttgccaaagcatcttgacgagaaggttgccgctcttcatcttggaaagcttggagctaagttgaccaagttgaccaaggaccaggctgactacatcagcgtaccagttgagggtccatacaagcctgctcactacaggtactgagcgtgtcggttttttgggaggacattgttggttccttttcaagatacaattcgagtatgtgttagcgtttagttctgtttgttactttatcgggggtgttggcaagaaagaaaccgactggttgtttcttgatgagacgactgtttatgttggtttgaataagggatctgtgtgatggttgtgtggactgttttgtagttgtttttttggtttagaggttttgcttgctatggcttttgcttcttatttcattgagaaaaaaagagtaattttgtgcaccaagtatttgaattttataaaaaatctag

SEQ ID NO: 7783 - DNA, 1837 bp, Cucumis sativus
ctctcacatttctctcttccttctgcgaaactcttcttactcgcagaaacagagagatctttgtgttctttcttcccccaaatctctcacaatgtctctcatcgtcgagaagaccgccgccggccgtgagtacaaggtcaaggacatgtctcaggccgacttcggtcgtctcgagatcgagctcgccgaagttgaaatgcccggtctcatggcctgccgtactgaattcggcccttcccagccattcaagggagctcgcatcaccggttccctccacatgaccatccagactgctgttctcatcgaaaccctcaccgctcttggcgctgaagtccgttggtgctcctgcaacattttctccacccaggaccacgccgctgccgcgattgctcgtgacagtgctgctgtctttgcctggaaaggagagactcttcaggagtactggtggtgcactgagcgcgccttggattggggccctggtggtggtccggatctgattgttgatgatggcggtgacgcaactctcttgattcacgagggagttaaggcggaggagatttatgagaagactggtgctcttcctgaccctgcttctactgataacgctgagtttcagatcgtgttgacgattattagagatggattgaaatctgaccctaagaggtaccacaagatgaaggagagattggttggtgtttccgaagagactaccactggtgttaagaggctttaccagatgcagtcaagtggaaccttgttgttccctgccattaatgtcaatgactctgtcactaagagcaagtttgacaacttgtatggatgccgtcactctctccctgatggtctgatgagagctaccgatgtcatgattgccggtaaggtagctgttgtgtgcggttatggagatgtgggaaagggttgtgccgctgccctcaagcaagctggagctcgtgtgatcgtgactgagatcgatccaatttgtgccctccaggctcttatggaaggccttcaagtactcaccctggaagatgctgtctcggaggctgacatcttcgtcaccaccaccggtaacaaagatatcatcatggttgatcacatgagaaagatgaagaacaatgccattgtttgcaacattggtcactttgacaatgagattgacatgctcggtcttgagaattaccctggtgtgaagcgtatcaccatcaagcctcaaacagataggtgggtcttccctgaaaccaatgtcggcatcatcgtgttggctgaggggcgactcatgaacttaggttgtgccaccggacaccccagctttgtgatgtcctgctcattcacaaaccaagtgattgcacagctcgagctatggaacgagagggcatccgggaagtacgagaagaaggtgtatgtgttgccaaagcacctggacgagaaggtggctgcacttcacctgggcaaactgggggctaagctaaccaagctgagcaaggatcaagctgactacatcaatgtgccagttgagggaccatacaagcctgctcactacaggtactgagaggagaattgtggagccttgattttcacaacttagtgattatggttaggaaaagttttcaagaggtcttgtgtgtgtttcttaatgtgtttgggggttagtggtttgaaggaaggggaaaagggtctgaatgttgaagaaagaccaaataaggaaggtaagatttggttgcgtgaaaaatattactttgttattgtttttagttttattgttaatttttttgctaaatctatgtcatcgtttttatcggtgagaaagaaatgagaatgaaaaagccttttaatttaa

SEQ ID NO: 7784 - DNA, 1560 bp, Flaveria ramosissima
ctcacatcctctgctctaaaacagagtgtgtgaattgtgttcaccggaaccctaactccgatcagacttaccggaaccctagctccggcaaccatgtctctcaccgtcgagaaaacctccaccggccgtgaatacaaggtcaaagacatgtcattggctgacttcggtcgtctcgagctcgaattagccgaggtcgaaatgccggggttgatgtcttgtcggacggaattcggaccttcacagccgttcaagggggctagaatcaccggatcactgcacatgacgattcaaaccggtgtgttgatcgaaaccctaactgcattgggcgctgaagtgagatggtgctcgtgcaacatcttctcgacgcaggaccacgctgcggcggcgatcgcacgtgactccgccgcggtgttcgcgtggaaaggggagacgctgcaggagtactggtggtgtacggagcgagcgcttgattggggccctggtggtggaccggatctgattgttgacgatggtggtgatgcgacgttgttgattcatgaaggtgtgaaggctgaagaggagtttgagaagagtggaaagctgccggatccgaactcgactgataacgctgagtttcagatcgtgttgtcgattattaaggaggggttgcagagtgacccgaagaagtatcacaggatgaaggataggttggttggtgtgtcggaggagactaccactggtgttaagaggttgtatcagatgcaggctaatggtaccttgttgttccctgcgattaacgttaatgactccgttactaagagcaagtttgacaacttgtatgggtgccgccactcactcccagatggactgatgagagccactgatgttatgattgccggaaaggttgcagtagtctgcggttatggtgatgtcggcaagggttgcgccgccgccatgaaacaagctggtgcacgtgtcatagtgacagaaatcgaccccatttgtgcccttcaggctctcatggaaggcctccaagtcctaaccctagaagacgttctctcagaagctgacatctttgtcaccaccacaggcaacaaagacattatcatggttgaccacatgaaaaagatgaaaaacaacgccatcgtctgcaacattggccatttcgacaatgaaatcgacatgcttggcttggaaacatacccaggcgtaaaaagaatcaccatcaaaccccaaaccgacaggtgggtattccccgaaaccaacactggcatcatcgtgttagccgagggtcggctcatgaacttgggctgcgccactggtcaccctagttttgtgatgtcatgctcgttcacaaaccaagtgatcgcgcagctcgagctgtggaaagagaagtcatcagggaagtacaagaaggaagtatatgtcctgcctaaacatcttgatgagaaagtggctgcacttcatcttggaaagctcggagccaagctgactaagcttagccaggaccaagctgactacatcagtgtgccagttgagggtccatacaagcctgctcactataggtactgagttatgttt

SEQ ID NO: 7785 - DNA, 1557 bp, Flaveria ramosissima
cccacatcctcttctataaaccagtgtgtgtgtgaattgtgatcactggaaccctaactccgatcagactcaccggaaccctaactccgaccaccatgtctctcaccgtcgagaaaacctccaccggccgtgaatacaaggtcaaagacatgtcattggctgacttcggtcgtctcgagctcgaattagccgaggtcgaaatgccggggttgatgtcttgtcggacggaattcgggccttcacagccgttcaagggggctagaatcaccggatcactgcacatgacgattcaaaccggtgtgttgatcgaaaccctaactgcattgggcgctgaagtgagatggtgctcgtgcaacatcttctcgacgcaggatcacgctgcggcggcgatcgcacgtgactccgccgcggtgttcgcttggaaaggggagacgctgcaggagtactggtggtgtacggaacgagcgcttgattggggccctggtggtggaccggatctgatcgttgacgatggtggtgatgcgacgttgttgattcatgaaggtgtgaaggctgaagaggagtttgagaagagtgggaagctgccggatccgaactcgactgataacgctgagtttcagatcgtgttgtcgattattaaggaggggttgcagagtgacccgaagaagtatcacaggatgaaggataggttggttggtgtgtcggaggagactaccactggtgttaagaggttgtatcagatgcaagctaacggtaccttgttgttccctgcgattaacgttaatgactccgttactaagagcaagtttgacaacttgtatgggtgccgccactcactcccggacggactgatgagagctactgatgttatgattgccggaaaggttgcagtagtctgtggttatggtgatgtcggcaagggttgtgccgccgccatgaaacaagccggtgcacgtgtcatagtgacagaaatcgaccccatttgtgcccttcaagctctcatggaaggcctccaagtcctaaccctagaagacgttctctcagaagctgacatctttgtcaccaccacaggcaacaaagacattatcatggttgaccacatgaaaaagatgaaaaacaacgccatcgtctgcaacatcggccatttcgacaatgaaatcgacatgcttggtttggaaacatacccaggcgttaagagaatcaccatcaagccccaaaccgacaggtgggtattcccagaaaccaacactggcatcatcgtgttagccgagggtcggctcatgaacttgggctgcgccactggtcaccctagttttgtgatgtcgtgctcgttcacaaaccaagtgatcgcgcagctcgagctgtggaaagagaagtcatcagggaagtacaagaaggaagtttatgtgttgccgaagcatcttgatgagaaagtggctgcacttcatcttggaaagcttggagccaagctgactaagcttagccaggaccaagctgactacatcagtgtgccagttgagggtccatacaagcctgctcactataggtactgagtat

SEQ ID NO: 7786 - DNA, 1623 bp, Flaveria ramosissima
ctcacatcctctgctataaaacagagtgtgtgtgtgtgaattgtgatcaccggaaccctaactccgatcagactcaccggaaccctagctccggccaccatgtctctcaccgtcgagaaaacctccaccggccgtgaatacaaggtcaaagacatgtcattggctgacttcggtcgtctcgagctcgaattagccgaggtcgaaatgccggggttgatgtcttgtcggacggaattcgggccttcacagccgttcaagggggctagaatcaccggatcactgcacatgacgattcaaaccggtgtgttgatcgaaaccctaactgcattgggcgctgaagtgagatggtgctcgtgcaacatcttctcgacgcaggaccacgctgcggcggcgatcgcacgtgactccgccgcggtgttcgcgtggaaaggggagacgctgcaggagtactggtggtgtacggaacgagcgcttgattggggccctggtggtggtccggatctgatcgttgacgatggtggtgatgcgacgttgttgattcatgaaggtgtgaaggctgaagaggagtttgagaagagtgggaagctgccggatccgacgtcgactgataacgctgagtttcagatcgtgttgtcgattattaaggaggggttgcagagtgacccgaagaagtatcacaggatgaaggataggttggttggtgtgtcggaggagactaccactggtgttaagaggttgtatcagatgcaagctaacggtaccttgttgttccccgcgattaacgttaatgactccgttactaagagcaagtttgacaacttgtatgggtgccgccactcactcccggatggactgatgagagcaactgatgttatgattgccggaaaggttgcagtagtctgcggttatggtgatgtcggtaagggttgtgccgccgccatgaagcaagccggtgcacgtgtcatagtgacagaaatcgaccccatttgtgcccttcaagcactcatggaaggcctccaagtcctaaccctagaagacgttctctcagaagctgacatctttgtcaccaccacaggcaacaaagacattatcatggttgaccacatgaaaaaaatgaaaaacaacgccatcgtctgcaacatcggccatttcgacaatgaaatcgacatgcttggtttggaaacatacccaggcgttaagagaatcaccatcaaaccccaaaccgacaggtgggtattcccagaaaccaacactggcatcatcgtgttagccgaaggtcggctcatgaacttgggctgcgccactggtcaccctagtttcgtgatgtcgtgctcgttcacaaaccaagtgatcgcgcagctcgagctgtggaaagagaagtcatcagggaagtacaagaaggaagtttatgtgttgcctaagcatcttgatgagaaagtggctgcacttcatctcggaaagcttggagccaagctgactaagcttagccaggaccaagctgactacatcagtgtgccagttgagggtccatacaagcctgctcactataggtactgagtatgtttgaaagatgaattgctttatacttattgattgttatggggtttggtggttggtggttgg

SEQ ID NO: 7787 - DNA, 1848 bp, Lotus japonicus
acacatactctaacttccacccttctctctcgctctcttgctcatcattcttgtgatctcatttctctcatcataaccaaaaatggcgttggtggtagagaaaaccacgtccggccgtgaatacaaggtcaaggacatgacccaggccgacttcggacgcctcgagatcgacctcgccgaggtcgaaatgcccggtctcatctcctgccgaaccgagttcggtccctctcagcccttcaagggcgccaagatcacgggctccctccacatgaccatccagactgccgtcctcattgagaccctcaccgccctcggcgctgaggtccgctggtgctcctgcaatatcttctccacgcaggaccacgctgctgccgcgatcgctcgcgacagcgctgcggtcttcgcgtggaagggagagactctgcaggagtactggtggtgcactgagcgggcactcgattggggtccctccgggggacctgaccttatcgtcgacgacggcggtgatgccacgctactcatccatgagggtgttaaggctgaggaggtgtatgagaaggatgggacgtttcctgatccggcttccactgacaatgctgagttccagatcgtgcttaccatcatcagggacgggttgaagaccgatcctcacaggtaccgcaagatgaaggagaggctcgtcggtgtttcggaagagaccaccaccggtgtcaagaggctttaccagatgcaggctaatggtaccctcttgttccccgctatcaatgtcaatgactctgtcaccaagagcaagtttgataacttgtacgggtgtcgtcactcactccccgatggtctgatgagggccactgatgtcatgatcgccggtaaggttgctgttgtcgctggttatggagatgttggcaagggttgtgctgctgccttgaagcaggctggtgctcgtgtgattgtcactgagattgaccccatttgtgctcttcaagctctcatggaaggcctccaagtccaaaccttggaggatgctgtttctgaggctgacatcttcgttaccaccactggtaacaaggacatcatcatggtagaccacatgaggaagatgaagaacaacgccatcattagcaacattggccactttgacaatgagatcgacatgcacggcctcgagacataccccggtgtgaagcgcatcacgatcaagcctcaaactgaccggtgggtcttccctgataccaactcaggtatcattgtcttggcggagggtcggttgatgaacttggggtgtgccacagggcaccctagttttgtgatgtcctgctccttcacaaatcaggtcattgctcagcttgagctgtggaaggagaagggttctgggaaatatgagaagaaggtgtatgttttgccgaagcaccttgatgagaaagtggctgctcttcatcttggcaagcttggagcaaggctcaccaagcttaggaaagatcagtcagactacatcagtatacctattgagggtccatacaagcctgctcactacaggtactaagatgatgatcaagggataatgatgatattaattaagcttctaaggaataaacgatttcgtcgatcggcttcattgtttcacttccattttttgattttttctcattatagttttcagatttgtgtgggtagatttggcaatttctttgattttttgtagaatcttagttccattgggttgaagggtaagggaaggaaaacaaacctcttggtctctctgcaatgagaccaaatttgttttagaataaggctttgggtgtggctgtgcaggtttatgatttagcagttataatacatgcgtgtttgccc

SEQ ID NO: 7788 - DNA, 1790 bp, Triticum aestivum
cctccgctgccagatccaatccaccaaccttctccatggcgctctccgtggagaagacctcgtcgggccgggagtacaaggtcaaggacctctcccaggccgacttcggccgcctcgagctcgacctcgccgaggtcgagatgcccggcctcatggcctgccgcaccgagttcgggccctcgcagcccttcaagggcgcccgcatatccggctccctccacatgaccatccagaccgccgtcctcatcgagacccttaccgcgctcggcgccgaggtccgctggtgctcctgcaacatcttctccacccaggaccacgccgccgccgccatcgcccgcgactcggccgccgtcttcgcctggaagggcgagaccctcgaggagtactggtggtgcaccgagcgctgcctcgactggggcgccggcggcggccccgacctcatcgtcgacgacggcggtgacgccacgctgctcatccacgagggcgtcaaggccgaggaggagttcgagaagtccggcaaggtccccgacccggagtccaccgacaaccccgagttcaagatcgtcctcaccatcatccgcgacgggctcaagaccgacgcccacaagtaccgcaagatgaaggagaggctcgtcggtgtctccgaggagaccaccaccggcgtcaagaggctctaccagatgcaggagtccggcaccctcctcttccccgccatcaacgtcaacgactccgtcaccaagagcaagtttgacaacctttacggttgccgtcactcgctccctgatggtcttatgagggccactgatgttatgatcgccggcaaggttgccgtggtctgtggttatggtgatgttggcaagggctgtgccgccgcacttaagcaggctggtgcccgtgtgatcgtgacagagattgaccccatctgtgcccttcaggccctgatggagggcatccagatcctcaccttggaggatgttgtctctgaggctgatatctttgtgaccaccaccggaaacaaggacatcatcatggttgaccacatgaggaagatgaagaacaacgccattgtctgcaacattggtcactttgacaacgagattgacatgaacggccttgagacctaccctggtgtcaagcgcatcaccatcaagccccagactgaccgctgggtcttccccgagaccaagaccggcatcattgttcttgctgagggtcgtctgatgaaccttggatgtgccactggccaccccagctttgtcatgtcctgctcattcactaaccaggttattgctcagcttgagttgtggaacgagaaggccaccggcaagtacgagaagaaggtgtacgttctccccaagcacctcgacgagaaggtcgcggccctccacttgggcaagctcggcgccaggctgaccaagctcaccaagtcccagtctgactacattagcatcccagttgagggtccttacaagcctgcggcctaccggtactagtgtgtccagcacggctagcggctggcctgagcctgagtcggagcagcggcaccaacgggaactctatcaactatcctgtttcccttctattatcttacatgctgtctcttaggcggaggatttgttattatggttatgttttgagccttgtgagggttgggagaggcggcgtttgcttttgcccagaaataatggcattattattggtttgagtgaggaggtgtgcttttccagatacagttttgtctcgtttgttctgccatgtctgaaatccttcgcaagctgttgctcatattt

SEQ ID NO: 7789 - DNA, 1979 bp, Triticum aestivum
cctcctctgccagatccaatccaccaaccttctccatggcgctctccgtggagaagacctcgtcgggccgggagtacaaggtcaaggacctctcccaggccgacttcgggcgcctcgagctcgacctcgccgaggtcgagatgcccggcctcatggcctgccgcaccgagttcggtccctcgcagcccttcaagggcgcccggatctccggctccctccacatgaccatccagaccgccgtgctcatcgagaccctcaccgccctcggcgccgaggtccgctggtgctcctgcaacatcttctccacccaggaccacgccgccgccgccatcgcccgcgactccgccgccgtcttcgcctggaagggcgagaccctcgaggagtactggtggtgcaccgagcgctgcctcgactggggcgccggcggcggccccgacctcatcgtcgacgacggcggcgacgccacgctgctcatccacgagggcgtcaaggccgaggaggagttcgagaagtccggcaaggtccccgacccggagtccaccgacaaccccgagttcaagatcgtcctcaccatcatccgcgacgggctcaagaccgacgcccacaagtaccgcaagatgaaggagaggctcgtcggcgtgtccgaggagaccaccaccggcgtcaagaggctctaccagatgcaggagtccggcaccctcctcttccccgccatcaacgtcaacgactccgtcaccaagagcaagtttgacaacctttacggttgccgtcactcgctccctgatggtcttatgagggccactgatgttatgatcgccggcaaggttgccgtggtctgcggttatggtgatgttggcaagggctgtgcggccgcactcaagcaggctggtgcccgtgtgatcgtgacagagattgaccccatctgtgcccttcaggccctgatggagggcatccagatcctcaccttggaggatgttgtctctgaggctgatatctttgtgaccaccaccggaaacaaggacatcatcatggttgaccacatgaggaagatgaagaacaacgccattgtctgcaacattggtcacttcgacaatgagatcgatatgaacggccttgagacctaccctggtgtcaagcgcatcaccatcaagccccagactgaccgctgggtcttccccgagaccaagactggcatcattgttcttgctgagggtcgtctgatgaaccttggatgtgccactggccaccccagcttcgtcatgtcctgctcattcaccaaccaggttattgctcagcttgagttgtggaacgagaaggccactggcaagtacgagaagaaggtgtacgttctccccaagcacctcgacgagaaggtcgcggccctccacttgggcaagctcggcgccaggctgaccaagctcaccaagtcccagtctgactacattagcatcccagttgagggtccgtacaagcctgcggcctaccggtactagtgtgtccagcacgactagcggctggcctgagcctgagtcggagcagcggcaccaacgggaactcttatcaactatcctgtttcccttctattatcttacatgctgtctcttaggcggaggatttgttattatggttatgttttgagccttgtgagggttgggagaggcggcgtttgcttttgcccagaaataatggcattattattggtttaagtgaggtggtgttcttttccatatgctgttttatctcggttgttctactgtgtctgaaatccttcggaatctgatgctcatattttgtgtggtttcttaatgactattgccgtagatgcttgtttatccctgaagtttcatcacagcgtcatgtcacaaaaaagtttctttcaaatatgaattcagtggtgtattttgttggttaaatcatatgtaaaaaaactagtgtatttaattggttaagctgaatataaaaaaatatgtggctcgacc

SEQ ID NO: 7790 - DNA, 2083 bp, Zea mays
aatagattgattccatcattggtcaccaatgtctcagatccgcgcatctcacctgacgtcttcacccaccaacggcactccggtatggcgactcaccaaccccccaccaatcccccgcccagatccgacggccgctaatcgccgcgtccgcaaaccaacggtctggcgccgtcgtctcttcccataaaaccctccccacccctgcctcccaaccgcgccgtcttctccctcactctcgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgcactcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctcaagagcatacttaaagacgg

SEQ ID NO: 7791 - DNA, 1805 bp, Solanum phureja
tgccacacttcttcttcttccctgaaaaaccccaaaggaagaagagaaaagcctatcagatctcatctcaaaccattccatttctctacccatggctctactcgttgagaagaccacttctggccgcgagtacaaggtgaaggacatgtcccaggctgacttcggcaggctcgaaatcgagcttgccgaagtcgaaatgcctggtctcatggcttcccgtactgaatttggcccttcacagcccttcaaaggtgcaaagatcactggatctctgcatatgactatccaaactgctgtccttattgaaaccctaactgctttgggtgctgaagttagatggtgttcttgcaacattttctcaactcaggaccatgctgcagcagccattgcacgtgatagtgctgctgtttttgcctggaaaggtgagactttgcaggagtactggtggtgtactgagagggcacttgattggggtccaggtggtggtcctgatctgattgttgatgatggaggtgatgctactctcttgattcatgagggagttaaggcagaggaggagtttgctaagaatgggacaatcccagatcctacttctactgacaatgttgagtttcaacttgtgcttactattattaaggagagcttaaagactgaccctttaaggtacactaagatgaaggagagacttgttggtgtttctgaggaaactaccactggtgttaagaggctttatcagatgcaggctaatggaactttgcttttccctgctatcaatgttaatgactctgttaccaagagcaagtttgacaacttgtatggatgccgccactcactgcccgatggtctcatgagggcaactgatgttatgattgccggaaaggttgctcttgttgctggttatggagatgttggtaagggatgtgctgctgccatgaaacaagctggtgcccgtgtgattgtgactgagattgacccaatctgtgctctccaggctaccatggaaggcctccaggttcttcctctcgaggatgttgtttctgaggttgatatctttgtgaccaccactggtaacaaggacatcatcatggttgaccacatgaggaagatgaagaacaatgccattgtctgcaacattggtcactttgacaatgaaatcgacatgcatggtcttgagaccttccctggtgtgaagaggatcacaatcaagcctcaaaccgacagatgggtcttcccagaaaccaacagtggcatcattgtcttggccgagggtcgtctcatgaacttgggatgtgccactggacaccccagttttgtgatgtcttgctctttcactaaccaagtcattgcccaactcgagttgtggaatgagaggaaaagtggcaaatacgagaagaaggtgtacgtcttgccaaaacacctcgacgagaaggttgctgctctccatcttggaaagcttggagctaagcttaccaaactcaccaaggatcaagctgactacattagcgtaccagttgagggtccttacaagcctgctcactacaggtactgagggaagagacactcatggtggaacaactatattgcggcatgattgttttgtttttaatactttgattttgtttaggtagtgtgtttttattattgttgggggatgttttggggggaaagttgatctaaatgtgttcgaataatatttgaattatggttggggtggtgtcatctgatatttgtactaagattcatttgcttttgtttctctataaattttgcttcaaggaaacaaagcctcatgttttccattttca

SEQ ID NO: 7792 - DNA, 1723 bp, Ocimum basilicum
gataaacctactgggtagagaagaacgaaaccaaacctcagatccaatctatttctctcaacccatggcgctccaagtcgagaagaccaactccggccgcgagtacaaggtcaaggacatgtcccaggccgacttcggccgcctcgagatcgagctcgccgaggtcgaaatgccgggcctcatgtcctgccgggccgagttcgggccctctcagcccttcaagggcgccagaatcactggcagcctccacatgaccatccaaaccgccgtcttgattgagaccctcactgccctcggcgctgaggtcagatggtgctcctgcaacatcttctctactcaagaccacgctgccgccgccatcgcccgcgacagcgctgccgtgttcgcgtggaaaggagagaccctgcaggagtactggtggtgcaccgagcgcgccctcgactggggccccggcggcggccccgatctgatcgttgacgacggtggtgatgctacgctgttgattcacgagggtgtgaaggcggaggaggagtacgagaagtctgggaagttgccggacccgagttccaccgataatgcggagtttcagatagtgctgactttgatcagagatgggttgaaggcagatccgagcaagtacaggaagatgaaggagagattggttggtgtttctgaggagactactactggtgtcaagaggttgtatcagatgcaggctaatggcactctgcttttccctgctatcaatgtcaatgattctgtcaccaagagcaagtttgataacttgtacggctgccgccactcacttcctgatggacttatgagggccacagatgtgatgattgccgggaaggttggagttgtgtgtggttatggagatgtgggaaagggctgcgctgctgcactaaaacaagcaggtgcccgtgtgatcgtgactgagatcgatcccatctgcgctcttcaggccctcatggaaggcttccaagttctaaccctcgaggacgttcttgctgatgccgacatctttgtcactaccaccggcaacaaggacatcatcatggtggaccacatgaggaagatgaagaacaatgccatcgtctgcaacattggtcactttgacaatgagatcgacatgcagggcctcgagacctacccaggcgtgaagaggatcaccatcaagccacagaccgatcgatgggttttcccagaaaccaacactggaatcattgtgttggctgagggccgtttgatgaacttgggatgtgcaacggggcaccctagctttgtcatgtcatgctccttcaccaaccaggtcatcgcccagctcgagctctggaaggagaggagcagtggaaagtatgagaagaaggtgtacgtgttgcctaagcatcttgatgagaaggtggctgctcttcaccttggaaagctcggggccaagctcactaagcttacaaaggatcaggctgactacattagcgtaccggttgagggtccttacaagcctcctcactacaggtactaagaggcaaaccaagtattattgattcttcccagagagagttgtttgtttgcagttataactgcattgagtttgtagttttgatgtttgggttttcgggattgtgtacttttgttggggaagaatttatggctaaggcaagatctatgtgaaaccgctagttagccttttgtttgagttttcatttactattaatggaagctt

SEQ ID NO: 7793 - DNA, 2251 bp, Gossypium hirsutum
ctttgttcctttccaagggagagtgtgatctgttcttcttcacttcatttctctaacccatggctctttccgtcgagaaaaccgccgccggccgcgagtacaaggtcaaggacatgtctcaggctgacttcggtcgtctcgagatcgagttggccgaggtcgaaatgcccggtctcatggcttgccgagccgagttcggccctgcccaacctttcaagggagccaaaatcaccggttctcttcacatgaccatccagaccgctgtcctcatcgaaaccctcaccgccctcggagctgaagtccgttggtgctcttgcaatatcttctctacccaagaccatgccgccgccgccattgcccgtgactcggcagccgtgttcgcctggaaaggtgagaccctccaggaatactggtggtgtaccgagagagcccttgactggggtcccaccggtggacctgatctgatcgtggatgatggtggcgatgctactctgttgatccatgaaggagttaaagccgaggaggtttatgagaaaaccgggcagctcccagatccgtcttctaccgacaatgccgagtttcagattgttttgaccataattagagatgggttgaaggcagatcccaagaagtatacaaggatgaaggagagattagttggtgtttctgaggaaactacaaccggtgttaagaggctttatcagatgcaggccaatggaaccttgttgttccctgctattaatgtcaatgactctgtcaccaagagcaagttcgataacttgtatggatgccgtcactctcttcccgatgggttgatgagagctaccgatgtcatgattgctggtaaggtcgctgttgtctgtggttatggtgatgtcggcaagggttgtgctgctgccttgaagcaagccggtgctcgcgtcattgtcaccgagatcgatcccatctgtgcccttcaggctctcatggaaggacttcaagttttgacccttgaggatgttgtctccgaggctgatatctttgtcaccaccactggtaacaaggacatcatcatggttaaccacatgaggaagatgaagaacaatgccattgtttgcaacatcggtcacttcgacaatgaaattgacatgctcggtctcgagaattatcctggtgtcaagcgcattaccatcaagcctcaaaccgataggtgggtcttccctgaaaccaacaccggcatcattgtgttggctgaaggacgtctcatgaacttgggttgtgctactggccaccctagctttgtcatgtcatgctctttcaccaaccaggtgatcgcccagctcgagctgtggaaggagaaggcaaccggcaagtacgagaagaaggtgtacgttttgcctaagcaccttgatgagaaggtggctgctcttcaccttggaaagcttggggctaacctcaccaagctcaccaaggatcaggctgactacattagcgtccccattgagggtccttacaagcctcctcactacaggtactgaggagagaatacgagagagagagagggagagagttggactagaaaaaggaaccatacaacgggatggtttgattgtttgttttactaaaatttattgatgatttgtggttagatggttagattttgattttgataggagtttgcgtgtgggatggatggtaagttttggtggaaaagaaatgaggtctctgcttgaagaagaccaaatggggtctgaataaggtgatggggattgtgtgggagatgatattttgccattggtgcagtccagttttgctgcatctggttttcaattaattaatcaaaaaaagatgcaactttgctttcattttcactttctatttcatcaaatagtgacacccaactttatatttaattggctttattatggcagaggaaatttcatagaggaaaaaagaacgttgaactaaacagtaggatatttgttgacaaaaaggcagttgctggttggggtaggttgtattcatttctaattttcatacttggcgtcgatggtggccttagaaaatggaataagaaagggtaaattatatggtcacttaattcaggcagcatagggtggttggcaagcgtaaaggaggcaattgactactgatttggggtgtccaactttggataaataggcaggcctctctctcttaggccatccttttggatttgaaagctgcacgtttcacattttattccatgccactctaattagaacctgcgcgg

SEQ ID NO: 7794 - DNA, 1950 bp, Eucalyptus grandis
cgctcacccctaagcccttctctctctctcttcccctgtttctctcgccgctgttcctgcgtttcagatctctgtccgaagaaggaagcagcagagcagcagaggaagatggcgttgtccgtggagaagaccaccggcggccgggagtacaaggtgaaggacatgtcccaggccgacttcggccgcctcgagatcgagctggcggaggtggagatgccggggctcatggcctgccgcacggagttcggcccctcccagcccttcaagggcgcccgcatcaccggctccctccacatgaccatccagaccgccgtcctcatcgagaccctcaccgccctcggcgccgaggtccgctggtgctcctgcaacatcttctccacccaggaccacgccgccgccgccatcgcccgcgactccgccgccgtgttcgcctggaagggcgagaccctccaggagtactggtggtgcaccgagcgcgccctcgactggggccccggcggcggccccgacctcatcgtcgacgacggcggtgacgccaccctcctcatccacgagggggtcaaggccgaggagatcttcgccaagaccggcaagctccccgacccggcctccaccgacaacgccgagttccagctcgtgctcaccatcatcagggacggcctgaagaccgacccgcagaggtaccacaagatgaaggacaggctcgtcggcgtctcggaggagaccaccactggcgtcaagaggttgtaccagatgcaggccaacgggactctcttgttccctgccatcaacgtcaatgactctgtcaccaagagcaagtttgataacttgtatggctgccgccactctctccctgacggtctgatgagggccaccgatgtcatgatcgctggaaaagttgctgtggtctgtggatacggagatgtgggcaagggctgcgctgctgccctcaagcaggctggtgctcgcgtcattgtgactgagatcgatcccatctgtgctctccaagctctcatggaaggcctccaggtcctacccctccaggatgttgtctctgaggctgacatctttgtcaccaccactggcaacaaggacatcatcatggtccacgacatgaagaagatgaagaacaatgccatcgtctgcaacatcggtcactttgataacgagattgacatgcacggcctggagaacttccccggtgtgaagcgcatcaccatcaagccccaaaccgacaggtgggtcttccccgacaccaagtcaggcatcatcgtcttggcggagggacgcctcatgaacttgggttgtgccaccggccaccctagcttcgtcatgtcctgctccttcacgaaccaggtgattgcccagcttgagctgtggaaggagaagtcctctggcaagtataagaaggaggtctatgtcttgcccaagcacctggatgagaaggtggctgctcttcacctcggcaagctcggtgctaagctcaccaagctcagcaaggagcaagccgactacattagcgtccccgtcgagggtccctacaagcctcctcactacaggtactaggcgggttcacatgaagattttacggacggcttccccatttctttctcaatttgatttctcggtagaatggtgggatttttgttattcgggaagtatggttggatgtttttcggggcgaggaaggtgagctgataaatcgatgagactatgagagggtctatgaataaagtttgcaaggcctgtagaatagcatgttgttagtgctgcaattcaaccttgctgcacatgttttaccatatatctcgaagctgaaaggctgacttctttttcttttatattttctggggcgtctgtggacgagatgaaagaatatatgatccaatccgattgatcctgctttgtttccacgcgtttctacgttcaagtttcttctccattcactag

SEQ ID NO: 7795 - DNA, 1842 bp, Helianthus annuus
ctctaaacagatctacaaactcttcttcaccatggctctcaccgtcgagaaaacctccactggccgtgaatacaaagtcaaagacatgtccttagccgacttcggccgcctcgaactcgagctagccgaagtcgaaatgcccggacttatgtcctgcaggaccgaattcggcccatcgcagcccttcaaaggcgctcgcatcaccggttcactccacatgactattcaaaccggtgtccttatcgaaacccttaccgccttgggcgctgaggtcagatggtgctcttgcaacattttctccacccaggatcacgctgcggccgccatcgctcgcgattcggctgctgtgttcgcctggaagggggaaacactacaggaatactggtggtgtactgagcgtgctttggactgggggcctggtggtggtccagatctgattgttgatgacggtggtgatgctactttgttgatccatgaaggagtgaaggctgaggaggagtttgagaagactggaaagttgccagatcctagctcgactgataatgcggagtttcagattgtgttgtcgattattaaggaaggattggcgactgacccgaagaagtaccacaagatgaaggagagattggttggtgtgtctgaggagactaccactggtgttaagaggttgtaccagatgcaagctaacggtactctgttgttccctgctattaatgtcaacgactctgttaccaagagcaagtttgacaacttgtatggatgccgtcactctctccccgatggtttgatgagagccaccgatgtcatgattgccggaaaggtagccgtcgtctgcggttacggagatgtcggaaagggttgtgctgccgccatgaaacaagccggtgcccgtgtcatcgtcacagaaatcgaccccatctgcgctctccaggccaccatggaaggacttcaagtcctcaccttggacgacgtattttctgaagcttacattttcgtcaccaccaccggtaacaaagacatcatcatggtttctgacatgaagaagatgaagaacaacgccatcgtttgcaacatcggtcacttcgacaacgaaatcgacatgcttggactcgaaacttaccccggtgttcaaagaatcaccatcaaaccccaaaccgacaggtgggtcttccccgaaaccaagaccggcatcattgttttggccgagggtcgtctcatgaacttgggttgtgccactggtcaccctagtttcgtgatgtcttgctcgttcaccaaccaagtgatcgctcaactcgaactgtggaacgagaagaacaccgggaagtacaagaaggaggtgtacgtgttgccaaagcatcttgacgagaaggttgctgctcttcatcttggaaagcttggagctaagttgaccaagttgaccaaggaccaggctgactacatcagcgtaccagttgagggtccatacaagcctgctcactacaggtactgagcgtgtcggttttttgggaggacgttggttccttttcaagatacaattcgagtatgtgttagcgtttagttttgtttgttactttgatcgggggtgttgctgaggaagaaaccgactggttgtttcttgttgagacggctgtttatgttggtttgaataagggatgcgtgtgatggttgtgtggactcgattgtagttgttttttggtttagaggttttgcttgctatggcttttgcttcttatttcatatggaaaaaagagtaattttgtgcaccaagtatttgaattttataaaaaatctagtttggcaagccaaaatcaagacgtgcttgtttatattgtgggttcgaaa

SEQ ID NO: 7796 - DNA, 1882 bp, Prunus persica
gctctaatccctcactcgccacaaaccctattttgcagagaaagcaaaacagagtgagagattatctcccaacctttaccttcttctccaatggctctctccgtcgagaaaagcagcagcggccgcgagtacaaggtcaaggacatgtcccaggccgacttcggtcgcctcgagatcgagctcgccgaggtagaaatgccgggcctcatctcctgccgcactgaattcgggccctcccagcccttcaagggcgcccgcatcaccggctccctccacatgaccatccagaccgccgtcctcatcgaaaccctaaccgccctcggtgccgaggtccgctggtgctcctgcaacattttctccacccaggaccatgccgccgccgccatcgcccgcgacagcgccgccgtcttcgcctggaagggcgagaccctccaagagtactggtggtgcaccgagcgcgccctagactggggtcccggcggcggacccgatctgatcgtcgacgacggcggtgacgccacgttgctgatccacgagggggtcaaggccgaggaggagtttgagaagtccgggaagcttcccgaccccgcctccaccgataaccaggagttccagctcgttcttaccattatcagagatgggttgaagaccgaccccaagaggtaccacaaaatgaaagacaggttggtcggtgtttctgaggagaccaccaccggagttaagaggttgtatcagatgcaggctagtggggcgcttttgttccctgctattaatgtcaatgactctgttaccaaaagcaagttcgacaacttgtacgggtgccgtcactctctccctgatggtttgatgagagccactgatgtcatgattgccggaaaggtttccgttgtctgtggatacggagatgttggaaagggctgtgctgctgccctcaagcaagctggatcacgtgtgattgtgactgaaattgacccaatctgtgccctccaggctcttatggaaggccttcaggttcttcctctggaagatgttgtctctgaggctgatatcttcgttaccaccaccggtaacaaggacatcatcatggtagaacacatgaggaagatgaagaacaatgccattgtttgcaacattggtcactttgacaatgagattgacatgcatggtcttgagacatacccaggagtaaagcgcatcaccatcaagcctcaaactgacaggtgggtcttcccagagactaacaccggcatcatcattttggctgagggccgtctcatgaacttgggttgtgccactggacaccccagctttgtgatgtcctgttctttcaccaaccaagtgattgcccagctcgagttgtggaatgagaggaagtccggcaagtatgagaagaaggtgtatgttttgccaaagcaccttgatgagaaggtcgctgcccttcatcttggcaagcttggagctaagctcaccaagctcaccaaggaacaggctgactacatcagcgtgccagttgagggtccatacaagccagctcactacaggtactgagaggaggagaagattgtcaaggacaagagacatgagaaaaaaatatatatttggacgggttgtttttaatttgtttattttacattttgatgaactgtgttagaattgtaggttaaattttgtaggagtttgtggtgtgatggggaaaagggtgggaggaaggaaatggatgattaggtctcagatgaagacctggggtttgaataaggatggaatggggctgtgtttggatacatcttctgccgcatccgttgtgctgcatttgattatcattttactaccaaaaaagagatcctaaaaatgaacaatttaccttccatttgatttttggttc

SEQ ID NO: 7797 - DNA, 1979 bp, Glycine max
gaaaaatgaaatgcgtgtgaaaattggaaggaggtaaggctgggtcgacccagatctagttgagctcaccaactcccgctcccatttccttatttatagacagagtctgattgtttcctcaccactccctccactctctttctctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagaccgccgttctcattgagaccctcaccgcccttggcgccgaggtccgctggtgctcctgcaacatcttctccacccaggaccacgccgccgccgctattgcccgcgacagtgccgccgtcttcgcctggaagggtgagaccctccaggagtactggtggtgcaccgagcgcgccctcgactggggccccggtggtggacccgacctcatcgtcgacgacggtggtgacgctacccttctcatccacgaaggcgtcaaggccgaggagctctatgagaagaccggcgaactccccgaccccaactccaccgacaacgccgagtttcagatcgtgcttaccatcatcagagatgggttgaagaccgatcccaccaggtaccgcaagatgaaggagcgtctcgttggggtttctgaggaaaccaccactggagttaagaggctctatcagatgcaggcgaatgggactcttctcttccctgctattaatgtcaatgactctgtcaccaagagcaagtttgacaacttgtatgggtgccgtcactctctccctgatggtctcatgagggctaccgatgttatgattgctggaaaggtggctgttgtggctggatatggtgatgttggcaagggttgtgctgctgcaatgaagcaggctggtgctcgtgtcatcgtgaccgagattgatcccatctgtgcccttcaggctctcatggaaggccttcaggttctgaccttggaggatgttgtttctgaggctgatatctttgtcaccaccaccggtaacaaggacatcatcatggttgaccacatgaggaaaatgaagaacaatgccattgtttgcaacattggtcactttgacaatgagatcgacatgcttgggctggagaactaccccggcgtgaagcgcatcaccatcaagccccaaactgacagatgggtcttccctgagaccaacaccggtatcattgtcttggctgagggtcgattgatgaacttgggatgcgccactggacaccccagttttgtgatgtcctgctccttcaccaaccaggtcattgctcagcttgagttgtggaaggagaagagtaccggcaagtacgagaagaaggtttacgttttgcccaagcaccttgatgagaaggtggctgcacttcacctgggcaaacttggagctaagctgacccagcttagcaagtcccaggctgattacatcagtgtgcctgttgagggtccatacaagcctgctcactacaggtactaagtgattgagatgatcaactgaaaagtgagtgagggaaagacaaaaatcggttttatcaatcggatttgattgtttaattttcctttttttgatttttggtgttagacttttcagatttgtggtagaagaattgtagccatttttatttctgtagaacttttgttcgagtgggtgggaccagtaaggaggaaggcggcatcctgttggtttctgtgatatgaaaccaatttgggttgaataaggcttgttttgtttgggggatgtgtgcattttgctttattaaatactaaaatttgtgtttctttctgccttttcaatacatcaaagaaaataaaaaaattcctaccc

SEQ ID NO: 7798 - DNA, 1801 bp, Ipomoea nil
actcgcttcttcctaaacccagaagaagagaggcccagatctactccccctactgttcatactctctctacccatggctttgaccgtcgagaaaaccagttccggccgcgagtacaaggtcaaggacatgtctcaggccgatttcgggcggctcgaattggagctcgccgaggttgaaatgcctgggctcatggcttgccgggccgaattcgggccttcccagcccttcaagggcgccaggatcaccggcagtttgcatatgaccatccaaaccgccgtcctgatcgagaccctcaccgccctcggcgccgaggtcagatggtgctcctgcaacatcttctccacccaggaccacgccgccgccgccgtcgcccgcgacagcgccgccgtcttcgcctggaaaggggagactctccaggagtactggtggtgcacggagagggccctcgactggggccccggcggcggcccggatctcatcgtcgacgacggcggcgacgccaccctcctcatccacgagggcgtcaaggccgaggaggagtacgccaaaaacggcaccgttccggatccaagctccaccgacaatgccgagttccagattgtcctcaccatcatcagagacggcctcaaggccgatcccaagaagtacaccaggatgaaggagagactcgtcggtgtttccgaggagaccactactggtgtcaagagactttatcagatgcaggagagtggaactcttcttttccccgccattaatgtcaacgactctgtaaccaagagcaagtttgacaacttgtatggatgccgccactctcttcccgatggtttgatgagagccactgatgtgatgattgccggaaaggtggcagttgtgtgtggttacggagatgttggcaagggctgtgctgcagctttgaagcaggctggtgctcgtgtgattgtgactgagattgatccaatctgtgctctccaggccctcatggagggtctccaagttcttaccctcgaggatgttgtctcggaagccgatatctttgtcaccaccacgggcaacaaggacatcatcatggttagccacatgaagaagatgaagaacaacgccattgtttgcaacattggccacttcgacaatgaaatcgacatgcacgggctcgagacgtaccctggcgtgaagagaatcaccatcaagcctcagactgacagattcgtcttccccgagaccaagactggcatcattattctggccgagggccgtctcatgaacttgggttgcgccaccggacaccccagtttcgtgatgtcctgctcattcaccaaccaagtcatcgcccagcttgagctgtggaaggagaagaacaccggcaagtacgagaagaaggtttacgtcttgccaaagcacctcgatgagaaggttgctgcccttcatctcgggaagctcggtgccaagctcactaaacttacccccgaacaagctgcttacattagtattccagttgagggtccttacaagcctcctcactacaggtactaagcggaaggaagcctcgaagatcaagaagagaatgtgttttaatgcgattgttgccttctttatacacattttgatttgcactagagacaggtagtttttggttgatggattttgggaggctggaatatttgaaaggatggtctttcttgtaaaagaccaccttatatgttgaataaggttgtgtggttggaggtgtgtggtattgtagcctgtttctgttagattggtttgcatctgttatggcttttctttcataaaaaatgaaaccaa

SEQ ID NO: 7799 - DNA, 1692 bp, Helianthus annuus
tctcttctcaactagatctacatatccaaaaccctaacaatgtctctcaccgtcgagaaaacctccaccggccgtgaatacaaggtcaaggacatgtccttagccgacttcggccgtctcgaactcgagctagccgaagtcgaaatgcccggtttgatgtcatgtaagactgaattcggaccctcgcaaccattcaagggtgcgaggatcaccggttcactccacatgacaattcaaaccggtgtcttaatcgaaacactaaccgccttaggcgcagaagtcagatggcgctcctgcaacattttctccacgcaggaccacgcagccgctgccatcgcacgtgactcggccgcggtgttcgcgtggaaaggagaaacgttacaggagtactggtggtgtaccgaacgagctcttgattggggcccaggtggtggacctgatttgattgtggatgatggtggtgatgccactcttttgatccatgaaggtgtgaaggcggaagaggagtttgcgaaaaccggaaagttacctgacccgagctccacggataacgctgagtttcagatcgtgttgtcgattattaaagacgggttgcagagtgaccccaagaagtaccataagatgaaagataggttggttggtgtgtctgaggagactaccactggtgttaagaggttgtaccagatgcaggctaatggtaccttgctgttccctgccatcaatgttaatgattcagtcaccaagagcaagtttgacaacttgtatggatgccgccactcactccctgacggactgatgagagccactgatgtcatgattgctggaaaagttgcagtagtctgcggttatggtgatgttggcaagggttgtgctgccgcaatgaaacaagctggtgcgcgtgtcatagtcacagaaatcgaccccatttgtgcccttcaggctctaatggaaggtctccaggttctaaccctcgaagacgttctctcagaagctgacatcattgtaaccaccacgggtaacaaagacatcatcatggttgaccacatgaagaaaatgaaaaacaacgcgatcgtctgcaacattggacattttgacaatgaaatcgacatgctcgggttagaaacataccctggtgtgaaaagaatcaccatcaaaccacaaaccgacagatgggtgtttcctgaaaccaacagtgggatcattgtgttagctgaaggtcggctcatgaacttgggttgcgccacgggccaccctagttttgttatgtcgtgctcgtttactaatcaagtgatcgcccaactcgagttgtggaaagaaaaggcaaccgggaagtacaagaaagaagtgtatgtgttgcctaaacatctagatgagaaagtggctgcacttcatcttggaaagcttggagccaagctgactaagcttagccaggaccaagctgattacatcagtgtgccagttgagggtccatacaagccggctcagtacaggtattgagcagagaacaagcaaagtgtcggtttggtggttgggaaaggtggttggagagaattgattggtttcttgaaggattatgctatggtttaaataaggggtggtgtaagaaggtggtgtgaagcattgaagttgttatttttgttggctttgtgttatgtttcattgacaaaattaaattggaaaaaagatatttcc

SEQ ID NO: 7800 - DNA, 1635 bp, Valeriana officinalis
ctacctcatagaagtgagaagtataataaaccttaatttcccagatctgaagagagaaacactcagatctatataatcactaatggctgctttagttgcagagaaaactgcttccggccgggaatacaaggtcaaggacatgtccttggctgatttcggaaggctggagcttgagcttgctgaggttgaaatgcccggacttatgtcttgccggactgaattcggaccttcgcagccttttaagggtgctaggatcaccggatctctccacatgactattcagaccggtgttttgatcgagactcttactgctcttggtgctgaggttagatggtgctcctgcaacatcttctctactcaggatcatgctgctgccgccatcgctcgtgatagctgtgccgtctttgcctggaagggagagactctacaggagtactggtggtgcacagagagagccctagattggggtccaggtggtggacctgatctgattgttgatgatggtggtgatgcaactctgttgatccatgaaggagtgaaggctgaggaggagtttgagaagtccgggaagattccagacccaacttccactgacaaccccgagtttcagcttgttttgactatcattcgtgacggtttgaagaccgaccccaaaaagtaccacaagatgaaggacagacttgttggtgtttctgaggagactactactggtgttaagaggttgtaccaaatgcaagctaatggtaccttgttgttccctgctatcaatgttaatgactccgtcaccaagagcaagttcgacaacttgtacggttgccgccactcgctacctgacggtctgatgagagctactgatgtcatgattgccggaaaggttgctgtcatctgcggatacggagatgtcggaaagggttgtgcatcagcaatgaagcaagccggagcacgagtcatcgtgactgaaatcgatccaatctgtgccctacaagccctaatggaaggtctccaagtcctaaccctagaagacgctttgtcagaggctgacatcttcgtcaccacaaccggaaacaaggacatcatcatggttgaccacatgagaaagatgaagaacaacgccatcgtctgcaacattggccattttgacaacgaaatcgacatgttgggtcttgaaacatacccgggtgtgaagagaatcacgatcaaaccccagactgacaggtgggttttcccagaaaccaagaccggaatcttggtcttagccgagggtaggttgatgaatcttggatgtgctaccggtcaccccagttttgtgatgtcgtgctcgttcactaaccaagtcattgctcagctagaactatggaaggagaaatcttctggaaagtacgagaagaaagtgtacgttttgccaaaacatcttgacgagaaagttgcagctcttcatttgggtcagctcggagccaagttgaccaagttgagcaaagatcaagccgattacattagtgtgccgattgagggtccatacaagcctgctcactataggtattgagaaatgaaatttgaaggaaaatttgaaggaaggatgggatcttttatgtttggatttttgtttttattgattagttttttggattctgtgtt

SEQ ID NO: 7801 - DNA, 1815 bp, Malus domestica
aatgacggtaaatagtttttttttttttaatccatttcttggtagtaaaacgatagataaccggatgcagcacacaagtgatgctgcagcagaaattatcccacacaacccccgtcccattcccttattcaagcccctaggtcttccattgagacctaaatcatccctttccctcacacatcccataccctccgaaacccaccgacacaaactcctacaaaatttataaacctagaaaatctaccgcatttcatcacaagtgaaaataatcaaaagcaaaaaacaacccgtcgtccagatatagttttctttttctcatttctcgtctcattgacgacccctcttcagtacctgtaggcagctggcttgtatggaccctcgaccggcacgctgatgtagtcagcctgctctttggtgagcttggtgagcttagctccaagctttccaagatgaagggcagcaaccttctcatcaaggtgcttgggcaagacatacaccttcttctcgtacttgccggacttcctctcattccacaactcgagctgagcaatcacttggttggtgaaagagcaggacatcacaaagctggggtgtccagtggcacagcccaagttcatgagacggccctcagccaacacaatgatgccggatttggtctcggggaagacccacctgtcggtttgaggcttgatggtgatgcgcttcactccggggtatgtctcaagaccatgcatgtcaatctcattgtcaaaatgaccaatgttgcaaacaatggcattgttcttcatcttcttcatgtggtcaaccatgatgatgtccttgttaccggtggtggtaacaaagatatcggcctcagcgacaacatcctcaaggggaagaacctgaaggccttccataagagcctggagggcacagattggatcaatctcagtcacaaccacgcgggatccagcttgcttgagggcagcagcacaaccctttccgacatctccatatccacagacaacggaaacctttccggcaatcataacatcagtggctctcatcaaaccatcggggagagagtgacggcatccgtacaagttgtcaaactacataccttgctcttggtaacagagtcgttgacattgatggcggggaacaagagagcgccgctggcctgcatctgatacaatctcttgacgccggtggtggtctcctccgagactccgaccaacctgtccttcatcttgtggtacctcttggggtcggtcttcaagccatctctgatgatggtcagaacgagctggaactcctggttatcggtggaagacgggtcggggagagtcccggacttcgcgaactcctcctcggccttgactccctcgtggatcaagagggtggcgtcaccgccgtcgtcgacgatcagatcgggtccaccaccggggccccagtcgagggcgcgctcggtgcaccaccagtactcctggagggtctcgcccttccaggcaaagacggcggcgctgtcacgggcgatggcggcggctgcgtggtcctgggtggagaaaatgttgcaggagcaccagcggacctcggcgccgagggcggtgagggtttcgatgaggacggcggtctggatggtcatgtggagggatccggtgatgcgggcccccttgaagggttgggagggtccgaattcggtgcggcaggagacgaggccgggcatttcgacctcggcgagctcgatctcgaggcggccgaagtcggcctgggacatgtccttgaccttgtactcgcggccgctgctacttttctcgacggagagagccattgcgg

SEQ ID NO: 7802 - DNA, 1706 bp, Taraxacum officinale
tctcttttgaaccagagtgtctcagatctgttctgaaaaattccaaacctaacaccggtcatggctctaaccgtcgagaagacgtccaccggacgtgaatacaaggtcaaggatatgtccttggctgatttcggcagacttgaacttgaattagccgaagttgaaatgcccggtttgatgtcctgccgaactgaattcggcccttcgcagccatttaagggtgctaggatcactggttcactccacatgactattcaaactgctgttctgattgagacgctaaccgccttgggcgccgaggtgagatggtgttcatgcaacattttctctactcaggatcatgccgcctctgccatcgcacgtgattccgcggctgtgttcgcctggaagggggagactctgcaggaatactggtggtgtacggaacgagcacttgattggggtcccggaggtggacctgatttgattgtggatgatggaggtgatgccacgcttttgatccatgaaggagtgaaagcagaggaggagtttgcaaagacggggaaattgcctgatccgacttcaaccgacaaccccgagttccagatcgtgctgtcaatcattaaagaagggttacagagtgacccgacgaagtaccacaagatgaaagataggttggttggtgtatcggaggagacgactactggtgtcaagaggttgtaccaaatgcaagccaatggtaccctgcttttccccgccatcaaggtcaatgattcggttaccaagagcaagtttgacaacttgtacggatgccgacactcactccccgacggactaatgagagccaccgacgtcatgattgccggaaaggtcgcagtcatctgcggatacggagacgtcggacagggttgtgccgccgccatgaaacaagccggagctcgtgtcatagtcacagaaatcgacccaatctgtgccctccaagctctaatggaaggtctccaagtcctaaccctagacgacgtcctctcagaagccgacatcttcgtgaccaccaccggcaacaaagacatcatcatggtcgaccacatgaagaagatgaagaacaacgccatcgtctgcaacattggtcacttcgacaacgaaatcgacatgctagggctagaaacatacccaggcgtgaaacgaatcacaataaaaccccaaactgatcgatgggttttccctgacacgaaaactggggtcattattttggcggaggggaggctgatgacttggggtgtgctacagggcaccctagttttgtgatgtcgtgttcgtttactaaccaggtgattgcgcagcttgagctttggaaggaaaagggaagtgggaagtataagaaggaagtgtatgttttgcctaagcatcttgatgagaaggtggctgcacttcatcttggtaagcttggagccaagctgacaagctcagtaaagaccaggctgattacattagtgtgccggttgaaggtccgtacaagcctgctaattataggtattaagtgtattatatgtatcacatgatatttgtatacgtcttcagtttgggttggtggtgtccggtgagtaggtgggaaagttggttggagacgattgatgggtttcttataaaggaccattaaatttgtgggggttggaattatggaggtggtgtaaacattgaagttcttatttatatggattaaatgcaaa

SEQ ID NO: 7803 - DNA, 1597 bp, Arnica chamissonis
tctgcttcttactaaaaacgaaacagagggtgtccccaatcttaaaaccctaatccgccatggctttcatcgtcgagaaaacctcctccggccgtgaatacaaagtcaaggacatgtcactggcggacttcggccgtctggagctcgaattagccgaagttgaaatgccgggattgatgtcttgcaggacagaattcggaccttctcagccatttaagggcgccaaaatcaccggttcactccacatgacgatccagaccggcgtcctcatcgaaaccttaaccgccttgggtgccgaggtcagatggtgctcctgcaacattttctccacacaagaccacgccgccgccgcaattgcacgtgattccgcggcggtgttcgcctggaaaggggaaacacttcaggagtactggtggtgtacggagcgtgcgctcgattggggtccaggtggcggaccagatctgatcgtggatgatggcggtgacgcgacgctattgattcatgaaggagtgaaagcggaggaggagttcgagaagaatggtaaattgccagatccgaattctactgataacgcagagttccagatcgtgttgtcgatcatcaaggaaggattgcaaatcgacccaaagaagtatcacaaaatgaaagagagattggtcggagtgtctgaagagaccaccactggtgttaagagattgtatcagatgcaggctaacggtagcttgctattccccgccattaatgtcaatgactccgtcaccaagagcaagttcgataacctgtacggatgccgccactcgctccctgatggtttaatgagagccactgacgtcatgatcgctggaaaggtagctgtcgtctgtggctacggggacgtaggaaagggttgtgctgctgccatgaaacaagccggtgcgcgtgtcattgtcacagaaatcgaccccatctgtgcccttcaggctctcatggaaggtctccaagtgctaaccttagaagacgtagtttcagaagctgatatctttgtgaccaccaccggtaacaaggacatcatcatggttgagcacatgaagaagatgaagaacaatgcaattatctgcaacattggtcacttcgacaatgaaattgatatgcttggtctggagacttaccctggtgtgaagagaatcaccatcaagccccaaaccgacaggtgggtgttccctgaaaccaagagcggcgtcattgtgttggcagagggtagactcatgaacttgggttgtgccactggtcaccctagttttgtgatgtcgtgctcgttcactaaccaagtgatcgcgcagctcgagctgtggaacgagaaggggaatggcaagtacaagaatgaagtgtatgtgttgcccaagcaccttgatgagaaagtggctgcacttcatcttggaaagcttggagccaggctcactaagctcagcaagaaccaggctgactacattagtgtgtctgttgatggtccatacaagcctgctcactacaggtattgatcaaagaggatacagagaaaccccatgtgcttgttttctttatataatacaagtttgattgtgtagttttgttggatgcc

SEQ ID NO: 7804 - DNA, 1781 bp, Chelidonium majus
tttcacttccattttctcactctagaacttcagatctcgacaaccaccatggctcttctcgtcgagaaaaccgcttccggccgtgaatacaaggtcaaggacatgtctcaggctgatttcggccgtctcgagattgaacttgccgaagttgagatgcctggactcatgtcttgcagaaccgagttcggtccatctcaaccattcaaaggagccagaatcactggatctctccacatgactatccaaactgcggtccttatcgaaaccctaactgctcttggtgctgaggttcgttggtgttcttgcaacatcttctcgactcaggatcacgctgccgctgctattgctcgtgacagcgctgctgtgttcgcctggaagggggagactcttcaggagtactggtggtgtactgagagagctcttgattggggtccaggtggtggtccagatctgattgttgatgatggtggtgatgctactttgttgattcatgagggagttaaggctgaggaggagtatgagaagtctggtgccatcccagatccgacttctactgataatgctgagtttcagatcgttcttcagatcatcaaggatgggttgaaggatgatcccaagaaataccacaagatgaaggacaggttggttggtgtttctgaggagactaccactggtgtcaagaggttgtaccagatgcagttgaatggaactttgttgttccctgccattaacgttaacgattcagtcaccaagagcaagtttgacaacctttacggatgccgtcactctctccctgatggtttgatgagggcaactgatgtcatgattgccggtaagatcgctcttgtcgctggatacggagatgttggaaagggttgtgcagctgccctcaaacaggctggtgctcaggttattgtcactgagattgacccaatctgtgctctccaagctctaatggaaggcatcccagtccagaggcttgaggacgtcgtttctcaggttgatatctttgtcacaaccaccggaaacaaagacatcatcatgcttgagcacatgaggaagatgaagaacaatgccatcgtctgtaacattggtcactttgacaacgaaattgacatgcttggtcttgaaaccttcccaggtgttaagaggattacaatcaagccccagactgacaggtgggtgttccccgacaccaagaccggcatcattgttcttgctgagggacgtttgatgaacttgggttgtgccactggacacccaagtttcgtcatgtcttgctcattcacaaaccaagtgattgctcagttggaattgtggaacgagaaggcctcaggcaagtatgagaagaaggtgtacgtgttgcctaagcatcttgatgagaaggtcgcagctcttcatcttggcaagcttggagctaagctcaccaagctctccaaggatcaagctgattacatcagcgtccctgttgaaggaccctacaagccagcccactacaggtactgagaaaattgtgaggaagaagaaagggcttgattttggtaattgtcagttgatgattttgatgatgagattatagtaggagaattgtttgttcagctcatcgaagcaatgttaccaccttgttaggtagaatattttggctttcttttttctggtttatgatttaataaggtaggacttctacatgtgtgttccttaatttaagtgaagtatgttggattttgtaatggatgcagtttagttggccctggtaattagcattttgttttcgtgtttgt

SEQ ID NO: 7805 - DNA, 1601 bp, Flaveria ramosissima
tgtctctcaccgtcgagaaaacctccaccggccgtgaatacaaggtcaaagacatgtcattggctgacttcggtcgtctcgagctcgaattagccgaggtcgaaatgccggggttgatgtcttgtcggacggaattcgggccttcacagccgttcaagggggctagaatcaccggatcactgcacatgacgattcaaaccggtgtgttgatcgaaaccctaactgcattgggcgctgaagtgagatggtgctcgtgcaacatcttctcgacgcaggatcacgctgcggcggcgatcgcacgtgactccgccgcggtgttcgcgtggaaaggggagacgctgcaggagtactggtggtgtacggaacgagcgcttgattggggccctggtggtggtccggatctgatcgttgacgatggtggtgatgcgacgttgttgattcatgaaggtgtgaaggctgaagaggagtttgagaagagtgggaagctgccggatccgaactcgactgataacgctgagtttcagatcgtgttgtcgattattaaggaggggttgcagagtgacccgaagaagtatcacaggatgaaggataggttggttggtgtgtcagaggagactaccactggtgttaagaggttgtatcagatgcaagctaatggaaccttgctgttccctgcgattaacgttaatgactccgttactaagagcaagtttgacaacttgtatgggtgccgccactcactcccagatgggctgatgagagctactgatgttatgattgccggaaaggttgcagtagtctgcggttatggtgatgtcggcaagggttgtgccgccgccatgaagcaagccggtgcacgtgtcatagtgacagaaatcgaccccatttgtgcccttcaagctctcatggaaggcctccaagtcctaaccctagaagacgttctctcagaagctgacatctttgtcaccaccacaggcaacaaagacattatcatggttgaccacatgaaaaagatgaaaaacaacgccatcgtctgcaacatcggtcacttcgacaatgaaatcgacatgcttggcttagaaacatacccaggcgttaagagaatcaccatcaaaccccaaaccgacaggtgggtattccccgaaaccaacactggcatcatcgtgttagccgagggtcggctcatgaacttgggttgcgccactggtcaccctagtttcgtgatgtcgtgctcgttcacaaaccaagtgatcgcgcagctcgagctgtggaaagagaagtcatcagggaagtacaagaaggaagtttatgtgttgcctaagcatcttgacgagaaagtggctgcacttcatcttggaaagcttggagccaagctgactaagcttagccaggaccaagctgactacatcagtgtgccagttgagggtccatacaagcctgctcactataggtactgagtatttttcaaacatgagttgctttatatgcctattgattattatgaggtttggtggttgagttcttagaaagatcatcatcatgtgtggtggtttgtagtatgatgatggtagtaaactattaatggtttgttttttgtttgg

SEQ ID NO: 7806 - DNA, 1793 bp, Silene vulgaris
ctcctccatcttcctctgaatcctctctaattctccaatctccgtctaatacaaaattctacgatgtctttaatcgcagaaagaactagctccggccgtgaatacaaggtcaaggatatgtcccaggctgacttcggccgtctcgaactcgaactggccgaagtcgaaatgcctggacttatggcttgtcgtaccgagttcggtccctcgcaaccgtttaaaggcgctaagattactggatctcttcatatgactattcaaactgctgttcttattgaaactcttactgctcttggcgctgaggttcgctggtgttcttgtaacatcttctccactcaggaccatgctgcagctgccattgctagggacagcgctgctgtattcgcctggaagggtgagaccctacaagagtactggtggtgcacagagagggcacttgactggggtgctgctggaggtcctgacctcattgttgatgatggtggtgacgccactctcttgatccacgagggagtcaaggccgaggaggagtttgccaagtccggaaagattcctgaccctaactctactgataatgtcgagttccaactcgtcttgggtctgatcaaggaaagtcttaaggttgaccctaagaggtaccacaagatgaaggagagattggttggtgtttctgaggagaccactaccggtgttaagaggctttaccagatgcaagagaacggcaccttgttgttccctgctatcaatgttaacgactctgtcaccaagagcaagttcgacaacttgtatggatgccgtcactctctccctgatggtttgatgagagccactgatgttatgattgccggcaaggttggtgttgtctgtgggtacggagatgttggaaagggttgtgctcttgccttgaaggcaggtggtgctcgtgtcatcgtgactgagattgacccaatctgtgctctccaagctcttatggaaggtttccaagtgctcaccttggaagatgtcgtctctgaggctgacattttcgtcaccaccaccggtaacaaggacattatcatggtcgaccacatgaggaaaatgaagaacaatgccattgtttgcaacattggtcacttcgacaatgaaatcgacatgcacggtcttgagacattcccaggagtcaagaggatcaccatcaagccccaaaccgaccgattcgtcttcccagacaccaaatccggcatcatcatcttggctgagggtcgtctcatgaacttgggttgtgccactggtcaccccagttttgtcatgtcttgctctttcactaaccaagtgattgcccaactcgagttgtggaaggagaaggcctcaggcaagtacgagaagaaggtgtacgtgttgcccaagcacctcgatgagaaggtcgccgcacttcaccttggcaagctcggtgccaagctcaccaagctctcaaaggaccagtctgattacctcagcattcctgttgaggggccatacaagccagcccactacaggtactagagaaccaaggacatggagagtgcattgcaggaatgtctgtcgaaccctgttatcgagatgatgttccttatattacatttcatttttgcttgggatattagtttttgctttgagcttttgtttcggacgagtgggaagatttgggactacatggtttttaattatgtgctcaattgaggtttgaataagattggtggaagtttttaggtgttgtaatgctacattagttgcagcagacttgttctaatgctacattttggcaagtcttgcta

SEQ ID NO: 7807 - DNA, 1642 bp, Vinca minor
cttcccaaagcccccaaattccttccctcaattcacaagccatggctttgttagtcgaaaaaactagctctggcagagaatacaaggtcaaggacatgtctcaggccgatttcggcaggctcgaaatagagcttgccgaggtcgaaatgcctggattaatgtcctgcagaactgaatttggtcctagccaaccctttaaaggtgctaggatcactggaagtctgcatatgactatccaaactgcggttttaatcgagaccttaaccgcccttggagccgaagttagatggtgttcttgtaacatcttctcaacccaagatcacgctgcggctgccatagctcgtgacagtgccgccgtgtttgcctggaaaggggaaaccttacaggaatactggtggtgtactgaaagagctttggattggggtcctggtggtggtccagatctaattgttgatgatggtggtgatgccactttgttgatccatgaaggtgttaaggctgaggaggagtataagaaatctgggactattccagatcctaattctactgataatgctgagtttcagattgttttgactattattagagatgggttgaaatctgatccttcaaagtatactaagatgaaggagagacttgttggtgtttctgaagagaccaccactggtgttaagaggctttaccagatgcaagctaatggtacccttttgttccctgccattaatgtcaatgactctgtcaccaagagcaagtttgacaacttgtacggatgccgccactcactccctgatgggctaatgagggcaactgatgttatgattgccggaaaggtagcacttgttgctggatatggagatgtcggaaagggatgtgctgctgccttgaagcaagctggtgcacgtgtcattgttactgagattgatccaatctgtgctcttcaggcaaccatggaaggtctccaagtccttacccttaaggatgtcgtatccgatgtcgatatctttgttaccaccactggtaacaaggacatcatcatggtagacgacatgaaaaagatgaaaaacaatgccattgtttgcaacattggtcactttgacaacgaaatcgacatgttgggtcttgagagctacccaggtgttaagaggatcacaattaagcctcaaaccgatcgatgggtcttccctgagacaaactccggcatcattgtcttggccgagggacgtttgatgaacttgggttgtgccacaggacaccctagctttgtcatgtcttgctctttcaccaaccaagtgatcgcccagctcgagttgtggaacgagaggacgtccgggaaatacgagaagaaggtgtatgttctgcccaagcaccttgacgagaaggttgctgcccttcacctgggaaagcttggtgctcggctcactaagcttagcaaggatcaggctgattatatcagtgtaccggtcgaaggtccttacaagcctgctcactatagatactaaggggttgattgatagagaattgctgtttctttgatacggtattagattattgttagttttttttttggtgtgttttctgggttgtggagatgatgggaagaaagaaatggtcttctgtgaagatcaagaagtgttgaataagg

SEQ ID NO: 7808 - DNA, 1683 bp, Vinca minor
tcttctgccatggctttgttagtcgagaaaaccagctctggtagggagtacaaagtcaaggacatgtcccaggctgacttcggaaggctcgaactcgagcttgccgaagttgaaatgcctggattgatgtcttgcagaactgaatttggtcctagccaacccttcaagggtgctaggatcactggaagtttgcatatgacaatccaaaccgcagttttgatcgaaaccttaacagccctaggagccgaagttagatggtgttcttgcaacattttctcaacccaagatcacgctgctgccgccatagctcgtgacagcgccgccgtttttgcctggaaaggggaaacccttcaggaatactggtggtgtactgaaagggctttggattggggtcctggtggtggcccagatctgattgttgatgatggtggtgatgccacattattgatccatgagggtgttaaggctgaggaagagtataagaaatctggggctattccagatcctaattctactgataatcctgagtttcagattgttttgactattattaaggatgggttgaaatctgatcccactaagtatactaggatgaaggatagacttgttggtgtgtctgaagagaccaccactggtgttaagaggctttaccagatgcaggctaatggaacccttctcttccctgccattaatgtcaatgactctgtcaccaagagcaagtttgacaacttgtacggatgccgccactcactccctgatgggctcatgagggcaactgatgttatgattgctggaaaggtagccgttgttgccggatatggagatgttggaaagggatgtgctgccgccttgaagcaagctggtgcccgtgtcattgttactgagattgatccaatctgtgctcttcaggcactcatggaaggtctccaagtccttacccttgaggatgtcgtatctgatgctgatatctttgttaccaccactggtaacaaggacatcatcatggtagaccacatgaagaaaataaagaacaatgccattgtttgcaacattggccactttgacaacgaaatcgacatgttgggtcttgaaacctacccaggagtgaagaggattaccattaagccccaaaccgaccgatgggttttcccggaaacaaacactggcatcattgtcttggccgagggtcgtttgatgaacttgggttgtgctacagggcaccctagctttgtcatgtcatgctctttcactaaccaagtcattgcccagctcgagttgtggaacgagaggacatccgggaaatacaagaaggaggtgtatgttttgcccaaacaccttgatgagaaggttgcttcccttcaccttggaaagcttggtgctaggcttactaagcttagcaaggatcaggctgattatatcagtgtacctgttgaaggtccatacaagcctgctcactataggtactaagggatataaatggaattggcgtttggctgatagagataaatgctgttttttttctcaaaactgtattattattatttttggatgtgtttttggagatgatgtgagggaaagatatggtcttcttttgaagatcagtaagtgttttaataagggtagttttgggagtgttgaatggtttttttagttgcttcaattagttttttaattattgttttt

SEQ ID NO: 7809 - DNA, 1839 bp, Leymus cinereus x Leymus triticoides
  misc_feature (810)..(810): n is a, c, g, or t
gccgcctcctctcctccctcccatcactcttcttcctcctttgctagatccaatccaccaaccttctccatggcgctctccgtggagaagacctcgtcgggccgggagtacaaggtcaaggacctctcccaggccgacttcggccgcctcgagctcgagctcgccgaggtcgagatgcccggcctcatggcctgccgcaccgagttcggcccctcgcagcccttcaagggcgcccggatctccggctccctccacatgaccatccagactgccgtgctcatcgagaccctcaccgccctcggcgccgaggtccgctggtgctcctgcaacatcttctccacccaggaccacgccgccgccgccatcgcgcgcgactccgcggccgtcttcgcctggaagggggagaccctcgaggagtactggtggtgcaccgagcgctgcctcgactggggcgtcggcgggggccccgacctcatcgtcgacgacggtggtgacgccacgctgctcatccacgagggcgtcaaggccgaggaggagttcgagaagtccggcaaggtccccgacccggagtccaccgacaaccccgagttcaagatcgtcctcaccatcatccgcgacgggctcaagaccgacgccaacaagtaccgcaagatgaaggagaggctcgtcggtgtctccgaggagacaaccaccggcgtcaagaggctctaccagatgcaggagtccggcaccctcctcttccccgccatcaacgtcaacgactccgtcaccaagagcaagtttgacaacctctacggttgccgccactcnctccctgatggtcttatgagggccactgatgttatgatcgccggcaaggttgccgtggtttgtggttatggtgatgttggcaagggctgtgccgccgcactcaagcaggctggtgcccgtgtgatcgtgacagagattgaccccatctgcgcccttcaggccctgatggagggtatccagatcctcaccttggaggatgttgtctctgaggctgacatcttcgtgaccaccaccggaaacaaggacatcatcatggtcgaccacatgaggaagatgaagaacaatgccattgtctgcaacattggtcactttgacaatgagatcgacatgaacggccttgagacttaccctggtgtcaagcgcatcaccatcaagccccagactgaccgttgggtcttccctgagaccaacactggcatcattgttcttgccgagggtcgtctgatgaaccttggatgtgccactggacaccccagctttgtcatgtcctgctcattcactaaccaggttattgctcagcttgagttgtggaatgagaaggccaccggcaagtacgagaagaaggtgtacgttctccccaagcacctcgacgagaaggtcgcggccctccacttgggcaagctaggcgccaagctgaccaagctcaccaagtcccagtctgactacattagcatcccagttgagggtccttacaagcctgcggcttaccggtactagtgtgtccagcacgactagcggctggcctgagcctgagcatgagcagcggcaccaacgggaactctgccacggcgacctatcaactatactgtttcccttccatttatcttacatgctgtctcttaggcggaggatttgttattatggttatggtttgagccttgtgagggttgggagaggcggcgtttgcttttgcccagaaataatggtttaagtgaggtggtgttcttttccgtaggtgattttgtctcgtttgatctaccatgtctgaaatcctttgcaagctgttgtggtttattgtatggttgctta

SEQ ID NO: 7810 - DNA, 2017 bp, Medicago truncatula
caaccataaccactcgaaaattactcatcatccattttcagcatttcaaacctatttatacttacacatccccactctctcaaacacacactcctctcattctctcttcctttacccaaaactctctttctccctctccgtattttccatttccgatccatcgcaatggcgttgctggttgaaaccaccactagcggccgcgaatacaaggtcaaggacatgtcccaagccgacttcggccgtctcgaaatcgagctcgccgaagtcgaaatgcccggtctaatgtcctgccgaaccgaattcggtccatcccaacccttcaaaggcgctagaataaccggttcacttcacatgacaatccaaaccgccgtcctcatcgaaaccctaaccgctctcggcgctgaagtccgttggtgttcctgcaacatcttctccactcaagaccacgccgctgccgccatcgctcgtgacagcgccgccgtgttcgcatggaaaggagagactctccaggagtattggtggtgctctgaacgcgctcttgattggggtactggcggtggaccagatcttatcgttgatgatggtggtgatgtcactctcttgatccatgaaggtgttaaggctgaagaggtttttgagaagactggtcagttacctgatccttcttccactgataatgctgagatgcagattgttcttaccattatcagagatggtttgaagactgatcctaagaggtaccagaagatgaagactagaattgttggtgtttctgaagaaactaccactggtgttaagaggctttaccagatgcaagcaactggtacccttttgttccctgctatcaatgtcaatgactctgttaccaagagcaagtttgacaacttgtacggttgccgtcactcactccccgatggactgatgagagctactgatgtcatgattgccggaaaggttgctgttgtatgtggttatggagatgttggcaagggttgtgctgctgcattgaaacagggtggtgctcgtgtgatcgtgactgagatcgatccaatttgtgcacttcaagctcttatggaaggtcttcaagtcttgactttggaggatgttatctccgaggctgacatctttgttaccacaaccggtaacaaagacattatcatggttagtgacatgaagaaaatgaagaacaatgccattgtctgcaacattggtcacttcgacaatgaaattgacatgcatggacttgagacataccctggtgtgaagcgcatcacaattaagccacaaactgacagatgggttttccctgaaaccaaatctggcatcattgtcttggccgaaggtcgtttgatgaacttgggatgtgctactggacaccccagtttcgtcatgtcatgctccttcaccaaccaagtcattgctcagattgagttgtggaaggaaaagacttccggcaagtatgaaaagaaggtatatgttttgcctaagcaccttgatgagaaggttgctgcccttcatcttggccagcttggagctaggctcaccaagctttccaaagatcaggcagattacatcagtgtgcctgttgagggtccatacaagcctgctcactacaggtattgagatgatcaagagatggcagagggaaagaataaagatgattctatccgtattgttccgcattcgattttggatttttgttttctcattacaatttttagatttgtggggtagattgagaattcttttggattattatcctagaatctcaattccaccggggttgaagggtatgagtaaaaaaacctgttggtttctatgaaatgagaccaattgggtatgaataaagcttaggttgtggctgtgtctgttatgattgattattagagtataattacacgtgttcttgtccaatctttgacagaatcaagttaggaaaaaatgcagaaaaatatgtgcttactgtattacattcgatttgttttaatctatatttgcttatttttcactttatgaa

SEQ ID NO: 7811 - DNA, 1878 bp, Panicum virgatum
tccgccgccgtcgccttcccctcatctcccaatcccgagatctccccctccgcccgcccgctgccatggcgctctccgtggagaagacctcgtcggggcgggagtacaaggtcaaggacctgtcccaggccgacttcggccgcctcgagatcgagctggccgaggtcgagatgccgggcctcatggcgtgccgcgccgagttcggcccctccaagcccttcgccggcgccaggatctcgggctccctccacatgaccatccagaccgccgtcctcatcgagaccctcaccgcgctcggcgcggaggtccgctggtgctcctgcaacatcttctccacgcaggaccacgccgccgccgccatcgcgcgggactccgccgccgtcttcgcctggaagggggagacgctcgaggagtactggtggtgcaccgagcgatgcctcgactggggcggggccggcgggcccgacctcatcgtcgacgacggcggcgacgccacgctcctcatccacgagggcgtcaaggccgaggaggagtacgagaagtccggcaagatcccggacccggactccaccgacaacgccgagttcaagatcgtgctcaccatcatccgcgacgggctcaaggccgaccccaagaagtaccgcaagatgaaggagaggctcgtcggcgtctcggaggagaccaccaccggggtcaagaggctctaccagatgcaggagaccggcgcactcctcttccccgccatcaacgtcaatgactccgtcactaagagcaagtttgacaacctgtatggttgccgccactccctccctgatggtttgatgagggccaccgatgttatgattgccggcaaggttgcggtggtctgcggttatggtgatgttggcaagggctgtgctgctgccctcaagcaggctggtgcccgtgtcatcgtgactgagattgaccccatctgtgcccttcaggccctgatggagggtcttcaggtccttaccttggaggatgtcgtttctgaagctgacatctttgtgactaccactggtaacaaggacatcatcatggttgaccacatgaggaagatgaagaacaatgcaattgtctgcaacattggtcactttgacaatgagattgacatgcatggtcttgagacctaccctggtgtcaagcggatcaccatcaagccccagactgatcgctgggtgttccctgagaccaacactggcatcattgtccttgctgagggtcgtctgatgaaccttgggtgcgctactggccaccccagctttgtcatgtcctgctcattcactaaccaggtcattgctcaacttgagctgtggaaggagcggagctcaggcaagtatgagaagaaagtgtatgtgctccccaagcaccttgatgagaaggttgccgccctccacttgggcaagcttggtgccaagctcaccaagctcaccaagtctcaggctgactacatcagtgtcccgatcgagggtccctacaagcccgctcactaccggtactaggttacccagcatgactagaagctcactcggccagccggttgtgttgtgtgcccttacgaagttcactacaccggcttgtcaattatcttttgcatgcattatcatatgcgccgttgcgtaggaggatttgttatgatcattgcttgggcctggttgagtggggagaggagggaagagctgtttgctttttgcagaagaacaatggcgtatttggttgtagggtgaggcagtgtgcgttaccagaactatacagtttctgattatcatttgcaagtgatttgctctagttatgtgtctttcatgaataacatgctttcttcaagagcatatttagtctgatcctgagttttgctta

SEQ ID NO: 7812 - DNA, 2017 bp, Theobroma cacao
ccaggatccaccaaaccccccacccaatcttggccgttcatttcacctctctaacctatttataacatccctactcccccgagcatacctcgccacttcccactctctccattttatcaacacttccttcctcttccaagggagagtgccttcttcctcttactctgtactctttctcttgtagccatgtctcttttggtcgagaaaacctcaagcggccgtgagtacaaggtcaaggacatgtctcaggccgacttcggtcgtctcgagattgagttggccgaggtcgaaatgcccggtctcatggcttgcagaaccgaattcggcccttcccaacctttcaaaggagctaaaatcaccggttccctccacatgaccatccaaaccgctgttctcatcgaaacgctcaccgccctcggagccgaagtccgttggtgctcatgcaacattttctcaacccaagaccacgccgcctccgccatcgctcgtgactccgctgctgtatttgcctggaaaggggagaccctccaggagtactggtggtgtaccgagagagccctcgactggggtcccactggtggacccgatctaatcgtggatgatggtggggatgctactttgttgatccacgaaggagttaaagccgaggaggtttatgagaaaactgggcagctcccggatccggcttctacagataacgctgagttccaaattgttttgacgataatcagagatgggttgaagacagatcgcaagaagtataccaggatgaagaatagattagttggtgtttctgaggaaactacaactggagttaagaggctttatcagatgcaggccaatggatccttgttgtttcccgctattaatgtcaatgactctgtcaccaagagcaagtttgataacttgtatgggtgccgtcactctcttcctgatggtttgatgagagcaactgatgtcatgattgctggcaaggttgctgttgtctgtggttatggtgatgttggcaagggctgcgctgcagccttgaaacaagctggtgctcgcgtcattgtcactgagattgatcccatctgtgcacttcaggctcttatggaaggacttcaggttctgactcttgaggatgttgtctgcgaggctgatatctttgtcaccaccactggtaacaaagacatcatcatggttgatcacatgaggaagatgaagaacaatgccattgtttgcaacattggtcactttgacaatgaaatcgatatgtgtggtcttgagaactatcctggtgtcaagcgcatcaccatcaagcctcaaactgataggtgggtcttccctgataccaactcaggtatcatcgtattggctgaggggcgtctcatgaacttgggctgtgccactggccatcccagttttgttatgtcctgctcattcacaaaccaggtgattgcccagcttgagctgtggaatgagaaggcaaccggcaagtatgagaaaaaggtgtatgttttgcccaagcaccttgatgagaaggttgctgctcttcaccttcccaagcttggagctaagctcaccaagctcagcaaggaacaagctgattacattagcgtgcccgttgagggtccttacaagcctgctcactacaggtactgaggagagagttggagagagtttgacgataaaaaaaatacatccggatggtttgaaattgtttcttttactataattttattgatgatttgtggttagattgttaggttttgatttttgtaggagttttgtgtgggtggttggaaagttattggcggaaaagaaatggattggtctctcgatgaagaagaccagacgggtttgaataaggtgttgggggctgtgtgggagataatattgccactgatgcagtgcagttttgctgcatgtggttatcaaattaattatcaaaaagagaaaaggagaagcaatttgctttcactttcactttctatttcttgtcattttttttttaaagttaaaaagggatttcatt

SEQ ID NO: 7813 - DNA, 2105 bp, Triphysaria pusilla
tgaagtgataattatttttgcatagcccctcatcatgtctccagtcttcactcacctcccttctctctccaccactccccaaccactcccaatctcagatccaccaaacactcccaatcccagccgtccatcacaccatttaaatcctatttatacccctttcctcatatatcccccttgtccacaattctcttccaacaaccagaagagagcgtgattaaccaaatctgaatctcatttctaaactatcctaatcttcaatttccatggcgctcctcgtagagaagaccacctccggccgtgagtacaaggtcaaggacatgtcccaagctgacttcggccgccttgagctcgagctcgcggaggttgaaatgccgggtctcatgtcctgccgtaccgagttcgggccctcccagccctttaaaggcgcccggatcaccggcagccttcacatgaccatccaaacagctgtgttgatcgaaaccctaaccgctcttggggccgaggtcagatggtgctcctgcaacatcttctccacccaggaccacgccgccgccgccattgctcgcgacagcgctgccgtgttcgcctggaaaggggagacccttcaggagtactggtggtgcaccgagcgtgccctcgactggggccccggtggtggtcccgatctgatcgtggacgacggtggtgatgccactctgttgatccacgagggcgtgaaggccgaggaggagtttgagaagactggaaaggtacccgaccctacctcgacggacaatgttgagttccagtttgtgctgaccattattagggatgggcttaagactgatcccaagaggtacaccaagatgaaggagagattggtcggtgtttctgaggagacaaccaccggcgttaagaggttgtaccagatgcaggccagtggtaccctgcttttccctgctatcaatgtcaatgactctgttaccaagagcaagtttgacaacttgtatggttgccgccactcgctgcctgatggtctgatgagggctagtgacatcatgatcgccggaaaggtcggtgttgtctgtggttacggagatgttggtaaaggctgtgctgccgccttgaaacaaggtggtgcccgggtgatcgtgacagagattgatcccatctgcgccctccaagccctcatggaaggcttccaagtcctccccctcgaggacgtcgtctcagaggctgacatctttgtcaccaccaccggcaacaaggacatcatcatggtcgacgacatgaggaagatgaaaaacaatgccatcgtttgcaacattggccatttcgacaacgagattgacatgctcggcctcgagacattccctggcgtgaaaaggatcacgatcaagcctcagacagacagattcgtcttcccagacaccaagtcgggtgttataattttggctgagggtcgcctgatgaacttgggttgtgccactggacaccctagcttcgtcatgtcgtgctcgtttacgaaccaggtcatcgcccagctggagctctggaatgagaggaagagcggcaagtacgagaagaaggtttatgttttgcccaagcaccttgatgagaaggtagctgctcttcacctttccaagcttggtgctaagctgactaagcttagcaaggaccaagctgattacattagcgtcccggtggagggtccttacaagcctcctcactatagatattaaaggaagaagagcaacagaacatcatatatttttaccagcattattattttgattttgaattgtcataggtttttgttttatggggttgggggttgggcagtttgaagatcatttgatgattgagaataagttaagaggatgattcgagttctttgttattttattgtggttttggtttgccagcatatactcttgctgtatttgcttttggcaaccatatatgaaatattattgcttctagttctacttcaaatatatcttggtgttttagtcaagcaatctaagggttctgaatgaaagtgaacagctcttgtttgagcttggcttggcaggggttcgttcatggttgtttgttaatcttaatcaacataatgatcaaga

SEQ ID NO: 7814 - DNA, 1697 bp, Lactuca sativa
cggttttcttctgaaaccacagagtgtatcagatctgatctgaataattcaaaaccctaactccgaccatggctctcaccgtcgagaaaacctccaccggccgtgaatacaaggtcaaggacatgtccttagctgattttggcagacttgaactcgaattagccgaagttgaaatgcccggtttgatgtcttgccggactgaattcggaccttcgcagccattcaagggtgctaggatcacaggttcactccacatgactattcaaaccggtgttctgattgaaacactaaccgctttgggcgccgaggtgagatggtgttcatgcaacattttctcgactcaggatcacgccgcctccgccatcgcacgtgattccgcggctgtgttcgcctggaagggggagactcttcaggaatactggtggtgtacggaacgagctcttgattggggtcccggcggtggacctgatttgattgttgatgatggaggtgatgccacgcttttgatccatgaaggagtgaaagcagaggaggagttcgcgaaaacggggaaattgccagatccgacgtcaaccgacaatgcagagttccagatcgtgttgtcgatcattaaggaagggttgcagagtgatccgaagaagtaccacaagatgaaagataggttagtcggtgtatcggaggagacgacaaccggagttaagaggctatatcagatgcaagccaatggtaccttgcttttccctgccatcaatgtcaatgattccgttaccaagagcaagtttgacaacttgtacggatgccgccactcactccccgacggattaatgagagccaccgacgtaatgatcgccggaaaggtcgcagtagtctgtggttacggagacgtcggaaagggttgcgccgccgcaatgaaacaagccggagctcgtgtgatagtgacagaaatcgacccaatctgtgcccttcaagctctaatggaaggtctccaagtcctaaccctagaagacgtcctctcagaagccgacataatcgtcaccaccaccggcaacaaagacatcatcatggtggaccacatgaaaaaaatgaagaacaacgccatcgtctgcaacataggccatttcgacaacgaaatcgacatgcttgggctagaaacatacccaggtgtgaaaagagtcacgattaaaccccaaaccgatcgatgggtgttccctgatacaaaaactggagtgattatattggcagaagggaggttgatgaacttgggttgtgctacagggcatccaagttttgtgatgtcgtgttcgtttacaaaccaggtgattgcacagcttgaattgtggaaggaaaagggaagtgggaagtataagaaggaagtgtatgtgttacctaagcatcttgatgagaaggtggctgctcttcatcttggtaagcttggagcgaagctaacgaagcttagtaaagatcaggctgattatattaatgtgccggttgaaggtccctacaagcctgttacttacaggtactgattaagcataaaccattcgaaatatatacgtctggtggtggttgttgggaaaggtggttggagagaattaattggattatgggggttgaataagggtggagtattgaaggttgtgtaatattgtagtggttattattttattataatataatgggtaaaaaaaccccacaac

SEQ ID NO: 7815 - DNA, 1689 bp, Euphorbia peplus
ttaaacccttctcgagagtgtgttttgcctttctcatttctaaatctcagatctaaaaaaaccctatccctaccatggctttgttggtcgagaaaaccacctccggccgtgaatacaaggtcaaggacatgtctcaggccgacttcggtcgactcgaaatcgagttagccgaggtcgaaatgcccggtctcatggcttgcagaaccgaattcggcccatcccagccattcaaaggagccagaatcaccggatctctccacatgaccatccaaaccgccgtcctaatcgaaaccctaaccgctctcggcgccgaggtccgctggtgctcctgcaacattttcagcacccaggaccacgccgccgccgccatcgcccgtgactccgctgctgtctttgcctggaaaggggagactcttcaggagtactggtggtgcactgagcgtgctcttgattggggccccggtggcggtccagatctgattgttgatgatggtggtgatgctactttgttgatccatgaaggtgttaaggctgaggagctttacgctaagaccggggagctccccgacccgagttctactgataatgttgagtttcagctcgtgttgactattattagggatggattgaaaactgatcctcagaggtatcagaagatgaagcagagattggtcggtgtttctgaggagacgactaccggtgttaagaggttgtatcaaatgcaggctaatggaactttgttgtttcctgctatcaatgttaatgactctgttaccaagagcaagttcgataacttgtatggatgccgtcactctctccctgatggtttgatgagggctactgatgttatgattgccggaaaggtttcagttgttgctggttatggtgatgttggaaagggttgtgctgctgctttgaagcaagctggatctcgggtgattgtgactgagattgatcccatctgtgctcttcaggctactatggaaggatatcaagtgttgactcttgaggatgttgtctcagaggctgacatctttgttaccaccaccggtaacaaggacattatcatggttagccacatgaggaagatgaagaacaatgccattgtttgcaacattggtcattttgacaatgaaattgatatgcttggacttgagaccttccctggtgtgaagcgtatcaccatcaagccacaaaccgacaggtgggttttcccccgataccagctctggtgtcatcattttggctgagggacgtctgatgaatttgggttgtgctactggtcaccctagctttgtgatgtcctgctctttcaccaaccaggtgattgctcagcttgagttgtggaatgagaaggcaagcggcaaatatgagaagaaggtgtatgttttgccaaagcacctcgatgagaaggttgccctgctccatcttggaaagcttggagttaagctcaccaagctctccaaggaccaggctgattacatcagtgttccagtggagggtccttacaagcctgctcactacaggtactgaagaaagatggaggaacatgtggtgcatccccggacgggtctattggtttttccttacaatttgatgatttgttgtggtgctagaatattagactttaattttttgtaggatttgtttgtgttttggtggggagaggaagggaggaaagaaatggtt

SEQ ID NO: 7816 - DNA, 1824 bp, Ocimum basilicum
acatccaatcctgccctactcgctcaacccatggcgctccaagttgagaagaccacctctggccgcgagtacaaggtcaaggacatgtcccaggccgacttcggccgcctcgaaatcgagctcgccgaggtggagatgccgggcctcatttcctgccggaccgagttcggtccctcccagcccttcaagggtgcccgcatcaccggaagtctccacatgaccatccaaactgccgtcctcatcgagaccctcaccgctctcggcgctgaggtcagatggtgctcttgcaacatcttctccactcaagaccacgccgccgctgccattgctcgcgacagcgccgccgtcttcgcctggaagggcgaaaccttgcaggagtactggtggtgcaccgagcgggccctcgattgggggcctggcggcggccccgatctcatcgtcgacgacggcggtgatgccacgctgttgattcacgagggcgtcaaagcggaggaggagtacgagaaaagtgggaagttgccggaccccagctcgaccgataatgcggagtttcagatagtgctgacgttgatcagagatgggctgaaggccgatcccaccaagtacaggaagatgaaggagagattggttggtgtttctgaggaaacaactactggtgtgaagaggctgtatcagatgcaggctaatggcactctgcttttccctgccatcaatgtcaatgattccgtcaccaagagcaagttcgataacctgtacggatgccgccactcgctgcctgatggacttatgagggctactgatgtaatgattgccggaaaggtgggagttgtgtgtggttatggtgatgttgggaagggttgtgccgcggcctgaaacaagccggtgctcgtgtgatcgtcaccgagatcgatccaatctgcgctctccaagccctcatggaaggcttccaagtcctgaccctggaggatgttctttctgaggccgacatctttgtcaccaccaccggcaacaaggacatcattatggtcgaccacatgaagaagatgaagaacaatgccattgtcaacattggccacttcgacaacgagatcgacatgctgggtcttgagacctaccccggcgtgaagaggatcaccatcaagccacagactgaccgatgggtgttcccagagacgaatagcggaataatcgtgttggcagaaggtcggctgatgaacttggggtgtgcgacggggcacccaagctttgtgatgtcgtgctcgttcacgaaccaagtgatagcgcagctggagctgtggaaggagaggaagagtgggaaatacaagaaggaggtgtatgtgttgccgaagcacttggatgagaaggtggcagcacttcacctgggaaagctgggggcgaagctcactaagctcaccaaggatcaggctgattacatcagtgttccggtggagggaccttacaagcctcttcactacagatactgatcacaacaaacaagctctttctgctatttgccattgcgcaagcttgctactttttgagttttcttgccatcttggaactcccattttatggcctataataactaaaaatatcttctcttttgcatctctcctctttcacacaaacacaacaggcatttcaaggcatcattgggtcaattgatttcttagttataagaagaacgttatgcttggatctaacctaatgtcaactttttgctcaagttaataaaactgttgccttattttacttatgtccattaaatcatgtttcatgttccttttgcgcatgtcttattgtattttgatttgcacaacaaat

SEQ ID NO: 7817 - DNA, 1805 bp, Cichorium intybus
gggtaccgggcccccccctgagagcctccaagatccgatttacaaactctcatccaccatggctctcgtcgtcgagaaaacttccaccggccgtgagtacaaagtcaaggacatgtccttggccgacttcggtcgcctggaactcgaattagccgaagttgaaatgcccggtctcatgtcttgccggacggaattcggtccttctcagcccttcaagggtgccagaatcaccggctccctccacatgacaatccagaccggtgtcctcatcgaaaccctcactgccttaggtgccgaggttagatggtgctcttgcaacattttctctactcaggaccacgccgccgccgctatcgctcgtgattcggccgccgtgttcgcctggaagggggaaaccctacaggagtactggtggtgcacggagcgtgctctagactggggccctggtggcggccctgatttgattgttgacgatggtggtgatgcgacactgttgatccacgaaggagtcaaggccgaggaggagttcgcgaagaccggtaaattgcccgatccgacctctaccgacaacgccgagttccagatcgtgttgtcgatcatcaaggaaggtctagcagtcgaccctaagaagtaccacaagatgaaggaaagattggtcggtgtgtctgagaaaccaccaccggtgttaagaggttgtaccagatgcaagccaatggtactctgcttttccctgccattaacgtcaatgactccgtcaccaagagcaagttcgacaacttgtacggatgccgccactcactccccgacggtctgatgagagccaccgacgtcatgatcgccggaaaggtcgcagtcgtctgcggatacggagacgtcggaaagggttgcgccgccgccatgaagcaagccggagctcgcgtcatcgtcacagaaatcgaccccatctgcgccctccagccaccatggaagatctacaagtcctccccctagaagacgtagtctccgaagccgacatcttcgtcaccaccaccggcaacaaagacatcatcatggtctccgacatgaagaaaatgaaaaacaacgccatcgtctgcaacatcggccatttcgacaacgaaatcgacatgctcggacttgaaacctacccaggcgtcaaacgcatcaccatcaaaccccaaaccgacaggtgggtcttcccggagacaaaaaccggcatcatcgttctagctgaaggtcgtctcatgaacttgggttgcgccaccggccaccctagtttcgtgatgtcatgctctttcaccaaccaagttatcgctcaacttgagctatggaaggaaagaaccaccggaaagtacaagaaggaggtttacgttttacctaaacatcttgatgaaaaggtcgccgcacttcatcttggaaagcttggagctaaattgacagtgttgaccaaggatcaagctgattacatcagtgtaccagttgaaggtccatacaagcctgctcattacaggtactgaaaggtgtttgatttgatgatgatgaattttgaggggattttgaagagggtttattagttttggttgttgaagtttgttggggtgtttggcggtgaagaaactgagtggtctttttttgttgaaaggcttatggtttgaataatgggtcgagtgtgtgaaggttgtgtaacacaatttgtagtttttttttttttttttgggtagaggcgttactttggttgccttttggttgttattcatgaggagattaaagaaatgaaaaagaacaagaattattttcgttggtaaggg

SEQ ID NO: 7818 - DNA, 1751 bp, Cichorium intybus
tcacccctctcgtctttcttgtgaaactcgagagtgtctcagatctgatctgaaaaactcaaaaccctatccagcgacatggctttaaccgtcgagaagacctccaccggccgtgaatagaagggcaaagacatgtccttggctgatttcggtagacttgagcatgaattagcggaagttgaaatgccaggtctaatgtcttgccgagctgaattcggaccttcgcagccatttaagggtgctaggatcactggttcactccacatgactattcaaaccggtgtcctgattgaaacactaaccgccttgggcgccgaggtgagatggtgttcatgcaacattttttcgactcaggatcacgccgccgccgccattgcacgtgattccgcggctgtgttcgcctggaagggggagactctacaggagtactggtggtgtacggagcgagctcttgactggggtcccggcggtggacctgatttgattgttgacgatggaggtgatgccacgcttttgatccatgaaggagtgaaagcagaggaagagtttgcgaagacggggaaattgcctgatccgacctccaccgacaaccccgagttccagatcgtactgtcgattataaaagaagggctacagagtgacccgaagaagtaccacaagatgaatgataggttggtcggtgtatcggaggagaccacaaccggcgttaagaggctgtaccagatgcaagccaacggtaccttgcttttccccgccatcaatgtcaatgactccgttaccaagagcaagtttgacaacttgtacggatgccgacactcactccccgacggactaatgagagccaccgacgtcatgattgccggaaaggtcgcagtagtctgcggttacggagacgtcggaaagggctgtgccgcggccatgaaacaagccggagctcgcgtcatagtcacagaaatcgacccaatctgcgccctccaagctctaatggaaggtctccaagtcctaaccctagaagacgtcctctcagaagccgacatcttcgtcaccaccaccggcacaaagacatcatcatggtggaccacatgaagaaaatgaagaacaacgccatcgtctgcaacatcggccatttcgacaacgaaatcgacatgctagggctagaaacatacccaggtgtgaaacgaatcacgatcaaaccccaaactgaccgatgggtgttccctgatacaaaatccggtgtcattattctggcagaagggaggttgatgaacttgggttgtgcaacagggcatcctagctttgtgatgtcgtgttcgtttactaaccaggtgattgcacagcttgaattatggaaggaaaagggaagtgggaagtataagaaggaagtttacgtgttgccgaagcatcttgatgagaaagtggctgcacttcatcttggaaagcttggagccaagcttacgaagcttagtaaagaccaggctgattatattaatgtggcggttgaaggtccgtacaagcctgttaattacaggtactaaggatatattatattatacgatttgatttgggttggttgtgggtaggtgggaaaagtaggtggagagaattgattggtttcttgaaagacaattaatattggggggaggatagaggtagtataaaggtaaaacaaacgtcgcagttttgtattgagttaattggggaaagaaatatcaaaaatgctttcctttatttgtttaaatatatgtcattgg

SEQ ID NO: 7819 - DNA, 1524 bp, Arnica chamissonis
agaaaacctccaccggccgtgaatacaaggtcaaggatatgtccttggctgatttcggccgtcttgaacttgaattagccgaagttgaaatgcccggtttgatgtcttgccggactgaattcggaccttcacaaccattcaaaggtgctaggatcaccggctcactccacatgactattcaaaccggtgttcttatcgaaaccctaaccgcattgggcgccgaggtgagatggtgttcatgcaacattttctcgactcaggatcacgccgctgccgcaatcgcacgtgattctgcagctgtgttcgcttggaagggggaaacactgcaggagtactggtggtgtactgagagagctcttgattggggtcctgatggtggacctgatttgattgttgatgatggtggtgatgcaacgcttctgatccatgaaggagtgaaagctgaggaggagtttgcgaaaaccgggaaattgcctgatccgacttcaaccgataacgctgagttccagatcgtgttgtctattattaaggaagggttacagagtgacccgaagaagtaccataagatgaaagataggttggttggtgtatcagaagaaaccaccaccggtgttaagaggttgtaccagatgcaagccaatggtacattgcttttccccgccatcaacgtcaatgactccgtcaccaagagcaagtttgacaacttgtatggatgccgtcattcactccctgatggactgatgagagccactgatgttatgattgccggaaaagttgcagtagtctgcggttacggagacgtaggcaagggatgtgctgctgccatgaaacaggcgggtgcacgtgtcatagtcacagaaatcgaccccatttgtgcccttcaagctctaatggaaggtctccaagttctaacccttgaagacgttctctcagaagccgacatctttgtaactaccacaggtaacaaagacataatcatggttgaccacatgaaaaaaatgaaaaacaacgccattgtctgcaacattgggcattttgacaatgaaatcgacatgcttgggttagaaacatccccgggtgtgaaaagaatcacaatcaaaccacaaactgacaggtgggtattcccggaaaccaatagtggcatcatcgtgttagccgagggtcggctcatgaacttgggttgtgccacgggtcaccctagttttgttatgtcatgctcgtttacaaaccaagtgatagcccagctcgagctgtggaaggaaaagtcgaccgggaagtacaagaaagaagtttatgtgttgcctaaacatcttgatgagaaagtggctgcacttcatcttggaaagcttggagccaagctgactaagcttagccaggaccaggctgattacattagtgtgccagttgagggtccatacaagccggctcactacaggtattgagcatagaagaagaaaagtgtcggtttggtggttggtagttgggaagggtggttggactggtttctatatatatggtggttta

SEQ ID NO: 7820 - DNA, 1980 bp, Cedrus atlantica
gcaaatcgactaagttcgaatcctgctccgcgaaccatacctatctgggttgccgagatccgtggtttccctagatctgcctgttctcggccctgtctctgagcagcaatggcgcttcttgctgagaaaacggtgtccggaagggaatacaaggttaaggatatgtctcaggcggacttcgggaggctggagatagaattggccgaagttgagatgcccggactgatggcctgccgggtcgagttcggccccgcccagcccttcaagggcgcccggatcacgggttcccttcacatgacgatccagaccgctgttctcatcgagaccctgaccgcccttggggccgaggtgagatggtgctcctgcaacatattctctactcaagaccacgccgcggctgccattgcccgcgacagcgcagcagtgttcgcctggaagggggaaacactgcaggagtactggtggtgcactgagagggctctggactggggtccaggcggtggccctgatttgattgtcgatgatggcggtgacactacccttctgatccatgagggggtcaaggccgaggcagagtttgccaagaccgggaaggtgccagatccggcttctaccaccaatgtggagtttcagattgtgttggagttgatcaaggaaagcctcaaggtggatcccctgaagtaccacaggatgaaggataggctggttggtgtgtctgaggagactactactggggttaagaggctttaccagatgcaaaatgctgggtctctgctgttccctgctatcaatgtcaatgactctgttaccaagagcaagtttgacaacttgtatggatgtaggcactctctgcctgatggtcttatgagagccacagatgtcatgattgctggtaaggttgctgttgtgtgtgggtatggagatgttggcaagggttgtgctgcagccatgaaggttgctggagctagggtcattgttacagagattgatcctatatgtgccctgcaagctcttatggaaggccttcctgttctcaccctagaggatgtagttagtactgctgatatctttgtgacaaccactggtaacaaggacatcatcatgttggatcacatgagaaaaatgaagaacaatgccattgtttgtaacattggtcactttgacaatgagattgatatgcaaggccttgaaactttccctggtgttaagaagattaccatcaagcctcagacggataggtgggtgttccctgacaccaagagtggcatcattgttcttgcagagggacgtctgatgaacttgggttgcgcaactggccacccaagttttgtcatgtcctgctcgtttacaaaccaggtcattgctcagttagagctctggaacgagaggaaatcaggaaagtatgagaagaaggtctatgtgctgcctaagcatctagacgagaaggtcgctgctctgcacttacctaagttgggtgccaagctaacaaagcttactcctgaccaggcagaatatatcaatgtgcctgttgagggaccttacaaacctgctcagtaccgatactgaagggatctgactttttggatgacttgttgggtgggtagcaaatgtcctcgctgtttgccaatagaactagcatttctttgtggcaactccgttgtttcgagggaccttacaagcatactgatgacagaagacattttgttaagacctgttgagtgagtgccaagtaacgaagctcctcaacatcgaaagaactagcccctctttgtgacagctccattgctttgttagaattataataaaattttgttatcgtttgtatgcgtggttgctgaattcatcacagcatcacataaaagcttttccttttattatcggtatgtggtctaatagtttaatagagttcgtatccgaggtttctgccaatgtggcttttgtattgccgaaacttcagtatggaagtaagaacatattgat

SEQ ID NO: 7821 - DNA, 1916 bp, Plantago ovata
cacacaattctcctcatctttccttgttcacagtaaattaaacaaactaaatctcagatccatttctctctactctaaaacccagccatgtctctctccgtggagaaaaccacttccggccgtgaatacaaggtcaaggacatgtcccaggccgactttggccgtctcgaaatcgagctcgccgaggttgaaatgcccggtctcatgtcctcccgtaccgaattcggcccatcccagccattcaagggcgccagaatcaccggaagtctccacatgaccatccagaccgccgttctcatcgaaaccctaaccgccttgggcgctgaggttcgttggtgctcatgcaacattttctccacccaggaccacgctgccgccgccattgctcgtgattccgccgccgtgttcgcctggaagggggagactcttcaggagtactggtggtgtaccgagagggcgttggactggggtccaggtggtggtcccgatctgatcgttgatgacggtggtgacaccacgctgttgatccatgagggagtgaaggctgaggaggagtttgagaagtcagggaaattgcctgatccaacctccactgacaatgctgagttccagatcgtgttgagtttgatcaaggatggtttgaagaccgatcctaagaggtacactaagatgaaggagagattggttggtgtttctgaggagaccaccactggtgttaagaggttgtaccagatgcaggctaatggaactctccttttccctgctatcaatgtcaatgactctgtcaccaagagcaagtttgacaacttgtatggatgccgtcactcactccctgatggtctcatgagggccactgatgttatgattgccggaaaggtcggagttgtgtgcggttacggagatgtcggaaagggttgtgctatgtccttgaagcaagctggagcccgtgtgattgtcactgagattgatcccatctgtgctctccaggcactcatggaaggtttccaagttttgaccttggaagatgttgtatctgaggctgacatctttgtcacaaccaccggcaacaaggacatcatcatgctcgaccacatgaggaagatgaagaacaacgccattgtttgcaacattggtcactttgacaatgaaatcgacatgcttggtctggagactttccctggtgttcagaggatcaccatcaagccccaaacagacagatgggtgttccctgacaccaagtccggtgtcatcatcttggccgagggtcgtttgatgaacttgggttgtgccactggacaccccagtttcgtgatgtcgtgctcgttcaccaaccaagtcattgcccagctcgagctctggaacgagaggaaaactggcaagtatgagaagaaggtgtacgtcttgccgaagcaccttgatgagaaggttgctgctctccatcttggaaagctcggtgccaagctcactaagctcagcaaggaccaggctgattacatcagcgtcccagttgagggaccatacaagcctgtacactataggtactaagggaagagaaacagcagtgacctgagagaaggaacagtcactctattactataccttgatttttattgtttcttttgaattattatcacttaatactgtctggggttagttgttttgaggtgccttttggcaaagattgtgggatttgaacgaccatttgaactgaaataagtccaagaggctctgagtcatgacaaatgttagtcatgttttctttcatccgtttttgatcaagaacttctactttctgcactagagatttactcttgttttcttgtatccgtctctattctatattgcattctgagttctgtgctataaatctgttcaacacctagctagaaaagtatttgaaaaaatggtcttaacat

SEQ ID NO: 7822 - DNA, 1783 bp, Silene vulgaris
ttcttctctctcttctcctctctgtccttcaagctctcaacaatggcgttgttagtagagaaaacaacgacaggaagggagtacaaggtcaaggacatgtcccaagccgatttcggtcgtctcgaactcgagcttgccgaagtcgaaatgcctggtctcatggcttgtcgtaccgaattcggcccttctcagcctttcaaaggtgctagaatcactggatctcttcatatgactattcaaaccgctgttcttatcgaaaccctaactgctcttggtgctgaagttcgttggtgttcttgcaacatcttctctactcaggatcacgctgcagctgctattgccagggacagtgcagcagtgttcgcctggaagggggagacccttcaggagtactggtggtgcactgagagggctcttgactggggtcccggtggtggtcctgacctaattgtggatgatggtggtgatgccactcttttgatccacgagggagtcaaggccgaggaagagtttgagaagaacggaacaattcccgatcctacctcaaccgacaatgttgagttccagcttgtgttgggtctgatccgtgaaagtctcaaggttgaccccaagaggtaccacaagatgaaggagagattggtcggtgtgtctgaggagaccactactggtgtcaagaggctttaccagatgcaggctaacggaacccttttgttccctgccatcaacgttaacgactctgtcaccaagagcaagtttgacaacttgtatggatgccgccactctctccccgatggtttgatgagagccactgatgttatgattgccggtaaggtgggtgttgtctgtggttacggagatgtcggaaagggttgtgctcttgccttgaaggctggtggtgcccgtgttatcgtgactgagattgacccaatctgtgctctccaagctcttatggagggtttccaagtgcttaccttggaagatgtcgtctctgaggctgacattttcgtcaccaccactggtaacaaggacatcatcatggtcgaccacatgaggaagatgaagaacaacgccattgtttgcaacattggtcactttgacaatgaaatcgatatgcaaggtctagagaccttcccaggagtcaagaggatcaccatcaagccccagactgaccgatttgtcttcccagacaccaactcaggtgtcattatattggctgagggtcgtctcatgaacttgggatgtgccacaggtcaccccagctttgtcatgtcttgctctttcaccaatcaagtgattgcccaactcgagctatggaatgagaggtcctccggcaagtacaagaaggaggtgtatgtattgcccaagcaccttgatgagaaggtggccgcccttcaccttggaaagctcggtgccaagctcaccaagctcacaaaggagcaggcagactacatcagcatccccgtcgagggtccttacaagcccgcccactacaggtactagagagcatggatcgtgttggacattgcggagagacggagttcccttgtgccatatgatggcttaggaattaatgtttgttaaattttggattttgatgttgatctttcatataaggattttagttggaaagttgtaaggattcgagttcaattaggtatttgaattgaagatgggaatgggggttcgattgttcgaataaggggttgaagccttgtaggtttcggtttttaggtgtgagttgtaatcgctgtagacttatctcttccttctttttatgccaatg

SEQ ID NO: 7823 - DNA, 1880 bp, Tabernaemontana elegans
tgccactctcttcttccccaaaacctcacaggagagagagagtcagagacctcaattttctcccaaattctttagccatggctttgttagtcgagaaaaccagttcaggaagagaatacaaggtcaaggacatgtcccaggctgacttcggaaggctcgaaattgagcttgccgaggtagaaatgcctgggttgatgtcttgcagggctgagtttggtcctagccagcccttcaagggcgcaaagattactggaagtttgcatatgactattcagaccgcagtgctgatcgaaacattgacagcactcggcgctgaggttagatggtgttcttgcaatattttctcaactcaagatcacgccgccgccgccatagcccgtgacagcgccgccgtgtttgcctggaagggtgagacccttcaggaatactggtggtgtaccgagagggccttggactggggtgctgatggtggcccagatcttattgttgatgatggtggtgatgccacattgttgatccatgagggtgttaaggcagaggaggagtataagaagtgtggaactctccctgatcccaattcaactgataatgctgagtttcagattgttttgacgattattagggatgggttgaaggctgatcccaccaagtatacaaggatgaaggagagacttgtgggtgtgtctgaagagactaccactggtgtcaagaggctttaccagatgcaggctaatgggactttgttgttctctgccatcaacgtcaatgactccgttacaaaaagcaagtttgacaacttgtatggatgccgccactcactccctgacgggctcatgagagccactgatgtgatgattgctggcaaggttgcagttgtctgtggatatggagatgtcggaaagggctgtgccgctgccttgaagcaagctggtgctcgtgtcattgttactgagattgatccaatctgtgctcttcaggcactcatggaaggtctccaagttcttacccttgaggatgtggtctctacagctgatatctttgttaccaccacgggtaacaaggacatcatcatggttgaccacatgaaaaagatgaagaacaatgccattgtttgcaacattggccactttgacaacgaaattgacatgctaggtcttgagacctacccaggtgtgaagagagtcacaattaagcctcaaacagatagatgggtcttccctgaaacaaattcaggcattattgtcttggctgagggtcgtctcatgaacttgggttgtgccacgggacaccctagctttgtcatgtcgtgctctttcactaaccaagtcattgcccagctcgagttgtggaatgagaggacgtcagggaagtacgagaagaaggtttatgttttgcccaagcaccttgatgagaaggttgctgcactccaccttggcaagcttggggccaagcttactaagcttaccaaggagcaggctgactacattagtgtacctgttgagggtccttacaagcctccgcactataggtactgagggattgatcacatcaattcggataaaaatggtgaaacaatatattttgacagggcattattgctcttctttcatactgtattagatttggtaggttattgagttttggatgtgttctttggggggctggagatgatcggaaaaattatggtctttgtcaagaccgagatatgtttgaataaggctagcgtgggggtgtggagctatatttttgcttcttcaattaggtttattgtattttggcttttgtttgttgcagaaaaagaaacaagaatatattgtttccaatgagtttttatacccatccaatagttgtttttgctcttaatggtgttggttggtggc

SEQ ID NO: 7824 - DNA, 1999 bp, Fragaria vesca
gcaattccctcactctctcttctaaccctacccatctgaagatccagagagtagagagagaaccaacccgacccgataacaatggctctctccgtcgagaagcatagctccggccgcgagtacaaggtcaaggacatgtcccaggccgacttcggcaggctcgagatcgagctcgccgaggtcgaaatgcctggtctcatggcctcccgtgtcgaattcggcccgtcccagcccttcaagggtgcccggatcaccggatctctccacatgaccatccagaccgccgtcctcatcgaaaccctaaccgctctcggagccgaggtccgctggtgctcctgcaacatcttctccacccaggaccacgccgccgccgccattgctcgcgatagcgccgctgttttcgcctggaagggagagactctccaggagtactggtggtgcactgagcgcgccttggactggggccccggcggaggcccagatctgatcgtcgacgacggtggtgacactactctcttgatccatgagggtgttaaggccgaggagatctttgagaagaccgggcagctacctgacccgacttccaccgacaacgcggagttccagatcgtgctctctattatcaaggaggggttgaagaccgaccccaagaggtaccgcaagatgaaggacaggattgtcggtgtctcggaggagaccacaaccggagtcaagaggctgtaccagatgcagaacagcggctcattgttgttccctgctatcaatgtcaatgactctgtcaccaagagcaagtttgacaacttgtatggttgccgtcactctctccctgatggtttgatgagagccactgatgttatgattgccggaaaggtttctgttgtctgtggatatggtgatgttggaaagggttgtgctgctgctctcaagcaagccggatcccgtgtgatcgtgactgagattgacccaatctgtgctcttcaggctcttatggaaggccttcaggttcttcccattgaggacgtcgtctctgatgctgatatctttgtcaccaccaccggaaacaaggacatcatcatgcttgagcacatgaggaagatgaagaacaatgccattgtttgcaacattgggcattttgacaatgagatcgacatgcatggacttgagacattcccaggagtgcagcgtatcaccatcaagcctcaaacagataggtgggttttccccgataccaagactggtatcattgtgttggctgagggccgtctcatgaacttgggttgtgccactggacaccctagctttgtgatgtcctgctctttcaccaaccaagtgattgctcagcttgagttgtggaatgagaggaagagcggcaagtatgagaagaaggtctatgtcttgcctaagcaccttgatgagaaggttgctgctcttcatcttggaaagctcggagccaagctcaccaagctcagcaaggagcaggctgactatatcagcgttccaattgagggtccatacaagcctgctcactacaggtactgaaaggcctgcaggaagaagagaactgagaagaacattatacctggacgggttgaattttttttcttattatttttttgttggtttcatttacgttgcgaacggattgtgctagaactctaggtgcttaattttgttagtagtttttgtggtcgggaaggtatggtcgggaaagctatggatgatttggtctcacttgaagacctgggatgcggtttgaataacgattgaaaggtgggatgtgtgggatatatctggtgcagtatttgttttgctgcatctgattatccatttactagcacgaaaacgagttctagaaaaagaaaatgaactaaattgcttcattttgaaattttgttcccttaatagtagtttcattttgtttctttaacactcgacacttacaatacagggatgtcttgcccaaatgcttggattactgaaaacatagtttcaatttagt

SEQ ID NO: 7825 - DNA, 1446 bp, Solanum tuberosum
tcgtcgagaaaaccacctccggccgcgagtacaaggtcaaggacatgtcccaggccgatttcggccgcctcgaaatcgagctagccgaagtcgaaatgcctggattaatggcttgtcgtactgaattcggtccatcacagccattcaaaggtgcaaaaatcaccggaagtttacacatgacgatccaaaccgctgtcctaatcgaaaccctcactgcattgggtgctgaagttcgatggtgttcctgcaacattttctcaactcaagatcacgcggctgctgcgacagcgcgtgacagcgccgccgttttcgcgtggaaaggggaaacattgcaggagtattggtggtgtacggagagggcacttgattggggtccaggtggtggacccgatctgattgttgatgatggtggtgatgctacattgttgattcatgaaggtgttaaagctgaagaggaatacgcgaaaactggtaaatttccagatcctaattctactgataatgttgaatttcagcttgtgcttactattattaaggatgggttgaaaagcgatccgttaaagtatacgaagatgaaggagagacttgttggtgtttctgaagaaactactactggtgttaagagattgtatcagatgcaggctaatggaactttgcttttccctgctattaatgttaatgactctgtcaccaagagcaagtttgacaacttgtatggatgtcgccactcactgcccgatggactcatgagggctactgatgttatgattgctggaaaggttgcccttattgctggttatggtgatgttggcaagggttgtgctgctgcaatgaagcaagcaggtgcgcgtgtgattgtgactgagattgacccaatctgtgctctccaggctactatggaaggtctccaggttcttcctctcgaggatgttgtttccgaaattgatatctttgttaccacaactggtaacaaggatatcatcatggttgaccacatgaggaagatgaagaacaatgccattgtctgcaacattggccactttgacaatgaaatcgacatgcttggtcttgagacctaccctggtgtgaagagaatcacaatcaagcctcaaaccgacagatgggtcttccccgacaccaagagtggcatcattgtcttagctgagggtcgtctcatgaacttgggatgcgctactggacaccccagttttgtcatgtcgtgctctttcactaaccaagtcattgctcagcttgagttgtggaaggagaaggcaagtggcaagtatgagaagaaggtgtacgtcttgccaaagcacctcgatgagaaggttgctgcccttcatctcggacagctcggagtcaagctcactaagctctccaaggaccaagctgattacattagtgtaccagttgagggtccttacaagcctgctcactacaggtact

SEQ ID NO: 7826 - DNA, 1890 bp, Arachis hypogaea
ggcgtctccgcctctcaactgagtcagtcacacactctcttctcttcttttctcttcattttctcaagaaagcagcgaccatgtctctgtccgtagagaagaccacaagcggccgcgagtacaaggtcaaggacctttctcaggctgacttcggccgtcttgagatcgagctggcggaggttgagatgcccggactcatggcctgccggactgagttcggcccatcccagcccttcaagggtgccaggatcactggctccctccacatgaccatccagaccgccgtcctcattgaaaccctcaccgccctcggcgctgaggtccgctggtgctcctgcaacatcttctccacccaggaccatgccgccgctgccatcgcacgtgactccgccgctgtctttgcctggaagggagagactctccaggagtactggtggtgcactgagagggctcttgactggggtccatccggcggacctgacctcatcgtcgacgacggtggtgacgccactctcctcatccacgagggtgtcaaggctgaggagctttacgagaagaccggtcagctccctgaccctgcttccaccgacaacgctgagttccagatcgtgctcaccatcatcagagatggcttgaagaccgatccacagaggtacagaaggatgaaggaaaggcttgttggtgtctcggaggaaaccaccaccggtgtcaagaggttgtaccagatgcaggccaatggaactctcttgttccctgccatcaatgtcaatgactctgtcaccaagagcaagtttgacaacttgtatgggtgccgccactccctccccgatggtctcatgagagccactgatgtcatgattgccggaaaggttgccgttgttgccggttatggagatgttggcaagggttgtgctgctgccttgaagcaggccggtgctcgcgtcattgtgactgagatcgatccaatttgcgcccttcaggctctcatggaaggtcttcaggtcttgacccttgaggatgttgtctctgaggctgatatcttcgtcaccaccaccggtaacaaggacatcatcatggttgaccacatgaggaagatgaagaacaatgccattgtctgcaacattggacactttgacaatgagatcgacatgcacggtcttgagacataccctggcgtgaagcgcatcaccatcaagccccaaaccgatagatgggtgttcccagagaccaacaccggcatcatcgtcttggccgagggtcgtttgatgaacttgggttgtgccaccggacacccaagtttcgtgatgtcttgctcattcaccaaccaggtcattgcacagctcgagttgtggacggagaagagcagtggcaaatatgagaagaaggtgtatgttttgcccaagcacctcgatgagaaggtggctgcactccaccttggcaagcttggagccaagctcaccaagctttcccaatcacaagctgattacatcagtgttccagtggagggtccatacaagcctcctcattacagatactaaggaagaagatcaagatttgttgagagaagaaagaaaaaaaaaacttatgttttgtggatcgaatttgattgtttcattttgcattttggagactttcattgttacacacacatttcggatttgtggttagatgggtggtagtcttctaattctagtagggtttcttgtgttgtttcagaggggagggttaagagggatgggtagaatctccattgctttctctggaaagagaacaaatgggtttggttttgaataaggctgcgggttggggggttgtgttcattcttctttagtagctggttgtgttcattcttctttagtagctcatatatccgtgtttggatccactttt

SEQ ID NO: 7827 - DNA, 1606 bp, Lactuca sativa
gcgggggtcacaccttcctctctgcttcttactgaaataagaaacagaggagtctccgatcagctcataaaaccctaatccaccatggctctcgtcgtcgagaaaacctcctctggccgtgaatacaaagtcaaggacatgtccttggccgacttcggtcgtctcgagctcgaattagccgaagttgaaatgccgggactaatgtcttgccggacggaattcggtccttctcagccattcaagggcgctagaatcaccggatccctccacatgactatccaaaccggtgtcctcatcgaaaccctaactgccttgggcgccgaggtcagatggtgctcctgcaacatcttctcaacacaagaccacgccgctgccgccattgcacgtgactccgccgccgtgtttgcttggaaaggggagactcttcaggaatactggtggtgtacggagaggtcacttgactggggcccaggcggtggtccagatctgatcgtggatgatggtggtgatgccacgatgttgattcacgaaggagtgaaagcagaggaggagttcgcgaaaaccggtaagttgccggatcccacctccactgacaacgccgagttccagatcgtgttgtcgattatcaaggaaggtttacaaatcaatccgacaaagtaccacaaaatgaaggagagattagtcggagtatcggaggaaaccaccaccggcgtcaagcgtctctaccagatgcaagctaacggcagcttactcttccccgccattaacgtcaatgactccgtcaccaagagcaagttcgataacttgtacggctgccgtcactccctccccgacggtctaatgagagccaccgacgtaatgatcgccgggaaagtcgccgtcgtctgcgggtacggagacgtcggaaagggttgcgcctccgccatgaaacaagccggcgcccgcgtcatcgtgacagaaatcgacccaatctgcgccctccaagctctaatggaaggtctccaagtcctaaccctcgaagacgtcctcccccacgccgacatcttcgtcaccaccaccggaaacaaagacataatcatggtcgacgacatgaagaagatgaaaaacaacgccatcgtctgcaacatcggccacttcgacaacgaaatcgacatgcttggactcgaaacatacccaggtgtgaaaagaatcacgatcaaaccccaaactgaccggtgggtgttcccggagacgaaaagtgggatcattgtgttggcggaggggaggctgatgaacttgggttgtgcgactgggcatcctagctttgtgatgtcgtgttcgtttactaatcaagtgattgcgcagcttgaattgtggaatgagaaaggaagtgggaagtataagaagcaggtttatgttttgcctaagcatcttgatgagaaagttgctgctcttcatcttgaaaagcttggagcgaagcttacgaagcttagtgaggatcaagctgattatattagtgttcctgttaatggtccctacaagcctgctcattataggtattgattgaaaaagggttttggattgttgttgattttttctacgaaatttgagtttgattgtgggttta

SEQ ID NO: 7828 - DNA, 1878 bp, Glycine max
ctcaccactccactctctttttctactctttctatctttctttctttcttcttccccatggctttgttggtggagaaaaccacgagcggccgcgagtacaaggtcaaggacctttcccaggccgacttcggccgcctcgagatcgagctggccgaggttgagatgccgggcctcatggcctgccggaccgagttcggcccatctcagcccttcaagggggcccgcatcaccggctcccttcacatgaccatccagaccgctgtcctcatcgagaccctcaccgctctcggcgccgaggttcgctggtgctcctgcaacatcttctccactcaggaccacgccgccgccgccatcgcccgtgacagcgccgccgtcttcgcctggaagggtgagaccctccaggagtactggtggtgcaccgagcgcgccctcgactggggccccggcggcggccccgacctcatcgtcgacgacggaggcgacgccaccctcctcatccacgagggcgtcaaggccgaggagctctatgagaagaccggggaactccccgaccctaactccactgacaacgccgagttccagatcgtgcttaccatcatcagagatgggttgaagaccgatcccaccaggtaccgcaagatgaaggagcgtctcgttggggtttctgaggaaaccaccactggtgttaagaggctatatcagatgcaggcgaatgggactctactcttccctgctattaatgtcaatgactctgttaccaagagcaagtttgacaacttgtacgggtgccgtcactctctccctgatggtctgatgagggctactgatgtgatgattgctggaaaggtggctgttgtggctggatatggtgatgttggcaagggttgtgctgctgcattgaagcaggctggtgctcgtgtcatcgtgactgagattgaccccatttgtgcccttcaggctctcatggaaggccttcaggttctgaccttggaggatgttgtttctgaggctgatatctttgtcaccaccacgggtaacaaggacatcatcatggttgaccacatgaagaaaatgaagaacaatgccattgtttgcaacattggtcactttgacaatgagatcgacatgctggggctggagaactaccccggcgtgaagcgcatcaccatcaagccccaaaccgacagatgggtcttccccgagaccaatgtcggcatcattgtcttggccgagggtcgtttgatgaacttgggatgcgccacaggacaccctagttttgtgatgtcctgctccttcaccaaccaggtcattgctcagcttgagttgtggaaggagaagagtaccggcaagtacgagaagaaagtttacgttttgcccaagcaccttgatgagaaggtggctgcacttcaccttggcaaacttggagctaagctcaccaagcttagcccggcccaggctgattacatcagtgtgcctgttgagggtccatacaagcctgctcattacaggtactaagtaattgagattatcaacggaaagtgagggaaagacaaaatcggttttatgaatcggattgattgtttaattttcctttttttgaatttttgttgttagacttttcagatttgaggtagaagaagtttagctttttttatttttaatttccgtagaatttctgttcgagtgggtgggacgggtaaggaggaagacatcctgttggtttctgtgatatgaaaccaatttgggttgaataagcatgttttgtttggggaatgtgtgtgcattttgcttttgctttattaaatactaaattatgtgtttctgtccaccttttcaatatatcaaaagaaaataagagaaaatgaaaaaattcctaca

SEQ ID NO: 7829 - DNA, 1780 bp, Taraxacum officinale
acggtccggattcccgggatctcagagcccccaagatccgatctacaatcccttatccgccatggctctcaccgttgagaaaacttccaccggccgtgagtacaaagtcaaggacatgtccttggccgacttcggacgcctggaactcgatttagccgaggttgaaatgcccggtctcatgtcctgcaggacggaatttggtccttctcagcctttcaagggtgcgagaatcaccgggtccctccacatgacaatccagaccgctgtcctcattgaaaccctcaccgccttgggtgccgaggttagatggtgctcctgcaacattttctcaactcaagaccacgccgccgctgctatcgcccgtgattcggccgccgtatttgcctggaagggggaaaccctagaggagtactggtggtgcacggagcgtgctctagactggggccctggtggtggacccgatctgattgttgatgatggtggtgatgcgactttgttgatccacgagggagtcaaggcggaggaggagtttgctaagaccggtaaattgcccgatcctacttcaaccgacaacgctgagttccagatcgtgttgtcaatcattaaggaaggtctgtctaccgacccaaagaagtaccacaagatgaaggataggttggttggtgtgtctgaggagaccaccaccggtgttaagaggttataccagatgcaagccaatggcactttgcttttccctgccattaatgtcaatgactctgtcaccaagagcaagttcgacaacttgtacggatgccgtcactcactccccgacggtttgatgagagccaccgacgtcatgatcgccggaaaggtcgcagtcgtgtgcggatacggagacgtcggaaagggttgcgccgccgccatgaagcaagccggagctcgcgtcatcgtgacagaaatcgacccaatctgcgctctccaagccaccatggaaggtctccaagtcctcaccctagaagacgtagtctcagaagccgacatcttcgtcaccaccaccggcaacaaagacatcatcatggtctccgacatgaaaaaaatgaagaacaacgccatcgtctgcaacatcggccattttgacaacgaaatcgacatgctcggactcgaaacctacccaggagtgaagcgcatcacaatcaagccacaaaccgacaggtgggtcttccctgaaaccaacaccggaatcattgttctagctgaggggcgtctcatgaacttggggtgtgccaccggccaccctagtttcgtgatgtcatgctcgttcaccaaccaagtgatcgcccaacttgagctatggaaggagagaaccagtggaaagtaccagaaggaggtgtacgttttacctaaacatctcgatgagaaagttgctgcgctccatttgggtaaacttggtgctaggttgacgaagcttagcaaggatcaagctgattacatccatgtaccagttgaaggtccatacaagcctgctaactacaggtactgagaagcttgttgggtttttgaagtggggttttgtgattggatgcttttgtaggggttttagttgtgtttgttgaattttatggtggtgtttggtggggaggaaactgattggtctttttttgttgaaaaggctgatttgaataagggttgagtgtgatgggttgtgtaccacaattgtagttttttttggtaataggttggattttgttacattttggttgttaattgatgcggaagtttaagcaaaaaaaaaaaaaaaaaa

SEQ ID NO: 7830 - DNA, 1841 bp, Flaveria ramosissima
gttttaacccacatcctctgctataaaccagagtgtgtgtgaattgtgatcaccggaaccctaactccgatcagacccaccggaaccctaactccgaccaccatgtcgctcaccgtcgagaaaacctccaccggccgtgaatacaaggtcaaagacatgtcattggctgacttcggtcgtctggagctcgaattagccgaggtcgaaatgccggggttgatgtcttgtcggacggaattcgggccttcacagccgttcaagggggctagaatcaccggatcactgcacatgacgattcaaaccggtgtgttgatcgaaaccctaactgcattgggcgctgaagtgagatggtgttcgtgcaacatcttctcgacgcaggaccacgctgcggcggcgatcgcacgtgactccgccgcggtgttcgcgtggaaaggggagacgctgcaggagtactggtggtgtacggaacgagcgcttgattggggccctggtggtggaccggatctgatcgttgacgatggtggtgatgcgacgttgttgattcatgaaggtgtgaaggctgaagaggagtttgagaagagtgggaagctgccggatccgacgtcgactgataacgctgagtttcagatcgtgttgtcgattattaaggaggggttgcagagtgatcccaagaagtatcataagatgaaggagagattggttggtgtgtcggaggagaccaccactggtgttaagaggctgtatcagatgcaggctaatggaactctgttgttccctgctattaacgttaatgactctgttactaagagcaagtttgataacctgtacggttgccgtcactctctccctgatggtttgatgagagctactgatgtcatgatcgctggaaaggttgcagtggtctgcggttatggtgatgtcggaaagggttgtgctgctgcaatgaaacaagttggtgcacgtgtgatcgttacagaaatcgaccccatctgtgcgcttcaggccaccatggaaggactccaagttcttaccttggatgatgtggttcagaggccgatatcttcgttaccaccactggcaacaaggacatcatcatggtttccgacatgaagaagatagaaaaacaacgcgatcgtgtgcaacattggtcatttcgacaatgaaatcgacatgcttggtcttgaaacctacccaggtgtcaagagaatcaccatcaagccccaaaccgacaggtgggtcttcccagaaaccaacactggcatcattgtgttggccgagggtcggctcatgaacctggggtgtgctactggacaccccagtttcgtgatgtcgtgctctttcactaaccaagtgatcgcccaacttgagctttggaaagaaaagaactccgggaagtacaagaaggaagtgtatgtgttgcccaaacatctcgatgagaaggttgctgcacttcatctcggaaagcttggagccaagttgaccaagttgaccaaggaccaggccgattacatcagtgtgccggttgagggtccatacaagcctgctcactacaggtactagacgggtcgggttttttggtgagtttgaagagagggtgatgtgattgttgctttctttataagatacaatgagtatgtgttagggtttagttttgtttgttatgttgatcggggtgttggcgaggaaaaaaccgactggtcgtatcttgatgagacgaccgatgatatcggtttgaataagggttttgagaaggttgtgtaaacgccattgtagttgttttttgggtcaagatgttttgtttgctatgtgttttgcttgttagttcatcaggaaactaatag

SEQ ID NO: 7831 - DNA, 1806 bp, Ocimum basilicum
acttcaaatcctgccctactcgctcaacccatggcgctccaagtggagaagaccacctccggccgcgagtacaaggtcaaggacatgtcccaggccgacttcggccgcctcgaaatcgagctcgccgaggtggagatgccgggcctcatttcctgccggaccgagttcggcccctcccagcccttcaagggtgcccggatcaccggaagtctccacatgaccatccaaactgccgtcctcatcgagacccttaccgctctcggcgctgaggtcagatggtgctcttgcaacatcttctccactcaagaccacgccgccgctgccattgctcgcgacagcgccgccgtcttcgcctggaagggtgagaccttgcaggagtactggtggtgcaccgagcgggccctcgattggggccctggcggcggccccgatctcatcgtggacgacggcggtgatgccactctgttgatccacgagggcgtgaaggcggaggaggagtacgagaagacggggaagttgccggaccccagctcgactgataatgcggagtttcagatagtgctgacgttgatcagagatgggttgaaggccaatcccaccaagtataggaagatgaaggagagattggttggtgtttctgaggaaacaactactggtgtgaagaggctgtatcagatgcaggctaatggcactctgcttttccctgccatcaatgtcaatgattctgtcaccaagagcaagttcgataacctgtatggttgccggcactcgctgcctgatggacttatgagggctactgatgtgatgattgccggaaaggtgggagttgtgtgtggttatggagatgttggcaagggttgtgctgcggcctgaaacaggccggtgctcgtgtgattgtcaccgagattgatcccatttgtgctcttcaagccctaatggaaggcttccaagtgctgaccctggaggacgttctttctgaggccgatatctttgtcactaccaccggcaacaaggacatcataatggtcgaccacatgaagaagatgaagaacaacgccatcgtcaacattggccacttcgacaacgagatcgacatgctgggtcttgagacctaccccggcgtgaagaggatcaccatcaagccacagactgaccgatgggtgttcccagagacgaatactggaataatcgtactggcagaaggtcggctgatgaacttggggtgtgcgacagggcacccgagctttgtgatgtcgtgctcgttcacgaaccaagtgatagcgcagctggagctgtggaaggagaggaagagtgggaaatacaagaaggaggtttatgtgttgccgaagcacttggacgagaaggtggctgcactgcacctgggaaagctgggggcgaagctcactaagctcaccaaggatcaggctgattacatcagtgttccggtggagggaccttacaagcctcttcactacagatactgatcacaacagagcaaacaagctctttctgctatttgccattgcgcaagcttgctccttttttagttttcttgccatcttggaactcccattttatggcctataataactaaaaatatgttctcttttgcatctctcctctttcacacaaacacaacaggcatttcaatttgagatggcttttggactaatcagacaatttgcagggcatcattgggtcaattgatttcttagttataagaagaacgttatgcttggatctaacctaatgtcaactttttgctcaagttaataaaactgttgccttattttacttatgtccatt

SEQ ID NO: 7832 - DNA, 1753 bp, Amsonia hubrichtii
aatccatttctaaaccctaagcccgaatcgaacccgccatggctctctctgtggacaaaacctcgtcgggccgggagtacaaggtcaaggacatgtctcaggccgactttgggcggctcgagatcgagctcgctgaggttgaaatgccaggactcatggcttgtcgggccgagttcgggccatctcagccattgaagggtgcttgcatcactggttccctccacatgactattcagaccgccgttctcattgaaaccctcaccgcccttggcgccaccgtccgctggtgctcttgcaatattttttccactcaggaccatgccgccgccgccatcgcccgtgattccgctgctgtctttgcctggaagggtgaaactcttcaggaatactggtggtgtacagagagggcattggactggggttcagagggaggaccagatttgattgtggatgatggtggtgatgctactttgttgattcacgagggagtgaaggcagaggaggagtatgagaaaacagggaagttgccggatccaagctccactgataatgctgaatttcagattgttttgggaatcattagggatggattgaaggcggatcccaagaaataccgcaagatgaaggagagattggttggtgtttcagaggagaccaccactggggtgaaaaggctgtaccagatgcaggctaatgggaccctgttgttccctgctatcaacgtcaacgactctgtcactaagagcaagtttgacaacttgtatggatgccgtcactcactccctgatggtctcatgagagccactgatgttatgattgctggtaaagttgctgtggtctgtggatacggagatgttggcaagggttgtgctgctgctcttaagcaagctggtgctcgtgttattgtcacagaaattgatcccatctgtgcccttcaagccctcatggaaggtattcaagttttgaccttggaagacgttgtctctgaggctgacatcttcgtgacaaccactggaaacaaagacattattatggttgatcacatgaggaagatgaagaacaatgcaattgtctgcaatattggtcactttgacaatgagattgacatgcttggtcttgaaacctatcctggtgttaagcgcatcaccatcaagccccaaactgaccgctgggtattccctgagactggaactggcatcattgttcttgctgagggacgtttgatgaacttgggatgtgccaccggccatccaagctttgtgatgtcttgctctttcaccaaccaactgatcgcccaacttgagttgtggaaagagaaggcctctggcaagtacgagaagaaggtctacgtgctgccaaaacatcttgacgagaaggttgcagctcttcatttgggaaaacttggagctaagttgacaaagctcacaccagatcaggctgcctatattagcgttccagctgagggtccatacaagccaccacactacaggtactgaggagcagcagcaaaagcagccgcgtaggcaagttgtggtgccttttttttgtttttctttaggggtgtcttagtggtgggggtagttgttaattgtttcggttgttttcctgggtcatctgttttccttttcttgtggtagagatactgtattaggattgcggttgttcaaccctgttcatggggtttgaatttgtactcgtgccactgggaagtaatacgagccaatgaaaaagcagaaaatgagtagattttttt

SEQ ID NO: 7833 - DNA, 1643 bp, Arnica chamissonis
ttcctctctgttttcttctgaaacagagcctgtgatcaaatccgatctgaaaccctaactccgaccaccatgtctctcaccgtcgagaaaacctccaccggccgtgaatacaaggtcaaggacatgtccttggctgatttcggccgccttgaacatgaattagccgaagttgaaatgcccggtttgatgtcatgccggactgaattcggaccttcacagccattcaagggagctaggatcaccggctcacttcacatgacgattcaaaccggtgtgttaatcgaaaccctaactgctctgggagccgaggtgcgatggtgttcctgcaacattttctcgactcaggatcacgccgccgcggcgatcgctcgtgattccgccgctgtgttcgcctggaagggggaaacactccaggagtactggtggtgtacggagagagctcttgattggggtcctggtggtggacctgatttgatcgttgatgacggtggtgatgcgacgcttttgattcacgaaggtgtgaaagctgaagaggagttcgagaagaccgggaaattgccggatccgacttcaaccgacaatgccgagttccagatcgtgctgtcaattatcaaggaaggcttacagatcgacccgaagaagtaccacaagatgaaagatagattggtaggtgtatcggaggagacgaccaccggtgtcaagaggttgtaccagatgcaagccaacggtaccttgcttttccccgccatcaacgtcaatgactccgtcacgaagagcaagtttgacaacttgtatggatgccgccactcgctcccagacggactgatgagagccacagatatcatgatcgccgggaaagttgcagtggtctgcggttatggtgatgtcggcaagggttgtgctgccgccatgaaacaagccggtgcgcgtgtcatagtcacagaaatcgaccccatttgtgcccttcaagctctcatggaaggtctccaagtcctaaccctagaagacgccctctcagaagccgacatctttgtaaccaccacgggcaacaaagacatagtcatggttgatcacatgaaaaggatgaaaaacaacgcgattgtctgcaacatagggcatttcgacaatgaaatcgacatgctcgggttagaaacatacccgggcgtgaagagaattaccatcaaaccacaaaccgacaggtgggtgttcccggaaaccaacagtgggatcatcgtgttagccgagggtcgactcatgaacctgggttgtgccacgggtcacccgagttttgtgatgtcgtgctcgtttacgaaccaagtgatcgcgcagctcgagctgtggaaagagaggtcatcagggaagtacaagaaggaggtttatgtgctacctaaacatcttgatgagaaagtggctgcacttcatcttggaaagcttggagccaagctaactaagcttagccaggaccaagctgattacattagtgtgccagttgagggtccatacaagcctgctcaatataggtactgagcatagggcaagaaatgtgttggttttgagggatatttgaaaaaggaaatgcttttatatctattgattaatgtggggtttggttggtgtaatattaatgtattgaatatgattat

SEQ ID NO: 7834 - DNA, 1573 bp, Chelidonium majus
agagaaacctagaatcaaattctattaaaattttcttcttttttttctcttcagatatttagcaatggcgttggtcgtcgagaaaacctcctccggtcgtgagtacaaagttaaagacatgtctcaggctgatttcggtcgtctcgaaatcgagctcgccgaggtcgaaatgcctggattgatgtcttgcagaactgaatttggtccatcacaaccattcaaaggagctagaattactggatctcttcacatgacgatccaaacagctgttctgattgaaaccctaactgcacttggtgctgaagtacgttggtgttcttgtaacattttctcaacacaagatcacgctgctgctgcaattgctcgtgatagtgctgctgtttttgcctggaaaggtgagactttgcaagagtattggtggtgtactgagagagctcttgattggggtgctggtggtggacctgatctgattgttgatgatggtggtgatgctactcttttgattcatgaaggagtgaaagctgaggaggaatttgagaaatctggtaaaatcccagatccaacttctactgataatgttgagtttcagattgttcttagtattattaaggatggattgactactgatcctaagaggtatcacaagatgaaggagagattggttggtgtttctgaggaaactacaactggtgttaagaggctttaccagatggaaactagtggaactttgctcttccctgccattaatgtcaacgactctgttaccaagagcaagtttgataacctctatggatgtcgtcactctctccctgacggtctaatgagagccaccgacgtcatgattgccggtaaggttgcattcgttgccggttacggagatgtcggaaagggttgtgctgctgctcttaaacaagccggagctcgtgtgatcgtatcagaaatcgatccaatctgtgcacttcaagctacaatggagggactccaagtcctacccctagacgatgttgtaggagaagtcgacattttcgttacaacaaccggtaacaaagacatcatcatggtttccgacatgaaaaagatgaagaacaatgcaattgtctgcaacattggtcatttcgataacgaaatcgatatgcaaggattagaaacttacccaggtgttaagagaatcaccattaaaccacaaactgacaggtgggttttccctgaaaccaacactggaatcattgttttggctgaaggaaggttgatgaacttgggatgtgcaactggtcatcctagttttgttatgtcttgttcattcaccaaccaggtgattgctcagcttgagctctggaatgagaaggcttctggtaagtatgagaagaaggtttatgttttgcccaagcatcttgatgagaaggttgctgcacttcatcttggaaagcttggagctaagcttactgtgctttcaaaagatcaggctgattacattagtgtgcctgttgagggtccatacaagcctgctcactacaggtactagagagtgtgtgagagagagagagaggaacagattgaaatgatgagagagaga

SEQ ID NO: 7835 - DNA, 1875 bp, Humulus lupulus
gattgaagcagagctcatcagatctgaaaatgtctctctcagtccagaaaacccccgccggccgtgagtacaaggtcaaggacctttctcaggccgacttccgtcgcctcgagatcgagctccccgaggtcgaaatgcccggtctcatggcttgccgtaccgagttcggtccttctcagcccttcaagggtgccaggatcactggttccctccacatgactatccagaccgccgtcctcatcgaaaccctaaccgccctcggtgctgaggtccgttggtgctcctgcaacattttctccactcaggaccacgccgccgctgccatcgctcgtgactccgccgctgtgttcgcctggaagggtgagacccttcaagagtactggtggtgcacggagcgcgctcttgactggggtcccggtggtggtcccgatctgatcgtcgacgatggtggtgacgctactctcttgatccacgagggagtcaaggctgaggagatctatgagaagaatggtcagttgcctgaccctacttctactgacaatgttgagtttcagctcgtcctttccattattaaggagggtttgaagactgaccccaagaggtaccacaagatgaaggacaggcttgtgggtgtctctgaagagaccaccactggtgtcaagaggctttaccagatgcaagccaatggttcattgttgttccctgctatcaatgtcaatgactcagtcaccaagagcaagttcgacaacttgtacggatgccgccactctctcccagatggtctgatgagggccactgatgttatgattgccggaaaggttgccgttgtctgcggttatggtgatgtcggaaagggttgcgctgctgccctcaagcaagccggagctcgtgtgatcgtgaccgagatcgaccccatctgtgcccttcaggctctcatggaaggtctccaaatcttgaccctcgaagacgttgtctccgaagccgatatctttgtcaccaccaccggtaacaaggacatcatcatggttgaccacatgaagaagatgaagaacaacgccattgtctgcaacattggtcacttcgacaatgagatcgacatgttgggtctcgagacttaccctggtgtgaagaggatcaccatcaagccacaaaccgataggtgggtcttcccagaaaccaacgttggaatcattgtcttggccgagggtcgattgatgaacttgggttgcgccactggacaccccagtttcgtcatgtcctgctcgttcaccaaccaagtcattgcccagctcgagctctggaacgagaagtcatccggcaagtacaagaaggaggtgtacgttttgcctaagcacctcgacgagaaggtcgccgctcttcacttgggcaagcttggagctaagctcaccaagctctcaaaggaccaggctgactacatcagcgtgcccgttgagggaccatacaagcccatccattacaggtactgagaacttgatatggtcagttgggtgaccgagttgagaaaacaacaaacgaaaaaaggccatatatttcaacgattgattgcttcttttttacatttctgatgatgtggtagaatactactagactttgatttttgtagggtgtgtttttatttttggtggtggttggtgggtgggagggatatgattttggaagggaaagtgtggaattggtctcttgatatgaagaccttaatgggtttcggtttcaataaggaatggatttgggctgtgttgggaatatatatatatataatatcgtaactgccgcgggtatattttgctctgctgcgtatgctttttatcttcaatattagcagagaaaatgggaaaaggaatgaattactttgcg

SEQ ID NO: 7836 - DNA, 2019 bp, Pinus pinaster
ttagccaaaatccgcggctttcccttagatctgcctgttttctcccctgtctctgtgcagcaatggcgctttacactgagaaaacggtgtccggaagggaatacaaggttaaggacatgtctcaggccgacttcggaaggctggagatcgagttggctgaagttgagatgcctggactgatggcctgccgggtcgagttcggacctgcccagcccttcaagggcgcccggatcacgggttccctccacatgactatccaaaccgctgttctcatcgagactctcaccgcccttggagccgaggtgagatggtgctcctgcaacatattctccactcaggaccatgccgcggccgccatcgctcgcgatagcgcggcggtgtttgcctggaagggggaaacactgcaggagtactggtggtgcaccgagagggctcttgactggggccctggtggcggccctgatctaattgttgacgatggcggtgacactacacttctgatacatgagggagtgaaggccgaggaagagtttgccaagactgggaaggtgccggatccgtcttctaccaccaatgtggagttccagatcgtgttggagttgatcaaggaaagcctcaaggtggatccattgaggtatcacagaatgaaggatagaattgttggtgtgtctgaggagactactactggggttaagaggctttaccagatgcagaatgccgggtccctgctgttccctgctatcaatgttaatgactctgttacaaagagcaagtttgacaacttgtatggatgtaggcactctctcccagacggtcttatgagagccacagatgtcatgattgctggtaaggttgctgttgtttgtgggtttggagatgttggcaagggttgtgctgcagccttgaaagtcgctggagctagggtcattgttacagagattgatcctatctgtgccctgcaagctcttatggaaggccttcctgtcctcacccttgaggatgtagttagcactgctgatatctttgtgacaaccactggcaacaaggacatcatcatggtagatcacatgcggaaaatgaagaacaatgccattgtttgcaacatcggtcactttgacaacgagattgatatgcaaggccttgaaactttccctggcgttaagaagattaccatcaagcctcagactgacaggtgggtgttccctgacaccaacagtggcatcattgttcttgcagagggacgtctgatgaacttgggttgtgcaactggccacccaagttttgtcatgtcttgctcctttacaaaccaggtcattgctcagttagagctctggaacgagaagaaatcagggaagtatgagaagaaggtctatgtgctgcctaagcatctagatgagaaggtggctgctctgcacttgcccaagttgggtgccaagctaacaaagctttctcctgatcaggcagagtatatcaatgtgcctattgaggggccttacaagcctgctcactaccgatactgaaaagatctgacatttgggatggcttgttggacgagtagcaaaggtcctcgctgtttgcaaataaaagaaactgtaggatttatttttggcagctctgttgttttaagggaccttacaagcctcctgactacatactgaagagatgacattttgggtgagacctgctcggcgagtatcaagttgcaatgctcctcgacatataaaaatctggcctctctttgtcggcatctccattgtttgggtagaattataataaaattttgctatcgcttgtatgcgtggctgctgaatttcttgcagcatcacatcaagcatctcgttttaatactggtatatggtttaatagtttattagagttcgtatgggaggtttctgccaatgtggcatttgtattgctcaaaattcagtttggaagcaaaaatataaggatgcctctgggtttctatccagcactggcatgttatgaatcaaatgaatttcaggtcaaggaccgcaattt

SEQ ID NO: 7837 - DNA, 1762 bp, Lippia dulcis
ctctccactttcttagcggagcgttagaacagatttttccattcctctatttcttccatactcgccgcacccatggcgctcatagtggagaaaacctcctccggccgcgagtacaaggtcaaggatatgtctctggccgacttcggccgtctcgagatcgagctcgctgaggtcgaaatgccggggctcatgtcctgccgtactgagttcggcccgtctcagccgttcaagggcgctagaatcaccggaagtcttcacatgaccatccaaaccgccgtgttgatcgagaccctgacggcgttgggcgccgaggtgagatggtgctcctgcaacatcttctcgacgcaggatcacgccgctgccaccatcgcccgtgacagcgccgcagtgttcgcctggaaaggggagaccctgcaggagtactggtggtgcacggagaggtccctcgactggggtcccgacggaggccctgatttgatcgtcgatgatggtggtgacgtcactctgttgatccatgagggcgtgaaggcggaggaggagtacgagaaatcgggtaaattgcccgacccgacgtcgacggataatgctgagtttcagatcgtgctgaccatcatcaaggatgggcttaaggccgatcctaaaaagtacaccaggatgaaggagagattggttggcgtttcagaggagaccaccactggtgttaagaggttgtaccagatgcaggctaatggcagtcttcttttccctgccattaatgtcaatgactctgtcaccaagagcaagtttgacaacttgtacggatgccgccactctctgcccgacggtctgatgagagccacagacgtgatgattgccggcaaagtcggtgttgtctgcggttacggagatgtcggcaaaggctgcgcctccgccttgaaacaagccggtgcccgcgtcatcgtgaccgaaatcgaccccatctgcgccctccaagccctcatggaaggctaccaagtcctaaccctcgaagacgtcctctccgtcgccgacatattcgtcaccacgaccggcaacaaggacatcatcatggtcgaccacatgaggaagatgaagaacaacgccatcgtttgcaacatcggccacttcgacaatgagattgatatgcacggcctcgagaccttcccaggggtcaagagaaccaccatcaagccgcaaacagaccggttcgtcttccccgacaccaactctggcgtcattgtgcttgccgagggccggctgatgaacctggggtgcgcgacggggcaccctagcttcgtgatgtcgtgctcattcacaaaccaggtcatcgcccagctcgagctgtggaacgagaggaagagcggcaagtacgagaagaaggtgtatgttctgccgaagcatctcgacgagaaggtcgccgcgcttcatctcgggaagctcggtgctaagctcactaagctctccaaggatcaggcggattacattagtgtgccgattgagggtccttacaagcctcctcactataggtactaaggggaagaagatgacaaagacaagtttataccatttgatttgcgttattatttcgtttttgaatcatgggaagactgaaaataagttgaagaggatttgagtcatcacaatgaatatctttgcctttctgattctatttcttgatgttttgattgttgggatatgggagaaaagtgtacttgtattgcttttgggatctctatatatttatatgaagtgatactctgcattc

SEQ ID NO: 7838 - DNA, 2070 bp, Valeriana officinalis
aaaatatttagttgtctccatccccacccaaacttattttgagcagatcaaatctccactaaactcaccaaccaccaccattctttgatctttctacatacaaaatcatcagatcttctctttgagatttttgacaaaaaaccaacggccacgatcatccaagtcaacatcaacttgcatagccctccaatcacgcgaacaaagatccagtagcgtcccaccattttacgacgtcgtttaactctgaagctcactcccgagttagcttcagagttaaacgacgtcgtaaaactctgaagctcactcccgagttagctgtatataaaacccattatctactctctagtctctccgtctcttccactctctattcgtctctctctacagagtttgaatcagaaaaaacctaaacagctccgatggatctggtagtagagaaaaccacatctggccaagagtacaaagtgaaggacatgtctcaggcagatttcggccgtctcgagatcgagttggccgaggtcgaaatgcctggactcatgtcctgcagaacagagttcggcccatctcagcccttcaagggagcacagatcaccggctccctgcacatgaccatccaaaccgccgtgctcatcgaaaccctaactgctctcggcgcttccgtccgttggtgctcttgcaacattttctccactcaggatcacgccgccgccgccatagctcgtgactccgccgccgtcttcgcctggaaaggcgagactctgcaggagtactggtggtgcactgagcgtgctctcgattggggacctggcagtgggccagatctgatcgtcgatgatggaggtgacgctactttgttaattcacgagggagtgaaggctgaggaggagtatgagaagaccggtaagattccggatccaacctctactgataaccctgagtttcagatcgtgctgtcaattattaaggatggtttgaagactgatcccaaaaagtatcacaagatgaaggagagactagttggagtttctgaagagaccaccactggcgtgaagaggctttaccagatgcaagctaacggtactcttttgtttccggctatcaacgttaacgactccgttactaagagcaagttcgacaacttgtatggatgccgccactcactccctgacggtctgatgagagccaccgatgtaatgattgccggtaaagttgccgttgtctgtggatacggagatgttggaaagggttgtgcctccgcaatgaagcaagccggtgcgcgagtcatcgttactgaaattgatccaatttgtgctctacaagctctgatggaaggaatcccagtcaaaacccttgaagacgtggtggctgaagctgacatttttgttaccacgaccggtaacaaagatatcataatggttgatgacatgaggaagatgaagaacaacgccatagtgtgcaacattggacatttcgacaatgagatcgacatgctaggtcttgaaacataccctggtgtgaagagaattacgatcaagccacaaactgaccgttgggtttttcctgagaccggtagaggcatattggttttggctgagggacggttgatgaacttgggttgtgcgactggtcaccctagctttgtgatgtcatgctctttcactaaccaggtgattgcccagcttgagctctggaatgagaggaagagtggaaagtacgagaagaaggtttatgttctgccgaagcatcttgatgagaaggttgctgcccttcatcttggcaagcttggagctaagctcaccaagctgtcgcctgagcaggctgcttatattagcattccagttgaaggtccatacaagccacctcactacaggtattaagcagatgcaatcagaggggatggtgagatggattatcggttttgtgtcatcttttgttttgtttatttttgatccattttgctgatgtactactctgctggtactttgtggctttattaaggttgatgattaaacttatgtttctttactgaatgtactctctgattatctatctatagcaatttgtgtcttt

SEQ ID NO: 7839 - DNA, 1478 bp, Aquilegia formosa
tctaatttcttgttgttctaatggctttgattgtagagaaaacctcttctggccgtgaatacaaggtcaaagacatgtctcaagcagatttcggtcgtcttgaacttgatcttgctgaagttgaaatgcctggtttgatttcttgcagaactgaatttggtccatcacaaccattcaaaggtgcaagaatcactggatctcttcacatgaccattcaaactgctgttctaattgaaactttaactgctcttggtgctgaagttcgttggtgttcatgtaacattttctctactcaagatcatgctgcagcagctattgctcgtgatagtgctgctgtatttgcttggaaaggagagactttgcaagaatactggtggtgtactgaaagagctcttgattggggtccaggtggtggtccagatctgattgttgatgatggtggtgatgctacactattgattcatgaaggtgttaaagctgaagaagagtatgagaaatctggtaaattaccagatccatcatcaactgataatgctgagtttcaaattgttctaactattattagagatggtttgaaaactgatcctaagaagtatcagaagatgaagcaaagattggttggtgtttctgaagaaactactactggtgttaagagactttatcaaatgcaagctaatggaactttgcttttccctgctatcaatgtcaatgactctgtcaccaagagcaagttcgacaatctctatggttgccgtcactctcttcctgatggtttgatgagagccactgatgttatgattgctggtaaggttgcattcgttgctggttatggtgatgttggtaagggttgtgctgctgctcttaagcagggtggtgctcgagttattgtttcagaaattgatcccatttgtgctcttcaagctcttatggaaggtttccaagttttgcctctagaggatgttgtttcctatgtagatatctttgttaccaccacaggtaacaaggacatcatcatggttgatgacatgaggaagatgaagaacaatgccattgtttgcaacattggtcactttgacaatgaaattgatatgcaaggattggaaacttaccccggagtgaagaggattactattaagcctcaaacagataggtgggtgttcccagataccaagtctggtatcattattttggctgaaggaaggctcatgaacttgggatgtgcaactggtcatcctagctttgtcatgtcttgctctttcactaaccaggtgattgctcagcttgagctatggaatgagaggaacagcggaaagtacgagaagaaggtgtatgtcttgcccaaacatcttgatgagaaggttgctcagcttcatcttggaaagcttggagctaagctcaccaagcttacacatgaccagtctgagtacattagcatccctgttgagggtccttacaagcctgctcagtacaggtattga

SEQ ID NO: 7840 - DNA, 1665 bp, Triphysaria pusilla
catttctcagatcttgtttgtactcatggcgctcctagtcgagaaaacaacttccggccgcgagtacaaggtcaaggacatgtcccaggctgatttcggccgcctcgagctcgagctcgcggaggttgaaatgccgggtctcatgtcctgccgtaccgagttcggtccctcccagcccttcaaaggcgcccggatcaccggcagcctccatatgaccatccaaaccgccgtgttgatcgaaacactaactgctctcggcgccgaggtcagatggtgctcctgcaacattttctccacccaggatcacgccgccgccgccatcgcccgtgacagcgccgccgttttcgcctggaaaggtgagactctgcaggagtactggtggtgcaccgagcgtgccctcgactggggccccggtggtggtcccgatctgatcgtggacgacggcggtgacgccactctgttgatccacgagggcgtgaaggccgaggaggagtacgagaagtcgggcacactgcccgacccgacttcgacagataatgctgagtttcagcttgtgctgaccatcattagagatgggttgaagactgacccgaaaaggtacacaaagatgaaggagagattggttggtgtttctgaggagacgaccactggtgttaagaggctgtaccagatgcaggccaatggcactttgcttttccctgctatcaatgttaatgactctgttaccaagagcaagtttgacaacttgtatggttgccgccactcgctcccagacgggctgatgagggccactgatgtcatgatcgccggaaaggttggtgttgtttgcggttatggagatgttggtaaaggctgtgctgctgccttgaaacagggtggggcccgcgtgatcgtgacggagattgatcctatctgcgccctccaagcgctcatggaaggcttccatgtcctccccctcgaagatgttgtctcagaagctgacatattcgtgaccaccaccgggaacaaggacatcatcatggtcgaccacatgaggaagatgaagaacaatgccatagtctgcaacatcggccacttcgacaacgagattgacatgctcgggctcgagaccttccctggtgtgaagaggaccaccatcaaaccgcagaccgacaggtgggtctttccagacaccaagtcaggcatactcgtgttggccgagggccgtctgatgaacttgggttgtgccacgggacatcctagctttgtcatgtcgtgctcgtttacaaaccaggtcattgcccagctggagctttggaatgagaggaagagcggcaagtatgagaagaaggtttacgtgttgcccaagcatctcgatgagaaggttgcagctcttcacctggcgaagcttggtgctaagctgaccaagcttagcaaggagcaggcagattacattagtgtggcagttgagggtccttacaagccagctcattacaggtactgagataacagaaaggtgttatttgtgtttgctgattagtaattttcggttattggttgtgtttgtggggtaagagaggctgtatttgattgcaattgtgtcgttagactttatgcttgtttctattctcagttatttttagtctgctttcaagacagttgattcttatggtggaattattagta

SEQ ID NO: 7841 - DNA, 1913 bp, Citrus sinensis
gggggctcacacccactctatctctcgcgcttgtacaatcattcactttgtttggttggtttccaaagagagagtagagtgccctctcttccttctttcttttagatctatcaattctattaatcagccatggctttgtccgtcgagaaatccgctagcggtcgtgaattcaaggtgaaggatctgtcccaggctgacttcggccgcctcgaaatcgagttggccgaagtcgaaatgccggggctcatggcttgccgcgccgagttcggcccttcacagcccttcaaaggagccaagatcaccggttcactccacatgaccatccagaccgccgtcctcatcgagaccctcaccgctctcggcgccgaagtccgctggtgctcctgcaacatcttctcaacccaagaccacgcggccgccgccatcgcacgtgactccgcctccgtctttgcctggaagggtgagaccctccaggagtactggtggtgcacggagaaagccctggactggggtcccggcggcggcccagatctcatcgtcgatgacggtggtgacgccacgttgttgatccacgagggagtcaaagctgaggagatctacgagaagaccgggaagttgcccgacccggcctccaccgacaacgccgagtttcagattgttttgactatcattagagatgggttgaaggccgatcccaagaagtaccacaaaatgaaggaaagattagttggtgtttccgaagaaaccacgaccggtgtcaagagattgtaccagatgcaagaaaatggaaccctcttgttccctgccatcaatgtcaatgactctgtcaccaagagcaagtttgataacttgtatggatgccgccactcgctcccagatggtttgatgagagctactgatgttatgattgccggaaaggttgctgttgtttgcggttatggtgatgttggcaagggttgtgctgctgctttgaagcaagccggtgctcgtgtaattgttaccgagattgatccaatttgcgctctccaggctcttatggagggtcttcaagtcctaacccttgaggatgtcgtctccgatgctgacatctttgttaccaccaccggtaacaaggacatcatcatggttgaccacatgaagaagatgaagaacaatgcaattgtttgcaacattggtcactttgataatgaaattgatatgctcggtcttgagacctacccgggtgttaagcgcattaccatcaagccccaaactgataggtgggtcttccccgagaccaactcaggcatcatcgtgttggctgagggacgtctcatgaacttgggatgtgccactggacaccccagctttgtgatgtcctgctccttcaccaaccaggtgattgcccagcttgagctctggaaggagaagagcaccggcaagtacgagaagaaggtgtatgttctgcccaagcacctcgatgagaaggttgctgctcttcaccttggcaaacttggagctaagctcaccaggctcaccaaggagcaggctgactacatcagtgtgtccgccgatggtccttacaagcctcttcactacaggtactaagtggaaggaagaagaagaagaagaagaagaagaagagtgaatgttttgagggaaagaaacaaaatatttggccggcttgattgttttcaatgatgatctgtagtaggatgttaggtttaaatttcgtagtagtgtgtgtttgggtggtgggaaagttggaggaaagaaacggatttgtttcagttgattgaagaccatttgggatttgaataaggttttggatggggccgtgttggattattttgtatttgatgcagttttaagttttgcttgctttgctgcatcttgttatccttattgtttactgatgaatgattataaaaaaa

SEQ ID NO: 7842 - DNA, 1935 bp, Lotus japonicus
agatccagtccagtccaccaactccccaatcccccaacccctatttatacacactcccattcccacatttcctctcgtctcactccctcttcctctctcacacacaccctttaccctttctttcttctcaaccatcaccataaccatggctttgttggtcgagaaaaccacatctggccgcgagtacaaggtcaaggacctctctcaggccgacttcggccgcctcgagctcgagctcgccgaggtcgagatgcccggcctcatggcctgccgtaccgagttcggccctgctcagcccttcaaaggcgctagaatcaccggatccctccacatgaccattcaaaccgccgtcctcattgaaaccctcaccgccctcggcgccgaggttcgctggtgctcctgcaacatcttctccacccaggaccacgccgccgctgccatcgcccgcgatagcgctgcggttttcgcctggaagggtgagaccctccaggagtactggtggtgcaccgagcgtgccctcgactggggtcccggtggtggtcccgatctcatcgttgatgatggaggtgacgctaccctcctcatccacgagggggttaaggctgaggaggtgttcgagaagaccggtgagcttcccgacccgacttccaccgacaaccctgagttccagatcgtgcttaccatcatcagggatgggttgaagactgactcccataggtaccgcaagatgaaggagaggctcgtcggtgtctcggaggagaccaccaccggagtcaagaggctttaccagatgcaggccaatggaactctcttgttccctgctatcaatgtcaatgactctgtcaccaagagcaagtttgacaacttgtatggatgccgtcactctctccctgatggtctgatgagggctaccgatattatgattgctgggaaggtggctgttgtggctggatatggagatgtcggcaagggttgtgctgctgctttgaaacaagctggtgctcgtgtcattgtgactgagattgatcccatctgtgcccttcaggctctcatggaaggtcttcaggttctgaccctggaggatgttgtctctgaggctgatatctttgtcaccaccaccggtaacaaggacatcatcatggttgaccacatgaggaagatgaagaacaatgccattgtctgcaacattggtcactttgacaatgaaatcgacatgcttggtcttgagagctaccctggtgtgaagcgcatcaccatcaaacctcaaactgataggttcgtcttccccgagaccaacaccggcatcattgtcttggccgagggtcgtctgatgaacttgggctgcgccacagggcaccccagtttcgtgatgtcctgctccttcaccaaccaggtcattgctcagcttgagctgtggaatgagaggaactctggcaagtacaagaaggaggtttacgttttgcccaagcatcttgatgagaaggtggctgcacttcaccttggcaagcttggagctaggctcaccaagctcagcaaggatcaagctgattacatcagtgtgcctgttgagggcccatacaagcctcttcactacaggtactgagatatgatcaatggctggtgatgcgattcagggagaagaaagaaactgttttgtgaaccggattgattgttttgttttccttttcggattttcattagactttttataatttgtggtggaaagttggtaggattatgatgatttttgtagaatttctgaacttgtgggtgggaagggtaagagtaaggtaatctattggtctctgtcatatgagaccaaatgggttttgaataatgcattggttggaggctgtgttcgttttcattttagttgctaaatttgtgtttctatctacatatcatcagaaaaatgaaaaaaatatttatactcta

SEQ ID NO: 7843 - DNA, 2002 bp, Triphysaria pusilla
ctcaagcctcaattttctctccaccactctcacccaccgactcccatcattttttcagatctgagatccaccaaacacccaatctcagccgtccatttcactatttttaatctatttatatccctttccccacatctacttccttgcccacaattctcttcaacaacccgaagagagcgtgaaaaaccaaatctaaatctcatttctaaacactcttaaccttcccttccaatggctctcctcgttgagaaaaccacctccggccgcgagtacaaggtcaaggacatgtcccaggccgacttcggtcgcctcgagcttgagctcgccgaggtcgaaatgcctggtctcatgtcctgccgtactgagttcggcccttcccagcccttcaaaggcgcccggatcaccggcagccttcacatgaccatccaaaccgccgtgttgatcgaaacactcaccgccctcggcgctgaggtcagatggtgctcctgcaacatcttctccacccaggaccacgctgccgctgccatcgctcgcgatagcgccgccgtgttcgcctggaagggtgagacccttcaggagtactggtggtgcaccgagcgtgccctcgactggggccccggtggaggtcccgatctgatcgtggacgacggcggtgacgctactctgttgatccacgagggcgtgaaagccgaggaggagtacgagaagtccggaaaggtgccggatcctacctcaacggacaatgttgagttccaatttgtgctgaccattatcagggacgggcttaagactgatcccaagaggtacaccaagatgaaggagagattggtcggtgtttctgaggagacaaccaccggtgttaagaggttgtaccagatgcaggagagtggtaccctgcttttccctgctatcaatgttaatgactctgttaccaagagtaagtttgacaacttgtacggttgccgccactcgcttcctgatggtctgatgagggctactgatgtcatgatcgccggtaaggtcggtgttgtctgcggttacggagatgttggcaaaggctgtgctgctgccttgaagcaaggtggggcccgcgtgattgtgactgagatcgatcccatctgtgccctccaagccctcatggaaggcttccaagtcctcccccttgaggattgcgtctccgaggccgacatcttcgtcaccactaccggcaacaaggacatcatcatggtcaacgacatgaggaagatgaagaacaatgccatcgtctgcaacattggccatttcgacaacgagattgacatgctcggcctcgagaccttccccggtgtgaagaggatcactatcaagccacagactgacagattcgtcttccccgacaccaagtctggtgttatcattttggctgagggccgtcttatgaacttgggttgtgccacaggacatcccagctttgtcatgtcttgctcgttcactaaccaggtcattgcgcagctggagctctggaacgagaggaagagcggcaagtacgagaataaggtttacgtgttgcccaagcaccttgatgagaaggttgctgctcttcacctctccaagcttggagctaagctgactaagcttagcaaggaccaggctgattacattagcgtccctgtcgagggtccctacaagcctgctcactataggtactaagggaagaagaacatttggttgggtttttgttgttttgatttgaattctggagtgagagttgagcagtttgaagaacatttgatgactgcgaataagttgggaggatgattagatttcatttctatttttttgtgtttttgttttgcgagcatgtacaattgctgctgcagtgaatgtatttgcttttggcaaccatatatgaaatatcttggttttttcaatcaagcaataatctgtttgtgtgtcgtaagctcggcaagggtttgtttatggttgtattttaatcttaatcaacataatgaccaagacaatt

SEQ ID NO: 7844 - DNA, 1760 bp, Aquilegia formosa
tcttcttcttcttcttcttccttccccaactccacttgaaacttcttcttctttcttattcattttctcaaaatggcaacaactgatctagtagttgagaaaacatcttcaggtcgagaatacaaagtaaaagatatgtctcaagctgactttggtcgtcttgaacttgaacttgctgaagttgaaatgcctggtttaatgtcttgtagaactgaatttggtccatcacaaccatttaaaggagcaagaattactggttcacttcatatgactattcaaactgctgttttaattgaaactttaacttctcttggtgctgaagttcgttggtgttcttgtaatattttttctactcaagatcatgctgctgctgcaattgctcgtgatagcgctgcagtttttgcttggaaaggagaaacattacaagaatattggtggtgtactgaaagagcacttgattggggtattggtggtggacctgatttgattgttgatgatggtggtgatgctactttattaattcatgaaggtgttaaagctgaagaagaatttcaaaagactgggaaattaccagatcctgcgtcgactgataatgttgagtttcagattgttcttgggattattaaagatgggttgagtgttgatcctaaaaaatatcataaaatgaaggaaagattggttggtgtttctgaagaaactactactggtgtgaagaggttgtatcaaatgcaacttaatggaactttgttgtttcctgctattaatgttaatgactctgttactaaaagcaagttcgataacttgtatggatgccgtcactccctccctgatggtctgatgagggctactgatgtcatgattgctgggaaggttgctgttgtttgtgggtatggagatgttgggaaaggctgtgctgctgccctcaagcaaggtggcgctcgcgtaatcgtaacagagattgatcctatctgtgctctccaagcattgatggagggatttcaagttctgaccctcgaggatgctgtatcggatgctgatatctttgtaaccactactggtaacaaagatattatcatggttgaccacatgaagaaaatgaagaacaatgcaattgtgtgcaacattggccactttgacaatgagattgacatgcatggccttgaaactttacctggtgtgaagcggatcacaattaagccccagacggatagatgggttttccccgaaaccaacactggcattattgttcttgctgaagggagacttatgaacctaggatgtgctactggtcacccaagtttcgtcatgtcgtgctccttcaccaaccaagtgattgctcagctggagctgtggaaggagagagctactgggaagtacgaaaagaaggtttatgtgctacccaagcatcttgatgagaaggtcgctgcccttcaccttggcaaacttggagccaagctcaccaagctcaccccagagcaggctgattacattagtatccctgttgagggtccttacaagcctcctcactacaggtactgaggaattctccagtagtccagtcattgtgttttctcagtcattgcgtgttctcgagagtttgagttatgtttgcatttcaatttctttggtaactagattcaactatgaaaagaggagttattgttttctgtaatcttactcttatggtatgtgtggggacctttaaatgaggtcgccaaacttatttgtatgttcttattgttgtagcatttatcgttgga

SEQ ID NO: 7845 - DNA, 1607 bp, Eucalyptus grandis
cagaggaagatggcgttgtccgtggagaagaccaccggcggccgggagtacaaggtgaaggacatgtcccaggccgacttcggccgcctcgagatcgagctggcggaggtggagatgccggggctcatggcctgccgcacggagttcggcccctcccagcccttcaagggcgcccgcatcaccggctccctccacatgaccatccagaccgccgtcctcatcgagaccctcaccgccctcggcgccgaggtccgctggtgctcctgcaacatcttctccacccaggaccacgccgccgccgccatcgcccgcgactccgccgccgtgttcgcctggaagggcgagaccctccaggagtactggtggtgcaccgagcgcgccctcgactggggccccggcggcggccccgacctcatcgtcgacgacggcggtgacgccaccctcctcatccacgagggggtcaaggccgaggagatcttcgccaagaccggcaagctccccgacccggcctccaccgacaacgccgagttccagctcgtgctcaccatcatcagggacggcctgaagaccgacccgcagaggtaccacaagatgaaggacaggctcgtcggcgtctcggaggagaccaccactggcgtcaagaggttgtaccagatgcaggccaacgggactctcttgttccctgccatcaacgtcaatgactctgtcaccaagagcaaggtaacagttctagtttgataacttgtatggctgccgccactctctccctgacggtctgatgagggccaccgatgtcatgatcgctggaaaagttgctgtggtctgtggatacggagatgtgggcaagggctgcgctgctgccctcaagcaggctggtgctcgcgtcattgtgactgagatcgatcccatctgtgctctccaagctctcatggaaggcctccaggtcctacccctccaggatgttgtctctgaggctgacatctttgtcaccaccactggcaacaaggacatcatcatggtccacgacatgaagaagatgaagaacaatgccatcgtctgcaacatcggtcactttgataacgagattgacatgcacggcctggagaacttccccggtgtgaagcgcatcaccatcaagccccaaaccgacaggtgggtcttccccgacaccaagtcaggcatcatcgtcttggcggagggacgcctcatgaacttgggttgcgccaccggccaccctagcttcgtcatgtcctgctccttcacgaaccaggtgattgcccagcttgagctgtggaaggagaagtcctctggcaagtataagaaggaggtctatgtcttgcccaagcacctggatgagaaggtggctgctcttcacctcggcaagctcggtgctaagctcaccaagctcagcaaggagcaagccgactacattagcgtccccgttgagggtccctacaagcctcctcactacaggtactaggcgggttcacatgaagattttacggacggcttccccatttctttctcaatttgatttctcggtagaatggtgggatttttgttattcgggaagtatggttggatgtttttcggggcgaggaaggtga

SEQ ID NO: 7846 - DNA, 1799 bp, Avena sativa
tccaccaaccccttcctcccccagcccagttcccagccagccatggcgctctccgtggagaagacctcctccggccgcgagtacaaggtcaaggacctctcccaggccgacttcggccgcctcgagctcgacctcgccgaggtcgagatgccgggcctcatggcctgccgcgccgagttcggcccctcgcagcccttcaagggcgcccggatctcgggatccctccacatgaccatccagaccgccgtcctcatcgagaccctcacggccctcggcgccgaggtgcgctggtgctcctgcaacatcttctccacgcaggaccacgccgccgccgccatcgcgcgcgactccgccgccgtcttcgcctggaagggcgagaccctcgaggagtactggtggtgcaccgagcgatgcctcgactggggcgagggcggcgggcccgacctcatcgtcgacgacggcggcgacgccaccctgctcatccacgagggcgtcaaggccgaggaggagttcgagaagtccggcaaggtccccgaccccgagtccaccgacaaccccgagttcaagatcgtcctcaccatcatcagggacggcctcaagaccgacgtcaggaggtaccgcaagatgaaggagaggctcgtgggtgtctccgaggagaccaccaccggcgtcaagaggctctaccagatgcaggagtccggcgcactcctcttccccgccatcaacgtcaacgactccgtcaccaagagcaagtttgacaacctttacggttgccgccactccctccctgacggtctcatgagggccaccgatgtcatgatcgccggcaaggtcgccgtggtctgcggttacggagatgttggcaagggctgcgccgccgcgctcaagcaggccggtgcccgtgtcatcgtgacagagatcgaccccatctgcgccctgcaggccctgatggagggcatccagatcctcaccctggaggacgtcgtctctgatgccgacatcttcgtgaccaccacaggaaacaaggacatcatcatggttgaccacatgaggaagatgaagaacaacgctatcgtctgcaacatcggtcacttcgacaacgagatcgacatgaacggcctcgagacctaccccggtcgtcaagcgcatcaccatcaagccccagaccgaccgctgggtcttcccagagaccaagaccggcatcattgtccttgccgagggtcgcctgatgaaccttgggtgcgccactggccaccccagcttcgtcatgtcctgctcgttcactaaccaggttattgctcagcttgagttgtggaacgagaggaagtctggcaagtacgagaagaaggtgtacgtcctccccaagcacctcgacgagaaggtcgcagcactccacctgggcaagctcggcgccaagctgaccaagctcaccaagtcccagtccgagtacatcagcatccccgttgagggtccttacaagccagctgcctaccggtactagagagggtgcctgtccagcacgactcctggctggctggcttgcttgagcagcctcagctgcagcagcagctatgtgaactctgcccaatcgatgtatcaacgactgtatcttctttttgtcgttatcatttacatgggtgtctttaggcggaggatttgttatggttatatgttttgagccctgtgggggttgggttggaagaggaggcgtttgcttttgctgagaaataatggcaattttcaatggtttaagggcgtctatgtggttgataagaaagtctcatgtattgcatctccta

SEQ ID NO: 7847 - DNA, 1757 bp, Avena sativa
ctccctcccccagatccatcccgtccaccaccaacccctcctcccccagtccccagccccagccagccatggcgctctccgtggagaagacctcctccggccgcgagtacaaggtcaaggacctctcccaggccgacttcggccgcctcgagctggacctggccgaggtcgagatgccgggcctcatggcctgccgcgccgagttcggcccctcgcagcccttcaagggcgcccggatctcgggatccctccacatgaccatccagaccgccgtcctcatcgagaccctcacggccctcggcgccgaggtgcgctggtgctcctgcaacatcttctccacgcaggaccacgccgccgccgccatcgcgcgcgactcggccgccgtcttcgcctggaagggcgagaccctcgaggagtactggtggtgcaccgagcgatgcctcgactggggcgagggcggcgggcccgacctcatcgtcgacgacggcggcgacgccaccctgctcatccacgagggcgtcaaggccgaggaggagttcgagaagtccggcaaggtccccgaccccgagtccaccgacaaccccgagttcaagatcgtcctcaccatcatcagggacggcctcaagaccgacgtcaggaggtaccgcaagatgaaaggagaggctcgtgggtgtctccgaggagaccaccaccggcgtcaagaggctctaccagatgcaggagtccggcgcgctcctcttccccgccatcaacgtcaacgactccgtcaccaagagcaagttcgacaacctctacggttgccgccactccctccctgacggtctcatgagggccactgatgtcatgattgccggcaaggtcgccgtggtctgtggttacggagatgttggcaagggctgtgccgccgcgctcaagcaggccggtgcccgtgtcatcgtgaccgagatcgaccccatctgtgccctgcaggctttgatggagggcatccagatcctcaccctggaggacgtcgtctctgatgccgacatcttcgtgaccaccacaggaaacaaggacatcatcatggtggaccacatgaggaagatgaagaacaacgccatcgtttgcaacatcggccactttgacaacgagattgacatgaacggcctggagacctaccctggcgtcaagcgcatcaccatcaagccccagaccgaccgctgggtcttccccgagaccaagaccggcatcattgtccttgctgagggtcgcctgatgaaccttgggtgtgccactggtcaccccagcttcgtcatgtcctgctccttcactaaccaggtcattgctcagcttgagttgtggaatgagaggaagtctggcaagtacgagaagaaggtgtacgtcctccccaagcacctggacgagaaggttgcggcgctccacctgggcaagctcggcgccaagctgaccaagctcaccaagtcccagtccgagtacatcagcatccccgtcgagggtccttacaagcctgccgcctaccggtactagagaggatggtgtatttccagcacgactagcggctggatcgagaaaggagcagcaacgtgtctctgcggcatggatttgttgaaccactgtatcttctattttgcatcatcttgcatgaatgctgtgtctcgtagggcggaggatgatttgttatgttttgagtctgagtctggggtggtggaggaagcgtttatttttgctgaggaataataatggcattgttgatggtc

SEQ ID NO: 7848 - DNA, 2274 bp, Mesembryanthemum crystallinum
ctcttttcttcttcttaaacctccctctttcttctccaactgccctttctctctacaatcttgctctgcatttgattgaggagagagaaaacaatcccatcttcaacaatggcgttggcagtggagaagacaagctctggaagggagtacaaggtcaaggacatgtcccaggccgatttcggtagactcgagatcgagcttgccgaggttgaaatgcctggtctcatggcttgccgtactgagttcggcccatctcagcccttcaaaggtgctaagatcaccggatcccttcacatgactatccaaactgctgttcttattgagactctcaccgctcttggtgctgaggttcgttggtgctcttgcaacatcttctccactcaggaccatgctgccgctgccattgctagggacagcgcagcagtctttgcctggaagggtgagaccctccaagagtactggtggtgcactgagcgtgcccttgactggggtgctggtggtggccccgacctcattgtggatgacggtggtgacgccaccctgttgatccacgagggagtcaaggccgaggaggagtacgagaagaacgggactatccccgacccaacctccaccgacaaccccgagttccagctcgtcttgggtctgatccgtgacagcctaaaggtcgaccccaagagataccacaagatgaagacaagattggtcggtgtctcagaggagaccaccaccggagtcaagaggctttaccagatgcaggctaccggcaccttgttgttccctgccattaatgttaacgactccgtcaccaagagcaagttcgacaacttgtatggatgccgccactctctcccagatggtttgatgagagccactgatgttatgattgccggcaaggtcggtgttgtctgtgggtacggagatgtcggaaagggttgtgctcttgccttgaaggctgctggtgcccgtgtgatcgtgaccgagattgaccccatctgtgccctgcaagctcttatggagggtttccagatcttgaccttggaagatgttgtctctgaggctgatatctttgttaccaccaccggtaacaaggacatcatcatggttgaccacatgaggaagatgaagaacaatgccattgtttgcaacattggtcactttgacaacgaaatcgacatgctcggtctcgagaactacccaggtgtcaagaggatcaccatcaagccccaaaccgaccggtttgtcttccccgagaccaacactggcatcattgtcttggctgagggtcgtttgatgaaacttgggttgtgccaccggtcaccctagctttgtcatgtcttgctcattcaccaaccaagtgattgcccagctcgagctgtggaatgagagggcatccggcaagtatgagaagaaggtctatgtgttgcccaagcacctcgatgagaaggttgctgccctccatctaggcaagctcggggctaagctcaccaagctctccaaggaccaggctgactacatcagcgtgcccgtcgagggtccttacaagccagctcactacaggtattagagcagcgtcatggagactggtttaccggatcattgaagtggagcaggtggtgttctaggaaaagatagttttttgatttgttttctttctttttgttgggtgggttggtatgtggtttggaagtactgcaagttatcacctctcttttgggggttatgttcgaatcgggtttgaataagtggagattgtgttaggctttgtatttgcagacttgctgagtctgggtactattttttcttaccatcaaaatgaagagaatgttttagcttctaaaaaaaaacaactaaaaacttgaggcggggccccgttctccaattcgtcctatagtgagtcctattacgcccgcctacttggccgtcctttacaacgtcatgcctgggaaaacctgcccttccccaattaattccccctgcagaacattcccctttcggccagccgtcctatatctaaaaaggcctttccctttcttccttctcaatacttgtgcattcattattgccaattgtgcacccaccctgaacaacccctttccactccttgggtaatgttgcttaccttctaaaggaacctactcctttttcaccttctttgcccaccctcccttccgttttctcactttcctactcgccctgtccgactatttaccccttccccctttataaggccgctctcttccagggtctccgttcacccctttcgctcctcct

SEQ ID NO: 7849 - DNA, 1805 bp, Avena sativa
agccatggcgctctccgtggagaagacctcctccgggcgcgagtacaaggtcaaggacctctcccaggccgacttcggccgcctcgagctggacctggccgaggtcgagatgccgggcctcatggcctgccgcgccgagttcggcccctcgcagcccttcaagggcgcccggatctcgggatccctccacatgaccatccagaccgccgtcctcatcgagaccctcacggccctcggcgccgaggtgcgctggtgctcctgcaacatcttctccacgcaggaccacgccgccgccgccatcgcgcgcgactccgccgccgtcttcgcctggaagggcgagacgctcgaggagtactggtggtgcaccgagcgatgcctcgactggggcgagggcggcgggcccgacctcatcgtcgacgacggcggcgacgccaccctgctcatccacgagggcgtcaaggccgaggaggagttcgagaagtccggcaaggtccccgaccccgagtccaccgacaaccccgagttcaagatcgtcctcaccatcatccgggacggcctcaagaccgacgtcaggaggtaccgcaagatgaaggagaggctcgtaggagtctccgaggagaccaccaccggcgtcaagaggctctaccagatgcaggagtccggcgccctcctcttccccgccatcaacgtcaacgactccgtcaccaagagcaagtttgacaacctttacggttgccgccactccctccctgacggtctcatgagggccaccgatgtcatgatcgccggcaaggtcgccgtggtctgcggttacggagatgttggcaagggctgcgccgccgcgctcaagcaggccggtgcccgtgtcatcgtgacagagatcgaccccatctgtgccctgcaggccttgatggagggcatccagatcctcaccctggaggacgtcgtctctgatgccgacatcttcgtgaccaccacaggaaacaaggacatcatcatggttgaccacatgaggaagatgaagaacaacgccatcgtctgcaacatcggtcactttgacaacgagatcgacatgaacggccttgagacctaccctggtgtcaagcgcatcaccatcaagccccagaccgaccgctgggtcttccccgagaccaagaccggcatcattgtcctcgccgagggtcgcctgatgaaccttgggtgcgccactggccaccccagcttcgtcatgtcctgctcgttcaccaaccaggttattgctcagcttgagttgtggaacgagaggaagtctggcaagtacgagaagaaggtgtacgttctccccaagcacctcgacgagaaggtcgcagccctccacctgggcaagctcggtgccaagctgaccaagctcaccaagtcccagtccgagtacatcagcatcccggtcgagggtccttacaagcccgctgcctaccggtactagagagcgtgtccagcacgactcctggctggcttgcttgcttgagcagcctcagctgcagcagcagctatgtgaactctgcccaatcgatgtatcaacgactgtatcttctttttgcgttatcatttacatggtgtctttaggcggaggatttgttatggttatatgttttgagccctgtgagggttgggttggaagaggaggcgtttgcttttgctgagaaataatggcaattttcaatggtttaagggcgtctatgtggttgataagaaagtctcatgtattgcatctcctagggaaaggttatagaatgtcttgattaagggcgtttactacttacaaaaaa

SEQ ID NO: 7850 - DNA, 1724 bp, Avena sativa
cccagatccagctcgccagttcctcccccccgtccccagccatggcgctctccgtggagaagacctcctccggccgcgagtacaaggtcaaggacctctcccaggccgacttcggccgcctcgagctcgacctcgccgaggtcgagatgccgggcctcatggcctgccgcgccgagttcggcccctcgcagcccttcaagggcgcccggatctcgggatccctccacatgaccatccagaccgccgtcctcatcgagaccctcacggccctcggcgccgaggtccgctggtgctcctgcaacatcttctccacgcaggaccacgccgccgccgccatcgcgcgcgactccgccgccgtcttcgcctggaagggcgagaccctcgaggagtactggtggtgcaccgagcgctgcctcgactggggcgagggcggcgggcccgacctcatcgtcgacgacggcggcgacgccaccctgctcatccacgagggcgtcaaggccgaggaggagttcgagaagagcggcaaggtccccgaccccgagtccaccgacaaccccgagttcaagatcgtgctcaccatcatcagggacggcctcaagaccgacgtcaggaggtaccgcaagatgaaggagaggctcgtcggcgtctccgaggagaccaccaccggcgtcaagaggctctaccagatgcaggagtccggcgcgctcctcttccccgccatcaacgtcaacgactccgtcaccaagagcaagtttgacaacctctacggttgccgccactccctccctgacggtctcatgagggccactgatgtcatgatcgccggcaaggtcgccgtggtctgtggttacggagatgttggcaagggctgtgccgccgcgctcaagcaggccggtgcccgtgtcatcgtgaccgagatcgaccccatctgtgccctgcaggctttgatggagggcatccagatcctcaccctggaggacgtcgtctctgatgccgacatcttcgtgaccaccacaggaaacaaggacatcatcatggtggaccacatgaggaagatgaagaacaacgccatcgtttgcaacatcggccactttgacaacgagattgacatgaacggcctggagacctaccctggcgtcaagcgcatcaccatcaagccccagaccgaccgctgggtcttccctgagaccaagaccggcatcattgtccttgctgagggtcgcctgatgaaccttgggtgtgccactggtcaccccagctttgtcatgtcctgctcgttcaccaaccaggtcattgctcagcttgagttgtggaatgagaggaagtctggcaagtacgagaagaaggtgtacgtcctccccaagcacctggacgagaaggtcgcggcgctccacctgggcaagctcggcgccaagctgaccaagctcaccaagtcccagtctgagtacatcagcatccccgtcgagggtccttacaagcctgccgcctaccggtactagagaggatggtgtatgtccagcacggctagcggctgaaagattgagaaaggagcagcaacttgtctctgcggcatggatttgttgaaccactgtatcttctattttgcatcatcttgcatgaatgctgtgtctctcttaggcggaggatgatttgttatgttttgagtctgggatgggatggaggaggaagcgtttatttttgctgaggaataataatggcattgt

SEQ ID NO: 7851 - DNA, 1825 bp, Phalaenopsis aphrodite
cttgctagatctcggtgccattcgcagcgggaggcaaaaatttcccgatctatttctctttcatcgccatggctctgctcgtggagaagactacttccgggcgcgagtacaaggtgaaagacttatcccaagccgatttcggccggctcgagatcgagcttgcggaggtcgagatgccaggcctcatggcttgccgcgctgagttcggcccctcccagccgttcaaaggcgcgcgtatctccggctctctccacatgactatccagaccgctgtgctcattgaaaccctaacggccctcggtgccgaggtacgctggtgctcctgcaacattttctccacccaggaccatgctgctgccgcaatcgcccgtgattccgccgccgtttttgcttggaagggagagacccttcaggagtactggtggtgcacggagcgctgcctagaatggggcgccggcggaggcccggatctcattgtcgacgacggcggtgatgcgacacttcttatccatgagggagttaaggctgaggaggagtacgagaagaacgggaaaattccagatccggcttctacggacaacgcggagttccagatcgtgcttgggctcatcagggatagcttaagcgtcgatccgaagaaatatcggaggatgaaggagaggctcgttggcgtctctgaggagacgaccaccggagtgaagaggttgtaccagatgcagtacagtgggacccttcttttccctgccatcaacgtcaatgactcagttaccaagagcaagtttgataacctatatggttgccgtcactctctccccgatggcctaatgagagccaccgatgtcatgatcgccggcaaggtagctgttgtttgcggctacggagatgtaggcaagggttgtgccgcggcactcaagactgccggtgctcgtgtcatcgtcactgagatcgacccaatatgtgcccttcaggccctcatggaaggcctccctgtcctccgccttgaggacgtcgtgtccgaggctgacattttcgtcaccaccaccggcaacaaggacatcatcatggttgaccacatgaggaagatgaagaacaatgccatcgtctgcaacattggccactttgacaacgagattgatatgctcggactcgaatcattccccggtgtcaaacgcatcaccattaagccgcagacggatcggtgggtcttccctgacacaaatagcggcatcctcgtactggcggagggccgtctgatgaatctcggatgtgccacgggtcaccctagctttgtcatgtcgtgctcttttacaaaccaggtaattgctcagctggagctgtggaaggagaaggcgtcgggaaagtatgagaagaaggtgtatgtgttgccgaagcacctggatgagaaggttgcagcacttcatttaggcaagcttggggccaagctcaccaagcttactccttcgcaggctgattacatcagcgttccggtcgagggtccctacaaaccagcccattacaggtattagagaattttaatgtgaggaaactgaatctgttggaacttctgttccattggattcaaaggaggaatcagcttcatacttatctttatcaagttatgctctatttatccttttaaacattggtttaatgttgttgttgatttgaagggggtgagtgtgatttctgagaggaataatgaggtttgtgggttgtggcggaggtgttgtatcgtccctgactatgttcgggagactttttttgtttttttgtgtagcctttttctatatggggcttttggaggaaatttaatgaacttgttttg

SEQ ID NO: 7852 - DNA, 1900 bp, Trigonella foenum-graecum
ttctcttacccatctctttcgcttccttcttcgttttccattttcgatccatcgcaatggcgttgttggttgaaaccaccacaagcggccgcgaatacaaggtcaaggacatgtcccaagccgatttcggccgtctcgaaatcgagctagccgaagtcgaaatgcccggtctaatgtcctgccgaaccgaattcggttcatctcaacccttcaaaggcgccagaatcaccggttcacttcacatgacaatccaaaccgccgtcctcatcgaaaccctaaccgctctcggtgctgaagtccgttggtgttcttgcaacatcttctccacacaagaccacgccgctgccgccatcgctcgtgacagcgccgccgtgttcgcatggaaaggtgaaactctccaggagtattggtggtgctctgaacgcgctcttgattggggtactggtggtggaccagatctgatcgttgatgatggtggtgatgtcacacttttgatccatgaaggtgtgaaagctgaagaggcttttgagaagaatggtcagcttcctgatccttcttccacggataatgctgagatgcagatcgttcttaccattatcagagatgggttgaagactgatcctaagaggtaccagaagatgaaggatagaattgttggtgtttctgaagaaactaccactggtgttaagaggctttatcagatgcaagctactggtgcccttttgttccctgctatcaatgtcaatgactctgttaccaagagcaagtttgacaacttgtatggttgccgtcactcactccccgatggattgatgagagcaactgatgtgatgattgccggaaaggttgctgttgtatgtggttatggagatgttggcaagggttgtgctgctgcattgaaacagggtggtgctcgtgtgatcgtgactgagatcgatccaatttgtgcacttcaagctctcatggaaggtcttcaagttctgactttggaggatgttatctccgaggctgatatctttgttaccacaaccggtaacaaagacattatcatggttagtgacatgaggaaaatgaagaacaatgccattgtctgcaacattggtcacttcgacaatgaaattgacatgcatggacttgagacataccctggagtgaagcgcatcacaattaagccacaaactgacagatgggttttccctgaaaacaactctggcatcattatcttggccgaaggtcgtttgatgaaccttggctgtgctactggtcaccccagtttcgtcatgtcatgctccttcaccaaccaagtcattgctcagattgagttgtggaaggaaaagacttccggcaagtatgaaaagaaggtatacgttttgcctaagcaccttgatgagaaggttgctgctcttcatcttggccagcttggagctaggctcaccaagctttccaaagaccaggcagattacatcagtgtgcctgttgagggtccatacaagcctgctcactacaggtactgagatgatcaagagatggtagatggaaagaataaagatgattctatccgtattgttccgcattcgattttggatttttgttttctcattacaatttttagatttgtggtagattgggaattcttttggattattatcctagaatctcaattccattgggttgaagggtatgagcaaaaaaacctattggtttctgtcaaatgagaccaattgggtataaataaagctttggttgtggttgtgtctgttatgattgattatcagagtataattacgtgtgttcttgtccaatatttgacaaagaatcaagttaggaaaaatgcagaaaaatatgtgcttactgtattgcattcgatttgttttaatctatagtaatttgcttattttcc

SEQ ID NO: 7853 - DNA, 1777 bp, Citrullus lanatus
ttccattttcatttcgtttgaattcattcgatttcttttttgtttgtttattcttcgattcaattttgatcagcacaatgtctctattggtagacaaaaccagcagtggccgtgaatacaaggtcaaggacatggcgcaagccgatttcggtcgccttgaaatcgatctcgctgaggttgaaatgcctggattgatggcttgtagaaccgaatatggaccatcacagcctttcaagggggcgagaatcaccggatcccttcacatgacgattcaaaccgccgtcctcatcgaaaccctaaccgctctcggcgctgaggttcgttggtgttcctgcaacattttctcgactcaagaccacgctgccgctgccattgctcgagatagtgccgccgtgtttgcctggaagggcgagactcttcaggagtactggtggtgcactgagcggtccttggattggggccccgacggtggtccggatctgatcgtcgacgatggtggtgatgctacgctattaattcacgaaggagttaaggcggaggagatctatgaaaaaacagggacgctaccggatccttctacaactaccaactctgagtttcagattgtgctcaccattgttcgagatggattgaagaccgatcctaagaggtaccacaagatgaaggagagattggtcggtgtctcggaggagacaaccactggtgtgaaaaggttgtaccagatgcaggctaacggaactttgctgttccccgccatcaatgtcaatgactctgtcactaagagcaagtttgataacttgtacggatgccgccactcactcccagatggtttgatgagagctactgatgttatgattgctggcaaggttgctgttgtttgtggctatggagatgttggcaagggctgtgcttttgccctcaaacaaggtggagctcgtgtgatcgtcaccgaaattgacccgatttgtgcccttcaagcattgatggaaggcttccaggttttgacactcaatgatatcgtatctgaggcagacattttcgtcaccactacaggcaacaaggacatcatcatggtgaatgacatgaggaagatgaagaacaatgcaattgtctgcaacattggtcactttgataacgaaattgacatgctcgggctcgagactttccccggagtgaagcgcatcacgatcaagcctcaaactgacaggtgggtgttccctgatactaactcgggcatcatcgtgcttgccgaggggcggctcatgaacttgggatgtgccactggccaccccagctttgtgatgtcttgctcattcacaaaccaagtgattgcacaactagagctttggaatgagaggaaatctggaaaatatgaaaagaaagtgtatgttttgcccaaacatcttgatgagaaagttgctgctcttcatcttggcaagcttggagctaagctcactaagctcagtaaggatcaagccgactacattagtgtccccattgaaggtccttacaagcctgctcattacaggtattgaaatgaccgagtggagacaatattggttggaacgatcggaagggtttgttgtttttctttttcatatagaattatttcatcatatagagtgataggtctcgattcgcattcgggttttgttcggagaggtttggtttggacaaagattaagttcttttgtctaaagatcaaatggattgaataaggtttggattgggttgtgtgggataaactatgttgtttacttcattgcagtttgtttgg

SEQ ID NO: 7854 - DNA, 1624 bp, Festuca arundinacea
  misc_feature (34)..(34): n is a, c, g, or t
  misc_feature (448)..(448): n is a, c, g, or t
  misc_feature (601)..(601): n is a, c, g, or t
  misc_feature (625)..(625): n is a, c, g, or t
  misc_feature (661)..(661): n is a, c, g, or t
  misc_feature (694)..(694): n is a, c, g, or t
  misc_feature (724)..(724): n is a, c, g, or t
  misc_feature (778)..(778): n is a, c, g, or t
  misc_feature (781)..(781): n is a, c, g, or t
  misc_feature (817)..(817): n is a, c, g, or t
  misc_feature (829)..(829): n is a, c, g, or t
  misc_feature (832)..(832): n is a, c, g, or t
  misc_feature (859)..(859): n is a, c, g, or t
  misc_feature (1219)..(1219): n is a, c, g, or t
  misc_feature (1330)..(1330): n is a, c, g, or t
  misc_feature (1339)..(1339): n is a, c, g, or t
  misc_feature (1375)..(1375): n is a, c, g, or t
  misc_feature (1479)..(1479): n is a, c, g, or t
  misc_feature (1577)..(1577): n is a, c, g, or t
ggcgctctccgtggagaagacctcgtcggggcgngagtacaaggtcaaggacctctcccaggccgacttcggccgcctcgagctcgacctggccgaggtcgagatgccgggcctcatggcctgccgcgccgagttcggccccgcgcagcccttcaagggcgcccgcatctcgggctccctccacatgaccatccagaccgccgtcctcatcgagaccctcaccgccctcggcgccgaggtccgctggtgctcctgcaacatcttctccacgcaggaccacgccgccgccgccatcgcgcgcgactcggccgccgtcttcgcatggaagggcgagaccctcgaggagtactggtggtgcaccgagcgctgcctcgactggggcgcgggcggcgggcccgacctcatcgtcgacgacggcggcgacgccacgctgctcatccacgagggngtgaaagccgaggaggagttcgagaagtccggcaaggtccccgacccggagtccaccgacaaccccgagttcaagatcgtcctcaccatcatccgcgacggcctcaagaccgacgtcaggaggtaccgcaagatgaaggagaggctcgtcggngtctccgaggagaccaccacgggngtcaagaggctctaccagatgcaggagtccggcgcnctcctcttccccgccatcaacgtcaacgactcngtcaccaagagcaagtttgacaacctttanggttgccgccactccctgcccgatggtctcatgagggccaccgatgtcatgatngcnggcaaggtcgccgtggtctgcggttacggtgatgtnggcaagggctgngcngccgcgctcaagcaggctggtgcccgngtgatcgtgacggagatcgaccccatctgcgccctgcaggccctgatggagggcatccagatcctcaccctggaggacgtcgtctcggaggctgacatcttcgtgaccaccactggtaacaaggacatcatcatggtcgaccacatgaggaagatgaagaacaacgccattgtctgcaacattggccacttcgacaacgagatcgacatgaacggcctcgagacctaccctggcgtcaagcgcatcaccatcaagccccagaccgaccgctgggtgttccctgagaccaagaccggcatcattgtccttgccgagggtcgcctgatgaaccttgggtgcgccactggccaccccagcttngtcatgtcctgctccttcactaaccaggtcattgctcagcttgagttgtggaacgagaggaagtctggcaagtacgagaagaaggtgtacgttctccccaagcacctcgangagaaggtngcggccctccacctgggcaagctcggtgccaagctnaccaagctcaccaagtcccagtctgactacatcagcatcccggtcgagggtccttacaagcccgctgcctaccggtactagagagggtgtccagcaggaatggnggctggcttgcttgagcagctgcgtcagcaacggctctgccacatcgatttatcaactactgtatcttttttgcattatgttacaagatgccttttangcggaggatttggtgagggggtggaaaggcaggcgtttgcttttgct

SEQ ID NO: 7855 - DNA, 1772 bp, Avena sativa
tcacgcgcccaggtaccatctcactaatccccagatccaccagcccacgccatggcgctctccgtggagaagacctcctccggccgcgagtacaaggtcaaggacctctcccaggccgacttcggccgcctcgagctcgacctcgccgaggtcgagatgccgggactcatggcctgccgcgccgagttcggcccctcgcagcccttcaagggcgcccggatctcgggatccctccacatgaccatccagaccgccgtcctcatcgagaccctaacggccctcggcgccgaggtccgctggtgctcctgcaacatcttctccacgcaggaccacgccgccgccgccatcgcgcgcgactcggccgccgtcttcgcatggaagggcgagaccctcgaggagtactggtggtgcaccgagcgatgcctcgactggggcgagggcggcgggcccgacctcatcgtcgacgacggcggcgacgccaccctgctcatccacgagggcgtgaaagccgaggaggagttcgagaagtccggcaaggtccccgaccccgagtccaccgacaaccccgagttcaagatcgtgctcaccatcatccgggacggcctcaagaccgacgtcaggaggtaccgcaagatgaaggagaggctagtcggcgtctccgaggagaccaccaccggcgtcaagaggctctaccagatgcaggagtccggcgcgctcctcttccccgccatcaacgtcaacgactccgtcaccaagagcaagtttgacaacctttacggttgccgccactccctccctgacggtctcatgagggccaccgacgtcatgatcgccggaaaggtcgccgtggtctgcggttacggagatgttggcaagggctgtgccgccgcactcaagcaggccggtgcccgtgtcatcgtgacagagatcgaccccatctgcgccctgcaggccctgatggagggcatccagatcctcaccctggaggacgtcgtctctgatgccgacatcttcgtgaccaccacaggaaacaaggacatcatcatggttgaccacatgaggaagatgaagaacaacgccattgtctgcaacatcggtcactttgacaatgagattgacatgaacggcctcgagacctaccctggcgtcaagcgcatcaccatcaagccccagaccgaccgctgggtcttccctgagaccaagaccggcatcattgtcctcgccgagggtcgcctgatgaacctcgggtgcgccactggccaccccagctttgtcatgtcctgctccttcactaaccaggtcattgctcagcttgagttgtggaacgagaggaagtcaggcaagtacgagaagaaggtgtacgttctccccaagcacctcgacgagaaggtcgcagcactccacctgggcaagctcggcgccaagctgaccaagctcaccaagtcccagtccgagtacatcagcatccccgtcgagggtccttacaagcctgccgcctaccggtactagagaggatggtgtatgtccagcacggctagcggctggatcgagaaaggagcagcaaagtgtctctgcggcatggatttgttgaaccactgtatcttctattttgcatcatcttgcatgaatgctgtgtctctcttaggtggaggatgatttgttatgttttgagtctgggactgggttggtggaggaagcgtttatttttgctgaggaataataatggcattgtcgattgtttagtctatggttggtaatatggtcttgtgtat

SEQ ID NO: 7856 - DNA, 1789 bp, Avena sativa
ctccctcccccagatccatcccgtccaccaaccccctcctcccccagtccccagccagccagccatggcgctctccgtggagaagacctcctccggccgcgagtacaaggtcaaggacctctcccaggccgacttcggccgcctcgagctcgacctcgccgaggtcgagatgccgggcctcatggcctgccgcgccgagttcggcccctcgcagcccttcaagggcgcccggatctcgggatccctccacatgaccatccagaccgccgtcctcatcgagaccctcacggccctcggcgccgaggtccgctggtgctcctgcaacatcttctccacgcaggaccacgccgccgccgccatcgcgcgcgactccgccgccgtcttcgcctggaagggcgagaccctcgaggagtactggtggtgcaccgagcgctgcctcgactggggcgagggcggcgggcccgacctcatcgtcgacgacggcggcgacgccaccctgctcatccacgagggcgtcaaggccgaggaggagttcgagaagagcggcaaggtccccgaccccgagtccaccgacaaccccgagttcaagatcgtgctcaccatcatcagggacggcctcaagaccgacgtcaggaggtaccgcaagatgaaggagaggctcgtcggcgtctccgaggagaccaccaccggcgtcaagaggctctaccagatgcaggagtccggcgcgctcctcttccccgccatcaacgtcaacgactccgtcaccaagagcaagtttgacaacctctacggttgccgccactccctccctgacggtctcatgagggccactgatgtcatgatcgccggcaaggtcgccgtggtctgtggttacggagatgttggcaagggctgtgccgccgcgctcaagcaggccggtgcccgtgtcatcgtgaccgagatcgaccccatctgtgccctgcaggctttgatggagggcatccagatcctcaccctggaggacgtcgtctctgatgccgacatcttcgtgaccaccacaggaaacaaggacatcatcatggtggaccacatgaggaagatgaagaacaacgccatcgtttgcaacatcggccactttgacaacgagattgacatgaacggcctggagacctaccctggcgtcaagcgcatcaccatcaagccccagaccgaccgctgggtcttccccgagaccaagaccggcatcattgtccttgctgagggtcgcctgatgaaccttgggtgtgccactggtcaccccagctttgtcatgtcctgctcgttcaccaaccaggtcattgctcagctcgagttgtggaacgagaggaagtctggcaagtacgagaagaaggtgtacgtccttcccaagcacctcgacgagaaggtcgcggcgctccacctgggcaagctcggcgccaagctgaccaagctcaccaagtcccagtccgagtacatcagcatccccgtcgagggcccttacaagcccgccgcctaccggtactagagaggatggtgtatgtccagcacggctagcggctgaaagattgagaaaggagcagcaacgtgtctctgcggcatggatttgttgaaccactgtatcttctattttgcatcatcttgcatgaatgctgtgtctcttaggcggaggatgatttgatatgttttgagtctgagtctggggtggtggaggaagcgtttatttttgctgaggaataataatggcattgtcgatggtttagtctatggttggtaatatggtcttgtgtatttt

SEQ ID NO: 7857 - DNA, 1914 bp, Triticum aestivum
cctctgctagatccaatccaccaaccttctccatggcgctctccgtggagaagaccgcctccggccgggagtacaaggtcaaggacctctcccaggccgacttcggccgcctcgagctcgagctcgccgaggtcgagatgcccggcctcatggcctgccgcgccgagttcgggccctcgcagcccttcaagggcgcccggatctccggctccctccacatgaccatccagaccgccgtcctcatcgagaccctcaccgccctcggcgccgaggtccgctggtgctcctgcaacatcttctccacccaggaccacgccgccgccgccatcgcgcgcgactcggccgccgtcttcgcctggaagggcgagaccctcgaggagtactggtggtgcaccgagcgctgcctcgactggggcgccggcggcggccccgacctcatcgtcgacgacggcggcgacgccacgctgctcatccacgagggcgtcaaggccgaggaggagttcgagaagtccggcaaggtccccgacccggagtccaccgacaaccccgagttcaagatcgtgctcaccatcatccgcgacgggctcaagaccgacgcccgcaagtaccgcaagatgaaggagaggctcgtcggcgtctccgaggagaccaccaccggcgtcaagaggctctaccagatgcaggagtccggcaccctcctcttccccgccatcaacgtcaacgactccgtcaccaagagcaagtttgacaacctttacggttgccgccactcgctccctgatggtcttatgagggctactgatgttatgatcgccggcaaggttgctgtggtctgcggttatggtgatgttggcaagggctgtgccgccgcactcaagcaggctggtgcccgtgtgatcgtgacagagattgaccccatctgtgcccttcaggccctgatggagggcatccagatcctcaccttggaggacgttgtctctgatgctgacatctttgtgaccaccactggaaacaaggacatcatcatggttgaccacatgaggaagatgaagaacaatgccattgtctgcaacattggtcactttgacaacgagatcgacatgaacggcctggagacctaccctggtgtcaagcgcatcaccatcaagcctcagactgaccgttgggtcttccctgagaccaacactggcatcattgttcttgctgagggccgtctgatgaaccttggctgtgccactggccaccccagctttgtcatgtcttgctcattcactaaccaggttattgctcagctggagttgtggaaggagaaggcctccggcaagtatgagaagaaggtgtacgtgctccccaagcacctcgacgagaaggtcgccgccctccacctgggcaagcttggtgcgaggctgaccaagctcaccaaggcccagtctgagtacattagcatcccagttgagggtccctacaagcctgcggcgtaccggtactagtgtgtgtgtccagcatgactagcggctggcctgagcctgagcggcggcactctgccacggcgacctatgaacctgttttcctttgcattgtctatctagatctaggcatgtgttcacttaggccgaggatttgtcatggttatgtttttagaccggtgagggtgtggtggacggaggtggcgtttgcttttgcccagaaataatggtgttattattttggatttaaatgaggaggtgtgatttgacggatatagtgttgcctttttgattctacatgtctgatgctccctacgccacaatttactagggatgcaaatttggaacctttagggtgtaccctctgtccctaattcaaccaaataaaatttcagaaatgaaaaggggttggagggtttgcattcctacaaataaatccgtggtttgc

SEQ ID NO: 7858 - DNA, 1776 bp, Hordeum vulgare
cagatccaatccaccaaccttccccatggcgctctccgtggagaagacctcctccggccgggagtacaaggtcaaggacctctcccaggccgacttcggccgcctcgagctggagctcgccgaggtcgagatgcccggcctcatggcctgccgcgccgagttcggcccctcgcagcccttcaagggcgcccggatctccggctccctccacatgaccatccagaccgccgtgctcatcgagaccctcaccgccctcggcgccgaggtccgctggtgctcctgcaacatcttctccacccaggaccacgccgccgccgccatcgcgcgcgactcggccgccgtcttcgcctggaagggcgagacgctcgaggaatactggtggtgcaccgagcgctgcctcgactggggcgccggcggcggccccgacctcatcgtcgacgacggcggcgacgccaccctgctcatccacgagggcgtcaaggccgaggaggagttcgagaagtcgggcaaggtccccgacccagagtccaccgataaccccgagttcaagatcgtcctcaccatcatccgcgacgggctcaagaccgacgcccgcaagtaccgcaagatgaaggagaggctcgtcggcgtctccgaggagaccaccaccggcgtcaagaggctgtaccagatgcaggagtccggcaccctcctcttccctgccatcaacgtcaacgactccgtcaccaagagcaagtttgacaacctttatggttgccgtcactcgctccctgatggtctcatgagggccactgatgttatgatcgccggcaaggttgctgtggtctgcggttatggtgatgttggcaagggctgtgccgccgcactcaagcaggctggtgcccgtgtgatcgtgacagagattgaccccatctgtgcccttcaggccctgatggagggcatccagatcctcacattggaggatgttgtctctgatgccgacatctttgtgaccaccactggaaacaaggacatcatcatggttgaccacatgaggaagatgaagaacaatgccattgtctgcaacattggtcactttgacaacgagatcgacatgaatggccttgagacctaccctggtgtcaagcgcatcaccatcaagcctcagactgatcgttgggtcttccctgagaccaacactggcattattgttcttgctgaggggcgtctgatgaaccttggctgtgccactggccaccccagctttgtcatgtcctgctcattcactaaccaggttattgcccagcttgagttgtggaaggagaaggccaccggcaagtacgagaagaaggtgtacgttctccccaagcaccttgatgagaaggtcgcggccctccacctgggcaagctcggtgccaggctgaccaagctcaccaaggcccagtccgagtacattagcatcccagttgagggtccctacaagccgtctgcctaccggtactagtgcgtccactccagcacgactagcggctgggctgagcctgagcaggcgcaccgacgggaactctgcctcggcgacctatgaactatcctgttttcctttgcattatctatctagatctaggcatgttgtctcttaggtggaggatttgtcatggttacgtttttagaccggttagggttggttgacggaggtggcgtttgcttttgcccagaaataattgcgttattattttggtttaaacgaggtgtgatttgccggttttgtcctgttgattttacatgtctgatgctccc

SEQ ID NO: 7859 - DNA, 1844 bp, Vigna unguiculata
actcaactcttctttctttctctctctctcgctgctgcgcaaccatgtctctattggtggagaaaaccacaagcggccgcgagtacaaggtcaaggacctttctcaggccgacttcgggcgcctcgagctcgatctcgcggaggtcgagatgccgggcctcatggcctgccgggctgagttcggcccatcgcagcccttcaagggggcccgcatcaccggctccctccacatgaccatccagaccgccgtgctcattgagaccctcaccgccctcggcgctgaggtccgctggtgctcctgcaacatcttctccacccaggaccacgccgccgccgccatcgcccgcgacagcgctgctgtcttcgcctggaagggcgagaccctccaggagtactggtggtgcaccgagcgcgcccttgactggggccccggcggcggtcctgacctcatcgtcgacgacggcggtgacgccaccctcctcatccacgagggtgtcaaggccgaggagctctatgagaaaaccggcgagctccccgaccccgcttccactgacaacgctgagttccagatcgtgcttaccatcatcagagatgggttgaagaccgacccctccaggtaccgcaagatgaaggagcgtctcgttggggtttctgaggagaccaccactggtgtgaagaggctgtatcagatgcaggccaatggaactcttctgttccctgctatcaatgtcaatgactctgtcaccaaaagcaagtttgacaacttgtatgggtgccgtcattctctgcccgatggtctgatgagggctactgatgttatgattgccgggaaggtggctgtggtggctggatacggtgatgtcggaaagggttgtgctgcagcattgaagcaagctggtgctcgtgtaattgtgactgagattgatcccatctgtgccctccaggctctcatggaaggccttcaggttttgaccttggaggatgttgtatctgaggctgatatctttgttaccaccaccggtaacaaggacatcatcatggttgaccacatgaagaaaatgaagaacaatgccattgtttgcaacattggtcactttgacaatgagattgacatgctgggtctggagaactaccccggtgtgaagcgcatcaccatcaagccccagaccgacaggtgggtcttccctgagacgaacaccggcatcattgtcttggccgagggtcgtttgatgaacttgggatgtgctacaggacaccccagttttgtgatgtcctgctccttcaccaaccaggtcattgctcagcttgagttgtggaaggagaagaacagtgggaagtatgagaagaaggtttatgttttgcccaagcaccttgatgagaaggttgccgcacttcaccttggcaaacttggagctaagctcaccaagcttagcaaggatcaggctgattacatcagtgtgcctgttgagggtccatacaagcctgctcactacaggtactaagttcgttgtgatgaccaaaggagagcgtgggaaaggcgaaattgtttcatgaagcggcttgttttcttttcttttttggattttttgtgctagattcaaatccatgtagaacattgttttcttaattttgtagaactcatgtctgggtgggtgcgacgggtaagagcgctatacatcctcttggattctgtgatatgaatccaatttggtttgaaataaggcttgttttgattgggggcggtggcgttctggtttaactaaagtttgtgttttttttttcttttcacctttttaatatatcaaagaatataagaaaattctaaaaaaaaataaaaagaaaaa

SEQ ID NO: 7860 - DNA, 2137 bp, Picea glauca
aaattaatcccccccccccccggcattctctgttggagcaaatcgatctaagttcgatcgccgtagtccgtggttctgtcagatctgcgtttttttttttccagttttcgcagcaatggctcttcttgctgagaaaactgtgtccggacgggaatacaaggtgaaggacatgtcccaggcggactttgggaggttggagatagaattggcagaagttgagatgcctggattgatggcctgcagggctgaattcggccccgcgcagccctttaagggtgcccggatcacggggtcccttcacatgaccatccaaaccgcggttctcatcgagactctcgcggctctgggcgccgaggtgagatggtgctcctgcaatatcttttccacgcaggaccacgccgccgcggctattgcccgcgacagcgctgcggtgttcgcttggaagggggagacgctgcaggagtactggtggtgcaccgaaagggctctcgactggggtccaggcggtggcccggatctgatcgttgatgacggtggtgacgcaacgttgctgatccatgagggggtcaaggccgaggaggagtttgccaagaccgggaaggtgccggatccagagtctaccaccaatctggagtttcagatggttttggggttgatcaaggagagcatgaaggtggatcccttgaggtaccataggatgaaggagaggttggttggtgtgtctgaggagacaactactggtgttaagagactttatcagatgcaagccagtgggactttgctgttccctgctatcaatgtcaatgattctgttaccaagagcaagtttgataacttatatgggtgtagacactctctcccagatggtctgatgagagctacagatgtcatgattgctggtaaggttgctgttgtgtgcggatatggagatgttggaaagggttgtgctgcagccctaaaggttgctggagctagggtcattgttacagaaattgatccaatctgtgccctacaggctcttatggaaggccttcctgtccttaccctagaggatgtagttagcactgctgatatttttgtgaccactactggcaacaaggatatcatcatgttggatcacatgaggaaaatgaagaacaatgccattgtttgcaacattggtcattttgacaatgagattgacatgcaaggccttgaaactttccctggtgttaagaagattaccatcaagcctcagacggataggtgggtgttccctgataccaacagtggcatcattgttcttgcagagggacgtctgatgaacttggggtgtgctaccggccacccaagttttgtcatgtcttgctcctttacaaaccaggttattgctcagctggagctctggaacgagaggaagtcagggaagtacgagaagaaggtctatgtgctgcctaagcatctagacgagaaggttgctgctctgcacttgcctaagttgggtgccaggctaacgaagctttctcccgatcaggcagagtatatcaacgtgcccgttgagggaccttacaagcctgcccattaccgatactgaagagagatggcattttcggtgacttgttgggcgagtagcaaggctcccgggcagttgccaatggaagaacgaagctccctccgtggccagccccgttgttttgttccaattttaataaaaaattgctcgtctgtatgtctgtctgctgagtttattacagcggcaccgaaagtattcggtttagtatggtcttatgataaaagtagtttacagtagaattggtattcgaggtttttacatgatgcagttagcttttgtattactgaaatttcagaatgtaagcaagaatatatggttacctctgggtttttgatctgactttttttacgattcaaatgtatttttatccgaggactgcaatataatcactctaagaatgtcatggatattgatgcattatacctattgtaagagtttaatatagattacatatctgagctctctgctgatatagcttttgtatcattggaatttgagaacggatttaagaatatgtgggcgtacctttacctttggctttttgatcaaaggttgacatttttataattcaaatgaattttaagt

SEQ ID NO: 7861 - DNA, 1849 bp, Avena sativa
ccagccatggcgctctccgtggagaagacctcctccggccgcgagtacaaggtcaaggacctctcccaggccgacttcggccgcctcgagctggacctggccgaggtcgagatgccgggcctcatggcctgccgcgccgagttcggcccctcgcagcccttcaagggcgcccggatctcgggatccctccacatgaccatccagaccgccgtcctcatcgagaccctcacggccctcggcgccgaggtgcgctggtgctcctgcaacatcttctccacgcaggaccacgccgccgccgccatcgcgcgcgactcggccgccgtcttcgcctggaagggcgagaccctcgaggagtactggtggtgcaccgagcgatgcctcgactggggcgagggcggcgggcccgacctcatcgtcgacgacggcggcgacgccaccctgctcatccacgagggcgtcaaggccgaggaggagttcgagaagtccggcaaggtccccgaccccgagtccaccgacaaccccgagttcaagatcgtcctcaccatcatcagggacggcctcaagaccgacgtcaggaggtaccgcaagatgaaggagaggctcgtgggtgtctccgaggagaccaccaccggcgtcaagaggctctaccagatgcaggagtccggcgcgctcctcttccccgccatcaacgtcaacgactccgtcaccaagagcaagttcgacaacctttacggttgccgccactccctccctgacggtctcatgagggccactgatgtcatgatcgccggcaaggtcgccgtggtctgcggttacggagatgttggcaagggctgtgccgccgcgctcaagcaggctggtgcccgtgtcatcgtgacggagatcgaccccatctgtgccctgcaggccctgatggagggcatccagatcctcaccctggaggacgtcgtctctgatgccgacatcttcgtgaccaccacaggaaacaaggacatcatcatggtggaccacatgaggaagatgaagaacaacgccatcgtttgcaacatcggccactttgacaacgagattgacatgaacggcctggagacctaccctggcgtcaagcgcatcaccatcaagccccagaccgaccgctgggtcttccccgagaccaagaccggcatcattgtccttgctgagggtcgcctgatgaaccttgggtgtgccactggtcaccccagctttgtcatgtcctgctcgttcaccaaccaggtcattgctcagctcgagttgtggaacgagaggaagtctggcaagtacgagaagaaggtgtatgtccttcccaagcacctcgacgagaaggtcgcggcgctccacctgggcaagctcggcgccaagctgaccaagctcaccaagtcccagtccgagtacatcagcatccccgtcgagggcccttacaagcccgccgcctaccggtactagagaggatggtgtatgtccagcacggctagcggctgaaagattgagaaaggagcagcaacgtgtctctgcggcatggatttgttgaaccactgtatcttctattttgcatcatcttgcatgaatgctgtgtctcttaggcggaggatgatttgatatgttttgagtctgagtctggggtggtggaggaagcgtttatttttgctgaggaataataatggcattgttgatggtctagtttatggctggtaagatagtctggtgttttcatccattccaagataagttatggcatgactaaaattatttcggggtggctgtctcccattttgctaccattaacagtcacatccatcttaaccattgcccattgggcaaaaaaaaaaaa

SEQ ID NO: 7862 - DNA, 1874 bp, Avena sativa
ccccagctcccatctcactaacccccagatccaccagcccagccatggcgctctccgtggagaagacctcctccggccgcgagtacaaggtcaaggacctctcccaggccgacttcggccgcctcgagctggacctggccgaggtcgagatgccgggcctcatggcctgccgcgccgagttcggcccctcgcagcccttcaagggcgcccggatctcgggatccctccacatgaccatccagaccgccgtcctcatcgagaccctcacggccctcggcgccgaggtgcgctggtgctcctgcaacatcttctccacgcaggaccacgccgccgccgccatcgcgcgcgactccgccgccgtcttcgcctggaagggcgagaccctcgaggagtactggtggtgcaccgagcgatgcctcgactggggcgagggcggcgggcccgacctcatcgtcgacgacggcggcgacgccaccctgctcatccacgagggcgtcaaggccgaggaggagttcgagaagtccggcaaggtccccgaccccgagtccaccgacaaccccgagttcaagatcgtcctcaccatcatcagggacggcctcaagaccgacgtcaggaggtaccgcaagatgaaggagaggctcgtgggtgtctccgaggagaccaccaccggcgtcaagaggctctaccagatgcaggagtccggcgcgctcctcttccccgccatcaacgtcaacgactccgtcaccaagagcaagtttgacaacctttacgggtgccgtcactccctccccgacggtctcatgagggccactgatgtcatgatcgccggcaaggtcgccgtggtctgcggttatggtgatgtcggcaagggctgtgctgctgcactcaagcaggctggtgcccgcgtcatcgtgacggagatcgaccccatctgcgccctccaggccctgatggagggcatccagatcctcacccttgaggacgtcgtctctgatgccgacatctttgtgaccaccacaggaaacaaggacatcatcatggtcgaccacatgaggaagatgaagaacaacgccatcgtctgcaacatcggtcactttgacaatgagatcgacatgaacggccttgagacctaccctggtgtcaagcgcatcaccatcaagccccagaccgaccgctgggtcttccctgagaccaagactggcatcattgtcctcgccgagggacgtttgatgaaccttggttgcgccactggccaccccagcttcgtcatgtcctgctcattcactaaccaggttattgctcagcttgagttgtggaacgagaggaagtctggcaagtacgagaagaaggtgtacgttctccccaagcacctcgacgagaaggtcgcagccctccacctgggcaagctcggcgccaagctgaccaagctcaccaagtcccagtccgagtacatcagcatccccgttgagggtccttacaagccagctgcctaccggtactagagagggtgcctgtccagcacgactcctggctggctggcttgcttgagcagcctcagctgcagcagcagctatgtgaactctgcccaatcgatgtatcaacgactgtatcttctttttgcgttatcatttacatggtgtctttaggcggaggatttgttatggttatatgttttgagccctgtgagggttgggttggaagaggaggcgtttgcttttgctgagaaataatggcaattttcaatggtttaagggcgtctatgtggttgataagaaagtctcatgtattgcatctcctacggaaattcagaaaaatgttgttatagaatgtcttgtttaagggcgtttactactaacacaaggtttctattaaca

SEQ ID NO: 7863 - DNA, 2027 bp, Pinus pinaster
atggggactcgcattctccgttggagcaaatcgtcctaatctcggtccccgcaatccgtggttttgtcagttctgcgtttcttttctccgcagcaatggcgcttctggccgagaaaactgtgtccggacgggaattcaaggtgaaggatctgtcccaggcggattttgggaggttggaaattgaattggccgaagttgagatgcctggattgatggcctgcagagctgagttcggccccgctcagccctttaagggtgcccggatcactgggtcccttcacatgaccatccagaccgcggtgctcattgagaccctcacagctctgggtgctgaggtgagatggtgctcctgcaacattttctccacgcaggaccacgccgccgcggctattgcccgcgacagcgctgcggtgttcgcttggaagggggagacgctgcaggagtactggtggtgtactgaaagggctcttgactggggtccaggcggtggccctgatctgattgttgatgacggtggtgatgcaactttgttgatccatgagggggtcaaggccgaggaggagtttgccaagaccgggaaggtgccagatccggcgtctactacgaatctggagtttcagatggttttgggattgatcaaggacagcatcaaggtggatcccttgaggtaccataagatgaaggatagattggttggtgtttctgaagagacaactactggtgttaagaggctttatcagatgcaagccagtgggacattgctgttccctgctatcaatgttaatgactctgttaccaagagcaagtttgataacttatatggatgtagacactctctcccagatggtctgatgagagccacagatgtcatgatagctggtaaggttgctgttgtgtgtggatatggagatgttggaaagggttgtgctgcagctctaaaggttgctggagctagagtcattgttacagaaattgatccaatctgtgccctgcaagctcttatggaaggtctccctgtccttactatagaggatgtagttagtactgctgatatttttgtgaccaccactggcaacaaggatatcatcatggttgaccacatgaggaaaatgaaaaataatgccattgtttgcaacattggtcattttgacaacgagattgacatgcaaggtcttgaaactttccctggtgtcaagaagattaccatcaagcctcagacggataggtgggtgttccctgataccaacagtggaatcatcgttcttgcagagggacgtctgatgaacttgggttgtgctactggccacccaagttttgtcatgtcttgctcctttacaaaccaggttattgctcagttggagctctggaacgagaagaagtcagggaagtacgagaagaaggtctatgtgttgcctaagcatctagacgaaaaggtggctgctctgcatttgcctaagttgggtgctcatctaacaaagctttctcctgaacaggcagcgtatatcaacgtgcccgttgagggaccttacaagcctgcccactaccgatactgaagagaaatggcatttttggtgacttgctgggcaagtggcaaggctcctggacagttgccagaaggacgaatccccctccgtggccggctccattgttttgttccaattttaataaaaaatgctgtagtcatgtatgtctgctgagttttttacagcagcaccgaaagatttcctgtttagtatggtcttatgatagaagttggttgccatagaattggtattcgaggtttctccatgatgtagctagcttttgcattactgagattttagaacgcaagcaagatatacggttgtctctggttttgacttttttaacgaattactgaaatttcagaactcaagcaagatatatgattccctcgggttttgacttttaaacgattcaagtgtatttttatctgaggactgcaatttaaatgactgtaagaatgtcatggagatggatgcagtatatctgctttgagagtctaatat

SEQ ID NO: 7864 - DNA, 1845 bp, Avena sativa
ctcctcaatggcgtgcctgggccgccgatctggcaccgtcgaggtctccgacagggtgacccgctgtccccgcagctgtttgtccttgcggtggaagttttgagcaagctgatccgacgcgccaccccctcccccagcccagccagccatggcgctctccgtggagaagacctcctccgggcgcgagtacaaggtcaaggacctctcccaggccgacttcggccgcctcgagctcgacctcgccgaggtcgagatgccgggactcatggcctgccgcgccgagttcggcccctcgcagcccttcaagggcgcccggatctcgggatccctccacatgaccatccagaccgccgtcctcatcgagaccctcaccgccctcggagccgaggtccgctggtgctcctgcaacatcttctccacgcaggaccacgccgccgccgccatcgcgcgcgactccgccgccgtcttcgcatggaagggcgagaccctcgaggagtactggtggtgcaccgagcgatgcctcgactggggcgagggcggcgggcccgacctcatcgtcgacgacggcggcgacgccaccctgctcatccacgagggcgtgaaagccgaggaggagttcgagaagtccggcaagatcccagacccggagtccaccgacaaccccgagttcaagatcgtgctcaccatcatcagggacggcctcaagaccgacgtcaggaggtaccgcaagatgaaggagaggctcgtcggtgtctccgaggagaccaccaccggcgtcaagaggctctaccagatgcaggagtccggcgcgctcctcttccccgccatcaacgtcaacgactccgtcaccaagagcaagtttgacaacctttacgggtgccgtcactccctccccgacggtctcatgagggccactgatgtcatgatcgccggcaaggtcgccgtggtctgcggttatggtgatgttggcaagggctgtgctgctgcactcaagcaggctggtgcccgtgtcatcgtgacggagatcgaccccatctgtgccctgcaggccctgatggagggcatccagatcctcaccctggaggacgtcgtctctgatgccgacatcttcgtgaccaccacaggaaacaaggacatcatcatggttgaccacatgaggaagatgaagaacaacgctatcgtctgcaacatcggtcacttcgacaacgagatcgacatgaacggcctcgagacctaccccggtgtcaagcgcatcaccatcaagccccagaccgaccgctgggtcttcccagagaccaagaccggcatcattgtccttgccgagggtcgcctgatgaaccttgggtgcgccactggccaccccagcttcgtcatgtcctgctcgttcactaaccaggttattgctcagcttgagttgtggaacgagaggaagtctggcaagtacgagaagaaggtgtacgttctccccaagcacctcgacgagaaggtcgcagccctccacctgggcaagctcggtgccaagctgaccaagctcaccaagtcccagtccgagtacatcagcatccccgttgagggtccttacaagcccgctgcctaccggtactagagagcgtttccagcacgccactcctggctgtcttgcttgcttgcttgagcaggctcagctgcagcagcagctatgtgaactctgcccaatcgatgtatcaacgactgtatcttctttttgcgttatcatttacatgggtgtctttaggcggaggatttgttatggttatatgttttgagccctgtgagggttgggttggaagaggaggcgtttgcttttgctgagaaataatggcaatt

SEQ ID NO: 7865 - DNA, 1986 bp, Citrus sinensis
atcctcactctgcccgtaaaccctcgctcacacccactctatctctctcgcttgtacaatcattcactttgtttggttggtttccaaagagagagtagagtgccctctcttccttcttccttttagatctatcaattctattaataagccatggctttgtccgtcgagaaatccgctagcggtcgtgaattcaaggtgaaggatctgtcccaggctgacttcggccgcctcgaaatcgagttggccgaagtcgaaatgccggggctcatggcttgccgcgccgagttcggcccttcacagcccttcaaaggagccaagatcaccggttcactccacatgaccatccagaccgccgtcctcatcgagaccctcaccgctctcggcgccgaagtccgctggtgctcctgcaacatcttctcaacccaagaccacgcggccgccgccatcgcacgtgactccgcctccgtctttgcctggaagggtgagaccctccaggagtactggtggtgcacggagaaagccctggactggggtcccggcggcggcccagatctcatcgtcgatgacggtggtgacgccacgttgttgatccacgagggagtcaaagctgaggagatctacgagaagaccgggaagttgcccgacccggcctccaccgacaacgccgagtttcagattgttttgactatcattagagatgggttgaaggccgatcccaagaagtaccacaaaatgaaggaaagattagttggtgtttccgaagaaaccacgaccggtgtcaagagattgtatcagatgcaagaaaatggaaccctcttgttccctgccatcaatgtcaatgactctgtcaccaagagcaagtttgataacttgtatggatgccgccactcgctcccagatggtttgatgagagctactgatgttatgattgccggaaaggttgctgttgtttgcggttatggtgatgttggcaagggttgtgctgctgctttgaagcaagccggtgctcgtgtaattgttaccgagattgatccaatttgcgctctccaggctcttatggagggtcttcaagtcctaacccttgaggatgtcctctccgatgctgacatctttgttaccaccaccggtaacaaggacatcatcatggttgaccacatgaagaagatgaagaacaatgcaattgtttgcaacattggtcactttgataatgaaattgatgtgctcggtcttgagacctacccgggtgttaagcgcattaccatcaagccccaaactgataggtgggtcttccccgagaccaactcaggcatcatcgtgttggctgagggacgtctcatgaacttgggatgtgccactgggcaccccagctttgtgatgtcctgttccttcaccaatcaggtgattgcccagcttgagctctggaaggagaagagcaccggcaagtacgagaagaaggtgtacgttctgcccaagcacctcgatgaaaaggttgctgctcttcaccttggcaaacttggagctaagctcaccaggctcaccaaggagcaggctgactacatcagtgtgtccgccgatggtccttacaagcctcttcactacaggtactaagtggaagaagaagaagaagaagaagaagagtgaatgttttgagggaaagaaacaaaatatttggccggcttgattgttttcaatgatgatctgtagtaggatgttaggtttaaatttggtagtagtgtgtgtttgggtggtgggaaagttggaggaaagaaacggatttgtttccgttgattgaagaccatttgggatttgaataaggttttggatggggccgtgttggattattttgtatttggtgcagttttaagttttgcttgctttgctgcatcttgttatccttattgtttactgatgaatgattataaaaaaaaaaaatctttttcccagtttcttatctaaatgaaaaatcattatgaaaactgaggtcaa

SEQ ID NO: 7866 - DNA, 1788 bp, Phalaenopsis aphrodite
ctcctcgcttgctagatctcggtgccattcgcagcgggaggcaaaaatttccgatctatttctctttcatcgccatggctctgctcgtggagaagactacttccgggcgcgagtacaaggtgaaagacttatcccaggccgatttcggccggctcgagatcgagcttgcggaggtcgagatgccaggcctcatggcttgccgcgctgagttcggcccctcccagccgttcaaaggcgcgcgtatctccggctctctccacatgactatccagaccgctgtgctcattgaaaccctaacggccctcggtgccgaggtacgctggtgctcctgcaacattttctccacccaggaccatgctgctgccgcaatcgcccgtgattccgccgccgtttttgcttggaagggagagacccttcaggagtactggtggtgcacggagcgctgcctagaatggggcgccggcggaggcccggatctcattgtcgacgacggcggtgatgcgacacttcttatccatgagggagttaaggctgaggaggagtacgagaagaacgggaaaattccagatccggcttctacggacaacgcggagttccagatcgtgcttgggctcatcagggatagcttaagcgtcgatccgaagaaatatcggaggatgaaggagaggctcgttggcgtctctgaggagacgaccaccggagtgaagaggttgtaccagatgcagtacagtgggacccttcttttccctgccatcaacgtcaatgactcagttaccaagagcaagtttgataacctatatggttgccgtcactctctccccgatggcctaatgagagccaccgatgtcatgatcgccggcaaggtagctgttgtttgcggctacggagatgtaggcaagggttgtgccgcggcactcaagactgccggtgctcgtgtcatcgtcactgagatcgacccaatatgtgcccttcaggccctcatggaaggcctccctgtcctccgccttgaggacgtcgtgtccgaggctgacattttcgtcaccaccaccggcaacaaggacatcatcatggttgaccacatgaggaagatgaagaacaatgccatcgtctgcaacatcggccacttcgacaacgagattgatatgctcggactcgaatcattccccggtgtcaaacgcatcaccattaagccgcagacggatcggtgggtcttccctgacacaaatagcggcatcctcgtgctggcggagggccgtctgatgaatctcggatgcgccacgggtcaccccagctttgtcatgtcgtgctcttttacgaaccaggtaattgctcagctggagctgtggaaggagagggcgtcgggaaagtatgagaagaaggtgtatgtgttgccgaagcacctggatgagaaggttgcagcacttcatttaggcaagcttggggccaagctcaccaagcttactccttcgcaggctgattacatcagcgttccggtcgagggtccctacaaaccagcccattacaggtattagagaattttaatgtgaggaaactgaatctgatggaacttctgttccattggattcaaaggaggaatcagctttatacttatctttatcaagttatgctctatttatcatttaaacattgctttaatgatgttgttgatttgaagggggtgagtgtgatttctgagaggaataatgaggtttgtgggttgtggcggaggtggtgtatcgtccctgagtatattcgggagactttttttgttttttgtgtagccttttt

SEQ ID NO: 7867 - DNA, 1686 bp, Tabernaemontana elegans
atcgtttctctcccgtagccggtactaaaccctaagcccgaacccgaacccgaacccgccatggctctctctgttgacaagacctcatcgggccgtgagtacaaggtcaaggacatgtctcaggccgacttcgggcggctcgagatcgagctcgctgaggtggaaatgcctgggctcctggcttgccgggccgagttcgggccacctcagccactgaagggtgctcgcatcactggctccctccacatgactattcaaacagccgttctcattgaaaccctgacggccctaggcgcctccgtccgttggtgctcttgcaatattttctcaactcaggaccacgctgccgctgccatcgcacgtgactccgccgccgtctttgcctggaaaggtgaaacactgcaggaatactggtggtgtacggagagggcattggactggggttcagagggaggaccagatttgattgtagatgatggtggtgatgctactctattgattcacgagggagtgaaagcagaggaggagtatgagaaaacaggcaagttaccggatccaagttccactgataatgctgaatttcagattgttttgggaattattagggatggattgaaggtggatcccaagaaataccacaagatgaaggagagattggtcggtgtttcggaggagaccaccactggtgtgaaaaggctgtaccagatgcaggctaatgggaccctgttgtttcctgctattaacgtcaacgactctgttactaagagcaagtttgacaacttgtatggatgccggcactcactccctgatggtctcatgagagccactgatgttatgattgctggtaaagttgcagtcgtctgtggttacggagatgttggcaagggttgtgctgctgctctcaagcaagcaggtgctcgtgtgattgttacagaaattgatcctatctgcgcccttcaagctctcatggaaggtattccagttttgaccttggaagatgctgtctctgaggctgacatcttcgtgacaacaaccggaaacaaagacattattatggttgatcacatgaggaagatgaagaacaatgcaattgtctgcaacattggtcactttgacaatgagattgacatgctcggtcttgagacctaccctggtgtcaaacgcatcaccatcaagccccaaactgaccgctgggtattccctgagactggaactggtatcattgttcttgctgagggacgtttgatgaacttgggatgtgccactggccatccaagctttgtgatgtcctgctctttcaccaaccaagtgatcgcacaacttgagttgtggaaggagaagacctctggcaagtatgagaagaaggtctatgtgctgccaaaacacctcgatgagaaggttgcagctcttcatttgggaaaacttggagctaagttgacaaaccttactccagagcaagctgcctacattagtgttccagttgatggtccatacaagccagcacactataggtactaaaaagcagccaagtgggcaagttgtggtgcctttctttgcgggtgggtcactggggtaaatttaatcgtttctgtgatagagataatgtgttaggaccgtggttgtgcaaccctgtgggtggagtttgaatttgtacgtttagccattggtaaggaagaaatgtgagct

SEQ ID NO: 7868 - DNA, 1469 bp, Vinca minor
tagctctggtagagaatacaaagtcaaggacatgtcccaggccgactttggaagactcgaaatcgagcttgccgaagtcgaaatgcctgggctaatgtcctgcagaactgaatttggtcctagccaaccttttaagggtgctaggatcactggaagtctgcatatgactatccaaaccgcggtcttaatcgagaccttaaccgcccttggagcagaagttagatggtgttcttgtaacattttctccacccaagatcatgcggccgccgccatagctcgtgacagtgccgccgtgtttgcctggaaaggggaaaccttacaggaatactggtggtgtactgaaagagctttggattggggtcctgatggtggaccagatctaattgttgatgatggtggtgatgccacattgttgatccacgagggtgttaaggctgaggaagagtataagaaatctggggctatcccagatcctaattctactgataatgctgagtttcagattgttttgactattattaaagatgggttgaaatctgatccttctaagtatactaagatgaaggagagacttgtgggtgtttctgaagagactaccactggtgttaagaggctttaccagatgcaggctaatggtacccttttgttccctgccattaatgtcaatgactctgttaccaagagcaagtttgacaacttgtatggatgccggcactcactccctgatgggcttatgagggcaactgatgtgatgattgctggaaaggtagcccttgttgctggatatggagatgttggaaagggctgtgctgctgccttgaagcaagctggtgctcgtgtcattgttactgagattgatccaatatgtgctcttcaggcactcatggaaggtctccaagtccttacccttgaggatgtcgtctccgatgtggatatctttgttaccaccaccggtaacaaggacatcatcatggtagaccacatgaagaagatgaaaaacaatgccattgtttgcaacatcggtcactttgacaacgaaattgacatgttaggtctcgagacttacccaggtgtgaagaggatcacaattaagccccaaaccgaccgatgggtcttccctgaaacaaaaaccggcatcattgtcttggctgagggtcgtttgatgaacttgggttgtgctacaggacatcctagctttgtcatgtcttgctcattcactaaccaagtgatcgcccagctggaattgtggaacgagaggacttcagggaaatacgagaagaaggtgtatgttttgcccaagcaccttgatgagaaggttgctgcccttcaccttggaaagcttggtgctaggctcactaagctaagcaaggatcaggctgattatatcagtgtacccgttgaaggtccttacaagcctgctcactataggtactaagagatggatggaattggcatagagaagattgctg

SEQ ID NO: 7869 - DNA, 1823 bp, Avena sativa
ctccctcccccagatccatcccgtccaccaccaacccctcctcccccactccccagccagccagccagccatggcgctctccgtggagaagacctcctccggccgcgagtacaaggtcaaggacctctcccaggccgacttcggccgcctcgagctcgacctcgccgaggtcgagatgccgggactcatggcctgccgcgccgagttcggcccctcgcagcccttcaagggcgcccggatctcgggatccctccacatgaccatccagaccgccgtcctcatcgagaccctcacggccctcggcgccgaggtccgctggtgctcctgcaacatcttctccacgcaggaccacgccgccgccgccatcgcgcgcgactcggccgccgtcttcgcatggaagggcgagaccctcgaggagtactggtggtgcaccgagcgatgcctcgactggggcgagggcggcgggcccgacctcatcgtcgacgacggcggcgacgccaccctgctcatccacgagggcgtgaaagccgaggaggagttcgagaagtccggcaagatcccagacccggagtccaccgacaaccccgagttcaagatcgtcctcaccatcatcagggacggcctcaagaccgacgtcaggaggtaccgcaagatgaaggagaggctcgtgggtgtctccgaggagaccaccaccggcgtcaagaggctctaccagatgcaggagtccggcgcgctcctcttccccgccatcaacgtcaacgactccgtcaccaagagcaagtttgacaacctttacgggtgccgtcactccctccccgacggtctcatgagggccactgatgtcatgatcgccggcaaggtcgccgtggtctgcggttatggtgatgtcggcaagggctgtgctgctgcactcaagcaggctggtgcccgcgtcatcgtgacggagatcgaccccatctgcgccctccaggccctgatggagggcatccagatcctcacccttgaggacgtcgtctctgatgccgacatctttgtgaccaccacaggaaacaaggacatcatcatggtcgaccacatgaggaagatgaagaacaacgccatcgtctgcaacatcggtcactttgacaatgagatcgacatgaacggccttgagacctaccctggtgtcaagcgcatcaccatcaagccccagaccgaccgctgggtcttccctgagaccaagactggcatcattgtcctcgccgagggacgtttgatgaaccttggttgcgccactggccaccccagcttcgtcatgtcctgctcattcactaaccaggttattgctcagcttgagttgtggaacgagaggaagtctggcaagtacgagaagaaggtgtacgttctccccaagcacctcgacgagaaggtcgcagccctccacctgggcaagctcggcgccaagctgaccaagctcaccaagtcccagtccgagtacatcagcatccccgttgagggtccttacaagccagctgcctaccggtactagagagggtgcctgtccagcacgactcctggctggctggcttgcttgagcagcctcagctgcagcagcagctatgtgaactctgcccaatcgatgtatcaacgactgtattttctttttgcgttatcatttacatggtgtctttaggcggaggatttgttatggttatatgttttgagccctgtgagggttgggttggaagaggaggcgtttgcttttgctgagaaataatggcaatttcaatggtttaaggaggtttatgtggttgataagaaagtttcatgtattgcatttccta

SEQ ID NO: 7870 - DNA, 1761 bp, Avena sativa
ccagccatggcgctctccgtggagaagacctcctccgggcgcgagtacaaggtcaaggacctctcccaggccgacttcggccgcctcgagctcgacctcgccgaggtcgagatgccgggactcatggcctgccgcgccgagttcggcccctcgcagcccttcaagggcgcccggatctcgggatccctccacatgaccatccagaccgccgtcctcatcgagaccctcaccgccctcggcgccgaggtccgctggtgctcctgcaacatcttctccacgcaggaccacgccgccgccgccatcgcgcgcgactccgccgccgtcttcgcatggaagggcgagaccctcgaggagtactggtggtgcaccgagcgatgcctcgactggggcgagggcggcggccccgacctcatcgtcgacgacggcggcgacgccaccctgctcatccacgagggcgtgaaagccgaggaggagttcgagaagtccggcaagatcccagacccggagtccaccgacaaccccgagttcaagatcgtgctcaccatcatcagggacggcctcaagaccgacgtcaggaggtaccgcaagatgaaggagaggctcgtcggtgtctccgaggagaccaccaccggcgtcaagaggctctaccagatgcaggagtccggcgcactcctcttccccgccatcaacgtcaacgactccgtcaccaagagcaagtttgacaacctttacgggtgccgtcactccctccccgacggtctcatgagggccactgatgtcatgatcgccggcaaggtcgccgtggtctgcggttatggtgatgtcggcaagggctgtgctgctgcactcaagcaggctggtgcccgtgtcatcgtgacggagatcgaccccatctgtgccctgcaggccctgatggagggcatccagatcctcaccctggaggacgtcgtctctgatgccgacatcttcgtgaccaccacaggaaacaaggacatcatcatggttgaccacatgaggaagatgaagaacaacgctatcgtctgcaacatcggtcacttcgacaacgagatcgacatgaacggcctcgagacctaccccggtgtcaagcgcatcaccatcaagccccagaccgaccgctgggtcttcccagagaccaagaccggcatcattgtccttgccgagggtcgcctgatgaaccttgggtgcgccactggccaccccagcttcgtcatgtcctgctcgttcactaaccaggttattgctcagcttgagttgtggaacgagaggaagtctggcaagtacgagaagaaggtgtacgttctccccaagcacctcgacgagaaggtcgcagccctccacctgggcaagctcggtgccaagctgaccaagctcaccaagtcccagtccgagtacatcagcatccccgttgagggtccttacaagccagctgcctaccggtactagagaggctgcctgtccagcacgactcctggctggcttgcttgcttgagcaggctcagctgcagcagcagctatgtgaactctgcccaatcgatgtatcaacgactgtatcttctttttgcgttatcatttacatgggtgtctttaggcggaggatttgttatggttatatgttttgagccctgtgagggttgggttggaagaggaggcgtttgcttttgctgagaaataatggcaattttcaatggtttaagggcgtctatgtggttgataagaaagtctcatgtattgcatctccta

SEQ ID NO: 7871 - DNA, 1798 bp, Antirrhinum majus
caaagaagagagtcagaaaaataaatctcagatccaacacagcaatggctctcctcgtcgagaagaccacttccggacgcgagtacaaggtgaaggacatgtctcaggctgacttcggtcgcctcgagatcgagctcgcggaggtggaaatgcctggtctgatgtcctgccgcaccgagttcggcccctcacagccgttcaagggcgccagaatcaccggaagtctccacatgaccatccaaaccgccgtcctgatcgagaccctgaccgccttgggtgctgaggtccgttggtgctcctgcaacatcttctccacgcaagaccacgctgctgctgctattgctcgcgacagtgctgcggtgtttgcgtggaagggagagactctgcaggagtactggtggtgcaccgagcgtgctcttgactggggcccaggcggtggacccgatctgattgtggatgacggtggtgatgccacactcttgatccacgagggtgtcaaggctgaggacgagtacgagaagaatggtaccattcccgatcccacctccaccgacaatgccgagttccagatcgtgctcaccattatcagggatgggctaaaggctgatcccaagaagtacaacaagatgaagcagagattggttggtgtttctgaggagaccaccactggtgtcaagaggttgtaccagatggagcagaacggcactctcctcttccctgctattaatgtcaacgactccgtcaccaagagcaagtttgacaacttgtatggatgccgacactcactgcctgatggtctgatgagggccactgatgttatgattgctggaaaggtcggtgttgtgtgcggttatggagatgttggaaagggctgtgctgctgcccttaaacagggtggtgctcgtgtcattgtgactgagattgatccaatctgtgctcttcaagctctcatggaaggtttccaagttttgcccctcgaggatgtcgtctctgaagctgatatctttgtcaccaccactggtaacaaggacatcatcatggttgatgacatgaggaagatgaaaaacaacgccatcgtttgcaacattggtcactttgacaacgagattgacatgcttggccttgagacttaccctggtgtcaagagaattaccatcaagccacaaacagacagatgggtcttcccagaaaccaacactggaattatcatattagcagaaggtcgtctgatgaacttgggttgtgcaactggtcaccctagctttgtgatgtcgtgctctttcactaaccaagttattgcccaacttgagctgtggaaagagaggaccaccggcaagtacgagaagaaggtgtatgtcttgcccaagcatcttgatgagaaggttgctgctctccatcttgggaagcttggtgctaagctcactaagctgtccaaggatcaggctgactacattagtgtaccagttgagggtccttacaagcctgctcactacaggtactgagaggcaaggactgactgaatcaacaagtactggaaagacaattgttgtttgttatattttgatttggtattggatatgtagtttcaatgttttgcttggggggtttggtatgtttgtgtaggcaagcaataaagattttgagtgatggactggtctatggaagcttgcgtttaagttgtttgtttaacttactttccgaatatcagtttttttatttaaaagtttgttagttactgctgttccgtgttgttgctatttgttccgacctcttttggctttctaattttggtcgtatg

SEQ ID NO: 7872 - DNA, 1763 bp, Amborella trichopoda
tgcgttttgtgagccatttccgatcactgaaaatggctttgcttgtggagaaaacggtctccggccgcgaatacaaggtgaaggacatgtctcaggcagattttggtcgcctggagatcgagcttgccgaggtcgagatgccaggcctcatggcctgccgtaccgagttcggcccgtcccagcccttcaagggtgcccgcatcaccggctcccttcacatgaccatccaaaccgcggtgctgatcgagaccctcactgcccttggcgctgaggtccgctggtgctcctgcaacattttctcgacgcaggaccatgctgctgctgccattgcacgcgacagtgcggcagtttttgcctggaagggtgaaactcttcaggagtactggtggtgcactgagcgcgccttggactggggtcctggcggaggaccggatttgattgtggatgatggcggtgatgcgactctgttgattcatgaaggggtgaaggctgaggaggagtttgaaaagtccgggaagctgcctgacccggcctcgaccaccaaccctgaatttcagattgttttggggattattaaggatgggttgaaggcagatcccaagaagtaccacaaaatgaaggataggcttgtcggagtgtcggaggagaccacgactggggtgaagaggctctaccagatgcatgccaatgggactttgttgttctcggcaatcaatgtcaatgactctgtcaccaagagcaagtttgacaacctctacgggtgcagacactctctccctgatggcctgatgagggccactgatgtcatgattgctggcaaggttgcggttgtgtgtgggtacggagatgtgggcaagggctgtgcctcggccctcaagcaggctggtgcccgtgtcattgtgactgagatcgaccccatctgtgccctacaagccctcatggaaggcatccctgttctaacccttgaggatgtagtctcagaggctgacatcttcgtgaccgccaccggtaacaaggacatcatcatggttgaccacatgaggaagatgaagaacaatgccattgtttgcaacattggtcactttgacaatgagattgacatgcaggggttggagacctaccctggtgtgaagcgcaacaccatcaagccccagactgaccgatgggtcttccctgagaccaacagcggtattattgtgttggctgagggccgtctcatgaaccttgggtgtgctactgggcatcccagctttgttatgtcttgctccttcactaaccaggtaattgctcaacttgagctatggaaggagaagggaactggcaagtaccagaagcaagtgtacgtgctgccgaagcacctggacgagaaggtggcttccctgcaccttggcaagcttggtgctcacctcaccaagctctctccggatcaggccgagtatatcaatgttcccattgagggtccctacaaaccaccacaatataggtactgagattggcaggaggagctactagttgccctgtcatgtgcgctttttttttcctttttttttttttttggcatttttgctttgctatatttggagagttggagacggtggtatgaaaagacattcccaattggagaagagagggtgttgttggtaccaataagtatgtgtgggctgaagatgatggtgtatcttgccggtggattgttttgtagcaacatctatttttaatcgatgggaaatgttgagagattaatttagtggttgtttgtgttg

SEQ ID NO: 7873 - DNA, 1986 bp, Citrus clementina
atcctcactctgcccgtaaaccctcgctcacacccactctatctctctcgcttgtacaatcattcactttgtttggttggtttccaaagagagagtagagtgccctctcttccttcttccttttagatctatcaattctattaataagccatggctttgtccgtccagaaatccgctagcggtcgtgaattcaaggtgaaggatctgtcccaggctgacttcggccgcctcgaaatcgagttggccgaagtcgaaatgccggggctcatggcttgccgcgccgagttcggcccttcacagcccttcaaaggagccaagatcaccggttcactccacatgaccatccagaccgccgtcctcatcgagaccctcaccgctctcggcgccgaagtccgctggtgctcctgcaacatcttctcaacccaagaccacgcggccgccgccatcgcacgtgactccgcctccgtctttgcctggaagggtgagaccctccaggagtactggtggtgcacggagaaagccctggactggggtcccggcggcggcccagatctcatcgtcgatgacggtggtgacgccacgttgttgatccacgagggagtcaaagctgaggagatctacgagaagaccgggaagttgcccgacccggcctccaccgacaacgccgagtttcagattgttttgactatcattagagatgggttgaaggccgatcccaagaagtaccacaaaatgaaggaaagattagttggtgtttccgaagaaaccacgaccggtgtcaagagattgtatcagatgcaagaaaatggaaccctcttgttccctgccatcaatgtcaatgactctgtcaccaagagcaagtttgataacttgtatggatgccgccactcgctcccagatggtttgatgagagctactgatgttatgattgccggaaaggttgctgttgtttgcggttatggtgatgttggcaagggttgtgctgctgctttgaagcaagccggtgctcgtgtaattgttaccgagattgatccaatttgcgctctccaggctcttatggagggtcttcaagtcctaacccttgaggatgtcctctccgatgctgacatctttgttaccaccaccggtaacaaggacatcatcatggttgaccacatgaagaagatgaagaacaatgcaattgtttgcaacattggtcactttgataatgaaattgatgtgctcggtcttgagacctacccgggtgttaagcgcattaccatcaagccccaaactgataggtgggtcttccccgagaccaactcaggcatcatcgtgttggctgagggacgtctcatgaacttgggatgtgccactgggcaccccagctttgtgatgtcctgttccttcaccaatcaggtgattgcccagcttgagctctggaaggagaagagcaccggcaagtacgagaagaaggtgtatgttctgcccaagcacctcgatgagaaggttgctgctcttcaccttggcaaacttggagctaagctcaccaggctcaccaaggagcaggctgactacatcagtgtgtccgccgatggtccttacaagcctcttcactacaggtactaagtggaagaagaagaagaagaagagtgaatgttttgagggaaagaaacaaaatatttggccggcttgattgttttcaatgatgatctgtagtaggatgttaggtttaaatttggtagtagtgtgtgtttgggtggtgggaaagttggaggaaagaaacggatttgtttcagttgattgaagaccatttgggatttgaataaggttttggatggggccgtgttggattatgttgtatttgatgcagttttaagttttgcttgctttgctgcatcttgttatccttattgtttactgatgaatgattattaaaaaaaaaaaaaaaaatctttttctcagtttcttatctaaataaaaaatcattatgaaaactgaggtcaa

SEQ ID NO: 7874 - DNA, 1812 bp, Phalaenopsis aphrodite
ccctacgactcgcttgctagatctcggtgccattcgcagcgggaggcaaaaatttcccgatctatttctctttcatcgccatggctctgctcgtggagaagactacttccgggcgcgagtacaaggtgaaagacttatcccaggccgatttcggccggctcgagatcgagcttgcggaggtcgagatgccaggcctcatggcttgccgcgctgagttcggcccctcccagccgttcaaaggcgcgcgtatctcaggctctctccatatgactatccaaaccgctgtgctcattgaaaccctaacggccctcggtgccgaggtacgctggtgctcctgcaacattttctccacccaggaccatgctgctgccgcaatcgcccgtgattccgccgccgtttttgcttggaagggagagacccttcaggagtactggtggtgcacggagcgttgcctagaatggggcgccggcggaggcccggatctcattgtcgacgacggcggtgatgcgacacttcttatccatgagggagttaaggctgaggaggagtacgagaaaaacgggaaaattccagatccggcttctacggacaacgcggagttccagatcgtgcttgggctcatcagggatagcttaagcgtcgatccgaagaagtaccggaggatgaaggagaggctcgttggcgtctctgaggagacgaccaccggagtgaagaggttgtaccagatgcagtacagtgggacccttcttttccctgccatcaacgtcaatgactcagttaccaagagcaagtttgataacctatatggttgccgtcactctctccccgatggcctaatgagagccaccgatgtcatgatcgccggcaaggtagctgttgtttgcggctacggagatgtaggcaagggttgtgccgcggcactcaagactgctggtgctcgtgtcatcgtcactgagatcgacccaatatgtgcccttcaggccctcatggaaggcctccctgtcctccgccttgaggacgtcgtgtccgaggctgacattttcgtcaccaccaccggcaacaaggacatcataatggttgaccacatgaggaagatgaagaacaatgccatcgtctgcaacattggccacttcgacaacgagattgatatgctcggactcgaatcattccccggtgtcaaacgtatcaccattaagccgcagacggatcggtgggtcttccctgactcaaatagtggcatcctcgtgctggcggagggccgtctgatgaatctcggatgtgccacgggtcaccccagctttgtcatgtcgtgctcttttacgaaccaggtaattgctcagctggagctgtggaaggagagggcgtcgggaaagtatgagaagaaggtgtatgtgttgccgaagcacctggatgagaaggttgcagcacttcatttaggcaagcttggggccaagctcaccaagcttactccttcgcaggctgattacatcagcgttccggtcgagggtccctacaaaccagcccattacaggtattagagaattttaatgtgaggaaactgaatctgttggaacttctgttccattggattcaaaggaggaatcagcttcatacttatctttatcaagttatgctctatttatcctttaaacattggtttaatgttgttgttgatttgaagggggtgagtgtgatttctgagaggaataatgaggtttgtgggttgtggcggaggcggtgtatcgtccctgactatattcgggagactttttttgttttgtgtagcctttttctatatggggcttttggagg

SEQ ID NO: 7875 - DNA, 1738 bp, Plantago ovata
ttcttctccactaaaccccgagctcagatccaaaccccaaccatggctatgtctctctccgtggagaaaaccacttccggccgtgaatacaaggtcagagacatgacccaggccgacttcggccgcctcgaaatcgagctcgccgaggtcgaaatgcccggtctcatgtcctgccgcaccgaattcggcccatcccagccattcaaaggtgccagaatcaccggaagtctccacatgaccatccaaaccgccgttctcatcgaaaccctaaccgccttgggcgctgaggttcgttggtgctcgtgcaacattttctccacccaggaccacgctgccgccgcaatcgctcgtgattcagctgctgtgttcgcctggaagggagagaatctccaggagtactggtggtgtaccgagagggccttggattggggtccaggtggaggtcccgatctgattgtcgatgacggtggtgatgccactttgttgatccatgagggagttaaggctgaggaggagttcgcgaagaacggtaccattccggatccgacctccactgacaatgctgagttccagatcgtgttgtcgattattaaggatggattgacgatcgatcctaagaggttcaccaagatgaaggagagattggttggtgtttcggaggagactaccactggtgtcaagaggttgtaccagatgcaagccaatggtactctgctgttccctgctatcaatgttaatgactctgtcaccaagagcaagttcgataacttgtatggatgccgccactcactccccgatggtctgatgagagccactgatgtgatgattgctggaaaggttggagttgtctgtggttatggagatgttggcaagggttgtgcctctgctttgaagcaagctggtgctcgtgtgattgtgaccgagattgacccgatctgtgcactccaagccctcatggaaggttaccaggtgttgaccctggaggatgttgtttctgacgctgatatctttgtcaccaccaccggtaacaaggacataatcatgctcgagcacatgaggaaaatgaagaacaatgctattgtttgcaacattggtcactttgataatgagattgatatgcacggccttgagacttaccctggtgtgaagaggaccacaattaagccacaaactgacaggtgggtgttcccagagaccaacactggcatcattgttttggccgagggtcgtctcatgaacttgggttgtgccaccggacatcctagctttgtgatgtcttgctcattcaccaaccaagttattgcccagcttgagttgtggaatgagaggacttctggcaagtacaagaaggaagtctatgtcttgcccaagcaccttgacgagaaagttgcagcactccatcttgggaaacttggagctaagctcaccaagctgtccaaggatcaagctgactacatcagtgtgccagttgagggtccctacaagcctgctcactacaggtactgagaggccatggttggtggaaataagaagagttgaaggtcattgtgtttaatattctagtggcttgatagtttaaatttggtgttttttgtcttggtgagttggtatgtacttggattgaaaaaaatggtcctgaaggaccacgggaaaggttgttttgtgggggatgtttaattgattgttgaatttgctgtcttgtcgattttcttgtttccttgatatgatgaagttgaat

SEQ ID NO: 7876 - DNA, 1547 bp, Musa acuminata
ggcacgagccttgcccaactccttcgattcgttccaacgatcggagaatggcgctgctggtggagaagacgtcgacgggacgcgagtacaaggtgaaggacctttctcaggctgacttcggccgcctcgagatcgagctggcggaggtggagatgccgggcctcatggcgtgccgcgccgagttcgggcccgccaaacctttcgccggcgcccgcatctccggctccctccacatgaccatccagaccgccgtcctcatcgagaccctcaccgccctcggtgctgaagtccggtggtgctcctgcaacatcttctccacccaggaccacgccgctgccgccattgcccgcgactccgccgccgtcttcgcctggaagggagagaccctcgccgagtactggtggtgcaccgagcgatgcctcgactggggccccaacggtggccccgacctcatcgtcgacaaagggggtgacgccactctcctcatccacgaaggcgtcaaggctgaggaagagtacgaaaagaccggcaagctgcccgatccggcctccacggaaaacgccgaattccaaatcgtgctggggatcatccgcgacgggctcaaggtcgaccccaagaagtaccgcaagatgaaggaacgcctcgtcggcgtgtcggaggagaccaccactggcgtcaagcgactctaccagatgcaggccagcggcgccctgctcttccccgccatcaacgtcaacgactccgttaccaagagcaagtttgacaacctgtatggatgccgccactctctccccgatggcctcatgagggccactgatgttatgattgccggaaaagttgccgtggtctgcggctatggagatgtgggcaagggctgtgctgctgccctgaagcaagctggcgctcgtgttattgttaccgagatcgaccccatctgtgctcttcaggcactgatggggggcctccctgttctcactctggaggatgtcgtctccgaggcagatatctttgtgacgacaaccgggaacaaggacattattatggttgatcacatgaagaagatgaagaacaatgccattgtttgcaacattggccacttcgacaatgagatcgatatgcatggcctggagacctacccgggcgtcaagcgcatcaccatcaagccccagaccgatcgctgggtgttccctgagaccaagaccggcatcatcgtgcttgccgaggggcggcttatgaatcttggttgtgccactgggcatcccagcttcgtcatgtcctgctccttcaccaaccaggtgatagcacaactggaattatggaaggaaaaggcgaccggcaagtacgagaagaaagtctatgtgctacccaaacatctggatgagaaggtggcagcgcttcacctcggcaagctgggtgccaagctcaccaagcttacaccatcgcaggctgattacattagcgtcccgatcgaaggaccctacaagcctgctcactacaggtattagggttgcttatgcaagagacaatgataataaatcggagcactg

SEQ ID NO: 7877 - DNA, 1853 bp, Elaeis guineensis
  misc_feature (35)..(35): n is a, c, g, or t
  misc_feature (417)..(417): n is a, c, g, or t
  misc_feature (446)..(447): n is a, c, g, or t
  misc_feature (450)..(450): n is a, c, g, or t
  misc_feature (453)..(453): n is a, c, g, or t
  misc_feature (463)..(463): n is a, c, g, or t
  misc_feature (465)..(465): n is a, c, g, or t
  misc_feature (468)..(468): n is a, c, g, or t
  misc_feature (501)..(501): n is a, c, g, or t
  misc_feature (561)..(561): n is a, c, g, or t
  misc_feature (565)..(565): n is a, c, g, or t
  misc_feature (573)..(573): n is a, c, g, or t
  misc_feature (622)..(622): n is a, c, g, or t
  misc_feature (631)..(631): n is a, c, g, or t
  misc_feature (648)..(648): n is a, c, g, or t
  misc_feature (656)..(656): n is a, c, g, or t
  misc_feature (659)..(659): n is a, c, g, or t
  misc_feature (687)..(687): n is a, c, g, or t
tcctctcccccgatcccaaatctctccctttctcntctcccttgctcgatctacagagagaagaattcgtccatcgccatggctctcctcgtagagaagacctcctccgggcgcgagtacaaggtgaaggacctttcccaggccgacttcggccgcctggagatcgagctcgctgaggtcgaaatgcccggtctcatggcctgccgtgccgagttcggcccctcccagcccttcaagggcgcacgcatctccggctccctccacatgaccatccagaccgccgtcctcatcgagaccctcaccgccctcggcgccgaggtccgctggtgctcctgcaacatcttctccacccaggaccacgccgccgccgccatcgcccgcgactccgctgccgtcttcgcctggaagggcgagacnctccaggagtactggtggtgcaccgagcnntgnctngactggggcncngcnggcggccccgacctcatcgtcgacgacggcggngacgccaccctcctcatccatgagggcgtcaaggccgaggaggagtacgagaagaccggnaagntgcccganccggcctccaccgacaacgccgagttccagatcgtgctggggctcatcngggacagcntcaaggtggatcccaanaagtaccncangatgaaggagaggctcgtcggcgtctcngaggagaccaccaccggcgtcaagaggctctaccagatgcaggccagcggtaccctcctcttcccggccatcaacgtcaatgactccgtcaccaagagcaagttcgacaatctctatggttgccgccactctcttcctgatggcctgatgagggccactgatgtgatgattgccggcaaggttgccgtggtctgtgggtatggagacgtcggcaagggctgtgctgctgccttgaagcaagctggagcccgggtgattgtcacagagatcgaccccatctgtgctcttcaagccctgatggagggcatccctgttctcaccctggaggatgtggtctcagaggctgatatctttgtgaccacaaccggtaacaaggatatcatcatggtcaaccacatgaggaagatgaagaacaatgcaattgtctgcaacattggccactttgataatgagatcgacatgcatgggctggagacctacccgggcgtcaagcgcatcaccatcaagccccagactgatcgctgggtattccctgacaccaactccggcatcatcgtgcttgctgaggggcgtctgatgaaccttggttgtgccaccggccatcccagctttgtcatgtcatgctccttcaccaaccaggtgattgctcagctggaactgtggaaggagagggcaagtggcaagtatgagaagaaggtgtatgtgctgcccaagcatctggatgagaaggtggcagcccttcatctgggcaagctgggagccaagctaaccaagctcacaccggcccaggccgagtacatcagtgttcctattgagggcccctacaagcctcctcactacaggtactagaaaggatgggactaatgacaagcagcagcaacagcagctgcctaaaaaacaaccaccgcaactcgagatgatttgggtgatgctatctccagtttcgtttctggtattatgagttaaaatattaatttggttgcatttgaattcaaagatgaggaatgaggaagtcatgttttggtaagaataatgaggttgccagaggtggtgtaatggccagatatgtttctatctttggctctttcttgatcacaatttggaaggcaacgcgccgtcacttagcatcttcggttatattttaccctctcatattcgttggctct

SEQ ID NO: 7878 - DNA, 2161 bp, Picea glauca
cccccccccccccacactcttcgttggagctaatcgaccagagttcgaatcctgctccgcgagccccttctatcttggtcacggtatttcgcatttagatcgctgtgatttgcatctaggtagccgaaatacgcggttttaccttagatctgcgtgttttcggccctgtctctgagcagcaatggcgcttttagctgagaaaacggtgtccggaagggaatacaaggttaaggatatgtctcaggcggactttgggaggctggagatcgaattggccgaagttgagatgcccggactgatggcctgccgggtcgagttcggtcccgcccagcccttcaagggcgcccggatcacgggttccctccacatgacaatccagacagctgttctcatcgagactctcaccgcccttggggccgaggtgagatggtgctcctgcaacatattctccactcaggaccacgccgcgtccgccatcgcccgcgatagtgcagcggtgtttgcctggaagggggaaacactgcaggagtactggtggtgcaccgagagggctcttgactggggccccggcggtggcccagatctgattgtcgacgatggtggcgacactacccttctgatccatgagggagtgaaggccgaggaagagttcgccaagactgggaaggtgccggatccggcctctaccaccaatgtggagtttcagattgtgttggcgttgatcaaggaaagcctcaaggtggatccattgaggtatcacaggatgaaggacaggattgttggtgtgtctgaggagacaactactggggttaagaggctttaccagatgcagaattctgggtccctgttgttccctgctatcaatgttaatgattctgttaccaagagcaagtttgacaacttgtatggatgtaggcactctctcccagatggtcttatgagagctacggatgtcatgattgctggtaaggttgctgttgtttgtgggtatggagatgttggcaagggttgtgctgcagccatgaaggttgctggagctagggtcattgttacagagattgatcctatctgtgccctgcaagctcttatggaaggccttcctgttctgaccctagaggatgtagttagcactgctgatatctttgtgacaaccactggtaacaaggacatcatcatgctggatcagatgaggaaaatgaagaacaatgccattgtttgtaacattggtcactttgacaatgagattgatatgcaaggccttgaaaatttccctggtgttaagaagattaccatcaagcctcagacggataggtgggtgttccctgacaccaagagtggcatcattgttcttgcagagggacgtctgatgaacttgggttgtgcaactggccacccaagttttgtcatgtcttgctcctttacaaaccaggtcattgctcagttagagctctggaacgagaggaaatcaggaaagtatgagaagaaggtctatgtgctgccaaagcatctagatgagaaggtggctgctctgcacttgcctaagttgggtgccaagctaacaaagctttctcctgatcaggcagagtatatcaatgtgcctgttgagggaccttacaagcctgcccactaccgatactgaaaagatctaacatttcggatgacttgttgggtgtcttcgctgttttgccaatgaagaaactagcatttctttgtggcagctcggttgttttgagggaccttacaagcctgctgactacatactgaagagaggtgacattttgggagaggcctgttgggtgagtaccaagaatcaaatctcctcgacatataaagatccggcctctctttgtaggcagctccattgttttgttagaattataataaaacttttctatcgtttgtatgcgtggctgctgaattccttgcagcatcacataaagttttttcttttcttctcggtgtatggtttaatagtttagttcgtattggaggtttctgccaatgtggcatttgtattgctcaaaattccgaatggaagcaaaaatataaggatgcctctgggtttttgatccaacactggtattttatgattcaaatgaattttaggtcgaggaccgcaattttcacactaataatctcatggatatgcattttcgatgct

SEQ ID NO: 7879 - DNA, 1812 bp, Eschscholzia californica
gaatattacccagcatttgtctcctagctcggatcctcttctctctctaggttttcatttctctgagaaattctatagcagttttctcagatctaggtttaacgatggctcttatcgtcgagaaaaccgcttccggccgtgaatacaaggtcaaggatatgtctcaggctgacttcggtcgtcttgagcttgagcttgccgaagttgagatgcctggtctcatgtcttgccgaactgagttcggtccatctcaaccattcaaaggtgctcgtatcactggatctcttcacatgaccatccaaaccgccgtcctcatcgaaaccctaactgctctcggtgctgaagttcgttggtgttcatgtaacatcttctccactcaggatcacgccgctgctgcaattgctcgtgacagcgccgccgtgttcgcctggaaaggtgagactcttcaggaatactggtggtgtaccgagagagctcttgactggggtcccggtggtggtccagatctgatcgttgatgatggaggtgacgctactcttttgatccatgaaggagttaaggccgaggaagaatacgagaagagtggaaagattcccgatccaacttcaactgataatcccgagttccagattgttcttcagatcattaaagatggattgaaagaagatcccaagaagtaccacaagatgaaggacagattggttggtgtttctgaggagactaccactggtgtcaagagattgtaccagatgcaacagagcggaactttgttgttcccagccatcaatgttaacgactccgtcaccaagagcaagtttgacaacctttacggatgccgtcactctctccctgatggtctcatgagggcaactgatgtcatgattgccggtaagatcgctctcgttgctggatacggagatgtcggaaagggttgtgctgctgcccttaagcaagctggtgcccaggtcattgttacagagattgaccccatctgtgcccttcaagctctcatggaaggtatcccagttcaaacccttgacgatgtcgtatctaaggtagatatttttgtcaccaccaccggaaacaaagacattatcatggttgatgacatgaggaagatgaagaacaacgccattgtctgcaacattggtcactttgacaatgagatcgacatgcttggtcttgagactttcccaggagttaagaggatcacaatcaaaccccagacagacagatgggtattccctgataccaagaccggcatcattattcttgccgagggacgtttgatgaacttgggttgtgccactggtcaccctagtttcgttatgtcctgttcattcactaaccaggtgatcgctcagttggaattgtggaacgagaggaaaactggcaagtacgggaaagaagtttacgtgttgccaaagcatctagacgagaaagttgcagcccttcaccttggcaaactaggagctaagctcactaagctctcaaaggatcaagctgactacatcagtgttcctgtcgagggaccatacaagcctgctcactacaggtactgagaggacaaaagaagaagaatggtggttttattttgattattagaattgtttgttgaggtcatgccttttatgttctaggcaatgagagggtctattttgaacttattttgctgttctcttttactttatgataatatggtggccgagcctagggtgttcttaatgtgtctttggattttgttaatggattccaatttggccctggtttgccatatacatttgtgttttaatctgaagagaaatgtctttt

SEQ ID NO: 7880 - DNA, 1773 bp, Lactuca sativa
ctcggcgggggcttacccaccctttctctgagagcctccagatccgatctacaaaccctcatcaaccatggctctcaccgtcgagaaaacctccaccggccgtgagtacaaagtcaaggacatgtccttggccgacttcggccgcctggaactcgaattagccgaagttgaaatgcccggtctcatgtcttgcaggacagaattcggtccttctcagcctttcaagggtgccagaatcactggctccctccacatgacaatccagaccggtgtcctcatcgagaccctcaccgccttgggtgccgaggttagatggtgctcctgcaacattttctcaactcaagaccatgccgcctccgccatcgctcgtgattccgctgccgtgttcgcctggaaaggggaaactctacaggagtactggtggtgcacagagcgtgctctagattggggtcccggcggtggtcccgatttgatcgttgacgatggtggtgacgcgacgctgttgatccacgagggagtcaaggctgaggaggagtttgagaagaccggaaaattgcccgatcccacttccacagacaacgctgagttccagatcgtgttgtcgatcattaaggaaggtcttgcagtcgaccctaagaagtaccacaagatgaaggaaagattggtcggtgtctctgaggaaaccaccactggtgttaagaggttgtaccagatgcaagccaatggtactctgcttttccctgccatcaatgtcaatgactctgtcaccaagagcaagttcgacaacttgtacggatgccgccactcactcccggacggtctcatgagagccaccgacgtcatgatcgccggaaaggtcgccgtcgtctgcggatacggagacgtcggaaagggttgcgccgccgccatgaagcaagccggagcacgtgtcatcgtgacagaaatcgacccaatctgcgccctccaagccaccatggaaggtctccaagtcctccccttggaagacgtcgtctccgacgccgacatcttcgtcaccaccaccggaaacaaagacatcatcatggtctccgacatgaggaagatgaagaacaacgccatcgtctgcaacatcggccatttcgacaacgaaatcgacatgctcggacttgaaacctacccaggtgtgaagcgcatcaccatcaaaccacaaactgacaggtgggtcttccctgaaaccaaaactggaatcatcatcttggctgaaggtcgtctcatgaacttgggttgcgccactggtcaccctagctttgtcatgtcatgctctttcaccaaccaagttatcgctcagcttgaactatggaaggagagaaccaccggaaagtacaagaaggaggtgtatgttctacctaaacatcttgatgagaaggtcgctgcacttcatcttgctaagcttggagctaagttgacaattctcagcaaagatcaagctgattacatcaatgttccagttgaaggtccatacaagcctcttacttacaggtactaagaagtgtttgctgctttttgaaagtgattttgaagagaggaatttgaggaaggaaatatggtttagttttgtttgttggattttaatggtggtgtttggttgggagaagaaactgattggtctttttttgttaaaaggctttggtttgaataagggttgagtgtgaaaggtttgtgtaacacaaatagtagttgtttttgggtagaggtcttgctttttgttgctttttggttaattcatgaggagat

SEQ ID NO: 7881 - DNA, 1849 bp, Cedrus atlantica
atctcggtcgctgtaatccgtggtctctctcagatctgcgtgatcaattttagcagcaatggcgcttcttgccgagaaaacggtatccggaagggaatacaaggtgaaggacatgtcccaggcggactttgggaggttggagatcgaattggcggaagttgagatgccaggattgatggcctgcagggttgagttcggtcccgcgcagcccttcaagggtgcccggatcacgggctccctccacatgacgatccagaccgcggtgctcatcgagacactcacggctctgggcgccgaggtgagatggtgctcctgtaatatcttctccacgcaggaccacgccgccgcggccattgcccgcgacagcgctgcggtgttcgcttggaagggggagacgctgcaggagtactggtggtgcaccgaaagggctttggattggggtccaggcggtggccccgatctgattgtcgatgacggtggcgatgcaacgttgttgatccatgagggggtcaaggcggaggaggagtttgccaagtccggaaaggtgccggatccggagtctaccaccaatgttgagtttcagatggtgttggggttgatcaaggagagcatcaaggtggatcctttgagataccacaggatgaaggataggttggttggtgtgtctgaggagactactactggtgttaagaggctttatcagatgcaggctagtgggactctgctgttccctgctatcaatgtcaatgactctgttaccaagagcaagtttgataacttgtatggatgtagacactctcttccagatggtctgatgagagccacagatgtcatgattgctggtaaggttgctgttgtgtgtggttatggagatgttggaaagggttgtgctgcagccctaaaggttgctggagctagggtcattgttacagaaattgatcctatctgtgccctgcaagctcttatggaagggcttccagtcctgaccctagaggatgtagttagcacagctgatatttttgtgaccaccactggcaacaaggacatcattatgctggatcacatgaggaaaatgaagaacaatgccattgtttgcaacattggtcattttgacaatgagattgacatgcagggccttgaaactttcccaggtgttaagaagattaccattaagcctcagacggataggtgggtgttccctgacaccaacagtggcgtcattgttcttgcagagggacgtctgatgaacttgggttgtgctactggccacccaagttttgtcatgtcttgctcctttacaaaccaggttattgcccaattggagctctggaacgagaagaagtcagggaagtatgagaagaaggtctatgtgcttcctaagcatctagatgagaaggtggctgctctgcacttgcccaagttgggtgccaagctaactaagctttctcctgaacaggcagagtatatcaacgtgcccgttgagggaccttacaagcctgcccactaccgatactgaagagcgatgacattttgggtgacttgttgggtgagtagcaaggctcccggacagttgccaatagaagaacgaagccccctccatggccagctccattgttttgttccaatttcaataaaatattgtttgtttgtatgtgtctgttgagcttattagagcagccaccttctgatctagaagcttaggcagcaccgaaagtttttctgtttagtatggtcatatgataaaagtagtttacaatagaattggtattcgacgaggtttctagatgatgtagctagcttttgtatcattgaaatttcagaatttaagccaagaatatatggttactgg

SEQ ID NO: 7882 - DNA, 1588 bp, Vinca minor
taaacttcttccatcttcgctctctttctcctcctctgaaaaccatttctctaaaccctaagcccgacccgtacccgaagaacgccatggctctatctgtggacaaaacctcatcgggccgtgaatacaaggtcaaggacatgtctcaggccgacttcgggcggctcgaactcgaactcgccgaagttgaaatgcctggactgatggcttgtcgggccgagttcggatcatctcagccattcaagggtgctcgcatcacgggctccctccacatgactattcagaccggcgtcctcattgaaaccctaactgcccttggcgcctccgtccgctggtgctcttgcaatattttctccactcaggaccatgccgccgccgccatcgcccgtgattccgccgccgtctttgcctggaagggtgaaactcttcaggagtactggtggtgtacggagagggcattggattggggttcagagggaggaccagatttgattgtggatgatggtggcgatgctactttgttgattcacgagggagtgaaagctgaagaagagtatgagaaaacagggaaggtgccggatccaagttccactgataatgctgagtttcagattgttttgacaattattagggatggattgaaggctgatcccaagaaataccacaagatgaaggagagattggttggtgtttcggaggagactaccactggtgttaaaaggctgtaccagatgcaggctaatgggacactattgttccctgctatcaacgtcaacgactctgttactaagagcaagtttgacaacttgtatggatgccgtcactcactccctgatggtctcatgagagccactgatgttatgatcgccggtaaagttgctgttgtctgtggttatggagatgttggcaagggttgtgctgctgctctcaagcaagctggtgcccgtgtcattgttacagaaattgatcccatctgtgcccttcaagctctgatggaaggtattcaagttttcaccttggaagatgtcgtctctgaagctgacatcttcgtgacaaccaccggaaacaaagacatcattatggttgatcacatgaggaagatgaagaacaacgcaattgtctgcaacattggtcactttgataatgagattgacatgcatggtcttgaaacctaccctggtatcaagcacatcgccatcaagccccaaactgaccggtgggttttccctgagactggaaccggaatcattgttcttgctgagggacgtttgatgaacttaggatgtgctaccggccacccaagttttgtgatgtcttgctctttcaccaaccaagtgattgcacaattggagttgtggaaggagaagacctctggcaagtacgagaagaaggtgtacgtgttaccaaaacatctcgacgagaaggtcgcagctcttcatttgggaaagcttggagctaagttaacaaagctcagtccagagcaagctgactacattagtgttccagtcgatggtccatacaagccagcacattacaggtactgagaagctacaaaagcagacgggaaagcaagctggtggtgcctttt

SEQ ID NO: 7883 - DNA, 2100 bp, Setaria italica
ccattccctcccagatccaatccgcgagctctccctccgcccgctgccatggcgctctccgtggagaagacctcgtcggggcgggagtacaaggtgaaggacctgtcccaggccgacttcggccgcctcgagatcgagctggcggaggtcgagatgccgggtctcatggcgtgccgcgccgagttcggcccgtccaagcccttcgtctcgggctccctccacatgaccatccagaccgccgtcctcatcgagaccctcaccgcgctcggcgccgaggtccgctggtgctcctgcaacatcttctccacgcaggaccacgccgccgccgccatcgcgcgggactcagccgccgtcttcgcgtggaagggggagacgctcgaggagtactggtggtgcaccgagcgatgcctcgactggggtgagggcggcggccccgacctcatcgtcgacgacggcggcgacgccacgctactcatccacgagggcgtcaaggcggaggaggagtacgagaagaccggcaaggtccccgacgccgagttcaagatcgtgctcaccatcatccgcgacggcctcaagtccgaccccaagaggtaccgcaagatgaaggagaggctcgtcggcgtctccgaggagaccaccaccggagtcaagaggctctaccagatgcaggagaccggcaccctcctcttccccgccatcaacgtcaacgactccgtcaccaagagcaagtttgacaacctctatggttgccgccactccctccctgatggtttgatgagagccaccgatgttatgatcgctggcaaggttgcagttgtctgcggttatggtgatgttggcaagggctgtgctgctgccctcaagcaggctggtgcccgtgtcatcgtgactgagatcgaccccatctgtgcccttcaggccctgatggagggtcttcaggtccttaccttggaagatgtcgtctctgaagctgacatctttgtgactaccaccggcaacaaggacatcatcatggttgaccacatgaggaagatgaagaacaacgcaatcgtctgcaacattggtcactttgacaatgagattgacatgcacggtcttgagacctaccctggtgtcaagcgcatcaccatcaagccccagactgaccgctgggtgttccctgagaccaagactggcatcattgtcctcgctgagggtcgtctgatgaaccttgggtgcgctactggccaccccagctttgtcatgtcctgctcattcactaaccaggtcattgctcagcttgagctgtggaaggagaagagctctggcaagtatgagaagaaggtgtacgtgctccccaagcaccttgatgagaaggttgctgctctccacttgggcaagcttggtgccaggctcaccaagctcagcaagtctcaggctgactacatcagtgtcccgattgagggtccctacaagcctgctcactaccggtactaggcagcacgacaagaagttcactctggttgtgttgtgtgccggtatgaagttcgctacaccggcttgtcaattaacttttgcatggatatcaaatgcgccgttggcgtaggagggtcatcgcttgagcctggttgagtggggagaggagggaagagctgtttgcttttgcggaagaataatggcgtaattggtcgtggggtgaagcgggcgtgcgttgccagaaactataccgtttctgattatcatttgcaagcgatttattctagttatgtgtctttcatgaataacttgctttctttaagagcatatttagtcagatactgagttttgcatatgtctgtttcgttgagttatccagcaagctcgtcgtgccttctcggttcattctcttctattgtgtctctgtatgccgtttaggaaatgcattaattcatgcctgttctacgaattctgatagcatgtggatgggtcagctgagctttgctagagtttttgaatggtggtgtcatgtgcttcagcttgcctgtcgggggtggcatttccgttgccaatgtgtgcaagttccttgaaaaacctggtctgccacagccgacaggcaagctgaagcacatgacaacaccattc

SEQ ID NO: 7884 - DNA, 1970 bp, Papaver somniferum
cttctttctcttcgttttacagagaaagaaagaattttcattacttatttagtttcttcgttgttcttcagatctttgtagcaatggcgttagttgtggagaaaacctcaacaggtcgtgagtacaaagttaaagacatgtcccaagctgatttcggcaggctcgaaatcgaattagccgaagttgaaatgccaggattgatgtcttgcagaactgaattcggcccatcacagccattcaaaggagcaagaattactggttcactccacatgacaattcaaactgctgttttaatcgagactttaaccgcacttggtgctgaagttcgttggtgttcatgtaacattttctcaacacaagatcatgctgctgctgttattgctcgcgattcagctgctgttttcgcatggaaaggagagactttgcaagaatactggtggtgtactgagagatctcttgattggggtcctgatggaggtcctgatttgattgttgatgatggtggtgatgttacattgttgattcatgaaggtgttaaagctgaagaagagtatgagaaaactgggaaattcccagatcctacttctactgataaccctgagtttcagattgtgcttaccattattaaggatggattgaaggagaaccctaagaagtatacccagatgaagaacagaattgttggtgtttctgaggagactactaccggtgtgaagagattgtatcaaatggaacaaactggaactttgttgttccctgctatcaatgtgaatgactctgttaccaagagcaagtttgacaacctctacggatgccggcactcacttcccgatggtttgatgagggctactgatgttatgattgctggaaaggttgctgttgtttgtggttacggagatgtcggaaagggttgtgcctcagctcttaaacaagccggagctcgtgtaattgtgactgaaattgatccaatctgtgctcttcaagctttgatggaaggtcttcaagtcttgaccttggaagatgctatctcagaagctgacattttcgttaccaccacaggtaacaaagatatcattatggtttcagacatgaaaaagatgaagaacaatgctattgtatgcaacattggtcatttcgataatgaaatcgacatgaatggattagaaacatacccaggtgttaagagaatcaccatcaaaccacaaacagataggtgggtgttccctgaaactaagactggtatcattgttctagctgagggtagattgatgaacttgggttgtgcaactggtcatcctagtttcgtcatgtcttgttcattcaccaatcaagttattgcacaacttgaattatggaatgagaagacctctggtaaatatgagaagaaagtctatgttttgccaaaacatcttgatgagaaggttgcattgcttcatctcggaaagcttggtgctaaccttaccaggctttcaaaagaccaagctgactacattagtgtccctgttgatggtccatacaagcctgctcactacaggtactgagcagagaaagaaagtgatgttggatgagaaaattgaactcccgaagcggatgttagatttttttcttttttcttgtgttgtttagtggatgttggggtatggggttggtgggcgatttgaataaggggttggattaggtttgtgttgcgtttgctattgggaaaaaatattatgaatttgttttgtaattggtgatgcaaattttgatattcaaaactgttggaagtttggatatgtttgcatctgttctaatttcttccactatcatcatcaatttttattaattatataaatgaaaaaagattttttctataaaaactcgagggggccgtaccaatcgcctaagggtcgaatacatcctgcgtctttaaccgtttgactgaaaacctggcgtaacccaccttattcgcctggggaacaattttcccc

SEQ ID NO: 7885 - DNA, 1799 bp, Triticum aestivum
agatccaatccaccaacctcctccatggcgctctccgtggagaagaccgcgtccggccgggagtacaaggtgaaggacctctcccaggccgacttcggccgcctcgagctcgagctcgccgaggtcgagatgccgggcctcatggcctgccgcgccgagttcgggccctcgcagcccttcaagggcgcccggatctccggctccctccacatgaccatccagaccgccgtgctcatcgagaccctcaccgcgctcggcgccgaggtccgctggtgctcctgcaacatcttctccacgcaggaccacgccgccgccgccatcgcccgcgactcggccgccgtcttcgcctggaagggcgagaccctcgaggagtactggtggtgcaccgagcgctgcctcgactggggcgccggcggcggccccgacctcatcgtcgacgacggcggcgacgccaccctgctcatccacgagggcgtcaaggccgaggaggagttcgagaggtccggcaaggtccccgacccggactccaccgacaaccccgagttcaagatcgtgctcaccatcatccgcgacgggctcaagaccgacgcccgcaagtaccgcaagatgaaggagaggctcgtcggcgtctccgaggagaccaccaccggcgtcaagaggctctaccagatgcaggagtccggcaccctcctcttccccgccatcaacgtcaacgactccgtcaccaagagcaagtttgacaacctttacggttgccgccactcgctccctgatggtcttatgagggccactgatgttatgatcgccggcaaggttgctgtggtctgcggttatggtgatgttggcaagggctgtgccgctgcactcaagcaggctggtgcccgtgtgatcgtgacagagattgaccccatctgcgcccttcaggccctgatggagggcatccagatcctcactttggaggacgttgtctctgatgctgacatctttgtgaccaccactggaaacaaggacatcatcatggttgaccacatgaggaagatgaagaacaacgccattgtctgcaacattggtcactttgacaacgagatcgacatgaacggcctcgagacctaccctggtgtcaagcgcatcaccatcaagcctcagactgaccgctgggtcttccctgagaccaacactggcatcattgttcttgctgaggggcgtctgatgaaccttggctgtgccactggccaccccagctttgtcatgtcctgctcattcactaaccaggtcattgctcagctggagttgtggaaggagaaggccaccggcaagtacgagaagaaggtgtatgttctccccaagcacctcgacgagaaggtcgcggccctccacctgggcaagctgggtgccaggctgaccaagctcaccaaggcccagtctgagtacattagcatcccagtcgatggtccctacaagccggcggcataccggtactagtgtgtctgtccagcacgactagcggctggcctgagcctgagcggcgcacggcgacctatgaactatcctgttttcctttgcattatctatctagatttaggcatgttgtctattaggtggaggatttgtcatggtttgagactggtgagggtgtggtggattgctattgcccagaaataatagtgttattattttggtttaaatgaggaggtgtgttttgtccttctgattctacatgtctgatgctccgtccatggacgtgacaaatcttttgcctccgtttcggaaaaagaatagtccgtgagtggtgtgatgtg

SEQ ID NO: 7886 - DNA, 1964 bp, Pseudotsuga menziesii
atcccgtttccattcctcgcacactccattggagccaatcgacctaagttcgaatcctcctcgactcgatcgctgtaatctgtgttctatctcagatctgcttgagtttttcagcagcaatggcgcttatttccgagaaaacggtgtccggacgggaatacaaagtgaaggacatgtcccaggcggactttgggaggctggagatcgaattggcagaagttgagatgcctggattgatggcctgcagggctgagttcggccccgcgcagcccttcaagggtgctcagatcaccgggtccctgcacatgacgatccagaccgctgtgctcattgagacgctcacggctctgggcgccgaggtgagatggtgctcctgcaatatcttctctacgcaggaccacgccgccgcggctattgcccgcgacagcgctgcggtgtttgcttggaagggggagacgctgcaggagtactggtggtgcactgaaagggctctcgactggggtcccggcggtggccctgacctgatcgtcgatgacggtggcgacgcaacgttgctgatccatgagggggtgaaggccgaggaagagtttgctaagaccgggaaggtgccggatccggagtctaccaacaatctggagtttcagatggtgttggggttgatcaaggagagcatcaaggtggaccccttgaggtaccacaggatgaaggataggttggtcggtgtgtctgaggagactactactggtgttaagaggctttatcagatgcaggccagtggaactctgctgttccctgctatcaatgtcaatgactctgttaccaagagcaagtttgataacttatatggatgtagacactctctcccagatggtctgatgagagccacagatgtcatgattgctggcaaggttgctgttgtatgcggttatggagatgttggaaagggttgtgctgcagccctaaaggttgctggagcaagggtaatagttacagaaattgatcctatctgtgccctgcaagctctgatggaaggccttcctgtcctgaccctggaggacgtagtgagcactgctgatatttttgtaaccaccactggcaacaaggacatcatcatgttggatcacatgaggaaaatgaagaacaatgccattgtttgcaacattggccattttgacaatgagatagacatgcaaggacttgaaactttccccggtgtcaagaagattactatcaagcctcagacggataggtgggtgttccctgacaccaacagtggcatcattgttcttgcagagggacgtttgatgaacctgggttgtgctactggccacccaagttttgtcatgtcttgctcctttacaaaccaggttattgctcagttggagctctggaacgagaagaagtcaggcaaatatgagaagaaggtctatgtgctgcctaagcatctagatgagaaggtggctgctctgcacttgcctaagttgggtgccaacctaacgaagctttcacctgaacaggcagagtatatcaacgtgcccgttgagggtccttacaagcctgcccactaccgatattgaagagaaatggcattttaggcgacttgttgggcgagtagcaagactcccggacagttgccagtagaagaaccaagctccctccgtttgcagttccatttgttttgttccaattttaataaaaacattgatcttgtttgttggtctgtctgctgagtttattacagcagagcaccgaatattagttccgtttattgtggtcatattagctaggtctgtctgatgtagctaggtcctatgtatttctgaaattccagaatgtaagcaagaatatatggttccctcttggtttttgatctattcgaggtttctacatgatgtagctaggtcctatgtatttctgaaattccagaatgtaagcaagaatatatggttccctcttggtttttg

SEQ ID NO: 7887 - DNA, 1888 bp, Podocarpus macrophillus
gaaagcagcccgctgtagatctgtacgctttgcttgtagagatctctccaagtctgttgtttagcaatggcgcttttggtggagaaaaccgtggcgggaagagagtacaaggtgaaggacatgtctcaggcggacttcggtcgcttggagattgatctggcggaggtggaaatgccagggcttatggcgtgccgtgctgagtttgggccaactcagccattgaagggggccagaattactggatcccttcatatgaccattcagactgcggtgctcattgagactcttactgctctgggagctgaagtcagatggtgctcctgcaatattttttcaactcaggaccatgctgctgctgccattgcccgtgacagtgccgcggtatttgcctggaagggggagaccctccaagagtactggtggtgtaccgagagagcccttgactggggccctggcggtggcccagatttgattgtggatgatggaggtgatgcgacattgttgatccatgagggagtgaaggccgaggaagagtttgccaagtccgggactctcccagatccctcctcaactaccaatcctgagttccagattgttttggggttgatcaaggatagtcttaaggtggatccccagaggtaccaaaagatgaagcaaaggttggtgggtgtgtctgaggagacgactactggtgtccacaggctttatcagatgcaggccaatggatctctactcttccctgccattaatgtcaatgactctgttactaagagcaagtttgataacttgtatggttgcagacactctcttcctgatggtctgatgagagccacagatgtgatgattgctggtaaggtcgctgttgtatgtgggtatggagatgttggcaagggctgtgccgctgccatgaaggctgctggagctagggttattgtaacagaaattgacccaatttgtgctctgcaagccctaatggaaggtattcctgttttgaccctggaggatgttgtaagcactgctgatatctttgtgacaaccacgggtaacaaagatattatcatggttgatcatatgaggaagatgaaaaacaatgccattgtttgcaatattggtcactttgataatgagattgacatgcacgggcttgaaacctatcctggtgtgaagaagatcaccattaagcctcagaccgaccgatgggtgtttcctgaaaccaacactggcatcattgtccttgcagaggggcgacttatgaatttgggttgtgctactggccaccctagttttgtcatgtcttgctccttcacaaaccaggttattgctcagctggagctttggaacgagaggaaatcagggaagtatgagaagaaggtgtatgtgttgcccaagcatctggatgagaaggtggctgctcttcatttgcccaagcttggagccaaactaacaaaactcactccagatcaggctgcatacatcaatgttcctgccgaaggtccttacaagccagcccactatcggtactgatcaaaattacgttttctgcattatttgttcgaccggatgtagtgttcaattctagggattaggagcaaaggccaattttggcatctccattattttcaattaactataataagaaatgagaggtctattgtattggaggcgtgtctgctgaatttacaatagcagcacatgcttggattttatggttgaagttggatatttgaaatctgtataaggtttggttaatatttggattttgtattattggaaacctagaatgaaagcacaaatctatgggtataatattggttatggcatagtttcatattacttttgagtttcagatttttgtcctccataatcggatgaaatggtaatgttttag

SEQ ID NO: 7888 - DNA, 1521 bp, Lactuca sativa
cggcgggggcttacccatcctttctctgagagcctccagatccgatctacaaaccctcattcaccatggctctcacagtcgagaaaacctccaccggccgtgagtacaaagtcaaggacatgtccttggccgacttcggccgcctggaactcgaattagccgaagttgaaatgcccggtctcatgtcttgcaggacggaatttggtccttctcagcctttcaagggtgccagaatcactggctccctccacatgacaatccagaccggtgtcctcatcgaaactctcaccgctttgggtgctgaggttagatggtgctcctgcaacattttctcaactcaagaccatgccgcctccgccatcgcccgtgattccgccgccgtgttcgcctggaagggggaaactctacaggagtactggtggtgcacggagcgtgctctagattggggtcccggcggtggtcccgatttgatcgttgacgatggtggtgacgctactctattgattcacgagggagtcaaggctgaggaggagtttgagaagaccggcaaattgcccgatccgacttccaccgacaacgctgagttccagatcgtgttgtcgatcattaaggaaggtctagcagtcgaccccaagaagtaccacaagatgaaggataggttggttggtgtgtctgaggaaaccaccactggtgttaagaggttgtaccagatgcaagccaatggtactctgcttttccctgccattaatgtcaatgactctgtcaccaagagcaagttcgacaacttgtacggatgccgtcactctctccccgacggtttgatgagagccactgacgtcatgatcgccggaaaggtcgcagtcgtctgcggatacggagacgtcggaaagggttgcgccgccgcaatgaagcaagccggagcacgtgtcatcgtgacagaaatcgacccaatctgcgccctccaagccaccatggaaggtctccaagtcctccccttggaagacgtcgtctccgacgccgacatcttcgtcaccaccaccggaaacaaagacatcatcatggtctccgacatgaggaagatgaagaacaacgccatcgtctgcaacatcggccatttcgacaatgaaatcgacatgctcggacttgaaacctacccaggtgtgaagcgcatcaccatcaaaccacaaactgacaggtgggtcttccctgaaaccaagaccggaatcatcatcttggctgaaggtcgtctcatgaacttgggttgcgccaccggccaccctagtttcgtgatgtcatgctctttcaccaaccaagttatcgctcagcttgagttgtggaaggagagaaccaccggaaagtacaagaaggaggtctatgttctacctaagcatcttgatgagaaggttgctgcacttcatcttgcaaagcttggagctaagttgacaattcttagcaaagatcaagctgattacatcaatgttccagttgaaggtccatacaagcctcttacttacaggtact

SEQ ID NO: 7889 - DNA, 1598 bp, Gossypium hirsutum
acattgccatttaccactctgcctttctttttctatcattgctacgttgatcgtttctttaccaggggtgattttgtgtgctttgttctcacttttcacttccaccaatggctctttcagtcgataaaacctccggcggccgtgaatacaaggtgaaagacatgtctcaagccgattttggccgtctcgagatcgatttagccgaggtcgaaatgcctggtctaatggcatgtagaactgaattcggcccttctcaacctttcaaaggagccaaaatcacgggttcacttcacatgacaatccaaaccgccgtcctcatcgaaaccttaaccgcattaggagccgaagtccgttggtgttcttgcaacattttctcaacccaagaccacgccgccgccgtcatcgctcgtgactccgcttctgtattcgcttggaaaggcgaaacactccaagaatactggtggtgtaccgagaaatccctcgattggggtgccggtggtggacctgatttgattgttgatgatggtggggatgttacgatgttgatccatgaaggggttaaagctgaggaagcttatgagaaaaccgggaaggtaccggacccgacgtcgagcgataacgctgagtttcagatcgtattgacgataattaaagatgggttgacagcaaatccgaagaaatatacgaagatgaaggagagattggttggtgtttctgaagaaaccacgactggggttaaaaggctttatcaaatgcaggctaatggaaccttgttgttccctgctattaatgtcaatgactctgtcaccaagagcaagtttgataacttgtatggttgccgccactctcttcctgatggtttaatgagagccaccgatgttatgattgccggaaaagtcgccgttgtctgcggttacggtgatgtcggcaagggttgtgcctcagccttgaaacaagccggagctcgtgtcatcgtgaccgagattgatccaatctgtgcccttcaagctcttatggaaggactccaagtcctaactcttgaagatgttctttcaacagctgatatctttgtcaccacaacaggtaacaaggacatcatcatggttgatcacatgaagaagatgaaaaacaacgccatcgtttgcaacatcggtcatttcgataacgagatcgacatgttaggcctcgagaattatccaggtgtcaaacgaatcaccatcaagcctcaaaccgataggtgggtattccccgataccaagacaggtatcatcgtgttagccgaaggacgtctcatgaacttaggatgtgctaccggtcatcctagcttcgtcatgtcttgttcgttcacgaaccaggtgattgcacagctcgagctatggaaggagaaatcaaccggaaaatacgagaagaaggtttacgttttgccgaaacatctcgatgagaaagtcgcttctcttcaccttgggaaacttggggctaagctcactaagcttaccaaggaccaagctgactacattagtgtcccaattgaaggtccttataagcctcctaattacaggtactgaggagagaatttgaggcagaattcaataacgaaa

SEQ ID NO: 7890 - DNA, 2183 bp, Pseudotsuga menziesii
agagttcgaatcctgctccgcgaataacttctcttattcggatttcagtaattcgcatctgggtcgcggtgctacgtatccagtttgctgaaattttctgcttctctaagatcttgttttcttcccagtctctttgtagcaatggcgcttttggctgagaaaacggtgtccggaagggaatacaaggtgagggacttgtctcaggcggacttcgggaggctagagatcgaattggccgaagtcgagatgcccggactgatggcctcccgtgtcgagtttggccccgcccagcccttcaagggtgcccggatcactggttctcttcacatgacgatccagaccgctgttctcatcgagaccctgactgctcttggggccgaggtgagatggtgctcctgcaacattttctctactcaggaccacgccgccgctgccattgcccgtgatagcgcagcggtgtttgcctggaagggggaaacactgcaggagtactggtggtgcaccgagagggctctcgactggggtcccggcggtggcccagatctgattgttgacgatggcggtgacactacccttctgatccatgagggagtcaaggctgaggaagagtttgccaagaccgggaaggtgccagatccggcttctaccaccaatccggagtttcagattgtgttaggcttgatcaaggaaagtctcaaggtggatcccctgaggtaccacaggatgaaggataggattgttggtgtttctgaggagactactactggagttaaaaggctttaccagatgcagaattctgggtccctgctgttccctgctatcaatgttaatgactctgttacgaagagcaagtttgacaacttgtatggatgtaggcactctctcccagatggtcttatgagagctacagatgttatgattgccggtaaggttgctgttgtgtgtgggtatggagatgttggaaagggctgtgctgcagccatgaaggttgctggagctagggttattgttacagagattgatcctatctgcgcacttcaagctcttatggaaggcctccctgttctcaccctagaggatgtggttagtactgctgatatttttgtgacaaccactggtaacaaggacatcatcatgctagagcacatgaggaaaatgaagaacaatgccattgtttgtaacattggtcactttgataatgagattgatatgcaaggccttgaaagtttccctggtgttaagaagattaccatcaagcctcagacggataggtgggtgttccctgacaccaaaagtggcatcattgttcttgcagagggacgtctaatgaacttgggttgtgcaactggccacccaagttttgtcatgtcctgctcctttactaaccaggtcattgctcagttagagctctggaacgagaggaaatcaggaaagtatgagaagcaggtatatgttctccctaagcatctggatgagaaggtggctgctctgcacttgcctaagttgggtgctaagctaacaaagcttagtcctgatcaggcagcatatatcaatgtgcctgttgaggggccttacaagcctactcactaccgatattgaaaagttccgatatttcggaagacttgttgggtcggttgcaatgtcctcggggtttgctgatggaagaaactagctattctttgtggcagctccgttgttttgaagcaccttacaagcctactgactgcatactctgagagacctctgttggtagtacgaagtagcgaaagctccttgacataaaaaagatctagtcggtctttgtcgcatctccattattttggcagaattacaataaaattttgctatcgtttgcctgtgtggctgtgaatttcgtacagcataacacgagttttccttttattatcgttatttggtttagtagtttagtatggagtttgtattggacgtttctgccaatgtggcttttgtatccctcagatatccctcagaattcagaatggaagcaaaaatatatggatgcctcttggctttcaccgaacactggcattttatgattcaaatgaattttagttgaggactgcaatttttctctcaaaaaatgttatgggtatgcatctcttcgttgctgttaaaaccgagtaatttgagtgataatttaagtgcttatgaaacgatgaaaa

SEQ ID NO: 7891 - DNA, 1826 bp, Orobanche aegyptiaca
taaacccgtacaactgataggccacccatttctcagatccaattctttcttgtttgatactcgcaaaaacaaatggcgctcctagtggagaagacaacttgcggccgcgagtacaaggtcaaggatatgagccaggctgatttcggccgcctcgaaatcgaactcgcagaggtcgaaatgcctggactgatgtcctgtcgttacgaattcgggccctcacagcccttcaaaggcgccaagataacgggcagccttcacatgaccatccaaaccgccgtgttgatcgaaaccctaactgcattgggcgcagaggttaggtggtgttcctgcaacatcttctccactcaagaccatgccgctgctgcaatagctcgcgacagcgccgctgtgttcgcctggaaaggggagaccctacaggaatattggtggtgcactgagagggccctcgattggggacccagcggtgggccagatctgattgtggatgacggtggtgatgctactctgttgatccacgagggtgtaaaggctgaggaggagtacatgaagtccggaaagctgccagatccgagctcaacggacaactctgagtttcagattgtgttgaccataattagagatgggctgaaggttgatcccaagaagtacaccaggttgaaggagagattggttggtgtttctgaggagaccaccactggtgttaagagattgtatcagatgcaggctaatggcacccttcttttccctgctattaatgtcaatgattctgttacgaagagcaagtttgacaatttgtacggatgccgccactcgctacctgatggactgatgagggccactgatgttatgatcgctggtaagatgggtgttgtttgtggttatggagatgttgggaagggctgtgctgttgccttgaaacaagctggtgcccgcgtgattgtgacagagattgatccaatctgtgcccttcaagctctcatggaaggatttcaagttctgacccttgaggatgtggtttctgaggctgatatctttgtcaccactactggtaacaaggacatcatcatggttgaccatatgaaaaagatgaaaaacaatgccattctctgcaacattggtcactttgacaatgagattgacatgcttggtctcgagacattcccaggcgtgaagagaatcatgattaagccacaaacagacagatgggtcttcccagagacaaatactggcatcattgtgttggctgaaggtcgtctaatgaacttaggttgtgccacaggacatccgagcttcgtcatgtcatgctcttttactaaccaagtcattgcccaacttgagctatggaaggagagaaacaccggaaagtatgggaaaaaggtttatgtgttgccaaagcaccttgatgagaaggttgcagctctccaccttggcaagcttggtgctaagttgactaaacttaccaaggatcaagctgtttacattggtgtgccggttgagggtccttacaagcctcttcactacaggtactaaaaggtgactgcggtgaattgagattataaagccctgtgttattcttttacagacttggttttgtgtttgattagtagctttgacagtttactgaggtttctttattttggagtttggtgtgtttgtggaggaagaaatggcctctcttgaagaccataatgtgctggacaaaacatttctatgttttgtatacagataaaatgtcacaaacataataaaaaagaaatcggaaccctcaactcctatccccaatttttggtttccaagggtaacggtcacattataaaattcaaact

SEQ ID NO: 7892 - DNA, 1645 bp, Selaginella moellendorffii
agatggctctatcggttgagaagactgccgccgggcgcgagtacaaggtcaaggatatgtcccaggcggattttggaaggctggagatcgagctcgctgaggtcgaaatgccgggccttatggcctgtagaaccgagtttggccccgcgcagccattcaagggagctcggatcactggctcgctccacatgacgattcaaacggctgttttgatcgagactctcacggcccttggtgctgaggttcgctggtgctcgtgcaacatcttctccacccaggaccacgctgctgccgcgattgctcgtgacagcgccgcggtgtttgcatggaaaggggagaacttgcaggagtattggtggtgcactgagcgtgctctcgactggggtgttggcggcggcccagatctcattgtcgacgatggtggcgatgccactttgctcatccacgagggtgtcaaggccgagaaggagtttgagaagaatggaacgctgccggatccgagctccaccactaaccaggagttccagatcgttcttggtattctcaaggagggcctccaggtcgatcccaagaggtaccacaagatgatggagaggcttgttggtgtttctgaggagaccaccactggtgtcaagaggctctaccagatgcagtcgaatggatcgctgctcttcccggctatcaatgtcaacgattcagtcaccaagagcaagttcgacaacctttacggctgccgacactctctccctgatggactcatgcgagcaactgatgtgatgatcgctgggaaggtcgcagtcgtcgctggatacggagatgtcggcaagggttgcgcctcagcaatgaaggccgctggagctcgcgtcattgtgaccgagattgatccaatctgcgctctccaggctctgatggagggtctcgaggtgctgactctggaggacgttgtctcggtggctgacatcttcgtgacaaccactggaaacaaggacatcatcatggtggaccacatgaagaagatgaagaacaacgccatcgtgtgcaacattggtcacttcgacaacgagatcgacatgctgggccttgagacataccccggcgtgaagaggatcaccatcaagcctcagaccgaccgctgggtgttcccggagacaggcaccgggatcatcgtccttgccgagggtcgtctcatgaacttgggctgcgcgaccgggcatcccagcttcgtcatgtcctgctctttcacgaaccaggtgattgcgcagctagagctgtggaacgagaggaagtccggcaagtacgagaagaaggtctacgttcttccgaagcacttggacgagaaggtggcggcgctgcatctgcccaagctgggtgccaagctgaccaagctctccgccgaccaggccgcgtacatcaacgttccagtggaaggtccatacaagcccgcccactaccgctactagagcgagcgcgcgtctctccccggatcgaacgggaggaaccgggaggtactcgagcaaaaaactccgagcttttaatcctttttcgttcgttactatttcttacgagagtggcaatgccaagctctcgcgttttgtctcactaaaagtttcttaaaaataacgatgttttgggctaagattgttta

SEQ ID NO: 7893 - DNA, 1711 bp, Selaginella moellendorffii
ccaaggcggcggcagcggcattcgacgctctcgcagctcagatctctctcgatctctcggcgctatcaagatggctctatcggttgagaagactgccgccgggcgcgagtacaaggtcaaggatatgtcccaggcggattttggaaggctggagatcgagctcgctgaggtcgaaatgccgggccttatggcctgtagaaccgagtttggccccgcgcagccattcaagggagctcggatcactggctcgctccacatgacgattcaaacggctgttttgatcgagactctcacggcccttggtgctgaggttcgctggtgctcgtgcaacatcttctccacccaggaccacgctgctgccgcgattgcccgtgacagcgccgcggtgtttgcatggaaaggggagaacttgcaggagtattggtggtgcactgagcgtgctctcgactggggtgttggcggcggcccagatctcattgtcgacgatggtggcgatgccactttgctcatccacgagggtgtcaaggccgagaaggagtttgagaagaatggaacgctgccggatccgagctccaccactaaccaggagttccagatcgttcttgggatcctcaaggagggcctccaggtcgatcccaagaggtaccacaagatgatggagaggcttgttggtgtttctgaggagaccaccactggtgtcaagaggctctaccagatgcagtcgaatggatcgctgctcttcccggctatcaatgtcaacgattcagtcaccaagagcaagttcgacaacctttacggctgccgacactctctccctgatggactcatgcgagcaactgatgtgatgatcgctgggaaggtcgcagtcgtcgctggatacggagatgtcggcaagggttgcgcctcagcaatgaaggccgctggagctcgcgtcattgtgaccgagattgatccaatctgcgctctccaggctctgatggagggtctcgaggtgctgactctggaggatgttgtctcggtggctgacatcttcgtgacaaccactggaaacaaggacatcatcatggtagaccacatgaagaagatgaagaacaacgccatcgtgtgcaacatcggtcacttcgacaacgagatcgacatgctgggccttgagacataccccggcgtgaagaggatcaccatcaagcctcagaccgaccgctgggtgttcccggagacaggcaccgggatcatcgtccttgctgagggtcgtctcatgaacttgggctgcgcgaccgggcatcccagcttcgtcatgtcctgctctttcacgaaccaggtgattgcgcagctggagctgtggaacgagaggaagtccggcaagtacgagaagaaggtctacgttcttccaaagcacttggacgagaaggtggcggcgctgcatctgcccaagctgggtgccaagctgaccaagctctccgccgaccaggccgcgtacatcaacgttccagtggaaggtccatacaagcccgctcactaccgctactagagcgagcgcgcgtctctccccggatcgaaagggaggaaccgggaggtactcgagcaaaaaactccgagcttttaatcctttttcgttcgttactatttcttacgagagtggcaatgccaagctctcgcgttttgtctcactaaaagtttcttaaaaataacgatgttttgggctaagattgtt

SEQ ID NO: 7894 - DNA, 1807 bp, Triticum aestivum
cagatccaatccaccaacctcctcctggcgctctccgtggagaagaccgcgtcgggccgggagtacaaggtgaaggacctctcccaggccgacttcggccgcctcgagctcgagctcgccgaggtcgagatgcccggcctcatggcctgccgcgccgagttcgggccctcgcagcccttcagggcgcccgcatctccggctccctccacatgaccatccagaccgccgtcctcatcgagaccctcaccgccctcggcgccgaggtccgctggtgctcctgcaacatcttctccacccaggaccacgccgccgccgccatcgcccgcgactccgccgccgtcttcgcctggaagggcgagacgctcgaggagtactggtggtgcaccgagcgctgcctcgactggggcgtcgggggcggccccgacctcatcgtcgacgacggcggtgacgccacgttgctcatccacgagggcgtcaaggccgaggaggagttcgagaagtccggcaaggtccccgacccggagtccaccgacaaccccgagttcaagatcgtcctcaccatcatccgcgacgggctcaagaccgacgccagcaagtaccgcaagatgaaggagaggctcgtcggtgtctccgaggagaccaccaccggcgtcaagaggctctaccagatgcaggagtccggcaccctcctcttccccgccatcaacgtcaacgactccgtcaccaagagcaagtttgacaacctttacggttgccgcactcgctccctgatggtcttatgagggccactgatgttatgatcgccggcaaggttgctgtggtctgcggttatggtgatgttggcaagggctgtgccgctgcactcaagcaggctggtgcccgtgtgatcgtgacagagattgaccccatctgtgcccttcaggccctgatggagggtatccagatcctcaccttggaggatgttgtctctgatgctgacatctttgtgaccaccactggaaacaaggacatcatcatggtggaccacatgaggaagatgaagaacaatgccattgtctgcaacattggtcactttgacaacgagatcgacatgaagggcctcgagacctaccctggtgtcaagcgcatcaccatcaagcctcagactgaccgttgggtcttccccgagaccaacactggcatcattgttcttgctgagggccgtctgatgaaccttggctgtgccactggccaccccagctttgtcatgtcttgctcattcactaaccaggtcattgctcagctcgagttgtggaaggagaaggccaccggcaagtacgagaagaaggtgtatgttctccccaaacacctcgacgagaaggtcgccgccctccacctgggcaagctcggtgccaggctgaccaagctcaccaaggcccagtctgagtacatcagcatcccagttgagggtccctacaagcctgcggcgtaccggtactagtgtgtgtgtgtccagcacgactagcggctggcctgagcggcggcactctaccacggcgacctatgaacctgttttcctttgcattatctatctagatataggtgtgtgttctcttaggtggaggatttgtcacggttatgtttttagaccggtgagggtgtggtggacggaggtggcgtttgcttttgcccagaaataatggtgttattattttggatttaaatgaggaggtgtgatttgacggatatagtgttgcctttttgattctacatgtctgatgctccctacgccacaatttactagggatgcaaatttggaaaaaaaaaa

SEQ ID NO: 7895 - DNA, 1774 bp, Amorphophallus konjac
cttcttcactctgtgtagcccccctccccagtgcttgctcagttcagatctgccgctgcaggaggaggagatggcgctacaggtggagaagaccacctccggccgagagtacaaggtgaaggacatgtcgcaggcggacttcggccgcctcgagatcgagctcgccgaggtggagatgcccggcctcatgtcctgccgcgccgagtttggtccctcccagcccttcaagggtgcccgcatctccggctccctccatatgactatccagaccgccgtcctcatagagaccctcaccgctctcggcgccgaggtacgctggtgctcctgcaacatcttctccacccaggaccacgccgccgccgccatcgcccgcgacagcgccgccgtcttcgcatggaagggcgagaccctccaggagtactggtggtgcaccgagcgctgcctggactggggcgccggcggcggccccgacctcatcgtcgacgacggcggcgacgctaccctgcttatccacgagggcgtcaaggccgaggaggagtacgagaagtccgggaagctgcccgaccccagctccaccgacaacgccgagtttcagatcgtgctcggcctgatcagggacgggctcaaggtcgatccccgcagataccgcaagatgaaggagcggctcgtcggcgtgtcggaggagaccaccaccggcgtcaagaggctctaccagatgcaggcgaacggtactctcctgttcccggccatcaacgtcaatgactccgtcaccaagagcaagtttgacaacctctacgggtgccgccactcccttcccgatggtctgatgagggcaaccgatgtaatgatcgccggcaaggttgcggtcgtctgtggctacggagatgtcggcaagggctgcgctgccgccctcaagcaggccggcgcgcgcgtgattgtaaccgagatcgaccccatttgcgccctccaggccctcatggaaggcctccctgtgcttaccctggaggatgtggtggctgaagccgatatctttgtgaccaccaccgggaacaaggacatcgtcatggtcgaccacatgaggaagatgaagaacaacgcaatcgtctgcaacattggccacttcgacaacgagatcgacatgcacgggctggagaccttccccggtgtcaagcgcatcaccatcaagccccagaccgaccgctgggtcttccccgacacaaacagcggcatcattgtgctcgccgagggccgtctcatgaaccttggatgtgccaccgggcatcccagctttgtcatgtcctgctccttcaccaaccaggtcattgctcagctggagttgtggaaggagaggagcagcggcaagtacgagaaggaggtatacgttctgccgaagcacctggatgagaaggtggcagcccttcaccttgagaagctgggtgcgaagctgaccaagctgactccgtcgcaggcggagtacatcaatgtctcacctgatggtccattcaagcctcctcgctacaggtattaacgcagcaggaaatcttatgtgggggactgttgttgggtgtgggggggtttgcctttgttgtgtctttccgactccctgttttgctttcagctttctttcttctcgtataaggtagttttctttcttctcttgtaaggcagtttggtcgtagtttcttgccttgagccacaatggtggccatataaaagaggcagagcagcctttatgcgtgaaataacttataattgatgagtcattttgttatct

SEQ ID NO: 7896 - DNA, 1479 bp, Brassica napus
gcacacttggaaaaattcaaaacaatggcgttgcttgtggagaagacgtcgagtggccgtgagtacaaggtcaaggacatgtctcaggccgacttcggccgtctcgagatcgagctggccgaggtcgaaatgcctgggctcgtctcttgccgcaccgagttcggaccttctcagcccctcaaaggcgctagaatcaccggttctctccacatgacgatccaaaccgccgttctcatcgaaacgctaaccgctcttggcgccgaggtcaggtggtgctcatgcaacatcttctccactcaagaccacgccgccgccgccatcgctcgtgactccgccgccgtgttcgcatggaaaggagagactcttcaagagtactggtggtgcacggagagggctctcgactggggtccgggaggtggtcctgatctgatcgttgacgacggtggtgatgctactctcttgattcacgaaggagttaaggctgaggagatctttgcgaagacgggtcaggtccctgatccgagttctactgataatcctgagtttcagatcgtgttgtcgattattaaagatggtcttcaagttgatcccaagaagtatcataagatgaaggagagattggttggtgtttcggaggagacgaccactggtgttaagaggctttaccagatgcaggagactggagctctcttgttccctgccattaacgtcaatgactccgttaccaagagcaagttcgacaacttgtatggatgtcgccactctctccctgacggtctcatgagagccactgatgtcatgatcgccggaaaggtcgctgttatctgcggttacggtgatgtcggaaagggttgtgctgcagccatgaaaaccgctggtgcacgtgtgatcgtgactgagatagatccaatctgtgcccttcaggctctcatggaaggcctccaggttctaacccttgaggacgtcgtctcagaagctgacatattttgcaccaccactggaaacaaagacatcatcatggtcgaccacatgcggaagatgaagaacaacgccatagtctgcaacattggccactttgacaacgaaatcgacatgcaaggacttgagaccttccctggtgtgaaacgcatcaccatcaagccgcagactgataggtgggtgttccccgacaccaagtcaggcatcattgtgctagctgagggtcgtttgatgaacttgggatgcgccactggacacccgagtttcgtgatgtcgtgctcgttcaccaaccaggtgattgcgcagcttgagcgatggaacgagaagtcgagcgggaagtatgagaagaagtatatgtttgcctaagcacttggacgagaggttgctgcgcttcacgttgggcaagctcggtgctagactcaccagctcaccaagaccatctgactatgtcagcactacccattcgaacggtccctagaacgcctggtcattacgaggtac

SEQ ID NO: 7897 - DNA, 1522 bp, Pteridium aquilinum
ccacttcccactctctccattttatcaacacttccttcctcttccaagggagagtgccttcttcctcttactctgtactctttctcttgtagccatgtctcttttggtcgagaaaacctcaagcggccgtgagtacaaggtcaaggacatgtctcaggccgacttcggtcgtctcgagattgagttggccgaggtcgaaatgcccggtctcatggcttgcagaaccgaattcggcccttcccaacctttcaaaggagctaaaatcaccggttccctccacatgaccatccaaaccgctgttctcatcgaaacgctcaccgccctcggagccgaagtccgttggtgctcatgcaacattttctcaacccaagaccacgccgcctccgccatcgctcgtgactccgctgctgtatttgcctggaaaggggagaccctccaggagtactggtggtgtaccgagagagccctcgactggggtcccactggtggacccgatctaatcgtggatgatggtggggatgctactttgttgatccacgaaggagttaaagccgaggaggtttatgagaaaactgggcagctcccggatccggcttctacagataacgctgagttccaaattgttttgacgataatcagagatgggttgaagacagatcgcaagaagtataccaggatgaagaatagattagttggtgtttctgaggaaactacaactggagttaagaggctttatcagatgcaggccaatggatccttgttgtttcccgctattaatgtcaatgactctgtcaccaagagcaagtttgataacttgtatgggtgccgtcactctcttcctgatggtttgatgagagcaactgatgtcatgattgctggcaaggttgctgttgtctgtggttatggtgatgttggcaagggctgcgctgcagccttgaaacaagctggtgctcgcgtcattgtcactgagattgatcccatctgtgcacttcaggctcttatggaaggacttcaggttctgactcttgaggatgttgtctgcgaggctgatatctttgtcaccaccactggtaacaaagacatcatcatggttgatcacatgaggaagatgaagaacaatgccattgtttgcaacattggtcactttgacaatgagatcgatatgtgtggtcttgagaactatcctggtgtcaagcgcatcaccatcaagcctcaaactgataggtgggtcttccctgataccaactcaggtatcatcgtattggctgaggggcgtctcatgaacttgggctgtgccactggccatcccagttttgttatgtcctgctcattcacaaaccaggtgattgcccagcttgagctgtggaatgagaaggcaaccggcaagtatgagaaaaaggtgtatgttttgcccaagcaccttgatgagaaggttgctgctcttcaccttcccaagcttggagctaagctcaccaagctcagcaaggaacaagctgattacattagcgtgcccgttgagggt

SEQ ID NO: 7898 - DNA, 2005 bp, Cicer arietinum
gacctctcactcttcaaccctcttctcacactcacacacactttttcttattccatttctacccttgtgtgtgtagtgtaaccaccatgtctctaattgttgagaaaaccaacaccggccgtgaatacaaggtcaaggacctttcccaggccgatttcggccgactcgaaatcgagttggccgaaatcgagatgcccggactcatttccagtcggactgagttcggaccatcacagcccttcaaaggagccagaatcaccggatctctccacatgacgatccaaaccgccgttctcatcgaaaccctaacagcgttaggtgccgaagtccgttggtgttcatgcaatattttctcaacacaggaccacgccgccgctgccatagcacgtgacagcgccgccgtgttcgcctggaaaggtgagactcttcaggagtattggtggtgtactgaacgcgctttggattggggtccaggtggtggtcctgatttgatcgttgatgatggtggtgatgttacgcttttgattcatgaaggtgttaaggctgaagagctttttgagaaaactggtgaggttcctgatccttcttctactgataacgctgagtttcagatcgtgcttagtattattagagagggtttgaaaactgatcctcaaaggtatcgtaagatgaagcaaaggcttgttggtgtttctgaagagacaactactggtgttaagaggctttatcagatgcaggctaatggaactcttttgttccctgctattaatgtcaacgactctgtcaccaagagcaagtttgacaacttgtatggatgccgtcactcacttcctgatggtttgatgagggctactgatgttatgattgctgggaaagtgggtgttgtctgtggatacggagatgttggaaagggttgtgctgttgccttgaaacaagctggagcacgtgtgatagtgactgaaatcgatccaatttgtgcccttcaggctctgatggaaggtttccaggttctgactcttgaagatgttgtttctattgctgatatctttgttaccaccaccggtaacaaggacatcatcatggttgatgacatgaggaaaatgaaaaacaatgccattgtttgcaacattggtcactttgacaatgaaattgatatggctggtcttgagaactaccctggtgtgaagcgcatcaccatcaagcctcaaaccgacagatgggttttccctgagaccaacactgggatcattgtcttggccgagggtcgattgatgaacttgggttgtgctaccggacaccctagttttgtgatgtcatgctcgttcaccaaccaggttattgctcaacttgagttgtggaatgagaggaattccggcaagtatgaaaagaaggtttacgttttgcccaagcaccttgatgagaaggtggctgcacttcatcttaacaagcttggtgctaagctcaccaagctttcccaatcccaggctgattacatcagtgttccagttgagggtccatacaaacctgctcactacaggtactgagaggtgatcttggtggtgatgagattgagggagggaagaaaatcagttttatcaatagtggtcattgtttcattttccttgttgatttttgggttagactttttcagaattgttgtagaagaacggtagtaggtttattgtgatgttgcagttggtgggcatgggttagaggaaggcaacccattggtttctgttgaatgagaccaaacgggtttgaataatgatttggttcgaggttgtgtgaattattatgctgagtttgagtttccgtgtacaccattaacagtttgaaaaatgataacaaagtttttcttgctccttttctcttatccactttttattgatttaataatttcgacgtcgaattctttggtagccatgagagggtgtaaaaataaatacaaatactaagtagtacatgtgaaaaagtttattgtactaatattgtttgttttctcgct

SEQ ID NO: 7899 - DNA, 1858 bp, Trifolium pratense
  misc_feature (1211)..(1211): n is a, c, g, or t
  misc_feature (1307)..(1307): n is a, c, g, or t
gaatctctctcacactatcacagtttcttccattaactgtgttaagtgtaaccaccatgtctctcaccgtagagaaaaccaccgctggccgtgaatacaaggtcaaggacctttcacaagccgattttggccgtctcgaaatcgagttggccgaaatcgagatgcctggactcatttcctgccgtaccgagttcggtccatcacaacccttcaaaggtgctagaatcaccggatctcttcacatgacgatccaaaccgctgttctaatcgaaaccctaactgctctcggtgctgaagtccgttggtgttcttgcaacattttctcaactcaagatcatgctgccgccgccatagcacgtgacagcgccgccgttttcgcctggaaaggtgagactcttcaggagtattggtggtgtactgaacgtgctttggattggggtccaggtggtggtcctgatctgattgttgatgatggtggtgatgctactttgcttattcatgaaggtgttaaagctgaagagctttatgagaaaactggtgaggttcctgatcctagttctactgataatgttgagtttcagcttgtgcttactatcattagagatggattgaagactgatcctcaaaggtatcgtaagatgaaggagagacttgttggtgtttctgaagaaactactactggtgttaagaggctttatcagatgcaagctaatggaactcttttgttccctgctatcaatgtcaatgactctgttaccaagagcaagtttgacaacttgtatggatgccgtcactcacttccagatggtttgatgagggctactgatgttatgattgctgggaaagttggtgttgtctgtggatacggagatgttggaaagggttgtgctgttgccttgaagcaagctggagctcgtgtgatcgtgactgaaattgatccaatctgtgctcttcaggctctcatggaaggtttccaggttcttactttggaggatgttgtctcttatgctgacatctttgttaccaccaccggtaacaaggatatcatcatggttgatgacatgaagaaaatgaagaacaatgccattgtttgtaacattggtcactttgacaatgaaattgacatgtctggacttgagaactaccctggtgtgaagcgtatcaccatcaagcctcaaactgacaggtggctattccccgagaccaacacnggcatcattgtcttggctgagggtcgtttgatgaacttgggctgtgccaccggtcaccctagttttgtcatgtcctgctccttcaccaaccaggtnattgctcagctcgagttgtggaatgagaggaagtctggaaagtatgagaagaaggtttatgttttgcctaagcacctcgatgagaaggttgctgcacttcatcttggcaagcttggagctaagctcaccaagctttcccaatctcaggctgattacatcagtgtgccagttgagggtccatacaagcctgctcactacaggtattgagagatgatcgtggtggcgatgagacggagggaaaagaaaattgttttttttttttgtttcttatgaaactgcttgattgtttcattttccttgttggatttttgatattttagacttttttcagaatttgttagatgaatggtaggtttatgtgatgttgtagtggtgggttgggtaagaggaaggcaacctattggtttctcttgattgagaccaaatgggtttgaataatgctttggttggggtttgtgtgagaattatgtttaatttgagctttttgtagacctttaatgtttttttaaaaaaaatgagaaaatagttttcttgcatcttttcattatatt

SEQ ID NO: 7900 - DNA, 1906 bp, Sciadopitys verticillata
tatatatgagggatcatccctctctcagctctcgtactctttatttgctcgatttgttgagcatctatagatctcggttcgaatccccggactagtgatctgcacatctctgcctttgcggatctctgtttgtgtgagcagaagcgatggcgctcgtggtggagaagactgtgacggggagggaatataaggtgaaggacatgtcgcaggcggacttcggtcgtctggagatcgatctggcagaggtggagatgccgggactgatggcgtgcagggtagaattcgggccttcgcaacccctgaagggcgcccgcataactggctccctccatatgaccatccagactgctgtcttgattgaaacccttactgccctcggtgctgaagtcagatggtgctcctgcaacattttctctacccaggaccatgcagcggcagccattgccagggatagcgcggcagtatttgcatggaaaggggagaccctccaggagtactggtggtgcacagagagggcccttggttggggtcctggtggtggcccggatctgattgtggacgatggtggggatgcaacccttctgattcacgaaggtgtaaaggctgaggaagagtttgcgaagactgggaagcttccggatccatcttcgactaccaatcccgagttccagattgttctgggactgatcagagataccctcaaggaggacccactcaagtatcacaagatgaaggatagattggttggtgtgtctgaggaaaccactactggagtccacaggctataccagatgcagaataatggttctctgctcttccctgccattaatgtcaatgattctgttaccaagagcaagtttgacaacttgtatggatgcagacactctcttccagatggtctgatgagagccacagatgtgatgattgctggaaaggttgctgttgtttgtggatatggagatgttggcaagggttgtgctgcagccatgaaggctgctggagctagggtcattgtaacggagattgatcctatttgtgctttacaagcccttatggaaggtctccctgttcttaccctggaggatgtggtaagcactgccgatatctttgtgacaaccacaggtaacaaggatattatcatggtcgatgacatgaggaagatgaagaacaatgctattgtgtgcaacattggtcactttgacaatgaaattgacatgcacgggcttgaaacctaccctggtgtgaagaagattaccatcaagccccagactgaccgatgggtgttccccgaaaccaacacggggataattatacttgcagaaggtcgtctcatgaacttgggttgtgctactggccacccaagttttgtcatgtcttgctccttcaccaaccaggttattgctcagctggagctttggaacgagaggaaaacagggaagtatgagaagaaggtgtatgtgctgcccaagcatctggatgagaaggtggctgctttgcatttgcccaagctaggagccaggctaacaaagctttccgcagaccaggctgcatacatcaatgtgcctgttgagggtccttataagcctgcccactaccgatactgagcaaagcttggttttggtatgacgtgcaagagagctgcagttgcagcaagtcttttctggcatctctattattttccctttaacctccaataaaaggaagaggtctattgtatgaggtctttatatcccatgtgtatccgctgaatttacgacagcagctcctaccgcagagttattttgaatttgtttctgtgataaatagtacagttattttgaatttgttaatgttaggcgtctccactgtttggattttgtatgaagggaaacccagaaatatcaatataattgttggtttttaaacc

SEQ ID NO: 7901 - DNA, 2372 bp, Pinus taeda
acgtgcgaccttggctgtcactcaacactcttcgttggagcaaatcgatcaggctacttcggatcctgctccacgagcgctcccttacatctgggtctttagttctcatttaggtcgcggtaatcggcatttaggtctagccaaaatccgcggctttcccttagatctgcctgttttctcccctgtctctgtgcagcaatggcgctttacactgagaaaacggtgtccggaagggaatacaaggttaaggacatgtctcaggccgacttcggaaggctggagatcgagttggccgaagttgagatgcctggactgatggcctgccgggccgagttcggacctgcccagcccttcaagggcgcccggatcacgggttccctccacatgactatccaaaccgctgttctcatcgagactctcaccgcccttggggccgatgtgagatggtgctcctgcaacatattctccactcaggaccatgccgcggccgccatcgctcgagatagcgcggcggtgtttgcctggaagggggaaacactgcaggagtactggtggtgcaccgagagggctcttgactggggccctggtggtggccctgatctaattgttgacgatggcggtgacactacacttctgatacacgagggagtgaaggccgaggaagagtttgccaagactgggaaggtgccggatccgtcttctaccaccaatgcggagtttcagatcgtgttggcgttgatcaaggaaagcctcaaggttgatccattgaggtatcacagaatgaaggatagaattgttggtgtgtctgaggagactactactggggttaagaggctttaccagatgcagaatgccgggtccctgctgtttcctgctatcaatgttaatgactctgttacaaagagcaagtttgacaacttgtatggatgtaggcactctctcccagacggtcttatgagagccacagatgtcatgattgctggtaagtgggtttggagatgttggcaagggttgtgctgcagctttgaaagtcgctggagctagggtcattgttacagagattgatcctatctgtgccctgcaagctcttatggaaggccttcctgtccttacccttgaggatgtagttagcactgctgatatctttgtgacaaccactggcaacaaggacatcatcatggtagatcacatgcggaaaatgaagaataatgccattgtttgcaacatcggtcactttgacaacgagattgatatgcaaggccttgaaactttcccaggcgttaagaagattaccatcaagcctcagactgacaggtgggtgttccctgacaccaacagtggcatcattgttcttgcagagggacgtctgatgaacttgggttgtgcaactggccacccaagttttgtcatgtcttgctcctttacaaaccaggtcattgctcagttagagctctggaatgagaagaaatcagggaagtatgagaagaaggtctatgtgctgcctaagcatctagatgagaaggtggctgctctgcacttgcccaagttgggtgccaagctaacaaagcttactcctgatcaggcagagtatatcaatgtgcctattgaggggccttacaagcctgctcagtaccgatactgaaaagatctgacgtttgggatggcttgttggacgagtagcaaaggtcctcgctgtttgcaaataaaagaaactgtaggatttatttttggcagctctgttgttttaagggaccttacaagcctcctgactacatactgaagagatgacattttgggtgagacctgctcggcgagtatcaagttacaatgctcctcgacatataaagagctcgcctctctttgtcggcatctccattgtttgggtagaattataataaaattttgctatcgcttgtatgggtggctgctgaatttcttgcagcatcacatcaagcatctcgttttaatatgggtggctgctgaatttcttgcagcatcacatcaagcatctcgttttaatactactggtatatggtttaatagtttattagagttcgtatgggaatttctgccaatgtggcatttgtattgctcaaaattcagtttggaagcaaaaatataaggatgcctctgggtttctatccagcactggcatgttatgaatcaaatgaatttcaggtcaagaaccgcaattttcacacaatctcatggacatgcatattcggtgttgttaacgcatctctttttattactggtatatggtttaatagtttattagagttcgtattggctgtttctgccaatgtggcatttgtattgctcaaaattcagaatggaagaaaaaatataaggatgcctctcggtttctatcc

SEQ ID NO: 7902 - DNA, 1713 bp, Sequoia sempervirens
gggttcgaattgcaaccctgtgcattctgtagagaagctctgtttcttttttcattcttcttaaaatcatggcgctccttgtggagaagactgtgacgggaagagagtacaaggttaaagacttgtctcaggctgacttcggccgtatggagctcgatctggccgaagtggaaatgcccggcctcatggcctgcagggctgagtttggcccttcgcagccattcaagggagcacgaattactggctcgcttcatatgactatccagacggctgttctaattgagacactcactgctctcggagctgaggtcagatggtgctcctgcaatattttttctactcaggatcacgctgcagcagccattgcccgtgacagtgcagctgtgtttgcctggaagggggagacactccaggaatactggtggtgtacagagagggctctggactggggtcccggtggtggcccagatctgattgttgatgatggaggggatgctaccctactaattcatgagggggtcaaggcggaggaagagtttgcaaagactggcaagattccggatcctacttcaaccaccaatcctgaatttcagattgttttgggattgatcaaggatagtctcaaggaggaccctttgaagtatcacaaaatgaaggacaggttggttggtgtatccgaggaaaccactacaggggtgcacagactgtatcagatgcaggccagtggctctctgctgttccctgccatcaatgttaacgactctgttacgaagagcaagttcgataatttgtatggttgcaggcactctcttccagatggcctgatgagagccactgatgtgatgattgctggtaaggttggtgttgtgtgtggatatggagatgttggaaagggttgtgctgctgccttaaaggctgctggggccagagtcattgttacagagattgacccaatttgtgctctgcaagcccttatggaaggtatccctgttctgactctagaggatgtggtgagcactgctgatatctttgttacaacaacaggaaataaggatattatcatggtggatgacatgaggaagatgaagaacaatgccattgtttgcaacattggtcattttgacaatgaaattgacatgcatggtcttgaaacctaccctggtgttaagaagataacgatcaagcctcagacagaccgatgggtgttcccggaaacaaacagtggtatcattgtccttgcagaggggcgtctcatgaacttgggttgtgcaactggccacccaagttttgtcatgtcttgctcgtttacaaaccaggttattgcacagctggagctttggaatgagaggaaaacaggaaagtatgagaagaaggtatatgtgttgcccaagcatctggatgagaaggtggctgctttgcatttgcccaagttgggtgccagacttacaaagctttctccagatcaagctgcatacattaatgttcctgttgagggtccttacaagcctgtccactaccgctactgagctgatcatggttttcccatgactcatttggcaagagctgttttgatgataacaattgaagcaccgaacagtttttggctcttcattattttcctatggagtgatataatacctaatttgaatgaagttgaattgtgagctaaagctgaataagaatccatggggtgaaccaaggatttgaagaaat

SEQ ID NO: 7903 - DNA, 1938 bp, Vitis vinifera
ccttggtctgttggtcatctatttacgcgctgctgtcgcttgattttatcttgtcctggcctctctatctacacttcatcctcacttctcaagtgccaaaccctagctagccaccgccatggctcttgtcgtcgagaagaccacctccggccgagagtacaaggtcaaggacatgtctcaggccgacttcggccgcctcgaaatcgagctcgcagaagtcgaaatgcctggactcatggcttgccgtaccgaattcggaccccagcaacccttcaaaggtgctcgtatcactggatctctccacatgaccatacagaccgccgtcctcatcgaaaccctaaccgccttgggtgccgaggtccgctggtgctcatgcaacatcttctcaactcaagaccacgccgcagcagccattgcccgcgactctgccgccgtattcgcctggaagggtgagaccctccaggagtactggtggtgcaccgagcgtgccctcgattggggccccggcggtggccctgatctgattgtcgacgacggtggcgatgccacgctgttgatccacgaaggagtgaaggctgaggaggagtacgagcgatctgggaagcttccggaccctgcttccactgacaatgctgagttccagatcgtgcttggaatcatcaaggaagggctgtcggttgatccatgcaagtatcggaagatgaaggagagattggttggagtttcggaagagacaaccaccggtgtgaagaggctgtaccagatgcaggcaaatggaactcttttgtttgctgctatcaatgtcaacgattctgttaccaagagcaagtttgacaacttgtatggatgccgacactccctccccgatggtctcatgagagccactgatgtcatgattgctggcaaggttgctgtggtctgtgggtatggagatgttgggaagggctgtgctgccgcgctcaagcaggctggtgcccaggttatcgtgactgagattgatccaatttgtgctctccaagccctaatggaaggtatcccagtcctaaccttggaagatgtagtctcaaaggctgacatctttgtgaccaccactgggaacaaagacatcatcatggttcaccacatgaagcagatgaagaacaatgcaattgtttgtaacattggccactttgacaatgagattgatatgcttggtctggaaacctaccctggtgttaagcgcatcacaatcaagccccaaactgatcgatgggttttcccagaaaccaacagtggcatcattattctcgctgagggacgactgatgaacttaggatgtgcaactgggcatcccagctttgtgatgtcatgctcgtttacaaaccaggtgattgcccagcttgagctctggaaggagaaggcaacgggcaagtatgagaaaaaggtgtacgtgctgcccaagcatctggatgagaaggttgcagctcttcaccttggaaagcttggtgctaagctcaccaagcttagccccgagcaagctgcttacattagtgtccctgtggaaggtccttacaagcccactcactacaggtactagcctggtgattgttgtgtttttgttggtgtgatattatgattccgcctgttataacctcttagagatcagatttgctgttttgctttttggcaaattttaggagggattttggcaacattaataaatgcgatgtcgctgagtcatgtgtctgtctaaatttcatctgatgttatcatttttgctcttcatctttttctgtaactctttcaagactcgtcaccattgttgtatgtcttagaatgaattgctaagttccgaaccgttaaaagatggatcccatatggcattggagcccaaggtggttcaaaatactagcaacatgggatcaaaatgagagaggcagaggtgttcacaatctaaat

SEQ ID NO: 7904 - DNA, 1788 bp, Vitis vinifera
tcctggcctctctatctacacttcatcctcacttctcaagtgccaaaccctagctagccaccgccatggctcttgtcgtcgagaagaccacctccggccgagagtacaaggtcaaggacatgtctcaggccgacttcggccgcctcgaaatcgagctcgcagaagtcgaaatgcctggactcatggcttgccgtaccgaattcggaccccagcaacccttcaaaggtgctcgtatcactggatctctccacatgaccatacagaccgccgtcctcatcgaaaccctaaccgccttgggtgccgaggtccgctggtgctcatgcaacatcttctcaactcaagaccacgccgcagcagccattgcccgcgactctgccgccgtattcgcctggaagggtgagaccctccaggagtactggtggtgcaccgagcgtgccctcgattggggccccggcggtggccctgatctgattgtcgacgacggtggcgatgccacgctgttgatccacgaaggagtgaaggctgaggaggagtacgagcgatctgggaagcttccggaccctgcttccactgacaatgctgagttccagatcgtgcttggaatcatcaaggaagggctgtcggttgatccatgcaagtatcggaagatgaaggagagattggttggagtttcggaagagacaaccaccggtgtgaagaggctgtaccagatgcaggcaaatggaactcttttgtttgctgctatcaatgtcaacgattctgttaccaagagcaagtttgacaacttgtatggatgccgacactccctccccgatggtctcatgagagccactgatgtcatgattgctggcaaggttgctgtggtctgtgggtatggagatgttgggaagggctgtgctgccgcgctcaagcaggctggtgcccaggttatcgtgactgagattgatccaatttgtgctctccaagccctaatggaaggtatcccagtcctaaccttggaagatgtagtctcaaaggctgacatctttgtgaccaccactgggaacaaagacatcatcatggttcaccacatgaagcagatgaagaacaatgcaattgtttgtaacattggccactttgacaatgagattgatatgcttggtctggaaacctaccctggtgttaagcgcatcacaatcaagccccaaactgatcgatgggttttcccagaaaccaacagtggcatcattattctcgctgagggacgactgatgaacttaggatgtgcaactgggcatcccagctttgtgatgtcatgctcgtttacaaaccaggtgattgcccagcttgagctctggaaggagaaggcaacgggcaagtatgagaaaaaggtgtacgtgctgcccaagcatctggatgagaaggttgcagctcttcaccttggaaagcttggtgctaagctcaccaagcttagccccgagcaagctgcttacattagtgtccctgtggaaggtccttacaagcccactcactacaggtactagcctggtgattgttgtgtttttgttggtgtgatattatgattccgcctgttataacctcttagagatcagatttgctgttttgctttttggcaaattttaggagggattttggcaacattaataaatgcgatgtcgctgagtcatgtgtctgtctaaatttcatctgatgttatcatttttgctcttcatctttttctgtaactctttcaagactcgtcaccattgttgtatgtcttagaatgaattgctaagttccgaaccgtta

SEQ ID NO: 7905 - DNA, 1927 bp, Sequoia sempervirens
cgcatcgacaggttaagggattgaaatttgccctgatcggttttgataagcgcatatttcaaatttcttcttcttcctttgcttttcggcaatggcgctagttgtcgagaagactgtgacggggagggagtacaaggtgaaggatatgtcccaggcggactttggccgcatggagctagatctggcggaggtggagatgccggggctcatggcctgccgggtcgaatacgggccctcgcagccgtttaagggcgctcgcataactggctccctccatatgaccatccagaccgctgtgctcatcgagaccctcaccgccctcggtgctgaagtgagatggtgctcttgcaacattttctccactcaggatcatgcggctgcagccattgcccgtgacagtgcagctgtgtttgcatggaaaggggagacccttcaagaatactggtggtgcacagaaagggctttggattggggccctggtggaggcccagatctgattgtggatgatgggggagatgccacactgctgattcacgagggggtcaaggccgaggaagagtttgccaagaccgggaagcttccggacccatcttcaacaactaatcccgagtttcagattgttttgggattgataaaggacggcctcaaggaggatccactcaaatatcacaagatgaaggataggttggttggcgtatccgaggaaacgactactggtgttcacaggctgtaccagatgcaaaataatggcactttgctcttccctgccattaacgtcaatgattctgttacgaagagcaagttcgataatttgtatggatgcagacactctctaccagatggtctgatgagagctactgatgtgatgattgctggcaaggttgctgttgtctgtggatatggagatgttggcaagggttgtgctgcagccatgaaggctgctggagctagggtgattgtaacagagattgatcccatttgtgctttacaagcccttatggaaggcatccctgttctgacgctcgaggatgtgttagacactgctgatatctttgtgacaactacaggtaacaaggatatcatcatggtcgatcacatgaggaagatgaagaacaatgccattgtctgcaacattggtcactttgataatgaaattgacatgcatggacttgaaacctaccctggtgtgaagaaggtaaccatcaagcctcagactgaccggtgggtgttccctgaaaccaacagcggcatcattgtacttgcagagggacgtctcatgaacttgggttgtgctaccggtcacccaagttttgtcatgtcatgttccttcacaaatcaggtcattgctcagctggagctttggaatgagaggaaaacaggtaagtatgagaagaaggtttatgtgctccccaagcatttggatgagaaggtggctgctctgcacttgcccaagctgggtgccaagctaacaaagctttccccagatcaggctgcctacattaatgtgcctgttgagggtccttacaagcctgtccactaccgctactgagcaaagcatgtctttgacatgactcataagagcaggacagctgttttgataatattcgtaaggagcgaaggctattctttgcttctctgttgttttccttataccacttcaaataaaagcaagaggtctattgagtctattgtactgtaggcaaatctgcttttactacggcatacctctaataaaaacaagaggtctaatgtattttaggagtatctgcttaatttactaaaacagcaccttctatttcttgttgccagatatctttagaagagttccgatttttagaatctctatgcaagatttcttctctgtttgggcttcgaatggccgaaattctataataggaactcaaaaatattaaatataattctttat

SEQ ID NO: 7906 - DNA, 1986 bp, Abies balsamea
aaatcgacgagagttcgaatctagctccgcgaacattccctctcattcgcatttgggttccggtaatccgtatctggattgccgaaatacgcggtttctcttagatctgcttcttttcggccccgtctctgagcagcaatggcgctttttgctgagaaaacggtgtccggaagggaatacaaggttaaggacttgtctcaggcggacttcgggaggctggagatcgaactggcagaagttgagatgcccgggctgatggcctcccgggtcgagttcggccccgctcagcccttcaagggcgcccggatcacgggttccttacacatgacgatccagactgctgttctcatcgagactctgacagcccttggagctgaggtgagatggtgctcctgcaacatattctccacccaggaccacgccgcggctgccattgcccgcgatagcgcagctgtgttcgcctggaagggggaaacactgcaggagtactggtggtgcaccgaaagggctctggactggggcccgggcggtggccctgatctgattgttgacgatggtggcgacactacccttctgatccatgagggtgtcaaggccgaggcagagtttgccaagaacgggaaggtgccggatccggcttctaccaccaatgtggagtttcagattgtgttggcgctgatcagggaaagtctcaaggtggatcctctgaggtaccacaggatgaaggataggttggttggggtgtctgaggagactactaccggggttaagaggctttatcagatgcagaatgctgggtctctgctgttccctgctatcaatgttaatgactcggttaccaagagcaagtttgacaacttgtacggatgcaggcactctcttccagatggtcttatgagagcaacagatgtcatgattgctggtaaggttgctgttgtgtgtgggtatggagatgttggcaagggttgtgctgcagccatgaaggtggctggagccagggtcattgttacagagattgatcctatttgtgccttgcaagctcttatggaaggtcttcctgttctcaccctagatgatgtagttagctctgctgatatctttgtgacaaccactggtaacaaggatatcattatgttggagcacatgaggaaaatgaagaacaatgccattgtttgtaacattggtcactttgacaatgagattgatatgcaaggccttgaaagtttccctggtgttaagaagattaccatcaagcctcagacggataggtgggtgttccctgacaccaacagtggcatcattgttcttgcagagggacgtctgatgaacttgggttgtgcgactggccacccaagttttgtcatgtcttgttcctttacaaatcaggtcattgctcagctagagctctggaacgagaggaaatcaggaaagtatgagaagaaggtgtatgtgctgcctaagcatctagatgagaaggtggctgctctgcacttgcctaagttgggtgccaagctaacaaagcttactcctgatcaggcagaatatatcaacgtgcctgtcgagggaccttacaagcctgctcactaccgatactgaagagatctcagtttagatggcttgttgggtgaatagcaaaagtcctcgtcgcttgccaatagaagaactagtattctttgtggcagcgtcatggttttgagggaccttacgagcctactgactacatactgaatagagatgacattttgggtgggacctgttgagtgagtaccaagtaacaaagctcctcgacatagaaaagaactagcccctccttgtgccagcgccattattttgttagaattaaataaaattttgctatcgtttgtatgtttgtatgcgtggctgctgaattcactacagcatcacttaacgtttttccttttatatcggtatatggtttaatagtttactatagagttcgtattggaggtttctgccaatgtggct

SEQ ID NO: 7907 - DNA, 1869 bp, Abies balsamea
agcaaatcgactcaagttcgattattgttcatctcggtcgctctaatccgtggtatcgttcagatctgcgtgtaattttttaagcagctatggcgcttcttgctgagaaaacggtgtccggaagggaatacaaggtgaaggatctgtcccaggcggattttgggaggttggagctcgaattggcggaagttgaaatgcctggattgatggcctgcaggtctgagttcggccccgcgcagcccttcaagggcgcccggatcacggggtcactccacatgaccatccagactgcggtgctcatcgagacgctcactgctctgggcgccgaggtgagatggtgctcctgcaacatcttctccacgcaggaccacgccgctgcggccattgcccgcgacagctgtgcggtcttcgcttggaagggggagacgctgcaggagtactggtggtgcaccgaaagggctcttgactggggtccaggcggtggccctgatctgatcgttgatgacggtggcgatgcaacattgctgatccatgaaggagtcaaggctgaggaggagtttgccaaaacgggaaaggtgccggatccggagtctaccactaatgtggagtttcagatggtgttggggttgatcaaggagagcataaaggtggatcccttgagataccacaggatgaaggagaggttggttggtgtgtccgaggagactactactggtgttaagaggctttatcagatgcaggctagcgggactttgctgttccctgctatcaatgtcaatgactctgtcaccaagagcaagtttgataacttatatggatgtagacactctctcccagatggtctgatgagagccacagatgtcatgattgctggtaaggttgctgttgtgtgcggatatggagatgttggaaaggggtgtgctgcagccctaaaggttgctggagctagggtaattgttacagaaattgatcctatctgtgccctgcaagctcttatggaaggccttcctgtcttgcccatagaggatgtagtcagcactgctgatatttttgttaccaccactggaaacaaggacatcataatgttacatcacatgaggaaaatgaagaacaatgccattgtttgcaacattggtcattttgacaatgagattgacatgcaaggccttgaaactttcccgggcgttaagaagattaccatcaagcctcagacagataggtgggtgttccccgacaccaacagtggcatcattgtccttgcagagggacgtctgatgaacttgggttgtgctactggccacccgagctttgtcatgtcctgctcctttacaaaccaggttattgctcagttggagctctggaacgagaggaagtcagggaagtatgagaagaaggtctacgtgctgcctaagcatctagatgagaaggtggcagctctgcacttgcctaagttgggtgctaagctaacgaagctttctcctgaacaggcagagtatatcaacgtgcctgttgagggaccttacaagcctgtccactaccgatactgaagagagttgacattttgggtgacttgtcgggtgagtagcaaggctcccggacagttgccaatcgaagaactaagccccctccgcggcagctccattgttttgttccaattttaataaaactagttattgtttgtatgtgtgtctgctgagtttattacagcagtaccgaaagcttttccgtttagtatggtcatatgataacaatagtttacaaatagaattggtattcgaggtttctacatgatgttagctagctagctctttgtatcactgaaatttcataatgtaagcaagaatatatgattacctctgggtttttgat

SEQ ID NO: 7908 - DNA, 1481 bp, Cucumis sativus
ttttgataatcacaatgtctctattggtagacaaaaccagcactggccgtgaatacaaggtcaaggatatggcgcaggctgattttggtcgtcttgaaattgatctcgctgaggttgaaatgcctggattgatggcttgcagaaccgaatatggaccagcactacctttcaagggagcaaaaatcactggatctcttcacatgacgattcaaaccgccgtcctcattgaaaccctaactgctctcggtgctgaggttcgttggtgctcctgcaacattttctcgactcaggaccatgctgctgctgccattgctcgtgatagtgccgccgtgtttgcctggaagggggagactcttcaggagtattggtggtgcactgagcggtccttggattggggccctgaaggtggtcccgatctgatcgtcgatgatggtggagatgttacgcttttgattcacgaaggagttaaggcggaggagatctatgaaaaaacagggacgctaccggatccttcttcaactactaactcagagttgcagattgtgttcaccattattcgtgatggattgaagaccgatcctaagaggtaccacaagatgaaggagagattggtcggtgtttcggaggagacaactactggtgtgaaaaggttgtatcagatgcaagctaatggaactttgctattccccgccattaatgtcaatgattctgtcactaagagcaagttcgataacttgtacggctgccgccactctctcccagatggtttgatgagagctactgatgttatgattgctggcaaagttgctgttgtgtgtggctatggagatgttggcaaggggtgtgcttttgccctcaaacaaggtggagctcgtgtgatcgtcaccgagattgacccaatttgcgctcttcaggcattgatggaaggcttccaggtcttgacactcaacgatgtcgtttccgaggcagacattttcgtcaccaccacaggcaacaaggacatcatcatggtgagtgacatgaggaagatgaaaaacaatgcaatagtcagcaacattggtcacttcgataacgaaatcgacatgcatggtctcgagactttccctgacgtgaagcgcatcacgatcaaacctcaaactgataggtgggtgttcccggatactaaaacaggcatcatcgtgcttgccgaggggcggctaatgaacttgggatgtgccactggccaccctagctttgtgatgtcctgctcattcacaaaccaagtgattgcacagcttgagctttggaatgagaggaaaacaggaaaatatgagaaaaaagtgtacgttttgcccaaacatcttgatgaaaaagttgctgctcttcatcttggcaagcttggagctaagctcactaagctcagtaaggatcaagctgactatatcagtgtccccattgaaggtccttacaagcctgctcattacaggtattgaaaggaccac

SEQ ID NO: 7909 - DNA, 1878 bp, Medicago truncatula
acctctcacactctctcttctctctctctcaaaacccttacacaaacgctgcgtttagtgtaagaaaatcaatcatgtctcttacagtagagaaaacccaagctggccgtgaatacaaggttagggatctttcccaagccgatttcggccgactcgagatcgagttggccgaaatcgagatgcccggactcatgtcctgccgaactgagttcggaccatcccaacccttcaaaggtgccagaatcaccggatctcttcacatgaccatccaaaccgccgtcctcatcgaaaccctaaccgccttaggtgctgaagtccgttggtgttcctgcaacattttctcaactcaagaccacgccgccgccgccatcgctcgtgacagcgccgccgttttcgcctggaagggtgagactcttcaagagtactggtggtgtactgaacgtgctcttgactggggtccaggtggtggtcctgatttgattgttgatgatggtggtgatgctactttgttgatccatgaaggtgttaaggctgaagagctttatgagaaaactggtgaggttcctgatccaagttctactgataacgctgagtttcagcttgtgcttactatcattagagatgggttgaagactgatcctaagaggtatcgtaagatgaaggatagacttgttggtgtttctgaagagactactactggtgttaagaggctttatcagatgcaagctagtggaactcttttgttccctgctattaatgtcaatgactctgttaccaagagcaagtttgacaacttgtatggatgccgtcactctcttcctgatggtttgatgagggctacggatgttatgattgctggaaaggtgggtgttgtcgctggatatggagatgttggaaagggttgtgctgttgccctgaagcaagctggagctcgtgtgattgttactgaaattgatccaatctgtgcccttcaggctctcatggaaggtttccaggttctgactcttgatgatgttgtctcttatgctgacatctttgttaccaccaccggtaacaaggacatcatcatggttgatgacatgaggaaaatgaaaaacaatgccattgtttgcaacattggtcactttgacaatgaaattgatatgtctggacttgagaactaccctggtgtgaagcgcgtcaccatcaagcctcaaaccgacaggtgggttttccccgagaccaacaccggcatcattgtcttggccgagggtcgtttgatgaacttgggttgtgctactggacaccctagttttgtgatgtcctgctccttcaccaaccaggtcattgctcagcttgagttgtggaatgagaggaaatctggaaagtatgagaagaaggtttacgttttgcctaaacatcttgatgagaaggtcgcggcacttcatcttggcaagcttggagctaaactcaccaagctttcccaatcacaggctgattacatcagtgtgccagttgagggtccatacaagcctgctcactacaggtactgagagatgatcaaggtggtgattagaggtcgagggaaaaaggaaatgtgttttatgaaatggattgatttttcattttcattttccttgtttgattttttggaattagactttttcagaattgtggtagagtaggtttttgtaatgttaacagtgggtggggaatggtaagaggaaggcaacctactggtttcttgaatgagaccaaatgggtttgaataatgccttgtttggggattgtgtgtcaattatgctgaatttgagtttctgtagacctttaatgtttgaaaaaatgagaaaattattttcttgcatccttttcttattttaaaataatcatgttaagatt

SEQ ID NO: 7910 - DNA, 2032 bp, Aristolochia fimbriata
gatctggtggaatggctgagaatttgtttataaataaacacccgttcagtcctccatttgcacactctcacagcccctgcaacttctcactctctgtgtcggacccttgagcggaggcgcggagggagggtttggtgaatccccccggtctttcgtcttcgtcgccgggaatacagagagagaagacaatgtcgctctcggtggagaaaacttcctccggtcgggagtacaaggtgaaggacatgtcgcaggcggacttcggccgcctcgagatcgacctcgccgaggtggagatgcccggactcatggcctgccgcgccgagttcggcccacagaagccattcgccggcgcgcgcatcaccggatccctccacatgaccatccagaccgccgtcctcatcgagaccctcaccgccctcggagccgaggtccgctggtgctcctgcaacatcttctccacgcaggaccacgccgcagcagccatcgcccgcgactccgccgccgtcttcgcctggaagggggagacgctccaggagtactggtggtgcaccgagcgcgcactcgactggggccccggcgggggacccgatctcatcgttgacgacggcggtgacgccacgcttttgatccacgagggtgttaaggccgaggaggagtatgccaagaccggaaagttgccggatccggcctccaccgacaacgccgagttccagatcgtgctcaccatcatcagggatggacttaaggcggatccaacgaggttccacaagatgaaggacagaatcgttggggtttctgaggagaccaccaccggtgtcaagaggctctaccagatgcaggctgccggtactctgcttttcccggccatcaatgtcaacgactctgtcacaaagagcaagttcgacaacctgtatgggtgccgccactccctacccgacggtctgatgagagccacagacgtcatgatcgccggcaaagtcgccgtcgtgtgcgggtacggagacgtcggaaagggttgcgccgccgccctgaagcaggccggggcccgcgtgatagtgacagagatcgaccccatctgcgccctccaggccctgatggaaggcatccccgtcctgaccctggaggacgtcgtgggcgaggccgacatcttcgtcaccaccaccggcaacaaggacatcatcatggtctcccacatgaggaagatgaagaacaacgccatcgtctgcaacatcggccacttcgacaacgagatcgacatgctcggcctggagaactaccccggcgtgaagaggatcaccatcaagccccagaccgaccgctgggtcttccccgacaccaagtctggcatcatcgtgctcgccgagggccgtctgatgaaccttggttgtgctaccggtcatcccagcttcgtcatgtcctgctccttcaccaaccaggtgattgctcaacttgaactgtggaaggagaaggcatccggcaagtatgagaaggaggtgtatgtgctgccgaagcacttggacgagaaggtggccgcgctgcacctgcccaagctcggtgccaagttgacgaaactctcccctgatcaagccgagtacatccatgtctccgtcgagggtccctacaagcctcctcattacaggtactgaggaagaaaggaggaggtatgcagcagaaggagagcgaggggggaggatggaattttatttgatgtttgctgccaggttttacaattttatcttagtgcgtgtgttagtcccgatatattggtggggaaatctgtgttttctctctcttgactagagatctcggttcggtgtctctacgccgtaaaccgttattccggcgaaaccgtaatagaagaagatcgttttgttttgttttgttttgtttgtttcccatgacttctttcctctgttaataaaatagaaaacagttcatgactatgagctccctttaagagatagatgcatattaagtaaaattgtctagtcttgtccctttaatttccgggtttatttctttaatttctttc

SEQ ID NO: 7911 - DNA, 2080 bp, Distylium racemosum
aaaagaacagcattacatttattgcttttatgccagaaagttccacatgcatcaaaacaacgccaaagcattagtttaattctacgcttattcactggtagcctgctgtcgttctcgttctgccttcttcttgatcagatctgcacatatttgttacagatctagttcgtttttgagctatggcgctccttgttgagaaaaccgtggcaggaagagagtataaggttaaggacatgtcccaggcggactttggaaggctggagatcgatctggcggaggtggagatgccggggttaatggcgtgccgcgccgagttcggccctgcgcagccgctgaagggcactcgcatcacgggatccctccacatgaccatccagacggccgtgctcatcgagacccttacggctctcggcgccgaagtcagatggtgctcctgcaacatcttctccacccaggaccatgcggctgctgccattgcccgcgacagtgcagcggtgtttgcctggaagggtgagacccttcaggagtactggtggtgcacggagagggccctcgactggggtcccggcggtggcccagatctgattgttgatgatggaggcgatgccactcttttgattcacgagggagttaaggctgaaatagagtttgcgaagaacggggctattcccgatccgtcttcgactaccaaccctgagttccagcttgttttgggcttgatcaaggagagcctcaaggaggacccaatgaagtaccacaagatgaaggatagattggttggtgtctctgaggagactaccactggtgtccacaggctctaccagatgcaggccaatggaactctgttgttccccgccatcaatgtcaatgactctgttactaagagcaagtttgataacttgtatgggtgcagacactctcttccagatggtctgatgagagctacagatgtgatgattgctggtaaggttggtgttgtatgtggatatggagatgtcggcaaaggttgtgccgcagccctcaaggctgctggagctagggtcattgtaacagagattgacccaatttgtgctctgcaagcccttatggaaggtctccctgttctgacccttgaggatgtggtaagcactgctgatatctttgtgacaactactggtaacaaggatattatcatggttgacgacatgaagaagatgaagaacaatgctattgtttgcaacattggtcattttgacaatgagattgacatgcacggtcttgagacctaccctggagtgaagaagattaccatcaagccccagactgatcgatgggtgttccctgaaaccaactctggcatcattgtccttgcagaggggcgtctcatgaacttgggttgtgctactggccacccaagttttgttatgtcgtgctcctttacaaaccaggttattgctcaacttgagctctggaatgagaggaagtcagggaagtatgagaagaaggtgtatgtcctgcccaagcatcttgatgagaaggtggctgctcttcacttgcccaagctgggtgccaggttaacaaagctttctccggatcaggctgcatatatcaatgttcctgttgagggtccttacaagcctgcccactaccgatactgagcaaagcctgttttggtattacatggtttggcaacaatgcagctttctatgacaggcagttggagcactggccttttttggcgtctgccttatttttctataataaaaacaagaggtctaatgtatggaaggtggagctgctgaatttacaatagcagcatttgctcttctccttttcagttcggttatttcctaggattatatttgaggtttcttcattgttggggttttatatcactggaatttcaaaatggaagtaaaaatttataagtttgtccggttgacctatttcttttgtgattggcatgataaagaagaattgatttattcccttggtataatgaaataaacattagatgtttttataccagcctcacaaagatatcagcagtgcttaccacatcctcaagggtcagaacagggagaccttccataagggcttg

SEQ ID NO: 7912 - DNA, 1570 bp, Vitis vinifera
gttggtcatctatttacgcgctgctgtcgcttgattttatcttgtcctggcctctctatctacacttcatcctcacttctcaagtgccaaaccctagctagccaccgccatggctcttgtcgtcgagaagaccacctccggccgagagtacaaggtcaaggacatgtctcaggccgacttcggccgcctcgaaatcgagctcgcagaagtcgaaatgcctggactcatggcttgccgtaccgaattcggaccccagcaacccttcaaaggtgctcgtatcactggatctctccacatgaccatacagaccgccgtcctcatcgaaaccctaaccgccttgggtgccgaggtccgctggtgctcatgcaacatcttctcaactcaagaccacgccgcagcagccattgcccgcgactctgccgccgtattcgcctggaagggtgagaccctccaggagtactggtggtgcaccgagcgtgccctcgattggggccccggcggtggccctgatctgattgtcgacgacggtggcgatgccacgctgttgatccacgaaggagtgaaggctgaggaggagtacgagcgatctgggaagcttccggaccctgcttccactgacaatgctgagttccagatcgtgcttggaatcatcaaggaagggctgtcggttgatccatgcaagtatcggaagatgaaggagagattggttggagtttcggaagagacaaccaccggtgtgaagaggctgtaccagatgcaggcaaatggaactcttttgtttgctgctatcaatgtcaacgattctgttaccaagagcaaggtaatggataacttgtatggatgccgacactccctccccgatggtctcatgagagccactgatgtcatgattgctggcaaggttgctgtggtctgtgggtatggagatgttgggaagggctgtgctgccgcgctcaagcaggctggtgcccaggttatcgtgactgagattgatccaatttgtgctctccaagccctaatggaaggtatcccagtcctaaccttggaagatgtagtctcaaaggctgacatctttgtgaccaccactgggaacaaagacatcatcatggttcaccacatgaagcagatgaagaacaatgcaattgtttgtaacattggccactttgacaatgagattgatatgcttggtctggaaacctaccctggtgttaagcgcatcacaatcaagccccaaactgatcgatgggttttcccagaaaccaacagtggcatcattattctcgctgagggacgactgatgaacttaggatgtgcaactgggcatcccagctttgtgatgtcatgctcgtttacaaaccaggtgattgcccagcttgagctctggaaggagaaggcaacgggcaagtatgagaaaaaggtgtacgtgctgcccaagcatctggatgagaaggttgcagctcttcaccttggaaagcttggtgctaagctcaccaagcttagccccgagcaagctgcttacattagtgtccctgtggaaggtccttacaagcccactcactacaggtactag

SEQ ID NO: 7913 - DNA, 1732 bp, Platanus occidentalis
gaaaacctcctccggccgagaatacaaggtcaaggacatgtctcaggcggacttcggccgcctcgagatcgagctcgccgaggttgagatgcccggattaatgtcttgccggtcagagttcggcccctcccagcctctcaagggcgcccgcatcaccggctcgcttcacatgaccattcagaccgccgttctcatcgaaaccctcaccgccctcggcgccgaggtccgctggtgctcctgcaacattttctcaactcaagaccacgccgccgccgctatcgcccgggacagtgctgcggtttttgcgtggaagggggagacacttcaggagtactggtggtgcactgagagggctctggattggggtcctggtggtggccctgatctgatcgtcgatgatggcggagatgctactttgttgattcacgagggggttaaggccgaagaggagtttgagaagaatgggaagattcctgatccggcgtcgacggataatgcggagttccagatcgtgcttgggattattagagatggattgaaggttgatccgaagaagtatcataagatgaaggagagattggttggtgtttcggaggagaccaccactggtgtgaagaggttgtaccagatgcaggcgaatggatcgttgttgtttcctgctattaatgttaatgattctgtcactaagagcaagttcgataacctttacggatgccgacactccctccccgatggtctcatgagagccaccgacgtcatgatcgccggcaagattgccgttgtctgcggatacggagacgtcggcaagggttgtgcctccgctatgaagcaggccggtgcccgtgtaattgtgacagaaatcgatccaatctgcgccctccaagccctcatggaaggcatcgcagtccgaaccctggaggacgtcgtcgcagaaggggacatcttcgtgaccaccacagggaacaaagacatcatcatgcttcaccacatgaagaagatgaagaacaacgcaatcgtctgcaacatcggccacttcgacaacgagatagacatgctgggtctggagaattacccaggagtgaagcgcatcaccatcaagccacagactgatcgatgggtcttcccggagaccaacagtggcatcattgttcttgcagaaggccgactcatgaacttgggttgtgccaccggacaccccagctttgtgatgtcgtgctctttcactaaccaggtaatcgctcagctggagctgtggaaggagcgagccacgggcaagtatgagaagaaggtgtacgtgctgcccaagcatctggatgagaaggttgctgcacttcaccttggaaagctcggagctaagctcactaagctcactccggcgcaggcggagtacatcagcgttcccgtcgaaggaccttacaagcctcctcagtacaggtattgaggcagggagactaagagacagaaaagagagaagaagaggaacaccggctcctaggctaatattgggtcgggtttaatattctatttgtttgaaagtcatctgtctttggtagcctgaaggctgtgtgtgtatggttttttgggtggctgagtttgtatcgccgccggcgtctcgtttcagtgaagcaggagtcatagtagttccattattagtaggggttttgtgtgagatgtgtttcattttaatgtagtcaagaaaactttagtctgtaacgattaataagtaaaaaaa

SEQ ID NO: 7914 - DNA, 1850 bp, Trigonella foenum-graecum
aaaccctcacactaacacagcctcttcaaacgctgcgtttagtgtaagcccaccatgtctctcaccgtcgagaaaacccaaaccggccgtgagtacaaggtcagagacctttcccaagccgatttcggccgactcgagctcgagttagccgaaatcgagatgccaggactcatgtcctgcagaaccgagttcggaccatcacagcccttcaaaggagccagaatcactggatctcttcacatgactatccaaaccgccgtcctcatcgaaaccctaaccgccttaggtgctgaagtccgttggtgctcctgcaacattttctcaactcaagaccacgccgccgccgccatcgctcgtgacagcgccgccgttttcgcctggaaaggtgagactcttcaggagtattggtggtgtactgaacgtgctcttgattggggtcctgatggtggtcctgatttgattgttgatgatggtggtgatgctacgcttttgatccatgaaggtgttaaggctgaagagctttttgagaaaactggtgaggttcctgatcctacttctactgataacgttgagtttcagcttgtgcttactatcattagagatgggttgaagactgatcctaagaggtaccgtaagatgaaggagagacttgttggtgtttctgaagagactactactggagtgaagaggctttatcagatgcaagctaatggaactcttttgttccctgctattaatgtcaatgactctgttaccaagagcaagtttgacaacttgtatggatgccgtcactcacttcctgatggtttgatgagggctactgatgttatgattgccggtaaggttggtgtggtcgcaggatatggagatgtaggaaagggttgtgctgttgccttgaagcaagctggagctcgtgtgatcgtgactgaaattgatccaatctgtgcccttcaggctcttatggaaggtttccaggttctgactcttgatgatgttgtctcttatgctgacatctttgttaccaccactggtaacaaggacatcatcatggttgatgacatgaggaaaatgaagaacaatgcgattgtttgcaacattggtcactttgacaatgaaattgatatgtctggactagagaactatcctggtgtgaagcgtgtcaccattaagcctcaaactgacaggtgggtcttccctgagaccaacaccggcatcattgttttggctgagggtcgtttgatgaacttgggttgtgctactggacaccctagttttgttatgtcatgctccttcaccaaccaggtcattgctcaacttgagttgtggaatgagaggaaatctggaaagtatgagaagaaggtttatgttttgcctaagcatcttgatgagaaggtggctgcacttcaccttggcaagcttggagctaaactcaccaagctttcccaatcacaggctgattacatcagtgtgccagttgagggtccatacaaacctgctcactacaggtattgagagatgatcaaggtgttggtgagagttcgagggaagaagaacatgcgctttatgaaatgacttgatttttcattttccttgttggattttttggaattagactttttcagaattgtagtcgatgaatgataggtttttgtagtgtgtggggggatgggtaagaggaaggcaacctattggtttctgttgaacgagaccaattgggtttgaataatgcctttgtttgggtttgtgtgacaattattctgaatttgagtttctgtagaccttaaatgtttcaaaaaatgagaaatattttcttgcatccttttcttattttaaaataatcaatgttcaga

SEQ ID NO: 7915 - DNA, 1820 bp, Cephalotaxus harringtonia
ggtggctctcctcttattgctcatcgacagatcccgggttcaaatcctaatctgatctgttcatctattttttgtttcgtttcttcttcggcaatggcgctgctcgtggagaagactgtggcggggagggaatacaaggtgaaggacatgtcgcaggcggacttcggtcgcatggagttagatttggcggaggtggaaatgcccgggctcatggcgtgcagggtcgagtatggtccttcgcagcctttcaaggccgcccgcatcaccggctcactccatatgaccatccagaccgcagtgctcattgaaaccctcaccgccctgggagctgaagtcagatggtgctcttgcaacattttttctacacaggatcacgctgctgcagccattgcccgtgacagcgcggctgtgtttgcatggaaaggggagacccttcaagagtactggtggtgcacagaaagggctctggattggggccccggtggtggcccagatctgattgtggatgatggaggtgacgccacactgctgattcacgagggggtcaaggctgaggaagagtttgctaagactgggaaaattccagacccgacttcaactaccaatcccgagtttcagattgttttgggattgatcagggacactctcaaggaggaccccctcaaatatcacaagatgaaggataggttggttggtgtctctgaggaaaccactaccggggttcacaggctgtaccagatgcaagctaatggctctctgctcttcccggctattaatgtcaatgattctgttaccaagagcaagttcgataatctgtatggatgcaggcactctcttccagatggtctgatgagggccaccgatgtgatgattgctggcaaggttgctgttgtctgtggatatggagatgttggtaagggttgtgctgcagccatgaaggctgctggagctagggtgattgtaacagagattgatccaatttgtgctctacaagcccttatggaaggtatccctgttctgaccctagaggatgtggtagacactgctgatatctttgtgacaactacaggtaacaaggatattatcatggtcgatcacatgaggaagatgaagaacaatgccattgtttgcaacattggtcactttgacaatgaaattgacatgcttgggcttgaaacctaccctggtgttaagaagattactataaagcctcagactgaccggtgggtgttccctgaaaccaacagtggcattattgttcttgcagaggggcgtctcatgaacttgggttgtgctactggccatccaagttttgtcatgtcttgctccttcacaaaccaggttattgctcagctggagctttggaatgagaggaaaacagggaagtatgagaagaaagtgtatgtgctccccaagcatctggatgagaaggtggctgctctgcacctgcccaagttgggtgcaaagctaacaaagctttctccagagcaagctgcatacatcaatgtgcctgttgtgggtccttacaagcctacccactaccgatactgagcaaagcatgtctctaacatgacccattagtgcaggagagccaatttgagaaatatgctatagaagcacagcccatttttagtttctccattattttactgtacctcttaataaagaacaagaagtctattgtaccgtgggtgcatatgcttaaattattacagcagcatctacagtttgttcttttcaatttagattctagaatagttggattttgaatggaattttatattgcaagtacaaaattatcaaatatgattcttggttgt

SEQ ID NO: 7916 - DNA, 1745 bp, Gossypium hirsutum
agtgtatcagtgtttcttcccctcttactaattctctccgccaagggctctctccgtcgagaaaaccgccgccggccgtgagtacaaggtcaaagacatgtctcaggctgacttcggtcgtctcgagatcgagttagctgaggttgaaatgcctggtttaatggcttgtagaaccgagttcggccctgcccaacctttcaaaggagccaaaattactggttctcttcacatgaccatccaaaccgccgttcttattgaaacccttaccgccctcggagctgaagtccgttggtgttcttgcaacattttctctacccaagaccacgctgccgctgccatcgctcgtgactccgccgctgttttcgcttggaaaggggagaccctccaggaatactggtggtgtactgagagagcccttgattggggtcctactggtggacctgatctgatcgtcgatgatggtggtgatgctactttgttgatccacgaaggtgttaaagctgaggaagtttatgagaaaactgggcaactcccagatccggcttcgactgataacgctgagtttcagattgttctaaccattatcagagatgggttgaaagcagatcccaagaagtatagaaggatgaaggagagattggtaggtgtttctgaagaaactacaactggagtaaagaggctttatcagatgcaggccaatggtaccttgttgttccctgccattaatgtcaacgactctgttactaagagcaagttcgataacttgtatggatgccgtcactcacttcccgatggtttgatgagagctactgatgtgatgattgccggcaaggtcgccgttgtctgtggttatggtgatgtcggaaagggttgtgctgctgccttgaagcaagccggtgctcgtgtcattgttactgagattgatcccatctgtgcccttcaggctctcatggaaggacttcaggttttgaccctagaagatgttgtctccgaggctgatatcttcgtcaccacaaccggtaacaaggacatcatcatggttgatcacatgaggaagatgaagaacaatgccattgtttgcaacattggtcactttgacaatgaaatcgatatgctcggtcttgagacctatcctggtgttaaacgcatcaccattaagcctcaaaccgataggtgggtcttccctgaaaccaaaaccggcatcattgtgttggctgaaggacgtctgatgaacttgggatgtgccactggacacccaagttttgtcatgtcctgctcgttcactaaccaggtgattgcccagctcgaactatggaaggagaaggcaactggaaaatatgagaagaaggtttacgtattgccaaagcacctcgacgagaaagttgctgcacttcacctcggcaagctcggagctaagctcactaagctcactaaagatcaagctgattacattagtgtgcctgttgaaggtccttacaagcctcctcattacaggtactgagagaagagttgatgagtttttatcaagaaagaaaaaacatccggatggtttgattgtttcttgttttactgaaatttcatgatggttagggggtgatgggaaagtgcctgggggtgggaaaatgatgtgggatttggtatcttcttgtatgaagatgaccaaatgggtttgaaataaaaatgttagggatgtgtggaagattatatagtatttgccattaatgcagtcttgttttgctgcattg

SEQ ID NO: 7917 - DNA, 1908 bp, Cycas rumphii
gctcatcttatctttctccgatctctggagcattcgttcggtagcactgagttgtgcttggctcggatttgtatctgagttacgctggtctgcgttttttgcagatctctgtgggttttattgaggttttagaagagccatggctctcatcgtggagaaaacggtttcaggaagggaattcaaggtgagggatttgtcccaggcagacttcggtcgcttggaaatcgaacttgcagaggtcgaaatgcctggattgatgtcctgcagggccgaatttggcccctcacagcccttcaagggagctcggattaccgggtctctccacatgaccatccagacggctgttttgatcgaaacgctaactgctctgggtgccgaagtaagatggtgttcctgcaacatcttctctacacaggaccacgcggctgccgccactgctagagacagtgctgccgtattcgcttggaagggagaaactttgcaagaatactggtggtgtaccgagagagcattggattggggtcccggtggcggcccagatctgatcgtcgatgatggaggggatgccacgcttttgatccacgagggtgttaaggccgaggaagagtatgccaagactggaaaaatcccagatccatcctccactaccaatcttgagatgcagattgtcttgggattgattaaagatagtctccaggaagatccccaaaagtatcacaagatcaaggacagattggttggcgtttctgaggaaaccacaactggggtcaagaggttgtatcagatgcaggctaatggttcattactgttccctgccatcaatgtaaatgactctgttaccaagagcaagtttgataacttgtatggatgcagacattctctcccagacggtcttatgagagccacagatgtgatgattgctggtaaggttggggttgtatgtgggtacggagatgtgggcaagggttgtgctgcagccctcaaggctgccggagctagggtcattgttacagagattgatccaatctgtgccctacaagcgcttatggaaggtatccctgtactaacacttgaggatgtgctgagcactgcagacatctttgtgactaccactggtaataaggacattatcatggtggatcacatgaggaggatgaagaacaatgccattgtatgcaacattggacattttgacaatgagattgacgtgcaaggtcttgaaacttaccctggaatcaagaggataaccatcaagcctcagacggatcgttgggtattccctgaaacaaacactggcatcattgttctggcagagggtcggctcatgaacttgggttgtgctactggccatccgagttttgtgatgtcctgctccttcacaaaccaggtgatcgctcagctggagctctggaacgagaggaggtctggaaagtacaagaaggaggtctatgtgctcccaaaacatcttgatgagaaggtggctgctctgcatctggacaagctgggtgccaagctcaccaagcttactccttcacaggcggcatacatcaatgtgccaattgagggtccttacaaacctgtccactaccgatattgagagagttgtagttttgctgctttgagttggggctggttagaggtttcctttgcttgccagtgggaggacccgctaatttagtgccaattcccatatgacactcaaataagagaattgttagcactggtgggctgccgacttcttttcatagcagctttctttttccttttgtagtgggcataacgtaaagcagtggattttcccgttcacgaaggtcctatggatcctatcacgctgttttagcgaagtgccataagtatttatgttcaatttgattctttatatgaatcaaacttcacttttgttctgtg

SEQ ID NO: 7918 - DNA, 1887 bp, Amorphophallus konjac
cggccgggggtcccgaaccatttctcttcccacggaagtatatacagagaaagagggagagcgatcagatctggcaatggcgctgtcggtggagaagacgtcctccgggagggagtacaaggtgaaggacatgtcgcaggcggacttcggccgcctggagatcgagctggcggaggtggagatgccgggtctcatggcctgccgcaaggagttcggccccgcccagcccttcaagggcgcccgcatctccggctccctccacatgaccatccagaccgccgtcctcatcgagaccctcaccgccctgggcgccgaggtccgctggtgctcctgcaacatcttctccacccaggaccacgccgccgccgccatcgcccgcgacagcgccgccgtcttcgcctggaagggcgagaccctccaggagtactggtggtgcacggagcgatgcctcgactggggggctgacggcgggcccgacctcatcgtggacgacggcggcgacgccacgctgctgatccacgagggggtcaaggcggaggaggagtacgagaagtccgggaaggtgcccgaccccgcctccaccgacaacgccgagttccagctcgtgctcggcatcatccgggacgggctcaaggcggacccccgcggtaccggaagatgaaggagaggctcgtcggcgtgtccgaggagacgaccaccggcgtcaagaggctctatcagatggaggccaacggctctctcctcttccctgccatcaacgtcaacgactctgtcaccaagagcaagtttgataacctctacgggtgtcgccactccctccctgatggcttgatgagggcaactgatgtcatgattgccggcaaggtcgccgttgtctgtggttacggagacgtgggcaagggctgtgcttccgccctcaagcaggccggggcacgggtcttcgttactgagatcgacccaatttgcgccctccaagccctcatggaaggcatccctgttcgtactctggaggatgtgctgtccgaggctgacatctttgtgacgaccaccgggaacaaggatatcatcatggtggaccacatgaggaagatgaagaacaatgctattatctgcaacattggccactttgacaatgagatcgacatgcacggcctggagaccttccctggtgtcaagcgcatcaccatcaagccccagtcagaccgctgggtcttccctgacaccaacagcgggatcattgtcctagcggagggccggctcatgaaccttggatgtgcaactgggcatcccagctttgtcatgtcctgctccttcaccaaccaggtcattgctcagctagagctgtggaaggagaagggcagcggcaagtacgagaagaaggtgtatgtgttgcccaagcaccttgacgagaaggtggcagccctccacctggagaagctgggtgctaagttaaccaagctcactccagaacaggccgagtacatcagtgtccctgtcgacggcccgtacaagcccgctcactacaggtactaaatcaaaataaacacaggaaacggcgtgacagagggagagtccggccaacaacagaattcagaaggctagaaaagatttaaggacgcagtttacatctattttttcttcattatgctgtttttttcccagtttatcggccattgtagtagttggccgtgtagcagcagttagtgatgttagctccatgagctgatttacggatacaggggggaagagcatttatgcagggaaataactcctggttaagtccacaaggtggggcttcttcgccctgcgcgagttgtcttttgtttgatgaagtcttgaggaggtgagggttttccacccaccccatctctatttttcccttttttt

SEQ ID NO: 7919 - DNA, 2125 bp, Cephalotaxus harringtonia
attatgcacccccgcccccttctcaatctcaatcgcagcctcctccttcccatgaccgcccaacatcgccaccaccgccgccacctcctccatcctcccctcatccggacaatctctcaaaactcttttgttacttcttcaggtctcgagttcgaatcctgccggaagtcagatcttctttttctttgccttccttatcttctccttctttggccatggcgctcctggtggagaagaccgtgacggggagagagttcaaagtgaaggatttgtcgcaggcggacttcggtcggatggagctcgatctggccgaagtggaaatgcccggtcttatggcatgcagggtggagttcggccctacacagccgtttaagggagcccgcattacgggttctcttcatatgaccattcagactgcggtcctcatcgagaccctcactgcccttggagctgaagtcagatggtgctcctgtaacattttctccacccaggaccatgcggctgcagccattgcgcgtgacagtgcggctgtgtttgcttggaagggggagaccctccaagaatactggtggtgtactgagagggctctagactggggccctggtggtggcccggatctgattgttgatgatggaggtgatgccaccctattaattcatgaggggttcaaggccgaggaagagtttgccaagactgggaagattccagatccgacttcaactaccaaccccgagtttcagattgttttgggattaatcaaggacagtcttaaggaggatcccatgaagtatcacaagatgaaggataggttggttggtgtgtctgaggaaaccactacaggggtgcacaggctgtatcagatgcaggccaatggctctttgcttttccctgccattaatgtgaatgattctgttaccaagagcaagtttgataacttgtatggatgtaggcactctcttcctgatggtctgatgagagccactgatgtgatgattgctggcaaggttgctgttgtatgtggatatggagatgttggaaaaggttgtgccgcagccctaaaagttgctggagccagggtcattgtaacagagattgacccaatttgtgctctgcaagcccttatggaaggtctccctgttctgaccctacaggatgtggtaagcactgctgatatctttgtaacaaccacgggaaacaaggatattatcatggtggatgacatgaggaagatgaagaacaatgccattgtttgcaacattggtcactttgataatgaaattgatatgactggacttgaaacctaccctggtgttaagaagattactatcaagcctcagactgatcggtgggtattccctgaaaccaacagcggtatcattgtccttgcagaggggcgtctcatgaacttgggttgtgctaccggccacccaagttttgtcatgtcttgctcattcacaaaccaggttattgcacagctggagctttggaatgagaggaaaacagggaagtatgagaagaaggtttatgtgttgcccaagcatctggatgagaaggtggctgctctgcacttgcccaagctgggtgccagacttacaaagctttctccagagcaggcagcatatatcaatgttcctgtcgagggtccttacaaggctgcccactaccgatattgagcagattatggtttacccatgactaatttggcgcgagagctgttttcatgatgggcaataggagctccgaccaattttggcgtttgcattgttttccttggaagtgtaataaaaaacaagaggtctactacagtagcaccggtttcaaccttcactttggatgtatgacagaagaatttagtatcttctctatttagaaacttaatgtgaggcatctttgtttgcattttgaaatggtagcatgaatatatttatgtaatggtagatattttgacggacatgcacacgagtgaaagaatgttcagtctttgcatgaggttattcactactacagctatcttaaatgcatctatgtgaaaaacgtttatcaatttcaaggtgtttattttgaatttgtaatatagttgtacttattgaagataacatgaaaaaatttcagtgcctcaatataa

SEQ ID NO: 7920 - DNA, 2186 bp, Zingiber officinale
  misc_feature (386)..(386): n is a, c, g, or t
  misc_feature (390)..(390): n is a, c, g, or t
  misc_feature (394)..(394): n is a, c, g, or t
  misc_feature (405)..(405): n is a, c, g, or t
  misc_feature (1400)..(1400): n is a, c, g, or t
  misc_feature (1937)..(1937): n is a, c, g, or t
gtgggttgcggccggaggtggggtggcggaggagggcgatggggagttggtcgcggaggatgaaggcgccgcgagtgaagacgtggtggagggcgaggaggcacttgagggcgacggcggggtcgcgggtggagcggaggcggtcggcgagggcgccgacggcggacgcggcggagagacgggagccgtgtccgaaggagaggagcgcgcggatgtggcgggggcgggggggctcgtcggcgggctggtgaggcgtggcgcgaaggacagcgatctgggcagcggaggaaggggagagggttgcagcggcggcggcggcgaacgaggcggtgtccttgagcgcgccgacgaggccgcggagcttgcgacccatctctctgactctntctntcgncccttttcctnttcgatctcgtttcttcgaagccctaacgatggctctgatcgtggagaagacgtccgctggccgggagtacaaggtcaaggacctctcccaggctgacttcggccgcctcgagatcgagctcgcggaggtagaaatgcccggcttgatggcctgccgctctgagtacggcccctccaagcccttcgccggcgcacgcatctccggctccctccacatgaccatccagaccgccgtcctcatcgagactctcaccgccctcggcgccgaggtccgctggtgctcctgtaacatcttctccacccaggaccacgccgccgctgccatcgcccgcgactccgcggccgtttttgcctggaagggcgagacactcgccgagtactggtggtgcacagagcgtgcccttgactggggcaccggcggcggccccgatcttatcgtcgatgacggtggtgacgccacgctcctcatccatgagggggtcaaggccgaggaagagtacgagaagagcggcaagttgccagatccggcctccaccgacaacgtcgagttccagctcgtgctcggtatcatccgtgatgggctcaaggtcgatcccaagaagtaccacaagatgaaggagcgcctagtcggcgtctcggaggaaacaactactggtgtcaagcgactgtaccagatgcaagccagcggctccctcctcttccccgccatcaatgttaatgactccgtcacaaagagcaagttcgacaatctgtatgggtgccgccactcccttcctgatgggcttatgagggctaccgacgttatgatcgccggcaaggttggcgtggtctgtggttatggagacgttggcaagggttgcgccgctgctctgaagcaggcaggtgcccgtgtcatcgtcactgagatcgatcccatctgcgctctccaggccctgatggagggcatccctgttctccccctggaggatgttgtagctgaggccgacatcttcgtnaccacaaccggaaacaaagatatcattatggtggatcacatgaagaagatgaagaacaatgccatcgtatgcaacattggccacttcgacaacgagatcgacatgcacgggcttgagacctacccaggcatcaagcgcatcaccatcaagccccaaaccgaccgctgggtcttccccaagacgaactctggcatcattgttcttgcggagggacgtctcatgaaccttggctgtgccactggacatcccagctttgtcatgtcctgctccttcacaaaccaggtgattgcccagcttgagttgtggaaggaaaggaaaagtggaaagtatgagaagaaagtgtacgtactgcctaagcatctggatgagaaggttgcggctctgcacctgggtaagctgggagccaagctcaccaagctcacaccagagcaggcagagtacatcaatgttgccgttgaaggcccttacaagcctgctcactacaggtactaatgtgctatttcggtctgagatgatacccgaaatgcaatggcggcngtcttaccccagggatcggagtgatgctgaaattatctttgcttgatttaccttctacctttttctgtttttgctatttccgatggagttttattccatgttgaattcgatgaggaatgctgtgggcaagcttaggaactgaataattctccaagcgatgcccctttagtacttcttgttgtcgaactactatgtgaaatttagttttgagccttcccctcgtgccgaattcggcacgaggcctcgtgc

SEQ ID NO: 7921 - DNA, 2085 bp, Coffea canephora
ctcctcttcttgtcagtcctaaacccagaaccctcgcccgagcccgatccaaaccatggccctctcagtcgagaaaacctcatccgggcgcgagtacaaggtcaaagacctgtcacaggccgacttcgggcggctcgaaattgagctggctgaggtagaaatgccgggactcatggcatgtcgggccgagttcgggccttcgcaacccctcaagggagccagaatcactggttctctccacatgactatccagaccgccgtcctcattgaaactctcaccgcccttggcgcctccgtccggtggtgctcgtgcaacatcttctccactcaagaccacgccgctgccgccattgcccgcgactccgctgccgtttttgcctggaaaggggaaacccttcaggagtattggtggtgtactgagagggcattggactggggttcagaaggagggcctgatttgatagtggatgatggtggtgatgcaactttgctgattcatgagggggttaaggcagaggaggagtatgagaagactgggaagttgccggacccgagctcaactgaaaatgccgagtttcagatagttttggggataattagagatggacttaaggtggatcccaagaagtaccacaagatgaaggggagattggttggtgtttcggaggagactaccaccggtgtcaaaaggctttatcaaatgcaagctaatggaaccctgttgttctccgctattaatgtcaatgattctgttactaagagtaagtttgacaatctgtatgggtgccgtcattccctccctgatggtctcatgagggctaccgatgtgatgattgctggtaaagttgctgttgtctgtggatacggagatgttggtaagggttgtgctgctgctctcaagtcagcaggtgctcgtgtgattgtgacagaaattgacccaatttgcgctcttcaggccttgatggaaggaattccagttctaactttggaagatgttgtctccaaagctgacatttttgtgacaaccacaggaaacaaagacattattatggtggaccacatgaagaagatgaagaacaatgcaattgtttgtaacataggtcactttgataatgaaattgatatgcttggtcttgaaaactaccccggcgtgaaacgggtcaccatcaagccccaaactgaccgctggattttccccgaaaatgaaactggcatcattatacttgctgaaggacggctgacgaacttgggctgtgcaactggacatccaagctttgtcatgtcttgctccttcaccaaccaggtgattgcacagcttgagctttggaaggagaaggcaactggcaagtatgagaagaaggtgtacgtgttgccaaagcatttggatgagaaggttgctgcccttcatttgggaaagcttggagctaagttgacaaagctcacttctggccaagctgcctatattaatgttccagtagagggtccatacaagccacctcattatcggtactgagagatgaacaacctggatgaagggcttctactggtacttctttgggtgttggtttagatgctttcggttggccgtttcctcgttgattctgagttatgatagttataattgaaatatagatcgttttagattgtggttcgactctgccatctggcaaatgaagtcgtttttgtaatgatgagtaaccaaaaatggtgaactgataagtgatgcatatgaatcagtttattgttaagttttaaagccattgcttgttgcatcagctaatgctgttttgtaatctccagatgaagcttgcataaacatcctaccttgctgctttgatgttgcaacatatgcaatgaagataaaagcattgtcagaactgcaaaaagattatcccatgatgttctgcaattgcacatgggcatacagcttgagaccagaaattttgattggtgtcattttgaagagatgagctaaaagaacaacccctaactagagtatagatctctggtttcataagaagtttatcctttcaaaagagtagagagccacaagtccttgggctagcatatccttctttgatggaa

SEQ ID NO: 7922 - DNA, 1821 bp, Phalaenopsis aphrodite
tgccattcgcagcgggaggcaaaaatttcccgatctatttctctttcatcgccatggctctgctcgtggagaagactacttccgggcgcgagtacaaggtgaaagacttatcccaggccgatttcggccggctcgagatcgagcttgcggaggtcgagatgccaggcctcatggcttgccgcgctgagttcggcccctccagccgttcaaaggcgcgcgtatctccggctctctccacatgactatccagaccgctgtgctcattgaaaccctaacggccctcggtgccgaggtacgctggtgctcctgcaacatttttctccacccaggaccatgctgctgccgcaatcgcccgtgattccgccgtccgtttttgcttggaagggagagacccgttcaggagtactggtggtgcacggagcgctgcctagaatggggcgccggcggaggcccggatctcattgtcgacgacggcggtgatgcgacacttctaatccatgagggagttaaggctgaggaggagtacgagaagaacgggaaaattccagatccggcttctacggacaacgcggagttccagatcgtgcttgggctcatcagggatagcttaagcgtcgatccgaagaaatatcggaggatgaaggagaggctcgttggcgtctctgaggagacgaccaccggagtgaagaggttgtaccagatgcagtacagtgggacccttctttccctgccatcaacgtcaatgactcagttaccaagagcaagtttgataacctatatggttgccgtcactctctccccgatggcctaatgagagccaccgatgtcatgatcgccggcaaggtagctgttgtttgcggctacggagatgtaggcaagggttgtgccgcggcactcaagactgccggtgctcgtgtcatcgtcactgagatcgacccaatatgtgcccttcaggccctcatggaaggcctccctgtcctccgccttgaggacgtcgtgtccgaggctgacattttcgcaccaccaccggcaacaaggacatcatcatggttgaccacatgaggaagatagaagaacaatgccatcgtctgcaacattggccactttgacaacgagattgatatgctcggactcgaatcattccccggtgtcaaacgcatcaccattaagccgcagacggatcggtgggtcttccctgacacaaatagcggcatcctcgtgctggcggagggccgtctgatgaatctcggatgcgccacgggtcaccccagctttgtcatgtcgtgctcttttacgaaccaggtaattgctcagctggagctgtggaaggagagggcgtcgggaaagtatgagaagaaggtgtatgtgttgccgaagcacctggatgagaaggttgcagcacttcaatttaggcaagcttggggccaagctcaccaagcttacctcctcgcaggctgatacatcagccgtccggtcgacggtccctacaaacacgcccattacaggtatagagaattttaatgtgaggaaactgaatctgtggaacttctgtccattggattcaaaggaggaatcagctcatacttatctttatcaagttatgctctatttatcctttaaacattggtttaatgttgttgttgattgaagggggtgagtgtgatttctgagaggaataatgtaggtttgtgggttgtggcggaggtgttgtatccgtccctgactatagttcgggagttacttttttgtttttgtgtagcccttttctatatggggcttttggaggaaatttaatgaacttgttttgcaagatgctagttt

SEQ ID NO: 7923 - DNA, 1439 bp, Flaveria ramosissima
aacagagtgtgtgatcaccggaaccctaactccgattagactcaccggaaccctaactccggccaccatgtctctcaccgtcgagaaaacctccaccggccgtgaatacaaggtcaaagacatgtcattagccgatttcggccgtctcgagctcgaattagccgaggtcgaaatgccggggttgatgtcttgccggacggaattcggaccttcacagccgttcaagggcgctagaatcaccggatcactgcacatgacgattcaaaccggtgtgttgatcgaaaccctaactgctttgggagctgaagtgagatggtgctcatgcaacatcttctcgacgcaggatcacgctgcggctgcaatcgctcgtgattccgctgcggtgttcgcgtggaaaggggagacgcttcaggagtactggtggtgtacggaacgagcgcttgattgggggcctggtggtggacctgatctgatcgttgatgacggtggtgatgcgacgttgttgattcatgaaggtgtgaaagctgaagaggagtttgagaagaccgggaagttgccggatccgaattcgactgataacgctgagtttcagatcgtgttgtcgattattaaggaagggttgcagagtgacccgaagaagtatcacaagatgaaggagaggttggttggtgtgtctgaggagactaccactggtgttaagaggttgtatcagatgcaagctaatggtaccttgctgttccctgcgattaacgttaatgattctgtcactaagagcaagtttgacaacttgtatgggtgccgccactcactcccagacggactgatgagagccactgatgttatgattgccggaaaggttgcagtagtctgtggttatggtgatgtcggcaagggttgtgccgccgccatgaagcaagccggtgcacgtgtcatagtgacagaaatcgaccccatttgtgcccttcaagctctcatggaaggtctccaagtcctaaccctagaagacgttctctcagaagctgacatctttgtcaccaccacaggcaacaaagacattatcatggttgaccacatgaaaaagatgaaaaacaacgccatcgtctgcaacattggccattttgacaatgaaatcgacatgcttggcttagaaacataccctggtgtgaagagaatcaccatcaaaccccaaaccgacaggtgggtattccctgaaaccaacagcggcatcattgtgttagccgagggtcggctcatgaacttgggctgtgccacgggtcaccctagttttgtgatgtcatgctcgtttaccaaccaagtgatcgcgcagctcgagctgtggaaagagaagtcatcagggaagtacaagaaggaagtttatgtgttgcctaagcatcttgatgagaaagtggctgcacttcatcttggaaagcttggagcca

SEQ ID NO: 7924 - DNA, 1983 bp, Pinus taeda
gcattctccgtttggagcaaatcgtcctaatctcggtcgccgtaatccgtggttctgtcagttctgcgttttctttctccgcagcaatggcgcttctggccgagaaaactgtgtccggaagggaattcaaggtgaaggatctgtcccaggcggattttgggagattggagattgaattggccgaagttgagatgcctggattgatggcctgcagagctgagttcggcccctctcagccctttaagggtgcccggatcactgggtcccttcacatgaccatccagaccgcggtgctcattgagaccctcacagctctgggtgctgaggtgagatggtgctcctgcaacattttctccacgcaggaccacgccgccgcggctattgcccgcgacagcgctgcggtgttcgcttggaagggggagacgctgcaggagtactggtggtgtactgaaagggctcttgactggggtccaggcggtggccctgatctgattgtcgatgacggtggtgatgcaactttgttgatccatgagggggtcaaggctgaggaggagtttgccaagaccgggaaggtgccagatccggagtctaccacgaatgtggagtttcagatggttttgggattgcctcaaggtggatcccttgaggtaccacaagatgaaggatagattggttggtgtttctgaagagacaactactggtgttaagaggctttatcagatgcaagccagtgggacgttgctgttccctgctatcaatgttaatgactctgttaccaagagcaagtttgataacttatatggatgtagacattctctcccggatggtctgatgagagccacggatgtcatgatagctggtaaggttgctgttgtgtgtggatatggagatgttggaaagggttgtgctgcagctctaaaggagagtcattgttacagaaattgatccaatctgtgccctgcaagctcttatggaaggtctccctgtccttaccctagaggatgtagttagtactgctgatatttttgtgaccaccactggcaacaaggatattatcatggttgaccacatgaggaaaatgaaaaataatgccattgtttgcaacattggtcattttgacaacgagattgacatgcaaggtcttgaaactttccctggtgtcaagaagattaccatcaagcctcagacggataggtgggtgttccctgataccaacagtggaatctgatgaacttgggttgtgctactggccacccaagttttgtcatgtcttgctcctttacaaaccaggttattgctcagttggagctctggaacgagaagaagtcagggaagtacgagaagaaggtctatgtgttgcctaagcatctagacgaaaaggtggctgctctgcatttgcctaagttgggtgctcatctaacaaagctttctcctgaacaggcagcgtatataaacgtgcccgttgagggaccttacaagcctgtccattaccgatactgaagagaaatggcatttttggtgacttgctgggcgagtggcaaggctcctggacagttgccagaaggacgaatccccctccgtggccggctccattgttttgttccaatgctgttgttatgtatgtctgctgagtttattacggcagcaccgaaagatttcctgtttagtatggtcttatgatagaagtagtttgccatagaattggtattcgaggtttctccatgatgtagctagcttttgcattactgagattttagaacgcaagcaagatatatggttgtctctggttttgacttttttaacgaattactgaaatttcagaactcaagcaagatatatggttccctcgggttttgacttttaaacgattcaagtgtatttttatctgaggactgcaatttaaatgactgtaagaatgccatggagatggatgcagtatatctgctttacgagtctaatatagaattcataattgccttcttc

SEQ ID NO: 7925 - DNA, 1843 bp, Marchantia polymorpha
  misc_feature (1836)..(1836): n is a, c, g, or t
gcttggggctcgggagttgcagggcctgcagtctcgatcgaccgagcttgcatcgatttcgaacactccctgcggagctcgacgaaaggattgttcgaggtcgattgcgagcaggagtgacaggatggagctctccgtggagaagacgtccgcagggcgggagtacaaggtgaaggatatgtcgcaggccgatttcggtcgcatggagctcgacctggccgaggtcgagatgcccggcttgatggcgtgcagaaccgagttcggcccgtcgcagccattgaagggcacgaggatcaccgggtccctgcacatgaccatccagaccgccgttttgatcgagaccttgacggctttgggtgccgaggtcagatggtgctcctgcaatatcttctccactcaggaccacgctgccgccgccattgcccgtgacagcgctgccgtcttcgcctggaagggcgagactctggccgagtactggtggtgtaccgagagggctctggactggggtcccgacggaggccctgacctgattgtcgacgatggtggtgacgccactttgttgatccacgagggtgtcaaggccgagatcgagttcgagaaggacggtactctccccgatcccacctcgaccaccaaccaggagtttcagattgtgctgagcattctccgcgacgggctcaaggaggaccccaagaagtaccacaggatgaaggaaagactcgtgggagtctctgaggaaaccaccaccggagtgaagaggctttaccaaatgcaggagaccggaacccttttgttccctgccatcaacgtcaacgactctgtcaccaagagcaagtttgacaacctgtacggatgcagacactccctgcccgacggtttgatgagagccactgatattatgattgctggaaagtctgctgtcatcttcggatacggagatgtcggaaagggatgtgcctcagcaatgaaggccgccggtgccagagtgactgtcaccgagatcgatcccatctgtgctctccaggcctgtatggagggattctcagtccttcctttggaggacgttgttgccgatgctgatatcttcgtcaccaccaccggaaacaaggacattatcatggtttctgacatgattaagatgaagaacaacgccattgtatgcaacatcggtcattttgacaacgagatcgacatgctcggtcttgagacctacccaggtgtaaagaagatcaccattaagccccaaaccgatcggtgggtattccccgagacaaagaagggaatcattgttctcgccgagggaaggttgatgaatcttggatgcgctaccggtcacccaagtttcgtcatgtcctgctctttcaccaaccaggttattgcccaactcgagttgtggaacgagaggaattcaggcaagtatgagaagaaggtatacgtgctgcccaagcatttggacgagaaggttgccgccctacatctggagaagctcggagctaagctcaccaagttgactgccgatcaagctgcgtacatcagcgtgccagtcgagggtccatacaagccagctcactaccgttattgagctcgaaattttgcagtctgtgtagttgccccagtcaatcacattagtcaattgaatagatgacaccaatggaagtatttaattatcgctccaatgagtactttgaattctatttgagataggggttgtaccaatcatgagtacattgttggccattgcccagagttgtacggcctgatgggcctttccatccttctttttttattcacttctcactgacaattgcaatgagaaaaattggttcagcaaataanaaaaaaa

SEQ ID NO: 7926 - DNA, 1794 bp, Phalaenopsis aphrodite
ggccctaaggatcgccggagagctttatccctcatctccttcgccgcccagctccgtcgccatgactctcctagtggagaaaacctcctctgggcgcgagtataaggtgaaggacatatcccaggccgattttggccggctcgagatcgagctcgctgaggtcgagatgccaggtctcatggcttgccgcgcagagttcggcccctcacagccattcaagggcgcacgcatctccgggtcccttcacatgaccatacagaccgccgtcctcatcgaaacattgaccgcccttggtgccgaagtccggtggtgctcctgcaacatcttctccacccaggaccacgctgcagccgccatcgcgcgagattctgccgccgtgtttgcctggaagggcgagactctacaggagtactggtggtgtaccgagcgctgcctcgagtggggtgccggaggtggccccgatctcattgttgatgatggcggcgatgcgacgctgctcatacacgagggtgtcaaggcggaagaggagtacgagaaaaccgggaagctaccagatccagcatccacggacaacgcggagttccagatcgttttggggcttattagcgacagcatcaaagtggatcccaaaaagtactcgaagatgaaagagagactggttggtgtctcggaggaaacaaccaccggagtgaaaaggctgtaccagatgcaggccagtgggtctttgctcttcccagctattaacgtcaatgactccgtgaccaagagcaagttcgataatctatacggttgccgccactctctacccgatggtctaatgagagccactgacgttatgcttgccggaaaggctgccgtggtctgcggttatggagacgttggaaaaggctgtgctgccgccctaaaaaccgccggagctcgcgtcattgtgaccgagatagaccccatttgtgctctccaagccctaatggaaggcattcctgtcctcaccctcgaagacgtagtggccgatgccgacatcttcgtaactgccactggcaacaaggacatcattaaggtcgaccacatgaagaagatgaagaacaatgccatcgtctgcaacatcggccactttgacaatgagatcgatatgctgggcctcgaggccgtgccgggaatcaagcgaatcacgattaagccacagacggatcggtgggtctttcctgatacgaataagggcattattttgcttgctgagggccgtcttataaacctgggatgtgcgacggggcatccgagcttcgtgatgtcgtgttccttcaccaaccaggtgatagcacagctggagctgtggaatgaaaggttgtctgggaaatatgagaagaaggtttatgtgttgcctaagcacttggatgagagggttgcgttgctgcacctggggaagcttggggctaagctcaccaagctcagtctagcacaggctgagtacatcagtgtgcctgttgagggaccttacaaacctcctcactacaggtactaagatgttgagagatattgaggggattaagtaaaatgtttcaagataataatagcacctgatgctgaatatgaagactttgttggtcttctttatcatattgttctgatgtatttgttttgaggttgttttctagttctatttagcaatggtttaggcatttttgttgagtggaacagtgttgtaaggtgttgcttttgctgagagggggtaaatttggagtttgtataataattattttgaacctctataaataaaaataatagctaattctattt

SEQ ID NO: 7927 - DNA, 1769 bp, Taxus baccata
ggcactctccctttctcttcaacagatcttgggttatcttgctctgatctgttctgctcttcacatcgtttatcgttgttttgccttggcatttcagcaatggcgctgcttgtggagaagactgtggcggggagggaatacaaggtgaaggacttgtcgcaggctgacttcggtcgcatggaactggatctggcagaggtggaaatgccggggctcatggcttgcaggatcgaatatggcccctcgcagcccttcaagggcgcccgcatcaccggctccctccatatgaccatacagaccgctgtgcttatcgaaacccttactgccctcggagctgaagtcagatggtgctcttgcaacattttctctactcaggatcatgcagctgcggctattgcccgtgacagtgctgctgtctttgcatggaaaggagaaacccttcaggagtactggtggtgcactgaaagggctctggattggggtcccggtggtggcccggatctgattgttgatgatggaggagacgccacactgctcattcatgagggggtcaaggccgaagaagagtttgccaagtccgggaagcttccggacccgacttcaactaccaatcccgagtttcagattgttttaggattgatacgagacacccttaaggaggaccccctcaaatatcacaagatgaaggatagattggttggtgtatctgaggaaacaactaccggtgttcacaggctgtaccagatgcaagctaatggatctctgctcttccctgctattaatgtcaatgattctgttaccaagagcaagttcgataacttgtacggatgcaggcactctctgccagatggtctgatgagagccactgatgtgatgattgctggcaaggttgctgttgtctgtggatatggagatgttggcaagggatgtgctgcagccatgaaagctgctggcgctagagtcattgtaacagagattgatccaatttgcgctctacaagccctgatggaaggtatccctgttttgaccctagtggatgtgttagagactgctgatatttttgtgaccaccacgggtaacaaggatattatcatggtcgatcacatgaggaaaatgaagaacaatgccattgtttgcaacatcggtcactttgacaatgaaattgatgtgcatggacttgagacatatcctggtgttaagaaggttaccattaagcctcagactgatcggtgggtattccctgaaaccaacaatggcatcattcttcttgctgaggggcgtctcatgaacttgggttgtgctactggacacccaagttttgtcatgtcatgctccttcacaaaccaggttattgctcagctggagctttggaatgagagaaaaacaggtaagtacgagaagaaggtgtatgtgcttcccaagcatctggatgagaaagtggctgcgctgcacttgcccaagctgggggccaagttaacaaagctttctgcagatcaggctgcatacatcaatgtgcctgttgaggggccctacaagcctgtccactaccgatactgaacaaacattcttatttgacataacgcaagagagaggcgtgtaggcaatatgccataggagcactggccattttttggcttctccattaatttcttattcctcttaataaacaatcagaggtctattgtatcgtaggtgtatctgctcaacttatgacagcagctcctacagtttgtgttttttaattaggttctagaaaagaagaattctga

SEQ ID NO: 7928 - DNA, 1861 bp, Podocarpus macrophillus
gtggacctttcctgcccagattcaagtattttctgcccgactctgctcggttgaggtggcgagttcgattcctgccggagcctaggtctgtgcatttttgccccagcagagtcgctgttgtttcttttttcgtttatcagcaatggcgctcctggtggaaaagactgtagcgggaagagaatataaggtgaaggacatgtctcaggcggactttgggcgcatggagatcgacctggcggaggtcgaaatgcccggactcatggcgtgccgtgctgagtatggggcggttcaaccattgaagggcgctcgcattactggatctcttcacatgactattcagactgcggtgctcattgagaccctcactgctctaggagctgaagtcagatggtgctcctgcaatattttctccactcaggaccatgcggctgctgccattgctcgtgacagcgcggcagtttttgcgtggaagggggagaccctccaggagtattggtggtgtactgagagagcccttgattggggccctggtggtggtccagatctgattgtggatgatggaggtgatgctacattgctgattcatgagggcgttaaggcggaggaagagtataccaagtcggggactcttccagatccatcctctactaccaatcccgagtttcagattgttttgggactgatcaaggagagcctcaaggtggatcccaccaggtatcataagatgaaggataggttggttggtgtgtcagaggagaccactacaggtgttcacaggctgtatcagatgcaaaccaatggatctctgctgttccctgccattaatgttaatgactcggttaccaaaagcaagtttgataacttgtatggctgtagacactctcttcctgatggtctgatgagagctacagatgtgatgattgctggcaaggttgctgttgtatgcggatatggagatgttggtaagggctgtgctgcagccctcaaggctgctggagccagggtcattgtgacagaaattgaccctatttgtgctctgcaagccctcatggaaggtatccctgttttgaccctagaggatgtggtagggactgctgatatatttgttacaaccacaggtaacaaggatattatcatggctgatcacatgaagaagatgaagaataatgccattgtttgcaacattggtcactttgataatgagattgacatgcatggacttgaaacatatcctggtgttaagaagattaccattaagccccagacggatcgttgggtgtttcctgaatccaacaatgggatcattgtccttgcagaggggcgcctcatgaacttgggttgtgcaacaggccacccaagttttgtcatgtcttgctctttcacaaatcaggttattgcacagttggagctttggaatgagaggaaaacaggcaagtacgagaagaaggtttatgtgctgcctaagcatcttgatgagaaggtagcggcattgcacttgcctaagctgggtgcaaagctaacaaaactttctcctgatcaggctgcatatatcaatgtacctgttgaaggtccgtacaagcctgcccactaccgttactgagcaggtggagctctctattataggctgtgggagtttttgcctgcccactactgatatgctttatcagccattttggcacctcaatcagttttaattgacctttaatgaaataggtctattatgtattagaggtgggtgtgctaaatttgtcagagtagcagatgatgtttctccttttccattggagtcttagaatccatgagttaggtgtccagggtttgaaatagagcttgttcattgttgggatttttgttactggga

SEQ ID NO: 7929 - DNA, 1660 bp, Flaveria ramosissima
ccgtcgagctcgagctagccgaggtcgagatgcctgggctcatgtcgtgccggaccgagttcggcccgtcccagccgttcaaaggcgccagaatcaccggctcgctccacatgacgatccaaaccggcgtcctgatcgaaaccctaaccgccttaggcgctgaggtgagatggtgctcgtgcaacatcttctccactcaggaccacgcggcggcggcgatcgcacgtgactccgcggcggtgttcgcgtggaagggggagacgttgcaggagtactggtggtgtacggagcgggcgttggattggggccccggtggtgggcccgatctgatcgtggacgacggtggcgatgcgacgctgttgattcatgaaggtgtgaaggcggaggaggagtttgagaaaacggggaagctgccggatccgtcgtcgacggataacgcggagtttcagatcgtgttgtcgattattaaggatgggttgcagagtgacccgaagaagtatcataagatgaaggagagattggttggtgtgtcggaggagaccaccactggtgttaagaggttgtatcagatgcaggcgaatggaactctgttgttccctgctattaacgtcaatgattctgttactaagagcaagtttgataatctgtacgggtgccgtcactctctccctgatggtttgatgagagctactgatgtcatgatcgccggaaaggttgcagtggtctgtggttatggtgatgttggaaagggttgtgctgctgcaatgaaacaagctggtgcacgtgtgatcgttacagaaattgaccccatctgcgcgcttcaggccaccatggaaggactccaagttcttaccttggatgatgttgtttcagaggctgatatcttcgtcaccaccactggcaacaaagacatcatcatggtttccgacatgaagaagatgaaaaacaacgcgatcgtgtgcaacattggtcattttgacaatgaaattgacatgcttggacttgaaacctacccaggtgtcaagagaatcaccatcaagccccaaactgacaggtgggtcttcccagaaaccaacactggcatcattgtgttggccgagggtcggctcatgaacctggggtgtgctactggacaccccagtttcgtgatgtcgtgctctttcactaaccaagtgatcgcccaacttgagctttggaaagaaaagaacagcgggaagtacaagaaggaagtgtatgtgttgccaaaacatctcgacgagaaggtggctgcacttcatctcggaaagcttggagccaagttgacaaagttgaccaaggaccaggccgattacatcagtgtgccggttgagggtccatacaagcctgctcactacaggtactagacgggtcgggttttttggtgagtttgaagagagggtgatgtgattgttgctttctttataagatacaatgagtatgtgttagggtttagttttatttgttatgttgatcggggtgttggcgaggaaaaaaccgactggtcgtatcttgatgagacgactgttgatgtcggttgataagggttgtgtgaaggttgtgtaacgccattgtagttgttttttgggcaagatgttttgtttgctatgtgttttgcttgttagttcatcaggaaactaagtag

SEQ ID NO: 7930 - DNA, 2233 bp, Gnetum gnemon
cacactgcaactttcgaacaacaacagtcgcagttgccagagcaagaggatcggcagctttgactaaagctattcatattattattcagcaccaaggctccgccattagtctgcccaccagcaaggacggtgttggggaatggaaacccagaaatttctttcgtctgacgagtcgaagcaaacatttctttgttgtgactgcgagttggggaattctgcaagaccaatggatcaggaactgcggaacttatttttatgtcggttacaggattgtatattgcagcagcgtttgtgttgctgttctgcgtcgcatctgtttcctggatttccttgttgagatccatatccatcatagaacgtacattgcccttgttcagcacctcctgcaaggctgctgcataatcatcattgctgtcgttctgcgtctgctctgctattctcttccttccttgcagacacgggaacaggagaatacatcatcatcatactaaattcgtcgtcgtcgtcgtcgtcgtcgttgtcggcatggctctgtccacggagaagacggcgggtgggcgcgagtacaaggtaaaggacatgtcgcaggcggacttcgggcgcctggagctcgatctggccgaggtggagatgccgggtctgatggcgtgccgctccgagtacggtccatcgcagcctctgaagggcgcccgcatcaccggttcccttcacatgacggtgcagacgggcgtcctgatcgagactctgacagccctcggcgccgaagtcagatggtgctcctgcaacatcttctccacgcaggaccacgccgctgccgccatcgcccgcgacagcgccgctgtgttcgcgtggaagggcgaaactcttcaagagtattggtggtgcaccgagcgctccctcgactggggccccggcggtgggcccgatctgatcgtcgatgacggaggcgatgccacgttgctgatccacgaggccgtcaaggccgaggccgagttcgccaagtccggcgccttgcctgaccctgcttcatcctccaatcccgagttccagatcgttctgggactcatccgcgacagtcttaaggtggatcccaccaggtatagccgcatgaaggagaggctcgttggtgtttctgaggagaccaccaccggtgtgaagaggctctaccagatgcaggccaatggctccctgctcttccccgccatcaatgtcaatgactccgtcaccaagtccaagttcgacaacttgtatggatgtcgccactcgctgcctgacgggctgatgagggctaccgatgtgatgatcgccggcaaagtggccgttgtatgcggatacggtgatgtcggcaagggctgtgctgcagctctgaaacaggcaggagccagggtcattgtgacggagatcgatcccatctgtgctcttcaagctctcatggaggggctccctgttatgactctggaggatgttgtttccaccgccgacatctttgttacaacaaccggaaacaaggacatcatcatggtggaccagatgaggaaaatgaagaacaacgccattgtctgcaacattggtcactttgacaacgagatcgacatttatggtctggagaacttccccggcgtgaagaggatcaccattaagccgcagactgacagatgggtcttccctgatactaactccggcatcattgttcttgctgagggccgactcatgaaccttggctgtgctaccggacacccaagttttgtgatgtcctgctcgttcaccaaccaggtcattgcccaattggaactgtggaatgagaggaagagcggcaagtatgagaagaaggtttacgttctgcctaagcatttggatgagaaggtggctgctctgcaccttcccaagttgggtgccaaattgaccaagctgtcacctgagcaggccgcttacattaatgtcccagtggagggtccttacaaacctgctcaataccgttactaattcaattttgcttttccagcttccttttgttctgccctgaggcagtgtttagtgttttcttcttctcaaatgtgttgccaacaggcaaatatttagtggtttgttcgcaattgtctgagagtgggcgaattgtgcattaggagtttttaggatgatgaatgtttcactgttggaacgaataaaatttgatagtgaatttactttgcggatgcacgaagtcggtcagcattgatttacatgagaatggaaa

SEQ ID NO: 7931 - DNA, 2448 bp, Physcomitrella patens
aatcttagaccagatgaacacgtacccaagcattcaaccaactgtgtgaacgcatatgtgggactttataagaagtcctcgaggaccaccatttgctccgtgccctcctctgtctcttgctccctttcgttctacccatttctgcacggttgggttgcggcatccgcagcagcagtttcgttgccctctcttcgggttgcgttgaggaaggaggttgtgctgttggtgcctcgcccatttgcagatatggagctgtccgtggagaagaccgcctccgggcgcgagtacaaggtgcgggacatgtcccaggccgacttcgggcgtctggagctggatcttgcggaggttgagatgcccgggctcatgtcgtgtcgcacggagttcggagccgcgcagccattcaagggcgccaagatcacggggtccctgcacatgaccatccagactgcggtgctcatcgagacattgacggctctgggcgcggaggtgagatggtgctcttgcaacatcttttctacccaggaccacgctgccgccgctatcgcacgcgacagcgcggcggtgttcgcatggaagggggagacactgcaggagtattggtggtgcacggagagggctttggactggggtccggacggaggcccagatctgatcgtggatgacggcggtgacgcgacattgttgattcacgagggtgtgaaggccgaggatgtgtacgcgaaggatggcacgctgcccgaccccgagtcgacgacgaacgccgagttcaagatcgtgttgacaatcttgagggacggcatgaaggagaaccccaacaagtaccacaagatggcggaaaggttggtgggtgtgtcggaggagacgacgacgggagtgaagcggctgtaccagatgatggacaacggaagcctgttgttccctgccatcaatgtgaacgactctgtgacgaagagcaagttcgacaatctgtacggttgccggcactcgctgcccgacgggctgatgagggcgacggatgtgatgatcgccgggaaggttgctgtgatcttcggttacggtgatgtcgggaagggatgcgcgagcgccatgaaggccgcgggagcgcgtgtgatcgtgacggagatcgatcccatctgcgctctgcaggccctcatggaggggtaccaggtgctgaggttggaggactgcgtggagtacgccgacatcttctgcacgacgacgggtaacaaggacatcatcatggtgagcgacatgaggaagatgaagaacaacgccatcgtgtgcaacattgggcacttcgacaacgagatcgacatggaggggctggagacgtatcccggggtgaagaggattaccatcaagccgcagacggacaggtgggtgttcccggacaccaagaggggcgtgatcatcttggcggaggggcgtctgatgaacctgggatgcgctaccggccacccgagcttcgtgatgtcgtgctcattcacgaatcaggtgatcgcgcagctggagctgtggaacgagaagaagagcggcaagtacgagaagaaggtgtacgtgttgccgaagcacttggacgagaaggtcgctctgttgcatttggagaagctgggcgccaggctgacgaagttgagcgaggatcaggcctcgtacatcaacgtgccggtgggaggtccatacaagcccgctcactaccgttactgaaggagccttgcatttgcaatcatgctcggttgggcagtttgtaggtgacttaatggatgtagtggggtcccggaatttaattatgattataggtttttggggaattcatagtaggacgacatttgcaatttgtcaaccaatttttttggatgttgtagatgaatatagcacactatagaaattgcaaatcatctcgacagtaccctgtagggcatattgatatctccaattaaccaatccggaaaaccagggacgagcgacccgctagagctctcaacaaacaaatcactcacattcgtttctgaactctattcagattagatatgacttgatgttggcaaatatccacgaatctaaaaaattttatgtagcaaattccgagtaggcagcttttattctgtttttagacaaagtcaagtgcatcccttaagtgaagatgaggcctcctgtgttgagcacctaaatgaaacattgaactatacgtacgatataaacaagaacgttgctaacaattactcatcgactgtgacacctgagagtgaacaagaacctacctcagcacactacaacacgagaaaatatgtagttactaagaagatctgccaatcaaattctttgtgaaccgaagatgatattgtcagagcaggcaatatcgtagccaagttggtgaacaggttatcctgtaccgtaaataccaattcttgattgtataatgaataatgagaatagtactctccacagaat

SEQ ID NO: 7932 - DNA, 1867 bp, Physcomitrella patens
agatgccgcttgagaacgtggtagtcaggtgcctccaacagtgtgaacatattttgaggctttataagaactctccaagggtttccattctctgcgtcccctctgtctccagcttcatttcgtccggctcctgcaaggttgggttgcggcatccgcagcagcagcaacgcccgtttcgttctcttcggcctgcgttggagagcgagagagggaggttgtgctgttagcgcctcgcacatttgcggatatggagctgtccgtcgagaagaccgcctccgggcgcgagtacaaggtgcgggacatgtcccaggccgacttcgggcgcttggagctcgatctcgcggaggttgagatgcccgggctcatgtcgtgtcgcacggagtttggggccgcgcagccattcaagggtgccaagatcacggggtctctgcatatgaccatccagactgcggtgctaatcgagactttgacggctttgggcgcggaggtgagatggtgctcttgcaacatcttctccacccaggaccacgcggccgccgctatcgcgcgcgacagcgcggcggtgttcgcatggaagggggagacactgcaggagtactggtggtgcacggagagggctttggactggggtccggatggaggcccagatctgatcgtggacgatggcggtgacgcaacattgttgatccacgagggtgtgaaggccgaggatgcgtacgcaaaggatggcacgctgcccgaccccgagtcgacgacgaacgccgagttcaagatcgtgttgacaatcttgagggacggcatgaaggagaacccccagaagtaccacaagatggccgagaggttggtgggcgtgtctgaagagacgacgaccggagtgaagcgtttgtaccagatgatggacaacggatctctgttgttccccgccatcaacgtgaacgactctgtcacgaagagcaagttcgacaacttgtacggttgccgccactcgctgcccgacggcctgatgagagcgacggacgtgatgattgccgggaaggttgctgtgatcttcgggtacggtgatgtcgggaagggttgtgccagcgccatgaaggccgccggagcccgtgttatagtgaccgagatcgatcctatctgcgctctccaggccctcatggaaggctaccaggtgctgagattggaggactgcgttgagtacgccgacatcttttgcactacgaccggtaacaaggacatcatcatggtgagcgacatgaggaagatgaagaacaacgccatcgtgtgcaacattgggcacttcgacaacgagatcgacatggaggggttggagacgtttcccggggtgaagaggatcaccatcaagccgcagacggacaggtgggtgttcccggacaccaagaggggtgtgatcatcttggcggaggggcgtctgatgaacctgggatgcgccaccggtcacccgagcttcgtgatgtcgtgctcattcacgaaccaggtgatcgcccagttggagttgtggaacgagcgcacgagcggcaagtacgagaagaaggtgtacgtgttgccgaagcacttggacgagaaggtcgctctgttgcatttggagaagctgggcgccaggctgacgaagttgagcgatgatcaggcctcgtacatcaacgtgccggtgggaggcccatacaagcccgcccactaccgttactgaagggcctctgcaaccaggcttggttggggtgtttgtaggctgcggtacacttttgctgtttgtttctgagagcatctaacttgtcgtgaccgattggggggtcgacaaggatgacgtttttttaaaaaagagaaagttaaaaatcatttatttttgatacac

SEQ ID NO: 7933 - DNA, 1513 bp, Petunia hybrida
gtaccggaattcctacgaagacactgttggcctactgggtctcactcttcttcttctctacaaaaaccccatcaagaagtagagctaaaaaaaccccatttcaataatggctttacttgttgaaaaaacaacatcaggccgtgagtacaaggttaaagacatgtctcaggctgactttggccgactcgaaatcgagttggccgaagttgaaatgcctggacttatggcttgtcgtactgaatttggaccttcacaaccttttaaaggtgccaagattactggatctttacatatgactattcaaactgctgtcttgattgagactttgacagcattaggtgctgaagttagatggtgttcttgtaatatcttttctactcaagatcatgctgctgctgctatcgctcgtgatagcgctgctgtcttcgcctggaaaggcgagaccttgcaggagtactggtggtgtaccgagagggcactagattggggtccaggtggagggccagatttgattgtggatgatggaggtgacgctacactcttgattcatgaaggagttaaagctgaagaagagtatgctaagaatgggacagtcccagatcctacctctaccgataacgttgagtttcagcttgtgctaggtattattaaggaaagtttaaagactgatcctacaaagtatactaagatgaaggaaaggcttgttggtgtttctgaggaaactaccactggtgttaagagactttaccagatgcaagctaatggaactttgcttttccctgctatcaatgttaacgactccgttaccaagagcaagtttgacaacttgtatggatgccgccactcactgcctgatggtctcatgagggctactgatgttatgattgccggaaaggttgccgttgttgccggttacggagatgttggcaaagggtgtgctatgtccttgaagcaagctggtgcccgtgtgatcgtgactgagattgacccaatctgtgctctccaggctctcatggaaggcctacaagttctcactcttgaggatgttgttgctgatgctgatatctttgtcaccacaaccggtaacaaggacatcatcatggttgaccacatgaggaagatgaagaacaatgccattgtctgcaacattggccactttgacaatgaaatcgacatgcttggtcttgagacattcccaggtgtgaagaggatcacaatcaagcctcaaactgacaggtgggtcttcccagacaccaacagtggcatcattgtcttggccgagggtcgtctcatgaacttgggatgtgccactggacaccccagtttcgtgatgtcctgttctttcactaaccaagtcattgcccaactcgagttgtggaatgagaagagctctggcaagtatgagaagaaggtgtacgtcttgccaaagcacctcgacgagaaggtcgctggccttcaccttggaaaggctcggagcccagcttaccaagctctccaaggatcaagctgacta

SEQ ID NO: 7934 - DNA, 2442 bp, Physcomitrella patens
gcgtgcgagtgagcgtgggagtcaggtgccaccaacagtgtgaacgcatatgtgggactttataagaagtcctcgaggaccaccatttgctccgtgccctcctctgtctcttgctccctttcgttctacccatttctgcacggttgggttgcggcatccgcagcagcagtttcgttgccctctcttcgggttgcgttgaggaaggaggttgtgctgttggtgcctcgcccatttgcagatatggagctgtccgtggagaagaccgcctccgggcgcgagtacaaggtgcgggacatgtcccaggccgacttcgggcgtctggagctggatcttgcggaggttgagatgcccgggctcatgtcgtgtcgcacggagttcggagccgcgcagccattcaagggcgccaagatcacggggtccctgcacatgaccatccagactgcggtgctcatcgacacattgacagatctgggcgcggaggtgagatggtgctcttgcaacatcttttctacccaggaccacgctgccgccgctatcgcacgcgacagcgcggcggtgttcgcatggaagggggagacactgcaggagtattggtggtgcacggagagggctttggactggggtccggacggaggcccagatctgatcgtggatgacggcggtgacgcgacattgttgattcacgagggtgtgaaggccgaggatgtgtacgcgaaggatggcacgctgcccgaccccgagtcgacgacgaacgccgagttcaagatcgtgttgacaatcttgagggacggcatgaaggagaaccccaacaagtaccacaagatggcggaaaggttggtgggtgtgtcggaggagacgacgacgggagtgaagcggctgtaccagatgatggacaacggaagcctgttgttccctgccatcaatgtgaacgactctgtgacgaagagcaagttcgacaatctgtacggttgccggcactcgctgcccgacgggctgatgagggcgacggatgtgatgatcgccgggaaggttgctgtgatcttcggttacggtgatgtcgggaagggatgcgcgagcgccatgaaggccgcgggagcgcgtgtgatcgtgacggagatcgatcccatctgcgctctgcaggccctcatggaggggtaccaggtgctgaggttggaggactgcgtggagtacgccgacatcttctgcacgacgacgggtaacaaggacatcatcatggtgagcgacatgaggaagatgaagaacaacgccatcgtgtgcaacattgggcacttcgacaacgagatcgacatggaggggctggagacgtatcccggggtgaagaggattaccatcaagccgcagacggacaggtgggtgttcccggacaccaagaggggcgtgatcatcttggcggaggggcgtctgatgaacctgggatgcgctaccggccacccgagcttcgtgatgtcgtgctcattcacgaatcaggtgatcgcgcagctggagctgtggaacgagaagaagagcggcaagtacgagaagaaggtgtacgtgttgccgaagcacttggacgagaaggtcgctctgttgcatttggagaagctgggcgccaggctgacgaagttgagcgaggatcaggcctcgtacatcaacgtgccggtgggaggcccatacaagcccgctcactaccgttactgaaggagccttgcatttgcaatcatgctcggttgggcagtttgtaggtgacttaatggatgtagtggggtcccggaatttaattatgattataggtttttggggaattcatagtaggacgacatttgcaatttgtcaaccaatttttttggatgttgtagatgaatatagcacactatagaaattgcaaatcatctcgacagtaccctgtagggcatattgatatctccaattaaccaatccggaaaaccagggacgagcgacccgctagagctctcaacaaacaaatcactcacattcgtttctgaactctattcagattagatatgacttgatgttggcaaatatccacgaatctaaaaaattttatgtagcaaattccgagtaggcagcttttattctgtttttagacaaagtcaagtgcatcccttaagtgaagatgaggcctcctgtgttgagcacctaaatgaaacattgaactatacgtacgatataaacaagaacgttgctaacaattactcatcgactgtgacacctgagagtgaacaagaacctacctcagcacactacaacacgagaaaatatgtagttactaagaagatctgccaatcaaattctttgtgaaccgaagatgatattgtcagagcaggcaatatcgtagccaagttggtgaacaggttatcctgtaccgtaaataccaattcttgattgtataatgaataatgagaatagtactctccacagaat

SEQ ID NO: 7935 - DNA, 2521 bp, Ceratodon purpureus
acagtacatgggatgataccactacggtagctccctagtgggatggcctggcctactgagaacgtgcaaccaaactggggggtcaccgggcaccgggcacgtccggcaggcagcgggtgtgaaagcggagctgcgaacgcagtaagcagtgagtgggatcgagggcccggcgtcatcgcgacccgagggagggcgggtgtgaaacgatctagggcatttgggggagtgggagtggggggcataaagaagggcgccagggtttctgtttcctctgcacccgcactctgttcctcattccacccgctctcttactctctgcatctcggggctgcggcagctgcagctcgctcgtcctcccttccccttcttgccattgtgcgagaggaagtgagagagagtgaggaagagcagtttgctgtccgccgctcgcacccgaggcatcttataccatggagctctccgtcgagaagaccgcctccgggcgcgagtacaaggtgcgcgacatgtcgcaggcggacttcgggcgcatggagcttgatctggcggaggtggagatgccggggctgatgtcgtgccgcacggagttcggcgcggcgcagccgttcaagggcgcccggatcacggggtcgctgcacatgaccatccagacggcggtgctgatcgagaccctgacggcgctgggcgcggaggtgagatggtgctcgtgcaacatcttctcgacgcaggaccacgccgcggcggccattgcgcgcgacagcgcggccgtgttcgcgtggaagggcgagacgctgcaggagtactggtggtgcacggagcgcgcgttggactggggccccggcggtggcccggatctgatcgtggacgacggcggtgacgcgacattgctgatccacgagggtgtgaaggcggagatcgcgtacgccaaggacgggacgctgccggaccccgagtcgacgacgaacgcggagttcaagatcgtgctgaccatcctgagggacggcatgaaggagagcccgaacaagtaccacaagatggccgagaggctggtgggagtgtcggaggagacgacgacgggagtgaagcggctgtaccagatgatggacaacgggtctctgctgttcccggccatcaacgtgaacgactccgtgacgaagagcaagttcgacaacctgtacgggtgccgacactcgctgcccgacggtctgatgagggcgacggacgtgatgatcgccgggaaggtggcggtgatcttcgggtacggtgacgtgggaaagggttgcgcgagcgcgatgaaggcggccggcgcgcgcgtgatcgtgacggagatcgacccgatctgcgcgctgcaggcgctgatggaggggtaccagatcctgacgctggacgactgcgtggagtacgcggacatcttctgcacgacgacgggcaacaaggacatcatcatggtgaaggacatgaagaagatgaagaacaacgcgatcgtgtgcaacatcgggcacttcgacaacgagatcgacatggagggtctggagacgtacccgggcgtgaagaggatcacgatcaagccgcagacggacaggtgggtgttcccggacacgggcagaggcatcatcgtgctggcggaggggcggctgatgaacctggggtgcgcgacggggcacccgagcttcgtgatgtcgtgctcattcacgaaccaggtgatcgcgcagctggagttgtggaacgagcggaagagcggcaagtacgagaacaaggtgtacgtgctgccgaagcacttggacgagaaggtggcgctgttgcatctggagaagctgggcgcgaggctgacgaagctgtcggacgaccaggcgtcgtacatcaacgtgccggtgggaggcccatacaagcccgcccactaccgctactgagcgggtgtgcgtgttaggatgttttcagtggggggaggggtgtgtaggccgcggtacgcattttattgtttgtttttccgagagcatctgacttgcccgggaccgatggggggatcggcaaggatgacatttttttaaaaaccacacatatacggaagatccggggtgaatccgggatcgaattcatgctgtatgtatcgggtgcagagtgcggggctttgtgggatgtgtttgtgcgtgggcgatatgttttggatgttggatgtggcggactgggttggatacgttgctgattgcggtgcatgtgaggaagcatattgtactagttactggaggagggttgtttgtcgagctgattgtgagcattgcggagatgcggaggttgttgttgctggtgagcaagtggaggccgtgtgcagggagaacgttgccgcgcggtttttcggttcgaacctctttgcgggtttgtgtttattaatgtgcgttggccccgctatgttttggccacgattgttttggtctggaatagcatttgtacgatactgtcaaggttgtcggtggctgtgtatgatattacgcaaatcggtggttgagtaaatggatagagagttgtg

SEQ ID NO: 7936 - DNA, 1577 bp, Scabiosa columbaria
ccggtttaatgtcttgccggactgaattcggaccttcgcagcctttcaaaggagcgaggatcaccggatctctccacatgactatccaaaccggagttttgatcgaaaccctaactgctctcggcgctgaggtcagatggtgctcttgcaacatcttctccactcaggatcacgctgctgccgccattgctcgtgatagcgcggccgtgtttgcctggaagggggagactctacaggagtactggtggtgtacggagagagcgttggattggggtcccggcggtggaccggatctgattgttgatgatggaggtgatgctacgcttttgatccatgaaggagtgaaggctgaggaggagtttgctaagtccggcaagttccctgaccctacctctactgataatcctgaatttcagatcgttttgactatcattcgtgatggcctaaaaaccgatcccaaaaagtaccacaagatgaaggagagattggtcggtgtttctgaggagactaccaccggtgttaagagattgtaccagatgcaagacaatggcaccttgttgttccctgctatcaatgtcaatgactctgttaccaagagcaagtttgacaacttgtatggttgccgtcactcacttcccgatggtctcatgagagccactgatgttatgattgccggaaagatcgcagtcatctgcggatatggagatgtcggaaagggttgtgcctcagcaatgaagcaagctggtgctcgtgttattgtaacagagattgatcccatctgtgccctccaagcccttatggaaggtctccaagtcctaaccctagaggatgcactagctgaggctgacatctttgtcaccaccaccggtaacaaggacatcataatggttgatcacatgaggaagatgaagaacaatgccatcgtttgcaacattggacattttgacaatgaaatcgacatgatgggtcttgagaactacccaggtgtgaagaggatcaccatcaagccacaaactgataggtgggtgttccctgacaccaagtccgggatcttgatccttgctgagggtaggctaatgaaccttgggtgcgccactggtcaccctagctttgtgatgtcgtgctcgttcacaaaccaggtcattgctcagcttgagttgtggaatgagaaatcatctggcaagtatgagaagaaggtgtatgttttgcccaagcatcttgatgagaaggttgccgctcttcatcttggaaagctcggagccaagcttacgaagctcaccaaggaccagtccgattacattagcatcccaattgagggtccatacaagcctgctcactacaggtattgaggaaagaatgaaggagaaagtggaaatggggattgttttgtggttggttgtttcttatttgtaggatatagtcttttttttgtttgtttattttgagatttttgtgttgtgggtgttttggggagggaaaatttggagaagagaaaatgactctggccattttttgattaaaattggtcatgtgaagtcccaataataaaaggttatgatgtatggggttgtgtgggg

SEQ ID NO: 7937 - DNA, 2058 bp, Zostera marina
ttccgattcttttcgacatcaaccaaatcttcagatctaccgaaaatggcgtctactttgtcggtgtcgaaaaccacctcgggaagggagtacaaggtcaaggatatgtctcaggccgacttcggtcgccttgagattgatcttgcggagatcgagatgccggggctcatggcttgccgtaccgagttcggtccgtcgcagcctttcaagaatgctaggatctctggatctctacacatgacgatccaaaccgctgtcttggtcgagactttaactgcccttggcgctgaagttcgctggtgttcctgcaatattttttctactcaagaccacgccgctgccgtcattgccagggacagcgctgctgttttcgcatggaagggtgaaactctccaggagtactggtggtgtaccgataggtgtttggactggggtgagggtggaggtcccgatctgatcgtcgatgacggtggtgatgcaactctgttgatccatgagggagttaaggctgaagaggagtttgagaagtccgggaagttgccagatccaaccagcactgacaacgtcgagtttcagatcgtgttgggtttgatcaaagaaggtttaaaaatcaaccccaccaagtacaggacgatgagagacagactcgtcggagtttctgaagagaccaccaccggagttcacaggctttatcagatgcaacttaatggaactcttcttttccctgccatcaacgttaacgattccgttaccaagagcaagttcgataacctttacggttgccgccactcacttcctgatggtcttatgagagccaccgatgtgatgattgccggaaagaccgctgttgtctgcggatacggagatgtcggcaagggctgcgcagcagcactcaagcaagccggagcacgtgtcatcgttaccgaggtcgatcctatctgtgcccttcaggcctgtatggaaggtcttcaagtccttactctagaagacgtcctctcagaagctgacattttcgtcaccaccaccggaaacaaaggtatcataatggttgaccagatgcgcaagatgaagaacaatgccatcgtttgcaacatcggtcacttcgacaacgagatcgacatcaatggtcttgaaacttaccccggtgtgcagcgtgtgacaatcaagccccagactgacaggtgggtttttcccgagactaacactggaattatccttctcgctgagggtagactgatgaatcttggatgtgcaaccgggcatcccagcttcgtcatgtcatgctcgttcaccaaccaggtgatcgctcagctggagctttggaacgagaggaagagcggcaagtacgagaagaaggtgtatgttttgcctaagcaccttgatgagaaagttgctgcgcttcatcttcccaaacttggagctcgtctcaccaagctctctaaggaacaggcggattatatcagtgttcctattgagggtccatacaagcctgcacattacaggtactaagaaagaagctgaacaaccatgaattaaggtcgtagattgtaataatggagtttgattgtgtttgttttgtcatcaccgtcgtcattaaacaccatcatcaggtgtttggttttataagacagaataattagtattttttgagggggtgtcggagtgtgtgggtggtggtgatctcaaaatttacgttctattttctacatataatttgcctagttttggtggagtattttaggaagtgaagtattttgtttgaagaaaaagagatgatttgaagattaaaagcatgtctgttttaaaaagaatagtatttttttcatatcatcgtgttgttttcgaaaaaacagttgctgataaaatggtggtatttttcttttatcatattatctttctgatatcagaaacaaaaaagaaaatggtggtaattcaataaaataaagtttcaacattaaggttccaaaagagcggtcacatatgaatattattagattgtgatgggttgggttgaatcagttgtatatcttctttttttgaaataaaattatatggtaa

SEQ ID NO: 7938 - DNA, 1555 bp, Tragopogon dubius
gggtatacaaggtcaaggatatgtccttggccgacttcggtcgcctggaactcgaattagccgaagttgaaatgcccggtctcatgtcttgccggacggaattcggtccttctcagcccttcaagggagcgagaatcaccggctccctccacatgacaatccagactggtgtcctcattgaaaccctcaccgccttgggtgctgaagtcagatggtgctcttgcaacattttctcaactcaggaccacgccgccgccgctatcgctcgtgattccgccgccgtgttcgcctggaagggggaaaccctacaggagtactggtggtgtacggaacgtgctctagattggggccctggcggtggtcctgatttgattgttgacgatggtggtgatgcgacgttgttgattcatgaaggagtcaaggctgaggaggagtttgccaagaccggtaaagttcccgatccgacctcgactgacaacgctgagttccagatcgtgttgtcgatcatcaaggaaggtctatccactgaccctaagaagtaccacaagatgaaggagagattggtcggtgtgtctgaggaaaccaccaccggtgttaagaggttgtaccagatgcaagccaatggtactctgcttttccctgccattaatgtcaatgactctgttaccaagagcaagttcgacaacttgtacggatgtcgccactccctccccgacggtttgatgagagccaccgacgtcatgatcgccggaaaggtcgcagtcgtctgcggatacggagacgttggaaagggttgcgccgccgccatgaagcaagccggagcacgtgtcatcgtgacagaaatcgacccaatctgcgccctccaagccaccatggaaggtctccaagtcctccccttagaagacgtagtctccgaagccgacatcttcgtgaccaccaccggcaacaaagacatcatcatggtctcggacatgaaaaagatgaagaacaacgccatcgtctgcaacatcggccatttcgacaacgaaatcgacatgctcggcctagaaacctacccaggcgtgaaaagaatcaccatcaaaccacaaaccgacaggtgggtgttcccggaaaccaagacaggtatcatcgttttggctgaaggtaggttgatgaacttgggttgcgccaccggccaccctagctttgtcatgtcgtgctcttttaccaaccaggtgatcgctcagcttgagctgtggaaggagaggtccaccggaaagtacaagaaggaggtgtatgtgttgccgaagcatcttgatgagaaggttgctgctcttcatcttggaaagcttggagctaagttgacgaagctcaccaaggatcaagctgattacatcagtgtgccagttgagggaccttacaagcctgctcattacaggtactgaaaactgttgtctttttggtgggaggattttgaagagggtattgtgagttggtgctttctttatgagatagggtttagtttttgtttgttgaatttgtgggggtgttggattggggaagaaacttgttggtc

SEQ ID NO: 7939 - DNA, 2126 bp, Theobroma cacao
aaatattagcttagcttgtcgacctttattccaacggcgtcgtttgttagattttaaagttggtaaaacttaccagttaaaacaaaacccctaggtttgcttatccctctctccctcgtctgtcgctagattctctcccgtttgttttctacgccaccgcccaaacccaaaaacccaacccaagccatggccctcaccatttccagaaccccaaccggccgcgagtacaaggtcaaggacatttcccaagccgacttcggccgccttgaaatcgagctagcggaggtcgaaatgccaggcctcatggcttgccgtgccgagttcggcccaactcaacccctcaaagacgcccgcatcaccggttccctccacatgaccatccaaaccgccgtcctcatcgaaactttaaccgcccttggtgcccaagtccgctggtgctcctgcaacatcttctccactcaagaccacgccgccgccgccattgcccgcgactcggcctccgtctttgcctggaaaggagaaaccctggaagaatactggtggtgcactgagaaagctctcgagtggggccccggtggcggacccgatttgatcgtcgatgacggcggggacgccactttgctaattcacgaaggtgttaaggcggaggaggtgtacgagagaagtgggaagttgccaaacccgaatgagaccgaaaacgcagagtttcggatcgttttgagtatcattaaagaagggctgttggtggatcccaaaaaatatagaaggatgagggaaagattagttggagtttcagaagaaactaccactggagttaaaagattgtaccaaatgcaagccaatggcactcttctattccctgccattaatgttaatgattctgttacgaagagtaagtttgataacttgtatggatgtcgacattcgcttcctgatggtctcatgagagctactgatgtaatgattgctggaaaaattgctgttgtttgtggatatggagatgttggcaagggttgtgctgctgctcttaaggcagctggtgctcgtgtgattgtgacggaaattgatccgatttgtgctcttcaagccctaatggaaggcattccagttttgactctagaggatgttgttgctgaagctgacatttttgtgaccaccacaggaaataaggatatcatcatggtttgtcacatgaagcagatgaagaacaatgcgattgtctgtaacattggtcattttgataatgagattgatatgcttggcctggagacttaccctggtatcaagcggattactatcaagcctcaaactgatagatgggtcttcccagagactaataggggtatcattgttcttgctgagggacgcctcatgaatttgggttgtgcaactgggcatcctagctttgtgatgtcttgctcattcacaaaccaagtgattgcacagcttgagctctggaaggagaggggaacaggcaagtatgagaagaaagtctacgtgttgcccaagcacttagatgaaaaggttgctgcacttcatcttgggaagcttggagctaaactcaccaagctcactcctgagcaagctgcatacatcagtgtccctgttgaaggtccttataaacctcctcgttacaggtattagggggattgcccacttcattgttatctaagtcagcctttaggttgtgttttattgatgcactagtatgatccttggactgaagcatgattgctggggtggaagttagtttttgttgactggagtcagtttttgggtgacgctgaaggatattttcctattgtacttatgtatcttgtcgtgttcccttgatttccgagaaaactaggctgggggctgttttcctattgtacttatagtatcttgtggtgttcccctgattttcgagaaaactaggcaaatgcctgttggctttcttgcttaagtcaattccatctcacttgacaataaaacagggtacattgaatggaggcaatggtggccgtgcaccagtcagtggctataagtgccacgtacgcatttttcctatgacaaaaataagttcaccatagcatctagttggtgaggctatcattctcccctccacataaaaacttaattagctg

SEQ ID NO: 7940 - DNA, 1379 bp, Cleome gynandra
ctcgcacactctctttctctcgatttcggatctcagattggagaagagagtttcagatccggaaaaatggcgttgcttgtggagaagacgtcgactggccgtgagtacaaggtcaaggatatgtctcaggccgatttcggccgtctcgagatcgagctcgcggaggttgagatgcctggtctcatggcgtgtcgtaccgagttcgggccgtcgcagccgttcaaaggcgcgaagatcactggatctctccacatgacgatccaaaccgctgttcttattgaaaccctgacagccctcggagctgaggtcagatggtgctcttgcaatatcttctccactcaggaccacgccgctgccgccatcgctcgggactccgccgccgttttcgcctggaaaggtgagaccctccaggagtactggtggtgcacagagcgtgccctcgattggggtccgggtggtggtcctgaccttatcgtcgacgatggtggtgacgccactctcttgatccacgaaggtgttaaggccgaggaggtctttgagaagacaggtcaggtccctgatccgtcgtctactgacaaccctgagttccagatcgtgttgcagatcatcaaagacggactccaggtcgacccgaagaagtaccacaagatgaaggagagattggtcggtgtctccgaggagaccacaactggtgtcaagaggctctaccagatgcaagccaatggaactctcttgttccctgccattaacgtcaatgactccgtcaccaagagcaagtttgacaacttgtacggatgccgacactctctccccgacggtctcatgagggccactgacgtcatgatcgccggaaaggtcggagttgtctgtggttacggagatgtcggaaagggttgtgctcttgccttgaaggctgccggtgctcgtgtcatagtgaccgagatcgaccccatctgtgcccttcaagctctcatggaaggtttccagattctcacccttgaagacgtggtatccgaggctgacatcttcgttaccacgaccggaaacaaggacatcatcatggtcgaccacatgaggaagatgaagaacaacgccatcgtgtgtaacattggtcacttcgacaatgaaatcgatatgcacggtttggagaccttcccgggagtgaaacgcatcaccatcaagccccagaccgacaggtgggtcttcccggataccaaaaccggaatcattgttcttgcggagggtcgtctgatgaacttgggttgcgccacgggtcacccaagtttcgtgatgtcgtgctctttcacgaaccaagtgatagcacagcttgagctgtggaaggagaaggcaacggggaaatacgagaagaaggtgtacgt

SEQ ID NO: 7941 - DNA, 1852 bp, Gossypium hirsutum
gtacatgggaacgttaagttgggacaaggctcctacattcctttttcttaacagcagtgtccctagattctctccaccgcccaaccctaaacgctaaccatggctctcaccgtttccagaaccgccactggccgcgagttcaaagttaaggacattgcccaagccgactttggccgcctggaaatcgagctggccgaggtcgaaatgccgggacttatggcttgtcgcgctgagttcggtccaacccaacccctcaaagaagctcgcatcaccggttccctccacatgacaatccaaaccgcggtcctcattgagaccttaaccgcccttggcgctgaagtccgctggtgctcctgcaacatcttctccacgcaagacgacgccgccgccgccattgctcgtgactccgccgccgtctttgcatggaaaggagagaccctcgaagaatattggtggtgcacagagaaagctctcgactggggccccggtagcggacctgatttgatagtcgacgatggtggagacgccacgcttttgatccacgaaggggttaaggcggaggaagagtatgagaggagcggcaagttgccgaatccgaatgagactgaaaacgccgagtttcaaatcgttttgagtattatcaaagaaggattattaattgaccccaaaagatatacaaggatgaaggacagattggttggcgtttcagaggaaactaccactggtgttaaaagattataccaaatgcaagctaatgggacccttttattccccgccattaatgtcaatgattctgttacaaagagcaagtttgataacttgtatggatgtcgacattcactgcctgatggtcttatgagagctactgatgtaatgattgctggaaaaattgctgttgtttgtggttatggagatgttgggaagggttgtgccgctgctcttaaggcagccggagctcgtgtgattgtgaccgaaatcgatcccatttgtgctcttcaggctttaatggaaggtattccggttttgacattagaggacatggttgccgaagcggacatttttgtgactaccactggaaataaggatattattatggttagtcatatgaagcagatgaagaacaatgcggtcgtgtgcaacatcggtcatttcgataatgagattgatatgcttggtcttgagacttacccaggtattaagcggatcactatcaagcctcaaactgatcggtggatcttcccggagactaataggggtatcattgtgcttgcggaaggacgacttatgaatttggggtgcgcaaccgggcatccaagttttgtgatgtcttgctcgttcacaaaccaagtgattgctcagctcgagctgtggaaggagaggggaagtggcaagtatgagaagaaagtctatgttttgcccaagcacttggatgagatggttgcgtcacttcatcttgggaagcttggagctaaacttactaagctcactcctgaccaagctgcatacatcagtgtccctgttgaaggtccttataaacctcctcattacaggtactagaaccatagatgtactggcacgaaccatagttatgggtgatgttgaaggaggttttcctattgcgtactctgttgtatcttttcatgtttccttgaaaggtatccaaagtgcagtctcttttatatcaattttgggattgtaatcagttttcatttggcatttatccctatcaaaccgttcaacaagttcaattcatcccactttatgaatgttaaatgataaataaaagtgggttttgaacttcatcaagatggcatgacacatccgacattaattgcttttgctttatataaag

SEQ ID NO: 7942 - DNA, 1650 bp, Pteridium aquilinum
caagcggattttggccgtttagagattgagcttgcagaagttgaaatgcctggtcttatgtcttgccgtaccgagtttgggccctctcagcctctgaaaggtacccgcattacgggatctctgcacatgacaatccagactgctgttcttattgagacactcactgcccttggtgctgaggttcgttggtgctcttgcaacatcttctctacccaagatcatgcagctgctgccattgctcgtgatagtgcagctgtgtttgcatggaagggggagaacttgcaggagtattggtggtgtaccgagcgggcccttgattggggtcctggtggagggccagatctgattgtggatgatggtggtgatgctaccctcttgatccatgagggtgtgaaggcagaagaggcttatgctaaggatggaactctcccagatccatcttccacagagaaccctgagttccagattgtactttctatcttgcgtgatgggatgaaggcggaccccaagaagtaccacaagatgaaggacaggattgtaggtgtttcagaggagactacaacgggtgttcacaggctgtatcaaatgcaggcgaatggatcccttctgttccctgctatcaatgtaaacgattcagtgacgaagagtaagtttgacaacctttatgggtgtcgccactctctgcccgatggactcatgagggctacagatgttatgcttgctggcaaagttgtagtggtctgcggttatggtgatgttgggaaaggttgtgcagctgcaatgaaagctgctggatccagggtggtcgtcactgaaattgatccaatctgtgctcttcaagcgacaatggagggtcttcctgtattgactcttgaggatgttcttgagacagctgacatttttgttaccactactggcaacaaggacattatcatggttagccacatgagaaagatgaagaacaatgccattgtttgcaacattggtcactttgacaatgaaattgacatgctcgggttggagacatacccaggagtgaagaaaataaccatcaaacctcagactgatcgctgggtgtttccagaaactaatactggtattattgttttggcggagggtagattgatgaacttgggttgtgccactggtcaccctagtttcgtcatgtcatgctctttcaccaaccaggtgattgcccagctggagctgtggaatgagaggaagtctggcaaatatggcaaggaagtgtatgtcctccccaagcatctagatgaaaaggtagctgctttgcacttggagaagttgggcgttaagttgaccaagttaactgatgaccaggctaagtatatcaatgtacctatagaaggtccatacaagcctgcacattatcgctattagtacactgtaactcggctgcgttggagtttttccctgtttgtggttcaaaatgagcagttaaataagctcctagaatatcatccccgcatactatttttttctgccctacatcttcatttttttgaacaaggtatcgagaggcacattcaggtgagctgcctgatggagtactaagccttccaccttcaagttggttatttggtttttaataaagcaagtttctcaccaaaaaagaaaaagtaccgaactgcg

SEQ ID NO: 7943 - DNA, 1320 bp, Brassica rapa
  misc_feature (839)..(840): n is a, c, g, or t
gacacacttctctctctctgcccccaaatctctagatccgaaaaaatggcgttgatcgttgagaagacgtcgagtggccgtgagtacaaggtcaaggacatgtctcaggccgacttcggtcgtctcgagctcgagctcgccgaggttgagatgcccggactcatggcttgtcgtaccgagttcggcccagctcagcccttcaaaggcgctagaatcaccggatctctccacatgacgatccagaccgccgtcctcatcgaaaccctaaccgccctcggcgcggaagtcagatggtgctcctgcaacatcttctcgacccaagaccacgccgccgccgcaatcgcccgtgactccgccgccgttttcgcctggaaaggcgagacgctgcaggagtactggtggtgcacggagcgtgctctcgactggggcccaggcggtggtccagatctgatcgtcgatgacggtggcgacgccacgcttttgatccacgagggagtgaaggccgaggagatctttgagaagacgggccaggttcctgatcccacttccactgacaaccccgagttccagatcgtgctctccatcatcaaggaaggtctccaggttgatcccaagaagtaccacaagatgaaggagagactcgtcggtgtctctgaggagaccaccaccggtgtcaagaggctttaccagatgcaggaaagtggggccctcttgttcccagccattaacgtcaacgactccgtcaccaagagcaagttcgacaacttgtacggttgccgtcactctctacctgatggtctcatgagggccactgatgtcatgatcgccggaaaggttgnngttgtctgcggatatggtgatgtcggaaagggttgtgccgctgccatgaagaccgctggtgctagagttattgtgacggagatcgatcccatctgtgccctacaggctatgatggaagggcttcaagttttgacccttgaggatgttgtttccgaagctgacatctttgtcaccaccaccggtaacaaagacatcatcatggttgaccacatgaggaagatgaagaacaatgctattgtttgcaacattggtcactttgacaacgagatcgacatgctcgggctcgagactttccctggtgtgaaacgtatcaccatcaagccgcagactgataggtgggtgtttcccgacaccaggacaggcatcattgtgctagcagagggtcgtctgatgaacttggggtgtgctactggacacccaagtttcgtgatgtcgtgctcgttcaccaaccaggtgattgcacagcttgagctctggaac

SEQ ID NO: 7944 - DNA, 1649 bp, Primula obconica
tgcggaggtcgagatgcctgggctcatgtcctgccgcaccgagttcggcccatctcagccgttcaaaggggccaggatcaccggatctctacatatgaccatccagaccgctgttctcatcgagaccctcaccgccctcggtgccgaggtccgctggtgctcctgtaacatcttctccacgcaggaccatgcggcggcggcgatagctcgggactcggcggcggtgtttgcgtggaaaggggagacgttagcggagtactggtggtgtacggagagggcgttggattggggtgagggcggtggcccagatctcatcgttgatgatggaggtgatgcgactctgttgatccacgagggagtgaaggcagaggaggagtttgagaagaacgggacagtgccagacccaacctccactgacaatgctgagttccagattgtgctttcaataatcaaagaaggccttaagacagaccccaaaaggtaccacaagatgaagaccagattggtcggagtgtccgaagagaccactacaggtgttaagaggctctaccagatgcagttgaatggcactcttctcttccctgccatcaatgtcaacgactcagtcaccaagagcaagtttgacaacctgtacggttgccgccactctctccccgacggcctgatgagagccaccgacgtcatgattgccggaaaggtagccgtcgtctgcggatacggagatgtcggaaagggctgtgctgccgccctaaagcaggccggtgctcgtgtgatcgttacagagatcgacccaatctgcgcccttcaggctaccatggaaggccttcaggtcctaacccttgaagatgttgtctcccaggctgatatttttgtcaccaccaccggaaacaaggacatcatcatggtctcagacatgaggaagatgaagaacaacgctatcgtctgcaacattggacattttgataacgagatcgacatgctcgggctcgagacctaccctggcgtgaagaggatcacgatcaagccccagaccgacaggtggttgttcccagagaccaacaccggtatcatcatcttggctgagggtaggctcatgaacttgggctgtgccactggtcaccctagctttgtgatgtcgtgctcgttcaccaaccaggtgattgcccagctcgagctctggaaagagaaagatacaggaaagtacaaaaaggaggtgtatgtattgcccaagcaccttgatgagaaggtcgcagctcttcaccttgagaaactcggggctaaactaaccaagctcagcaaggaccaggccgactatatcagtgtccctgtcgagggaccgtacaagccagctgcttataggtattaagagagagttgaggatgatgttcggttgatcgaaatatgttttttttaatttattttattgcccattttctgggaattgatgtgtgtttgtgggagaagaggttaagaggaaagagattatggccacttttttatgatgaagaagaaggccagggttagtaataaatggattgtgaggctgtgtgtggtttgatgttgttgcagtttagggtgttgctgcattttgtacgagttttattcaaatggaaaactgtttaatggatttttagcttacattgttgatt

SEQ ID NO: 7945 - DNA, 1892 bp, Beta vulgaris
attcggacgaggctctcttcttttcttgtgttgttttaaactcttttctctctctctctctggctccatcaagttctgttcttgaaagagagagaaaaagagcaaaaatggcgacatctttatccgtggagaagaccacctctggtcgtgaatacaaggttaaagacatgtctcaggctgattttggtcgtctcgaaatcgagttagccgaagttgaaatgcctggacttgtctcttgtcgtactgagtttggtccttctcaaccttttaaaggtgctaaaattactggatctcttcatatgactattcaaactgctgttcttattgaaactcttactgctcttggtgctgaagttcgttggtgttcttgcaacatcttctctactcaggaccatgctgctgctgccattgctagggacagtgcagctgtgtttgcctggaagggtgagacccttcaagagtactggtggtgcacagagagagctcttgactggggtcctggtggcggtcccgacctcatcgttgatgacggtggtgacgctaccttgttgatccacgagggagttaaggccgaggaggagtttgagaagagcggcaagattcccgacccaacctccactgacaatgtcgagttccagctcgtattgggtctcatcaaggagagtttgaaggttgaccctaagaggtaccacaagatgaaggagagattggttggtgtttccgaggagaccaccaccggtgttaagaggctttaccagatgcaagctaacggcaccttgttgttccctgccatcaacgttaacgactctgtcactaagagcaagtttgacaacttgtacggatgccgccactccctccctgatggtttgatgagagccactgatgtcatgattgccggcaaggtcggtgttgtctgtggatacggagatgttggaaagggttgtgctcttgccttgaaggctgctggtgctcgtgtgatcgtgactgagattgaccctatctgtgctctccaagctcttatggaaggtttccagatcttgaccttggaagatgtgcttgctgagggtgatatctttgtcaccaccaccggtaacaaggacattatcatggtcgaccacatgaagaagatgaagaacaacgccattgtttgcaacattggtcactttgacaatgagattgacatgcacgggctcgagacctacccaggaatcaagaggatcaccatcaagccccaaactgaccgtttcgtcttccctgaaactaaatcaggtgtcatcatcctggctgagggtcgtctcatgaacttgggttgtgccactggtcaccctagctttgtcatgtcatgctcattcaccaatcaagttattgctcagcttgagttgtggaatgagaaggcatccggcaaatatgagaagaaggtctacgtgttgcccaagcaccttgatgagaaggttgctgcccttcaccttaacaagctcggtgctaagctcaccaagctcaccaaggatcagtccgactacctcagcatacctgttgagggtccttacaagccagctcactacaggtattgaagtgagaatttgcagagatcggcttattggatcatccaagaggagagggacagtgttcttccttatcgtaattcgcttaggattgttagttttttgtgcttttctttgatgttgggaaggatggaatggacaaagtttatatcaaagtgtgtttgattcaagtccaagaacgggttttgaataaagatgatgattgtcgtaggcgtatagtatgtttgtaattcactcactagacttgctgctttcgtgcattttggtgagtctggttatagtttttcagtcaatgaagaggaatgaatgttgtcatttcagttcccacca

SEQ ID NO: 7946 - DNA, 1745 bp, Pteridium aquilinum
ttgacctagctgaggttgagatgcctggcctgatgtcctgccgcagtgagtttggcccatcccagccgttgaagggagcacggatcactggttctcttcacatgacaattcagactgcggtgctaattgaaaccctaactgcccttggtgctgaagtacgctggtgctcctgcaacatcttctctacacaggaccatgctgctgctgctatcgcacgggatagtgcctctgtctttgcttggaagggagagactcttcaagagtactggtggtgtactgagagggccttggattggggtcctggtggtggcccagatctgattgtggatgatggtggcgatgcaactctccttatacatgagggagtcaaggctgaagcagcttatgccaaggatggaacccttcccgatcctacttccactgataaccaggagttccagcttgtcctttccatcatactcgatggcatcaagaaggatcccaagaagtaccacaagatgaaggacaggctggttggtgtgtcggaggaaaccaccactggtgtgcaccgactttaccaaatgcagaatagtggaactttgctcttcccggccattaatgtcaatgattcagtgaccaagagcaagtttgacaatctgtatggatgccgccactctctgcctgatgggctcatgagagctactgacgtcatgatcgccgggaaggtcgctgttgtctgtggctacggtgatgttggcaagggttgtgcttctgccatgaaggctgctggggcacgtgttgttgtcactgagattgatcccatttgtgctttgcaagcttcaatggaggggcttcctgtcttgacccttgaagatgttctagagactgctgatatttttgtgactactacgggcaacaaagatatcatcatggttagccacatgaagaaaatgaagaacaatgctattgtctgcaacattggtcactttgacaatgagattgacatgcatggcttggagacgtaccctggtgtaaagaaaataactatcaagccccagacagatcgctgggtgttccctgaaacaaactccggcatcattgttttggcggagggcaggttgatgaacctgggttgtgccaccgggcaccccagctttgtgatgtcttgctccttcaccaatcaggtgattgcgcagctggagctgtggaatgaaagaaagtctggcaagtatggcaagcaagtgtatgtgcttccgaagcatttggatgagaaggtagcgttgctgcatttggccaagcttggtgtgaagctgaccaagttgagcaaggaacaggctgagtatatcaatgttccagtggagggcccttacaagcctgcacactaccgctattgagtgtttttcaaagtcctaaaagcccaccaaagctccaccactgaaatgtcaaggttcttgtctcatgatttgaagtgtcatatgtgggaatgcatcacaaacaactggcgaagctcttctttgaaaatgctacaaagcttctaaaatccaaaaggcaaggtgcatgcatcctacaagggtaagcccccccacattccatgtggagttcagagaaatgagcagcaaatgagtggtcttatgcgaaaggaggcatgtgattttcatcgaggccattatattggatatgttaacaagaagggagctggatcacatagtgttaaattgtttcaccttggaaaatgcaagaccttcatattcacgatcaaaaaagaa

SEQ ID NO: 7947 - DNA, 1460 bp, Sequoia sempervirens
acaaggtgaaagacttgtcactggctgacttcggtcgtatggagcttcaactttctgaagttgaaatgcctggcctcatggcctgcagggctgagtttggtagtgtgcaaccattcaagggagcccgaattacaggctgccttcatatgaccatccagactgccgttctaatcgagaccctcactgctctcggagctgaggtcagatggtgttcttccaatattttctctactcaggaccatgctgcagcagctattgcacgcgatagtgcatctgtgttttcctggaaggaggagacgctccaggaatattggtggtgtgtagacagggctttggattggggtcctggtggtggcccagatttgcttgttgatgatggagcagatgtcaccatactaatccatgagggcgtcaaggctgaggaagagtttgccaagaatgggaagattccagatcttgcttcaactaccagtcctgagtttcaaattattttgggattgatcaaggatagtctcaaggaagaccctttgaagtatcacaagataaaggataggttggttggtgtatctgaggaaaccactacagggatttacaggttgcatcagatacaggctactggttctctattgttccctgccattggtgttaatgattctgttacaaagagtaagtttgataacttgtatggatgtagacactctcttgtagatggtttgatgagagccactgatgtgatgattgctggcaaggttgctgttgtgtgtggatatggagatgttggcaagggttgtgctgctgccttaaagagtgctggagctagagtaattgtaacagagattgacccaatttgtgctctgcaagcccttatggaaggtatccctgttcttactctagaggatgtggtgagcactgctgatatctttgttacaactacaggaaatagggatattatcatggtggatgatatgaggaagatgaagaacaatgccattgtttgtaacattggtcattttgacaatgagattgacatgcatggtcttgaaacctaccctggtgttaagaagataacgatcaagcctcagacagaccgatgggtgttcccggaaacaaacagtggtatcattgtccttgcagaggggcgtctcatgaacttgggttgtgcaactggccacccaagttttgtcatgtcttgctcgttcacaaaccaggttattgcacagctggagctttggaatgagaggaaaacgggaaagtatgagaagaaggtatatgtgttgcccaagcatctggatgagaaggtggctgctctgcatttgcccaagttgggtgccagacttacaaagctttctccagatcaagctgcatacattaatgttcctgttgagggtccttacaagcctgtccactaccgctactgagctaatcatggtttcccatcactcatttggcgagagctgttt

SEQ ID NO: 7948 - DNA, 1337 bp, Brassica napus
gcacactctgctcccttctcacatatctcacacatccgagaagaaacttttcaaaaaatggcgttgcttgtagagaagacgtcgagtggccgtgagtacaaggtcaaggacatgtctcaggccgacttcggccgtctcgagatcgagctcgccgaggtcgagatgcctggactcgtctcttgccgcaccgagttcggaccttctcagcccttcaaaggcgctaggatcaccggttctctccacatgacggtccaaaccgccgtcctcatcgagaccctaaccgccctcggcgcggaggtcagatggtgctcctgcaacatcttctccacccaggatcacgccgccgcagccatcgctcgtgactccgccgccgtgttcgcgtggaaaggagagactctccaggagtactggtggtgcacggagagagctcttgattggggtccgggaggtggtcctgatctgatcgtcgacgacggtggtgacgctacgcttttgatccatgaaggtgttaaggctgaagagatctttgccaagaccggtcaggtccctgatccgacatctactgataatcctgagtttcagattgtgttgtcgattattaaagatggtcttcaagttgatcccaagaagtaccataagatgaaggagagattggttggtgtttctgaggagacgaccactggtgttaagaggctttatcagatgcaggagactggagctcttttgttccctgccattaacgttaatgactctgtcaccaagagcaagtttgacaacttgtatggatgtcgccactctctccccgacggtctcatgagagccactgatgtcatgatcgccggaaaggtcgctgttatctgcggttatggtgacgtcggaaagggttgtgctgcagccatgaaaaccgctggtgcccgtgtcatcgtcactgagatcgatccaatctgtgcccttcaggctctcatggaaggccttcaagttctaaccctcgaggacgttgtctctgaagctgacatcttttgcaccaccactggaaacaaagacatcatcatggtcgaccacatgaggaagatgaagaacaacgccattgtctgcaacattggtcactttgacaacgaaatcgacatgctcgggctcgagactttccctggtgtgaaacgtatcaccatcaagccgcagactgataggtgggtgtttcccgacaccaagacaggcatcattgtgctagcagagggtcgtctgatgaacgttggggtgtgctacgtggacacccaagtttcgtgatgtcgtgctcgtcaccaaccaggtgattgcacagcttgagctcgtggaacgag

SEQ ID NO: 7949 - DNA, 1598 bp, Curcuma longa
tgatggcctgccgctccgagtacggcccctcccagcccttcgccggcgcacggatctccggatccctacacatgaccatccagaccgccgttctcatcgagactctcaccgccctcggcgccgaggtccgctggtgctcctgcaacatcttctccacccaggatcacgctgccgccgccatcgcccgcgactccgcggccgtctttgcctggaagggcgagacgctcgccgagtactggtggtgcacagagcgtgcccttgactggggcactggcggcggccccgatcttatcgtcgatgacggtggtgacgccacgctcctcatccatgagggggtcaaggccgaggaagagtacaagaagagcggtaagttgccagatccggcctccaccgacaacgccgagttccagatcgtgctcggtatcatccgtgatgggctcaaggtcgatcccaagaagtaccacaagatgaaggagcgcctagtcggcgtctcggaggaaacaactactggtgtcaagcgactgtaccagatgcaagacagcggctccctcctcttccccgccatcaacgttaatgactccgtcacaaagagcaagttcgacaatctgtatgggtgccgccactctcttcctgatgggcttatgagggctaccgacgttatgatcgccggcaaggttggcgtggtctgtggttatggagatgtcggcaagggttgcgccgctgctctgaagcaggcaggtgcccgtgtcatcgtcaccgagatcgaccccatctgcgctctccaggccctgatggagggcatccctgttctccccctggaggatgttgtcgccgaggccgacatcttcgtcaccaccaccggaaacaaagacatcattatggtggatcacatgaagaagatgaagaacaatgccatcgtatgcaacattggccacttcgacaacgagatcgacatgcacgggctcgagacctacccaggcatcaagcgcatcaccatcaagccccaaaccgatcgctgggtcttccccgagacgaactccggcatcattgttcttgcagagggccgtctcatgaaccttggctgtgccactggccatcccagcttcgtcatgtcctgctccttcaccaaccaggtgattgcccagcttgagttgtggaaagaaaggaaaagcggaaagtatgatcggaaagtgtacgtgctgcctaagcatctggacgagaaggttgcggctctgcacctgggtaagctgggagccaagctcaccaagctcacaccagagcaggcagagtacatccatgtcgccgttgaaggcccttacaagcctgctcactacaggtactagtgtgccatttcggcctgagatggtaccggaatcgccaaggcagcagcagtctttgccagggatcggagtgacgctgaaattatcttgcttgatttaccttctacctttctgtttttgctatttccgatggagttctatttcattttgaattggatgaggaatgctgtggccaagcttcggaactgaataattctccaagcgatgcccctttagtacttcttgttgtcgaaatacgatgtgaaatttagttttgag

SEQ ID NO: 7950 - DNA, 1578 bp, Artemisia annua
atatcgcgagaacccttccgttttgcacgatatccgagaaaagcacagaaagaagatagctatgagtatccagacaggtgtgttgatcgagactttgactgctttgggtgcggaagtgagatggtgttcttgtaatattttttcgactcaggatcatgctgctgctgctattgctagagactctgctgctgtttttgcatggaagggggagactctacaggaatactggtggtgtaccgagcgagctttggactggggtccaggcggtggaccagatttgattgttgatgatggaggtgatgctactttgttgatccacgaaggtgtgaaagctgaggaagagtttgcaaagactggaaaggtgccagacccaagctcaactgacaacgctgagtttcaaattgtgttgagcattattaaggaaggtttggctgttgaccctaagaagtaccacaagatgaaggagagattggtcggtgtgagtgaggagactaccactggagttaagaggttgtaccagatgcaagctaatggtactttgttgttcccggctattaacgttaacgactctgtcaccaagagcaagttcgacaacttgtatggatgccgtcactctctccctgatggtttgatgagagccactgatgtcatgatcgctggaaaggtcgctgttgtctgcggttatggagatgttggaaagggttgtgctgctgccatgaaacaagctggtgcccgtgtcattgtgacagaaattgaccccatctgtgcccttcaggccaccatggaaggtcttcaagtcctcaccttggaagacgttgtctcagaagccgacatctttgtcaccaccaccggtaacaaagacatcatcatggtttccgacatggtcaagatgaagaacaacgctattgtctgcaacattggtcacttcgacaatgaaatcgacatgcttggacttgaaacctaccctggtgtccaaagaatcaccatcaaaccccaaaccgacaggtgggtattcccagaaaccaagaccggcatcatcatcttggctgagggtcgtctcatgaacttgggttgtgccactggtcaccccagtttcgtgatgtcttgctcgttcaccaaccaagtgattgcccagcttgagctatggaatgaaaggaacagcgggaagtacaagaaggaagtgtacgtgttgccaaaacatcttgatgagaaggttgctgcactccatcttggaaagcttggagctaagttgaccaagttgagcaaggaccaagctgactacatcagtgtaccagtcgagggaccatacaagcctcttcactacaggtattgagcggcgttggtttttggtgatatgatttggatgttggtaatgtggtgaattgttggattcttgtaagatacatttccagtactatgttttagcgcttagtttttggatgttgttctaatgggaatgttggcctgatttggtcttttatcgagaagggctattgatgttggttttgaataatggttgtgtagtttctttgcttcttaattcatgttgaggaaatcaaaggaaaagggtattttctg

SEQ ID NO: 7951 - DNA, 1685 bp, Arachis hypogaea
gaggtgagtgaagtctttagtttcatcacgtgttcatgtctgctctgctctctctttctctcttcatccctgttatgactgctgattttctttctatctaaaaagattctttctcttctactatataaatactttcattctactccttctactctcatcttcatcacactctccgatcctctaatttcatttcattactttcaattttctcacattttcttagagcaaagagcaagatggcgatgctggcgaaacgtgttgcttcctctgcggctcgctcactcctcacttcttccaattccaccttcaccagaaacattcatgcttctggtggaaaaaagaagattgtgggagttttctacaaaggaaacgagtatgcttccatgaatcccaatttcgttggttgtgttgaaggagcattggggattcgcgagtggcttgaatcacagggtcatgagtacattgtcactgatgacaaagaaggaccagattctgtacttgagaaacacattcctgatctccatgtcctcatatctacaccatttcaccctgcatatgtcactgcggaaagaattaagaaagctaagaatttagagctgctgttgactgctggaattggttccgatcacattgatcttaatgctgcggccgctgccggcttaactgtggccgaggtcacaggaagtaatgtggtgtcggttgcagaggatgagctcctgcggatcctcatcctattgaggaatttcttgcctggataccagcaagctgttactggtgactggaatgttgccggcattgcttatagagcttacgatcttgaaggaaagactataggaactgttggtgctggacgaattggcaagctcttactacaaaggttgaaaccctttaactgtaatcttctgtatcacgatcggctcaagatggatcctgagttggagaaccaaattggagcaaagtttgaggaggaccttgatgcaatgcttccaaagtgtgatgtaattgttatcaacatgcctctcactgataagacaaggggattgttcgacaaagatcggattgctaagtgtaagaagggtgttcttattgtcaacaatgctcgaggggcaatcatggacacgcaagcagttgctgatgcttgctccagtgggcacattgcaggctacagtggtgatgtgtggttcccacaaccagctccaaaggatcatccatggcgctacatgccaaaccatgccatgactcctcacatttctggtaccaccatagatgcacagttgcgttatgctgctggcgtgaaagacatgcttgataggcacttcaggggtgaagacttcccagaacaaaactacattgtgaaggaaggtcaactagcaccccaataccggtgaagctaaagcagacatgttaaggcattcgactcttcaattgtggtgacccttcagaaaaggaatcagaaatgtatgaactgcaataattgttctgctttttattttgagtgttttcagttttaaactttgaactctttttgttttgtaagaaataaaactgatgaacgcctgaggctactagtatgctcatttttcattttatgaatttgggtgtacttttcccatgacgtgagtaaaatgtaataaatttggtataacaagatatggaaaattgacgaataaaagtgaactatggca

SEQ ID NO: 7952 - DNA, 1537 bp, Trigonella foenum-graecum
tttctatataaaccccctctttactcttcacacttcactaaccatttttctacttctctctctaattgtcacagtttcattgaaacagaaattgattgaagatggctatgaaacgtgctgcttccaccttgatcaccacttcttcaaagatttcttcactctcttcatcttcttcttccatcatcaccagaaaccttcatgcctctggtggaaagaagaagattgtaggtgtgttctacaaaggaaatgaatatgcttcattgaatcccaattttgtgggatgtgttgaaggtgcattaggtatacgcgagtggcttgaatcacaaggacatgagtacattgtcactgatgacaaagaaggactcaattctgaacttgagaagcacattcctgatctcaatgtcctgatatctactccatttcaccctgcctatgtgaccgcggaaagaattaagaaagctaagaatttagagctgcttttgactgccggtattggttctgaccatattgatctcaacgctgcggctgctgctggtttgaccgttgcagaggtcacaggaagcaatacagtgtcggtcgctgaggatgagctcatgagaattctcattcttgtgaggaatttcttgcctggttaccatcaagctgttactggagaatggaatgttgctggcattgcgcatagagcctatgatcttgaaggaaagacagttggaacagttggtgctggacgaatcgggaaactcttactccaaaggctgaaaccttttaactgtaaccttttgtatcatgatagacttaagattgaacctgaattggagaaagaaattggagctaagtttgaggaagatcttgatgcaatgcttccaaagtgcgacattattgttatcaacacccctctcactgataagacaagaggattgtttgacaaaaatagaattgctaagttgaagaaaggtgttttgattgttaacaatgctcgcggggcgattatggacacacaggcagtagctgatgcttgttctagtggacacattgcaggttacagtggtgatgtttggttcccacaaccagctccaaaagatcatccatggcgctacatgcctaatcatgctatgactcctcatatttctggaaccaccattgatgcacagttgcgttatgctgctggtgtgaaagatatgcttgagaggcacttcaagggtgaagactttcctgaacagaactacattgtgaagcagggtgaattggcaagccaataccggtgaaccaagtagtatcaaagattggttctgagtcttgtgtttttaaggccaacgggttattactaaataaagatatctgcggcattgtaataatgtacttgctttgttgaggttgaaactctttctttaataaaactgcaatggacacaagtatttgtgttttcctgaatttcaatgtactggcagtaattggtgtatgtgtgtgtgttttcctaattgtgttttcctcaaacaagcaaactagtgaaggaaaaactggagcacttgaatatctt

SEQ ID NO: 7953 - DNA, 1758 bp, Aristolochia fimbriata
aagtgaccggcggtagatagttccggcggcagccgtcggcgtgcgcgtcggggggaaccagccgccggtgagcagcggtgacacgtcacatcgaacgtggtctgtccgactaattattgccagtccacgctggaatagatagaaaagcagagaaaatcaaatttcccagcgcctcctgttcgtgtcgcctttatccttctcgacacgtgtctccggtgtcaataaattatgattcagacccagcactgccctgtattgctccagagttgaagacttcagtgtcggcctcggctctccacttcccctgtccccttctctcttttcgtctctccatcggcggaagcgctcgaattcagtaaatggcgatgaagaaggctgcgaccgccgcgatcaaatcgcttcgctctgcttcttctgtgtcggcttcttcgattttcaccagacagcttcatgccgcaactggtagtaagaagattgtgggagtgttctacaaagctaatgagtatgcctccatgaatcccaatttcgttggttgtgcagagggagctttgggaatacgcgactggctggaatcacagggtcatcaatacattgttactgacgataaggaaggacctacttgtgagcttgagaagcacatccctgacctgcatgtgctcataaccacgccattccatccagcctatgtaaccgcagaaagaatcaagaaagccaaaaacttgcaactgctcctcactgcaggaatcggctcagaccatgttgacttacaagctgcagctgaagccggattaacagttgctgaggttacaggtagcaacgttgtttcagttgcagaagatgagctcatgaggatccttatccttgttcgcaactttgtacctggatatcaccaagtgatttctggagattggaatgtagcggctatcgcccacagagcttatgatctggaggggaaaactgtgggaacatttggtgccgggcgcattggcagacttctattgcagcggttgaagcccttcaactgcaatcttctctatcatgatcgggtcaggatggagtcggaattggagaatcagttgggtgcgaagtttgaagaggatattgataaaatgcttcccaagtgtgatatcattgtgattaatacacctctgacagagaaaaccagggggatgtttgatagcgcaaggatcgcaaagctgaagaagggagttcttattgtgaataatgctcgtggagccatcatggatgcccaggctgtcgcagatgcctgtgcgagtgggcacattgcaggttacagtggggatgtatggaatcctcaaccagctcccaaagatcatgtgtggagacacatgcctaatcatgcaatgacacctcatatctctggcaccaccattgatgctcagttgcgatatgcggcgggagttaaagacatgttggataaatacttcaagggagaagacttccctactcaaaattacattgtcaaggaaggcaaactggctagtcagtacctctaaattctgcctcaccgtacaagtggctttacagtataaactaaaataaaaataggcccgcttcaacaaggcgggtcatgtaagttgctttggaaggattccaacaagttaaccctttttgcgacagctcctgaattctgatacagaattacagagtagaggaatttgaatcctaaagactgttttgttgttaaataagaatagttgtaggagtcgaatacatcaatatatcgactatcgtttt

SEQ ID NO: 7954 - DNA, 1515 bp, Eucalyptus grandis
accagtgtttcatgcactcttctctcttcttccgatactgaatctctcctttgaatcacttcgaacccgtgggactgctgcaagaaccgctccgcttggaaaatggccatgaagcgcgccggtgtgtctgccatcagcgctctgtgctcgtctccaaacttgactagaggcgtccattctactgctggaagcaagaagatcgtgggtgtgttctacaaggccaatgagtatgccgagttgaatcccaatttcgtgggcactgtcgagagaggtctgggcatacgtgattggctggaatcgcaaggccatcagtacattgtcacagatgacaaagagggaccagactgcgaacttgaaaagcatctttccaatcttcatgtcctcataacgaccccctttcaccctgcttatgttactgcggaaaggattaagaaggcgaagaatttgcagcttcttctcactgctgggattggttctgatcacattgatttgaaggctgcggccgaagcagggttgacagttgcagaagtcactggaagcaatgtcgtttcagttgcagaggatgagctcatgagaatactcattcttgtaaggaactttttgcctggatatcatcaggtcatcaatggggactggaatgtggccggcatagcgcaccgagcttacgatcttgaaggaaagactgtcgggactgttggtgctggacgaattggcaggcttttgctacagagattgaagcctttcaactgcaatctcctctatcacgaccgcatcaaaatcgacccagaactggagaatcagactggtgcaaaattcgaggaggaccttgatgtgatgcttccgaaatgcgacataatcgtgctcaacacccctctgacagagaaaacaagaggaatgctcgataaagagaggatttccaagctgaagaaaggtgtccttatcgtcaacaatgctagaggagcgctggtggatacacaagcagttgccgacgcctgtgccagtggacaaattggaggttatagtggggatgtttggttcccgcagccggcgcccaaggaccacccctggcgatacatgcctaaccaggccatgacgcctcatatttctggcacaactattgacgctcagctgcgatacgcggccggaaccaaagacatgctggataggtacttcaagggagaggaattcccagtccagaattacatcgtcaaggagggcgttctggcccctcagtaccagtgatttccctgcctcctcggctcgtggagtttccttgttcgtgttttcgcgatcgtcgaggttgtagaagttgcaggatcttgaataaagtgtaataacgctgctctttcaaagtttgtcttgaagtgatgaggtctgcttgagaacggaactgtactcttcgtacatattccctcctgtacttatgttttacactaacgtttgtagtccatatcgcaatccacaagtggctttgtagtccatatcgcgatgtactgatatagaaataataatcaa

SEQ ID NO: 7955 - DNA, 1631 bp, Castanea mollissima
gagaatccacacgtgcccaccatgcataagatagcaaagcatccgtgaagtaatgcttaagatagtaaagcaaatttcgacttctcgacacaccaagaaagcagtttggtctataagaaagcagtttggtctttgtctctttgattggacttcagtaattttgtatctataagtagtggagtttggggtcctttgttttgcagagagcacagaagaaactcaactaaaaagcttggtttttcctcctcttaatctttcacccataacagcatatatagcacactgagagtgatcaaagagagatagcaatggcgggtgctgctacttctgcaatcaaatcagttctcactaggcatctacatgcttctcctggaagcaaaaagattgtgggggtgttttacaaggccaacgaatatgctgccttgaatcccaattttgtgggttgtgtggagggagccataggcatacgtgattggcttgaatcacaaggtcaccagtacattgtcactgatgacaaagaaggaccaaactctgaactcgagaaacatattcccgatcttcatgtcctcattactacccccttccatccggcctatgttacggctgaaaggatcaagaaggccaagaacttgcaattgctgctcacagcaggaattggctctgatcatattgatttgcctgctgctgctgctgctggattaacagtcgcagaggtcacgggaagcaatgtagtttcagttgcagaagatgagctcatgagaatcctcattcttgtccggaacttcttacctggataccatcaagctattagtggagaatggaatgttgcagctattgctcacagggcttatgatcttgaaggaaagacagttggaactgttggtgctgggcgaattggcaaacttttacttcaacgtttgaaaccttttaattgtaatctcctctatcatgatcgactcaagatggaccctgaattagagaatcagatcggtgcaaagtttgaggaggatcttgatgcaatgcttcccaaatgtgacataattgtcatcaacacacctctcactgacaagacaagagggttatttgacaaagataggattgcaaagtgtaagaagggagtcctgattgttaacaatgctcgaggagcaatcatggacacacaagcagttgcggatgcttgttctagtggacatgttgcaggttacagtggtgatgtttggttcccacaacctgccccaaaggaccacccatggcgttatatgcctaaccatgctatgacccctcatatttctggtaccaccattgatgcacagttacgatatgctgctggaactaaggatatgcttgagaggtacttcaagggtgaagaatttcctccacaaaactacattgtcaaggagggtaaactagcaagccagtaccagtaaaaacttgtgcttcttgtgtgatggtctgagtttgttttcttctgtcagcaaggtcctgaaataaaacttgccttctaaggtttttaagttttctgttataaatctgtaatgagaactaatgatggttataattccatcaacttttatgttatcttagcatgcaatggtgaatttcttgtgcttttacaaaaaaaaaaaaaaaaa

SEQ ID NO: 7956 - DNA, 1875 bp, Quercus alba
caatatattcctgacttgccactgaagctgatctacctaaaaagtatgcccatatatggtaatagctttaacattttataaattaaataataataaagataagagaagctacacgtgcccaccatgcttaagatagaacagcatccgtgaagtaatgcataagatagtaaagccattttcgacttcgcgacagtcgactcagccaaccaagaaaagcaatttggtctttgtctctatgattggactttcgtaattttgtatctataagtagtggagtttggggtcctttgttttgcacagagcacagaagaaactcaactcaaaagcttggtttttcttcctcttaatctttcacccaaaacagcatatatagcacactgagagtgatcagagagagatagcaatggctggtgctgctacttctgcaatcaaatcagttctcaccaggcatcttcatgcttctcctggaagcaaaaagattgtgggggtgttttacaaagccaacgaatatgctgccttgaatcccaattttgtgggttgtgtggagggagccttaggcatacgtgattggcttgaatcacaaggtcaccagtacattgtcactgatgacaaagaaggaccaaactctgaacttgagaaacatattcccgatcttcatgttctcataactacccccttccatccggcctatgttacggctgaaaggatcaagaaggccaagaatttgcaattgctgctcacagctggaattggttctgatcatattgatttgcctgctgctgctgctgctggattaacagtcgcagaggtcacgggaagcaatgtagtttcagttgcagaagatgagctcatgagaatcctcattcttgtccggaacttcttacctggataccatcaagctattagtggagaatggaatgttgcagctatttctcacagggcttatgatcttgagggaaagacagttggaactgttggtgctgggcgaattggcaaacttttacttcaacgtttgaaaccttttaattgtaatctcctttatcatgatcgtctcaagatggaccctgaattagagaatcagatcggtgcaaagtttgaggaggatcttgatgcaatgcttcccaaatgtgacataattgtcatcaacacacctctcactgacaagacaagaggtttatttgacaaagataggattgcaaagtgtaagaagggagtcctgattgttaacaatgctcgaggagcaatcatggacacacaagcagttgctgatgcttgttctagtggccatgttgcaggttacagtggtgatgtttggttcccacaacctgctccaaaggaccacccatggcgttatatgcctaaccatgctatgacccctcatatttctggtaccaccattgatgcacagttacgatatgctgctggaactaaggatatgctcgagaggtacttcaagggtgaagaatttccttcacaaaactacattgtcaaggagggtaaactagcaagccagtaccagtaaaagcttgtgcttcttgtgtgatgatctgagtttgttttcttctgtcagcaaggtcctgaaataaattacttgctttttaaggtttctaagttttctgttttaaatctgtaatgagaactaatgatggttataattccatcgacttttatgttatcttagcatgcaatggtgaatttcttgtgcttttgaatgtgatgttgtataataactcacgattgtaaaataagacaaatggcatcccgtcacacccagattcactcccttcttgcgcatcactcgccatctttctttcaaagcccagaccacacacagctaaggcctaagggttttgcttgttcgtcactgctctgctc

SEQ ID NO: 7957 - DNA, 1398 bp, Lotus japonicus
agagcgagtactcgtcttcaactgttggaatgcaactcactcactctcaattttccaatttcagtgaaaactaccatcgctatggccatgaaacgtgctgcttcctctgctgttcgttcccttctcactgctccaacaccaaacccttcttcttccattttctctaggaaccttcatgcctctggtggaaagaagaagattgtgggggtgttctacaaggctaatgagtatgctgccctcaatcccaattttgtgggttgtgttgaaggagcactgggaattcgcgagtggctcgaagcacagggtcatgaatatatcgtcactgatgacaaagaaggacttgattctgaacttgagaaacacattcctgatctccatgtcctcatatctaccccatttcacccggcctatgtgactgctgagagaatcaagaaagcgaaaaatttagagctgcttttgactgctggcattggttctgatcacattgacctcaatgctgccgctgctgctggtttaactgtggctgaggtcacgggaagcaacaccgtgtccgttgcagaggatgaactcatgagaatcctcattctagtgaggaatttcttgcctgggtaccatcaggccattactggagaatggaatgttgctggcattgctcatagagcttatgatcttgaaggaaagaccataggaacggttggtgccggacgaattgggaagcttttactccaaaggttgaaaccttttaactgtaatcttctatatcatgatcgccttaagatggaacccgaattggagaaggaaattggagcgaagtttgaggaggacctagatgcaatgcttccaaagtgtgatgttattgttatcaacacccctctcactgataagacaagaggattgttcgacaaaaatagaattgctaagttgaagaagggtgtcttgattgttaacaatgctcgaggggcaattatggacacccaagcagttgctgatgcttgctctagtgggcacattgcaggttatagtggcgatgtttggttcccgcaaccagctccaaaagatcatccatggcgctacatgcctaaccatgctatgactcctcacatttctggtaccaccattgatgcacagttacgttatgctgctggggtcaaagatatgctggagaggcactttaagggtgaagacttccctgaacaaaactacattgtcaaggagggtcaactagcaagccaatatcgttgaagtagtgtgtatcagagtggttccaatcttccatttttaaggccagactaaataaagatatgtagggcattttactgatgtacttgcttttatcggatggaagagtcaaaataagcgaattaatcgatgaattaataaaatgttagactttcatgt

SEQ ID NO: 7958 - DNA, 1476 bp, Trifolium pratense
  misc_feature (727)..(727): n is a, c, g, or t
  misc_feature (730)..(730): n is a, c, g, or t
tttcactattctgtctgcacaaatatttctatataaacccccctctttactcttcacacttcatcactaaccatattcttctccttcttcttctctctaattgctataatttcttcactttcattgaaattgattgaagatggctatgaaacgtgctgcttccaccttgatcactactacttcttcaacgatttcatctctttcttcatcttctgcttcttccatcatcaccagaaaccttcatgcctctggtggaaagaagaagattgtaggtgtgttctacaaaggcaatgagtatgcttcatcgaatcctaattttgtgggatgtgttgaaggaggattgggtatacgtgagtggcttgaatcacaaggacatgaatacattgtcaccgatgacaaagaaggactcgattctgtacttgagaagcacattcctgatctccatgtcctgatatcaacaccatttcaccctgcctatgtcaccgcggaaagaattaagaaagctaagaatttagaactgcttttgactgccggcattggttctgatcacatcgatctcaatgctgcggctgctgctggtttaactgtcgcagaggtcacaggaagcaacacagtgtcggttgctgaggatgagctcatgagaattctcattctgacgaggaattttgtgcctggttaccatcaggctattaccggagactggaatgttgctggcattgcacatagngcntatgatcttgaaggaaagactgttggaacggttggtgctggacgaatcgggaagcttttactccaaaggctgaaaccctttaacgttaaccttttatatcatgatagactcaagatagagcctgaattggagaaagaacttggagctacatatgaagaggaccttgatgcaatgctgccaaagtgcgacataatcgttatcaacacccctctcactgaaaagacaagaggattgtttgacaaaaatagaattgctaagttgaagaaaggtgtcttgattgttaacaatgctcgtggagcaattatggatacgcaagcagttgctgatgcttgttctagtggacacattgcaggttacagtggtgatgtttggttcccacaaccagctccaaaagatcatccatggcgttacatgccaaaccatgccatgactcctcatatctctggaaccaccattgatgcacagttacgttacgctgctggggtgaaagatatgcttgagaggcactttaagggtgaagactttcctgaacagaactacattgtgaagcagggtgaattggcaagccaatatcggtgaataaattagtttcaaagagttcttctgtgtcttctgtttttaatgccaatggattattactaaataaagattaatgcggcattgtaataatatacttgctttgttgaggttaaaactcagtttaataaaactgcaatggacacaagtttgattcttgtgttctcctg

SEQ ID NO: 7959 - DNA, 1399 bp, Glycine max
agacacaactgcgacttagttcatcccttctcaagccaccgaagcctcactttttgaaattacttgcatagatagataatcatggctatgatgaaacgtgctgcttcctctgcgcttcgctctcttattgcctcatcctccaccttcaccagaaaccttcatgcctcaggtgaaaagaagaagattgtgggggtgttctacaaagggaatgaatatgctaaattgaatccaaattttgttggatgtgttgaaggtgcattgggaatacgtgagtggctggaatcacagggtcatcagtacattgtcactgatgacaaagaaggacctgattctgaacttgagaaacacattccagatgcacatgtcatcatatctactccattccaccccgcctatgtcaccgcagaaagaattaagaaagccaaaaatttggagctgcttttgactgctggcattggttctgatcatgttgatctcaaagctgcagctgctgctggtttaactgtggcagaggtcacaggaagcaacgttgtgtcggttgcggaggacgaactcatgagaatcctcattctaatgaggaatttcttgccagggtaccatcaggctgttaatggggaatggaatgttgctggcattgcacatagagcttatgatcttgaaggaaagacagtaggaaccgttggcgcgggtcgaattgggaagcttttgctccagaggttgaaaccttttagctgtaatcttctttattttgatcgacttaggatagatcctgaattggagaaagagattggagcaaaatttgaggaggaccttgatgcaatgcttccaaagtgtgatgtgattgttatcaacacccctctcactgagcagacaaggggattgtttgacaaaaatagaattgctaagtgcaagaaaggtgtcttgattgttaacaatgctcgaggggcaattgcggacactcaagcaattgctgatgcttgctccagtggccacgttgcaggttatagtggtgatgtttggttcccacaaccagctccaaaggatcatccatggcgctacatgccaaaccatgccatgactcctcatatttctggtaccaccattgatgcacagttacgttatgctgctggtgtcaaagacatgcttgataggcacttcaagggtgaagactttccagaacaaaactacattgtgaaggagggtcaacttgctagccaataccgatgaagtggtgtgtgtcaatgtggcctttgaatcttccaattttaaggccaatgaatatgagcaaataaagatctagaaggcactctaattatgtaatgcacttgctttgttgaatttgaactcgtttaattgatctcagaaataaaagtttaaggaacactccattttccatgta

SEQ ID NO: 7960 - DNA, 1441 bp, Aquilegia formosa
caagttttaacaagagaaacaattgggaaatggcaatgaagaaagctgccctttcgactgttcaaagcgtgttgtcatcttcatcattctcaacccgcctcgttagacatattcatgcttctccaggaagtaagaagatcgtgggggtattctacaaggccaacgagtatgcagctatgaatccaaactttgtaggttgcgcagaaggagcattgggcatacgaaattggctagaatcacaaggccatcaatacattgtcactgacgacaaggaaggccccaactgtgaactcgagaaacatattccagacctccatgtcctcatatccactccattccatccggcttatgtcacagaagaaaggattaagaaggctaagaacttacaacttcttcttactgctggaattggttctgaccacattgatttaaaagctgcatcagatgcagggctaacagttgcagaagtcactggaagcaatgtggtttcagtagcagaggatgagttgatgagaatactgatacttgtgcgaaatttcttacccggttaccatcaggtggctagcggggactggaacgttgcagctatttctcatagagcttatgatctggaaggaaagacagtgggaacaattggtgcaggacgtattggcaagcttctgctccagcggctgaagcccttcaattgtaacctcttatatcatgatcgactaaagatggaccctgacatggagaatcaaacaggagcaaagtttgaagaggatcttgataaaatgcttcccaagtgtgatgtaattgtcgtcaatatgcctttgacagaaaaaactaagggaatgttcaacaaagaaaagattgccaaattaaagaaaggagttttgattgtgaataatgctcgaggagcgatcatggatactcaggcagttgccgatgcctgctcaagtggacatattgcaggttatagtggggatgtttggtatccacaaccagctccaaaggatcatccatggcgtggcatgccaaatcaagccatgacacctcatacttctggcaccaccattgatggccagttgcgttatgctgcaggagttaaagacatgttggacaagtacttcagaggacaggaattccctgcacagaattatattgttaaggaaggtcaaattgcaagccagtatcgttaatctctaacaatatcagggtagtgatgaaataaacggagcacgcactatcatatcagcttaatattattagttcagcttcagtgtgcttcttgtttttgtgactgattggtaccgacttttagttctttcggtgtctcaagcagtttcttttgatcaatgtaatccagttctaccctttagtgacagtgattattaaggaaatgattatcaatccacaccttctgatctggttatggattaatgcattggctcatttatgt

SEQ ID NO: 7961 - DNA, 1450 bp, Medicago truncatula
atataaaccccccctcattactcttctcaattcactaaccattcttattctctctaatactttcagtttcatcactttcattgaaacaaaaattgtttgaaaatggctatgaaacgtgctgcttccaccttgatcactgcttcttcaaagatttcatcactttcttcaccttcttccatcatcaccagagaccttcatgcctctggtggaaagaagaagattgtaggtgtgttctacaaaggcggcgaatatgcttccttgaatcccaattttgttggatgtgttgaaggagcattaggtatacgcgagtggttggaatcacaaggacatgaatacattgtcactgatgacaaagaaggactcaattctgaacttgagaagcacattcctgatctcaatgtcctgatatccacaccatttcaccctgcctatgtcactgcggaaagaattaagaaagctaagaatttagagctgcttttaactgccggcattggttctgatcacattgatctcaatgctgcggctgctgctggtttaaccgtcgcagaggtcacaggaagcaacactgtgtcggttgctgaggacgagctcatgagaattctcattcttgtgaggaatttcttgcctggttaccatcaggctattaccggagaatggaatgttgctggaattgcacatagagcctatgatcttgaaggaaagacagttggaacggttggtgcgggacgaatcgggaagcttttactccaaaggctgaaaccctttaactgtaaccttttatatcatgatagacttaagatggagcctgaattggagaaagaaattggagctcagtttgaggaggatcttgatgctatgctaccaaaatgcgacattattgttatgaacatgcctctcactgataagacaagaggattgtttgacaaaaatagaattgccaagttgaagaaaggtgtcttgattgtcaacaatgctcgcggagcacttatggatacacaagcagttgctgatgcttgttccagtggacacgttgcaggttacagtggtgatgtttggttcccacaaccagctccaaaagatcatccatggcgctacatgcctaatcatgctatgactcctcatatttctggaactaccattgatgcacagttacgttatgctgctggagtcaaagatatgcttgagaagcactttaagggtgaagactttcctgaacagaactacattgtgaaggagggtcaattggcaagccaataccggtgaatgtagtatcgaagagtggttctgacttctgcgtcttgagtttttaaggccaatgaattactaaataaagatatccgcggcattgtaataatgtactcggctttgttgaggttgtaacttgtttaataaaattgcaatggacacaagtatcattcttgtgtttttttctgaattcagtgttctgttg

SEQ ID NO: 7962 - DNA, 1422 bp, Glycine max
aacacacacagaacagacacaactgcgaattagttcatcctttcccaagccagccaagcgaggcatgctctcaatttttgaaattacttgcatagatagagcatcatggccatgatgaaacgtgctgcttcctcttcggttcgctcgctactttcctcatcctccaccttcaccagaaaccttcatgcctcaggtgaaaagaagaaaattgtgggggtgttctacaaagggaatgagtatgctaaattgaaccccaatttcgtggggtgtgttgaaggagcattgggtatacgtgagtggctggaatcacagggtcatcagtacattgtcactgatgacaaagaaggaccagattctgaacttgagaaacacattccagatgcccatgtcatcatatctactccatttcaccccgcctatgtcaccgcggaaagaataaagaaagcgcaaaaattggagctgcttttgactgctggcattggttctgatcacgttgatctcaaagctgcagctgctgctggtttaactgtggcagaggtcacgggaagcaatgtcgtgtcggttgcggaggatgaactcatgagaatcctcattctaatgaggaatttcttgcctgggtaccatcaggctgttaagggtgaatggaatgttgctggcattgcacatagagcttatgatcttgaaggcaagacagtaggaaccgttggcgcgggacgaattgggaagcttttactccagaggttgaaaccttttaactgtaatcttctgtattttgatcgacttaggatcgatcctgaattggagaaagagattggagcaaaatttgaggaggaccttgatgcaatgcttccaaagtgtgatgtaattgttatcaacacccctctcactgagcagacaaggggattgtttgacaaaaatagaattgcgaagtgcaagaaaggtgtcttgattgttaacaatgctcgaggggcaattgcggacacccaagcaattgcagatgcttgctccagtggccacgttgcaggttatagtggtgatgtttggttcccacagccagctccaaaggatcatccatggcgttacatgccaaaccatgccatgactcctcatatttctggcaccaccatagatgcacagttacgttatgctgctggggtcaaagacatgcttgataggcacttcaagggtgaagactttccagaacaaaactacattgtcaaggagggtcaacttgcaagccaataccggtgaagtagtgtgtgtcaatgtggcctttgaatcttccatttttaaggccaatcgatgagcaaataaatatctagaaggcactttaattatgtaatgtacttgctttgttgtgtctgaactcgtttaattgatctcagaaataaaattttaaggaacactctccatgttccatgt

SEQ ID NO: 7963 - DNA, 1283 bp, Utricularia gibba
tccgcctcctcgtcgattctcactaggcgtcttcatgcttcccctggtcccaagaaaattgtgggcgttctttacaaggcaaatgaatacgcttccacgaatcccaacttcgtggcttgtgctgaaaatgctttgggcatacgcgattggttggagtcgcaaggccaccagtacattgtcactgcggacaaggaaggccctcactgtgagcttgagaaacatatacctgatctacatgtgctgattaccacccctttccatcccgcttatgtaactgctgaaaggatcgaaaaagctaaaaacttgcagctggtgctcactgccggcatcggttcggaccacgttgatctcaaggctgcagcagcagctggattaaccgttgctgaggtaactgggagtaacacagtctcggttgctgaagatgaactcatgaggattctcatactggtccgcaattttctacctggatatcatcaagttataaacggggagtggaatgttgcagctattgcacacagggcttacgaccttgaaggtaaaactgtgggaactgttggagctggacgcataggccgtttgctgatgcagagactaaagcctttcaactgcaatgtactgtaccacgatcgcattaaaattgatccggagctcgagagtgagatcggggctaagtatgaggaggaccttgatgcaatgcttcccaaatgtgacattgttgtcatcaacacacctctgactgagaaaaccaaaggaatgtttgataaagagaggatagcgaagctcaaaaagggagttctcattgtcaacaatgcaagaggtgcaatcatggacacacaggcagttgttgatgcttgctcatccgggcatattgcaggttacagtggagacgtttggttcccacagccagcacccaaggatcatccctggcgctacatgccaaaccaggccatgactccccacatctctggaaccaccattgatgcacagcttcggtatgctgctggtgtgaaggagatgctggataggtacttcaaaggcgaggactttcctcaacactattacattgtcaaggatggagaactggccgcacagtatcgttaggtacgatgtggtctggcaactgcaaataaagcaactttgctccactctgaagaatggatcagctgctgctgctctcttccagacaatttgctcactgtactgaagcggctctgtgtctaccgcgagttgtggttttgttctgaataaataatatcaacaattaaacaacaattaagcatacg

SEQ ID NO: 7964 - DNA, 1387 bp, Carthamus tinctorius
  misc_feature (921)..(921): n is a, c, g, or t
  misc_feature (924)..(924): n is a, c, g, or t
  misc_feature (939)..(939): n is a, c, g, or t
  misc_feature (944)..(944): n is a, c, g, or t
  misc_feature (968)..(968): n is a, c, g, or t
  misc_feature (993)..(993): n is a, c, g, or t
  misc_feature (1005)..(1005): n is a, c, g, or t
  misc_feature (1018)..(1018): n is a, c, g, or t
  misc_feature (1027)..(1027): n is a, c, g, or t
  misc_feature (1029)..(1029): n is a, c, g, or t
  misc_feature (1036)..(1036): n is a, c, g, or t
  misc_feature (1038)..(1039): n is a, c, g, or t
cggggatctccactgtcacaaacaatcaatcgtcttctttcagtccttccttccttccttcttcccaattcactactacactagtatactactacaaagaccaccggcgatcaatggccatggcgatggcgatgaagcgtgctgctgccactgctatttcctccgcttccattctcaccagacaccttcatgcttctgcggagaaaaagaagattgtaggtgttttctacaaggcacatgagtatgctgagatgaaccccaattttttgggttgtgcagagaatgcgttgggcattcgcaactggttggaatcacaaggccacgagtacgtagttaccgacgacaaagagggaccagattgtgaactagaaaaacatatttctgatatgcatgtcctcataaccaccccatttcatccggcctatgttactgctgaaaggattaaaaaggcaaagaatttgcagctgttgcttactgctgggattggatctgatcatgttgatctccaggcggccgctgctgctggattaactgttgcagaggttactgggagcaatgttgtttctgtagcagaagatgaacttatgaggatcctcattcttgttcgcaatttcttgcctggacaccaccaggttattaccggggattggaatgttgcaggtattgcttacagagcttatgatcttgaagggaaaactgtaggaacggttggttgtggacgtatcggtaggcttttacttcaaaggttgaagcctttcggctgtaatcttctctatcatgatcggattaagatggacccagaattggagaatcaaattggtgccagttttgaggaagatcttgataagatgcttcccaaatgtgacataattgtcatcaatacgcctttaacagagaaaaccaaaggaatgtttgacaaanaanggattgctaaattanagaanggtgttctgattgttaacaatgcncgaggggctatcatggatacacaanctgttgttgatngatgttctagtgnacacattgnangatatancnnagatgtttggtatcctcaaccagctccaaaggatcatccatggaggtacatgccaaatcaagccatgacccctcacatatctggaaccaccatcgatgcacagttgcgatatgctgctggagtgaaagatatgctggagaattatttcaagggagaagacttcccggcccaacattacattgtgaaggaaggtgaactagcaagccagtaccggtaatctgtgttccaattgtgtcaactgatgcatgctttctaataagttgagtcgagttgagctgagctctttaaaagtgaaagttatgacctggtaccagcaaggtgtagttatggcaaactgaatgccttcaa

SEQ ID NO: 7965 - DNA, 1741 bp, Amborella trichopoda
  misc_feature (38)..(38): n is a, c, g, or t
  misc_feature (582)..(582): n is a, c, g, or t
  misc_feature (1057)..(1057): n is a, c, g, or t
  misc_feature (1118)..(1118): n is a, c, g, or t
  misc_feature (1224)..(1224): n is a, c, g, or t
aaacgtctcattctctttcctaattgatgtgaattccnccccttccgcccctctattgcctgaataaatcccctctccctctaaaacctctctctttctcagaattgaccacaattctgtacgctctggtcgccgcctcctcctcctccttcccctttcctatataagttttcctcagtactgtctcatttatatctcaacctctctctcttcccccacatggcgatctcaagagccgctgcctctgttatccctgccctcttatccaagggccctgcaatttccagacatctccatgcatcatcaggaagcaagaagatcgtgggcgtgttttacaaggccaacgagtatgcgtccatgaacccgaacttcttgggttgtgcagagaatgctcttggcataaagggttggcttgaatctcaaggccaccaatacatagtaacagatgacaaggaaggcccctactgtgagctcgagaaacatatccccgacctccatgttctgatatcgacaccattccacccagcctatgtaacagctgagcgtataaagaaggcaaaaaatttagagcttctccttacngctggtattggttctgaccacatcgatctgaaagctgctgctgcagctggcttaacagttgcagagatcacagggagcaatgtggtatcagtagctgaggatgaactcatgagaattctcattcttgttcgaaattttttgcctggttatcaccaagtcatcaaaggtgaatggaatgttgcagcgatagcatatagagcttacgaccttgaggggaaaacaattgggactgttggagctggtcgtatagggaagcttttgcttcaaaggttgaagcctttcaactgcaatttgttgtatcacgatcgaatcaagatggagcatgaattggaggcacaaattggagctcaatttgagccggatgttgatgctatgcttccgaaatgtgatgtgattgttatcaacacaccacttactgagaaaaccaagggaatgtttgacaagaaccgtattgctaagttgaagaagggagttntgattgtgaacaatgcaaggggtgctatcatggatactgacgcagttgctgaggcttgttntaatggccacattggaggttatagtggggatgtgtggaatccacaaccagctccgaaggatcacccatggcgctatatgcccaatcatgccatgactcctcatatntctggcaccaccatcgatggccagatacgttatgcggctggagtgaaagacatgttggagagatacttcaagggtgaggacttcccccctcaaaattacattgtcaaggaaggtaaactggcaagtcagtacgtatgattttttagccctctttcaagatcaagctcctgtggggacaaatgttaggcagaataagtgttgggctgcattcttgaattagttgggttttttcttgaatgatagcctttggaatggaataaatattgctagctggaagggaaaatgagatttcatacaatttttacaagatatgtactggaaatgaatggatccaagtggtcttaatcacactttctgagtatttgtgttttgctattattaatccaagtggtcttaatccaagtaggtttccatttccgcttatgcgtttgaaaaccaagtattctttcaacaagtaggagcctgtattttccccagatctaccccaaaaataattttatttttttcatgatatttc

SEQ ID NO: 7966 - DNA, 1383 bp, Euphorbia esula
  misc_feature (328)..(328): n is a, c, g, or t
  misc_feature (339)..(339): n is a, c, g, or t
  misc_feature (354)..(354): n is a, c, g, or t
  misc_feature (382)..(382): n is a, c, g, or t
  misc_feature (937)..(937): n is a, c, g, or t
  misc_feature (946)..(946): n is a, c, g, or t
gacgtgctggtgtctctgcaattcggcctttaacttcatcatcatctccgatctcaggctcaattctctctaggcatctccatggttctgcagagagcaaaagatagtcggtgtattctacaaggcgaatgagtatgcttcaatgaatcccaattttttggggtgtgcagaggcaggattgggcatacgcgagtggctcgaatctcaaggacaccaatacattgtcactgatgacaaagaaggaccagactgtgaactcgaaaaacatattgatgatctccacgtcctcataactactccattccacccagcctatgttacagcaganaggatcaaganggcgaaaaacttacnattgcttctcactgctggaattgggtcngaccatatagatttgaatgcagcagctgctgccgggttgactgtggcagaagtaactggaagcaatgtggtctcggtggcagaagatgagctcatgaggattcttattctggtccggaatttcttaccgggataccatcaagttatctctggagactggaatgtagccggtattgcttacagagcttatgaccttgaaggaaagactgttggaactgttggtgctggtagaattggtaaacttttgctgcagcgtttgaaacctttcaactgtaatcttctgtaccatgatcgacttaagatggacccggaattggagagccagattggggcaacatttgaggaggatcttgatgcaatgcttcctaaatgtgacatagttgtcatcaacacgcctcttacagacaagacaaaggggatgtttaataaagaaaagattgctaagatgaaaaagggagtgcttattgtcaacaatgctcgaggagcaatcatggatacccaagcagttgctgatggttgttcaactggacaaattggaggttacaggggggatgtntggtatccncaacctgctccaaaggaccatccatggcgttatatgccaaatcaagctatgacccctcatatttctggaaccaccattgatgcacaactgcgatatgccgaaggagtgaaggacatgctggcgaggtactttaagggagaagaatttcctctgcaaaattacattgttaaagaagggaaacttgcaagtcaatatcagtaagctgtggagaagtgcggtttttaaggttcggaataatgtaaccttgatagaggtttaaagtttttctatgagaaaataagtgaacttaagtcttgaaaaaccatattgtaccagtttgtgaagtatgcttgtattggtttcttatttctgtgtaatttagttgtgttttctgtatgcattaatttccagtactttgaagcttatcaactaaacttttcaaaggatttggatcctct

SEQ ID NO: 7967 - DNA, 1587 bp, Phalaenopsis aphrodite
cactgatcaacgatcaggatgtggcgggcagcatcaaagcaagtgatccggactgtcggttcctccctctccgacctttcgcctctccggaagcagctccatgcttctccagggaaaaagaaaatagtgggcgtgttctataaggggaacgagtatgcagcgaagaaccctaatttttggggacggtggagagggctttgggaatcagagagtggttggaaagtcaaggccaccagtacattgttactgatgataaagatggacctaattccgaacttgagaagcacattcctgacctccatgttctaatcaccaccccttccacccggcatacgtcaccgccgaacgatcaaaaaagccaaaaacctccaactcctcctaaccgccggcatcggctccgaccacattgatctcaaagccgccgccgacgcgaagctcaccgttgccgaagtcaccggaagcaatgttgtgtccgtcgccgaagacgagctcatgagaattctcattctcgttcgaaacttcgttcctggttatcaacaggtcatcaatggcgattggaacgtagccgcaatctcttatcgggcttacgacctcgaaggcaagaccgtcggaaccgtcggcgccggccgaataggaaagcttttgctgcagcggttgaagccgtttaattgcaatctcctctatcacgatcgactgaagatcgatccggagttggagaaggagatcggagcgaagtttgaggaagatcttgatgtcatgcttcccaaatgtgatgttgttgtgatcaatacacctcttactgagaagacaaagggattgttttgataaggaagaatttcaaagttgaagaagggagttcttattgttaataatgctagaggagctattatggatactcaggcagtagtggatgcttgcaacagtggacatattgcaggctacagtggtgatgtgtggaatccacagccagctccaaaagatcacccatggagatacatgccaaccaggccatgactcctcatgttcaggcacaaccattgatggccaactgaggtatgcggctggtgtgaaggacatgcttgacaatacttcaaggagaagactttctcagcagaactatattgtgaaggaaggcaacttgcaagccagtacctgtgaatctgtgattttgactctctactcggtctgaggggcagctgccttattatatgattatataataacccttgctggtggagttagtctggtctctgtatttctctggttgatgctttgagtgtggtgtgaagtagtttctatggtgtttaatgcaataaaattctagaaattgttggggtgttattgcctatatacttttattagtttttgcaatagtatattataggaaaatttgcatagatggtaatatccgttatatccatcaagattgtcaattctaatccagtgattagtgcttcatattctgcttacgttgtttgtacacggctctgtcagatgatagaagaatctcaacatgcatatctctgaaaattcagacaggtgatatttttatgtggtatgaaagatttgggttactaatgtaaagat

SEQ ID NO: 7968 - DNA, 1398 bp, Antirrhinum majus
  misc_feature (405)..(405): n is a, c, g, or t
  misc_feature (453)..(453): n is a, c, g, or t
  misc_feature (473)..(473): n is a, c, g, or t
  misc_feature (494)..(494): n is a, c, g, or t
  misc_feature (823)..(823): n is a, c, g, or t
  misc_feature (871)..(871): n is a, c, g, or t
  misc_feature (874)..(874): n is a, c, g, or t
  misc_feature (891)..(891): n is a, c, g, or t
gaagagaatcagttcttctcaatttcaattattttcttatctttaagattttgataatttttcaatggcgatgaagcgtgccgctgtaactgcagttcgtgctcttacttcctcagctccttcttcagttctcaccagaggccttcatgcttcacctggcagcaagaagattgtgggtgtattctacaaggcaaatgaatatgcttccatgaatcccaatttcctcggctgtgtcgagaattcgttgggcatacgtgactggttttattccgaaggtcaccagtacatagttactcctgacaaagacgcgcccggactgcgagcttgagaagcacatccctgaaaatgcatgtgttgataacgaccccattccatccagcatatgtgactgccgaaaggatcaanaaggcgaaaaacttgcaacttttgctcacggctggaattggttcggancatatcgatctgaaggctgnagctgatgctggactaaccgnagcagaggtcctgggagcaatgttgtctcagttgctgaagatgaactaatgaggattctcattcttgttaggaactttttgccagggcaccatcaggttattaatggcgaatgggatgttgcggctattgcttaccgatcttatgatcttgaaggtaagactgttggaacagttggagctggacggattggccggcttttgcttcagaggttgaaaccattcaactgtaatcttctctaccatgaccgtcttaagatggatccggagttggagagtcaaataggagcacagtttgaggaagatcttgatgcaatgcttccaaaatgcgncataattgtcattaatacacctcttactgagaaaacgaaggggatgtntgncaaagatagaatagcanagctaaagaatggagtctaattgtgaccaacgctagaggtgcaatcatggcacacaagcagttgttgatgcctgttcaagtgggcatatcgcaggttacagtgccgatgtttggtacccacagccagctcctaaggatcacccctggcggtacatgccaaaccaagcaatgactcctcatatatccggcactaccattgacgcacagttgcgttatgcgcctggagttaaggacatgctggagaactatttcaagggtgaggattttcctcctcaaaattacattgtcaaggatggagaactcgcaagccagtacaggtacacgtgcttcgggacttgtgaagttgcacgctatctatattgacgaatgtaacgacatcctaccacttaaataaacggactcttcggtaatctcatcgttttatgtggacatgtgatggtttgttggcctggatgctaatgtacttgtagtaatgaataaaaagagttcagctttattctcaagcgg

SEQ ID NO: 7969 - DNA, 1545 bp, Sarracenia psittacina
agtattattacattacagacagcaaagcaaagcacctgagaaagagaaatggcgatgaagcgcgtggccgccactgcgattcgtgcttttgcatcttctggaaattccagttccctcattctaaccagaagtctccatgcttcgaccggaaagaaaaagatagtgggggtattttacaaagggggtgaatacgctgcattgaatccaaattttgtggggtgtgtggaaggcgcattgggcatacgtgattggttggagtctttaggtcatgagtacatcgttactgatgacaaagatggaccaaattctgaactggagaaacttattcctgatatgaatatcctcattccaacgcccttccatccggcctacgttacagcagaagaatcaagaaggccaaaatctcgaactggtggtcacagccggaattggctcggataacgtcgatctggaggcggcggctgccgccggtttaacagttgcgaaggtcaccggaagcaatgtggtgtccgtcgcggaagatcagctcatgagagttctcattctggttcggaatttcgtgtctgggtatcgccaggttattaacggcgaatggaacgtcgccgctattgcttacagagcttatgatcttgaaggaaagaccatcggaacagtcggcgccgggcgaattggaaagcttttactccagagattgaagccttttaactgtaatctactctaccacgatcggatcaagatcagcccggagctggagaaggaaacgggtgcgaagtttgaggaggatcttgacgccatgcttccaaaatgtgacgtaattgtcaccaacttacctcttacagaaaaaaccaagggatgtttgacaaggctaggattgctaagctgaagaagggagttctaattgttaacaattcaagaggagcactcatggatacaaatgcagtggttgatgcttgtgaaagtggacaaattggaggttacagtggggatgtttggtacccacagccagctccaaaggatcatccatggcgatacatgccacaccaagccatgactcctcacatttctggcactaccattgatgcgcagttacgatatgcggcaggagttaaggacatgttggagaggtactttaagggagaagagtttcctgcacagaactacattgtgaaggaggggcaactggctagccaataccgttgaacccatgttcgacgaattgcaataagaaaagcatggcagaggattcatgctcgtgttcaatttagttcaagagttaagaccagccgttttcgacgaaatcgacaataatcagttcagggtttagtaattgatgttgttgcaactagagtgtgtttagctttatgagaaataagtaattgatgttgtttcaactagagtgtgtttggctttatgagaaatttttttgtgctatcatgttttatcttaggccatataggcctttgtactttgttttattttagggctatacaggccttttgtactttgggactgttattgaaataaatggaataatttgtgcaaaaa

SEQ ID NO: 7970 - DNA, 1470 bp, Vigna unguiculata
  misc_feature (447)..(447): n is a, c, g, or t
  misc_feature (739)..(739): n is a, c, g, or t
  misc_feature (940)..(940): n is a, c, g, or t
  misc_feature (1221)..(1221): n is a, c, g, or t
  misc_feature (1454)..(1454): n is a, c, g, or t
ttattttttgtttctctgttattttctttgtttattttgttctatataaacatcacacactgctctattttttcacacagttctctttctctcttttctctattctctgttcttaaaaatttcatcaccatggccatgaaaagtgctgcttcctccgccgttcgctctctgctttcttcctcctcttctaccttttcaagaaaccttcatgcccagggtgagaggaagaagattgtgggagtgttctataaagggggtgagtatgctaaatcgaatcccaatttcgtgggatgtgttgaaggagcattgggtattcgtgagtggttggaatcaaagggtcatcaatatattgtcactgacgacaaagaaggacccaattctgaacttgataaacacctacccgatgcacatatcatcatatctactccgtttcatcctgcatatgtnactgctgagagaataaagaaagccaagaatctagagctgcttttgactgctggaatcggttctgatcacgtcgatctcaacgctgctgctgctgctggtttaactgtggcagaggtaacaggaagcaatgtggtttcggttgccgaggatgaactcctgagaatccttgttctggtgaggaatttcttgccagggtatcatcaagctgttaatggggaatggaatgtcgctggcattgcacacagagcttatgatcttgaaggcaagacaataggaactgttggtgctggangaattgggaaacttttgctgcagaggttgaaaccttttaactgtaatcttttgtactatgatagacttaggatgaacactgaattggagaaagagattggagcaaagtttgaggaggatcttgatgccatgcttccaaagtgtgatgtgattgttatcaacatgcctctcactgagcagacaagaggattgtttgacaaanacagaattgctaagtgcaagaagggtgtggtgattgttaacaatgctcgaggggcaattatggatacccaggcaattgctgatgcttgcaccagtggccatgttgcaggttatggtggggatgtttggccagtgcaaccagctccaaaggatcatccatggcggttcatgccaaaccatgccatgactcctcatatttctggcacaaccatagatgcacagctacgttatgctgctggtgtgaaagacatgttggataggcacttcaggggtgaagacttnccagaacaaaactacattgtgaaggagggtcaacttgcaagccaatatcgatgaagtatgaatgtggtgttagaaacttccactttcaaagccaaggaatgagaaaaaataaacatctagagtgaactctaattatatgaagtacttgctttgttgaatttgaacttgtctgtaataaatctaattcagaaataaaattatgaaaactgttgaaaaacttgctatcaaaaaanaaaaaaaagggaaaaa

SEQ ID NO: 7971 - DNA, 1351 bp, Festuca arundinacea
  misc_feature (442)..(442): n is a, c, g, or t
  misc_feature (760)..(760): n is a, c, g, or t
  misc_feature (780)..(780): n is a, c, g, or t
  misc_feature (847)..(847): n is a, c, g, or t
  misc_feature (1015)..(1015): n is a, c, g, or t
  misc_feature (1057)..(1057): n is a, c, g, or t
  misc_feature (1324)..(1324): n is a, c, g, or t
  misc_feature (1348)..(1348): n is a, c, g, or t
gcacgaggctcatctcctctcgtcccagctcgctctttccgtgaagccttgattgatccatctcgtgattcatccgtccatggcgatgtggagggccgccgccaggcacctcgtcgaccgggcactcggatccagggccgcgcacacgtcagcgggcagcaagaagatcgtgggtgtcttctacaaggccggcgagcacgccgacaagaaccccaacttcgtcggatgcgttgagggcgccctcggcatacgcaactggctcgaatccaagggacatcactacattgtcaccgacgacaaggaagggcccaacagcgaactggagaagcacatcgaagacatgcacgtcctgataaccaccccgttccacccagcctatgtttctgcagagaggatcaagaaggcaaagaaccttgagctgcttctcacggctggaattggntcagatcatattgatttgccggctgctgctgctgcgggcttgactgttgcagaagtcactggaagtaacaccgtctctgtggcagaagatgagctcatgcgcatcttgattctggtcaggaacttcttgcctggctatcaacaggtcgttcaaggtgaatgggatgttgcgggaattgcccatagagcttatgatcttgagggaaagactgttggaactgtcggggctggtcgtatcggcaggctcttacttcagcgtctgaagcccttcaactgcaatctgctctaccatgacagacttcagattaacccagagctngaaaaggaaattggggcganatttgaagaggacctcgatgctatgcttccaaagtgtgatgtcattgtgatcaacacacctcttacngagaaaacaagaggcatgttcaataaagaaaagattgcaaagatgaagaaaggtgtaatcgtcgtgaataatgctcgtggaggaatcatggacgcccaggcagtagctgatgcttgttccagcggtcacattgctggatatggaggcgatgtctggttcccccaaccngcaccgaaggatcacccatggcgctacatgcctaatcacgcnatgactcctcacatctctgggactaccattgatgcacagctgaggtacgccgcgggggtgaaggacatgttggacaggtacttcaagggcgaggacttcccggcagagaactacatcgtcaaggaaggcgagctcgccagccagtacaagtagggcaccaactgttggcgctgcatggtgatctacctggagcgaggtgccagagtagaaaccaaaccattctgttgttgtaccattgtgctctactctggctggtgttgccagggnagagaacgggaataatgttttttnttg

SEQ ID NO: 7972 - DNA, 1369 bp, Flaveria ramosissima
gacgttctcgcacgtcctctgctagtcgtcgtctatctctactcttcttattactaagtactactctaacagacgactcatgcgtcttacgggaaaagaaaggattgtaggtgtttcgtacaaggcacatgagtatgctcagatgaatccaatttcttggttgtgtagagaatgcattgggcattcgcaactggttagaatcacaaggccacgagtacattgtcaccgatgacaaagagggacctgattgcgaattagaaaagcatatccctgatgcacacgtcatcataaccaccccgttccaccctggttatatcactgctgaaaggataaaaaaagcaaagaatctgcaacttctgcttacagctgggatcggttctgatcatgttgacctcaatgctgctgctgctgctgggttaactgttgcagaggttacaggaagcaatgttgtctccgttgcagaagacgaacttatgagaatcctcattcttgttcgtaacttcttacctggataccatcaggttattactggagattggaatgttgcaggtattgcttacagagcttatgatcttgaagggaaaactgtcggaacagttggatgtggacgaattggtagacttttgcttcaaagattgaagccattcgggtgcaatcttctgtaccatgatcgtataaagatggaccccgatatggagaatcaaattggtgccagctttgaggaagatcttgataagatgcttcccaaatgtgacatagttgtcatcaacacacctttaacggataaaaccaaaggaatgtttgacaaagaacgcattgctaagatgaaaaaaggggttctcattgttaacaatgcccgaggagctataatggatacacaagctgttgctgatggctgttctagtggagacattgcaggctatagtggagacgtttggtttccacaaccagcgccaaaggaccatccatggaggtacatgccaaatcaggctatgaccccacacatttctggaactaccattgacgcgcagttgcgatatgctgctggagtaaaaggtatgttggagaattatttcaagggtgaagactttccggcccagcattacattgtgaaggagggtgaactggcaagccagtaccgttgatccgactactggaccgcctgcacgcatcggtagtcttgctgtttgaataagttatgttgagctggactttggttgtatcaccttgtaatggttaggtgtggttatgataaaactgaatggtaatggatttctatggtttttatgatgtggaccggctacaaatgtcgatcagtgttagaatgagtccgagtttaaaataacattaaccgggttgaattaggccg

SEQ ID NO: 7973 - DNA, 1018 bp, Gossypium hirsutum
attttagtattgagcagcctgttcaacaggttggctggcattagataaagctcctctgcaaatagttgaagcagctaacaggaaatattgagatagaaaagaatagggaaactatgtcacactttgttctagttcatggtatgtgtcatggagcttggtgttggtacaagattgtgtcgctgctcaaatcaggcggccaccgtgtcactcccttggatcttggtgcctgtggaatcaatcccaagaccatcactgacctggcttccttgtccgattatgcgcagccattgatggaattaatggcctctttgcctgaagacgagaaggtgatattagtgggtcatagttatggaggggttttcatttctttagccatggaaagcttccccaagaaagtattggccgctgtttatgtggcagctttgatgccgaatcatgattatcctattgcaaccggattaatggagctcttgaaacgtattatggcggagccgctcttggatttccaggtatggtttgatgatggatcagaaagtccaccaactcgcgccttatttggaccaaaatacacggagacaaaggtttaccacctctcaccaaaagcggatatagaattgggtttgacgttgatgagacaaggaaaattattcctcaaagatttagcaaacgaatcgctgctaagcaaagagaaattcggatccatccatcgggtttatatagtttgcaaagatgatttgttggtggaagaaagtatgcagaaatggtacattgaaaacagcccaacagaggatgtgaaattcatagctggtgcggatcatatgcccatgttctccaagcctcatgagctctgcaaatgcctccaagaagttgctcaccaatataattgataattaaagaatttatcttgataatttactccgtgtgttagcttaatagttagtgtgttcaccatccaaacatgatctgaattatgtaatcactgaaaataataattttgaagtttaattcaataaaaata

SEQ ID NO: 7974 - DNA, 1826 bp, Gossypium hirsutum
ggcgcaaacaatgcaaccatccatcgctatatcatttttaacaggtaattacgattaaattgtttaatgcccatcgcgtaacaacatgagcatcgagccctttaacagattggtgaagcttgcagctcgagcattttatgataatgtgacgacaaaagcagaaaatcaacctaagatgggtcgtggtgataataaagggattgctgttgtagtacttgatgctcttacaaggagacaatgggttagggaagaagatttggcaaaggagttgaaactacattcaaagcaacttcggcggactctacggctatttgaggaagaaaaattaatcacccgcgaatataggaaagagacggctaaaggggcaaaactatataatgctgcagttgctgcaacggttgatggtcaaccaagtgggaaagagggagaggagaaggttaaattacatactcactcttactgttgtctggattatgcacagatatatgatgttgttaggtgtagattgcatcgtatgaagaaaaaactaaaggatgaactcgaggacaaaaataccgttcaggagtatgtatgcccgggctgttcaaaacgatacaatgctttagatgcattgcgattgatttccttggaggatgaatcttttcactgcgaaagatgtaacggagaattagtggctgagagtgacaagttagcagcagaagaagtaggagagggagatgacaatgcgagacgacggcgacgtgaaaatttgaaggacatgcttcagaaaatggaggtacaacttaaaccattaatggaacaactcaacagagtaaaagatatgcctattccagaatttggaaccctcctatcatgggaaactcgagtaggtgctgctggtcatgctctaaacggtgctggttctaatgatccttataaaaattctcagggttatggtggaacaccgatgccatttcttggggatacaaaggttgaagttgctttttctggtcttgatagcaaggaagatgtcaaaaccgagagtgcaagcacatcattgaaagttttgccaccttggatgataaagcaaggaatgaacctaacaaaggaacaacggggagaggtcaagcaagagtcgaaggcagaagacagttcatcacaaccggatttttcagacgacaaaaagtcaaccattggaaatgatgataagaagaatgtacaggaagatgataagaagaatatacaggatgagtatcttaaagcatattatgctgctttatataagaaacaacaagaactagaagaagcggaaaagaaaaaacaacaaccggcagatacgtctttagaaactgatctttcggattctaccaagcgtcaagttggcatgaaagttaaacgtgaagacaatgatgaggaagatgatgatattaattgggaagtagatcccttttcaatttcaggcaatacgaccaataattacaaagtcgatgatttgaatgttgaagcggaggcatctgcaggtgatgacgaggatgatatagattgggaagaaggctgctccatggcattagcaagagtaacgtgtggtgtaaatgccggtctctactattcatatcttcatttgttctttcaagatctgcctccctgcaactgttttgttggtattaattttatctaccatcacctgattttgtgcaaacagttgcagtgggaagcagaaatttattttcgtggtcttaaaaacggattttcacgaactcggattgttcaaaactgtaaataaaagtagtttgtgtagcaaagatattttggtcatataatttttttcatgtcttgtttcagttacg

SEQ ID NO: 7975 - DNA, 2014 bp, Manihot esculenta
ggactattcacacgccatagctgcttctagaaaaagccgtttccctgcctcttagtctcgccggtgaccctccgccactacacatctaccagcatcgaaagctaatcagtgctgcgaaggccatactcacctctctctctttctctctctctctcactacttcttcctttgagaaacacaaatcttttcaaccagtaaaagctggcatatctacaccaacaatatgagcgtggagccgttcaatcggttggtgaagcttgctgctcgagctttttatgatgatataaccacgaaaggagataatcaacctaaaacgggaaggagcgataacagaggaattgctgtggtggtgcttgacgctctcactagacgacaatgggttagggaagaagatttggcaaaggatttgaaattgcactcaaagcaacttcgtcgaaccctgcggttttttgaggaagaaaaactaattactcgagatcataggaaagagacggctaagggagcaaagatatatagtgctgctgtagctgccactgctgaaggtcaacggaatgcaaaagagggggaggaaaagataaagctacacactcactcttactgttgtctggattatgcacagatatatgatgttgttaggtacagattgcaccgcttgaggaaaaagctaaaggatgaattggaaaacaagaatactgttcaagagtatatatgccctaactgtgggagaaggtacaatgccttggatgcgctgcggttggtttctccagatgatgagtacttccactgtgagaattgcaatggcgaacttgtggcagagagtgacaagttagctgctcaagaaggaggagatggagatgataatgcaaggaggcgacggcgtgaaaaattaaaggacatgcttcaaaaaatggaggtacaacttaaaccattaatggatcaacttaatagagtgaaagatttggctgttcctgaatttggaagccttcaagcatgggaagctcgagcaagtgttgctgggcgcgcagtaaatggtgattcgagttccaatgatccttccaaatcttcccaagggctaggatatggtagaacgccaatgacatttattggggagacaaaggttgaagttgccttttctggcattgaaggcaaggaagaggatgtcaaatctcaaactggaagttcgggcctgaaagttttgccgccatggatgatcaagcagggaatgaatcttacgaaagagcaacgtggagaggtcaaacaggagtctaagatggatggcatttcagcagcagaattctcacatgagaagaagtccactagtgatgatgttgataataaaagcttacaggatgagtacgttaaagcctattatgctgctttgcttaagaagcaacaagaactagaagaagctgctaagaaccaagagctgttgcaagtatccaactcaaatgctgtccctgaatctgtttctaatcgtcaggtgggcatgaaatccaaacgcgaggaggacgaaggggaagatgatgttgaatgggaagaggccccaactggaggcaattcgggtgaaagttacaaggtcaatgacttgaatgttgaagcagaagcttcaggagaggaggaggacgatatagattgggaagaaggttgagtgtcaaattaactaactagggcagtgcataggaacaagatcttcaaattcaatatgaaagataacacaacagttgatctagatgtgtcgctatgtagacattcacttctataagtttttgtccattaagaactactgttgataatgccttgtgtgttgtaagtcactctctctcttcccttgttagcactttttgcatttctttttttatacacattggtgtggtgaaactctcataattgctccataattaagctaactttttttgaaattttggctatggatctactgtgttcatgagttgtgtaatgtttcttctggccaaatgggttttttatttgaaatcaaagaatgttgtgttttatt

SEQ ID NO: 7976 - DNA, 3750 bp, Theobroma cacao
atcgtaaaacaaaggcttatgtaatacggtaaaaattttcattttttgtctataagattcactcttcgcctggacttgatgagtgtaacatggaaacattatccttgcccaacagacacaccaaattaaccatccgtccattaaattgcctggtgtttattggagcactacctcctttcacctttcttactgatttttaatctaacgccagcatgcttaatccgttacctaaccctttaaatcaactaccaaatccgtgtatgtttttcccacatgaaagttatagtagtatttaaaatggtgttgaatgcggttttcttcaacagttagggatccctccttacagagcttttatagcttttgcggccatggaataaagaaagaggtaagcagttctctttgatcggagcgttagccacgaaagattcagagttttatttgcttttcttgttgagtaaggcaaattgcacatatttttccacaaacataaatgattggaattctattatgattcacaaattaaaagttgaaattttagaagacatgattaagaaattccttggagaggttgaatgacttttttttcttttataatatatcattacctatctaccaaaacaaataaattatataatgaattattaaatacagtatagagaaggcttttttggttatttatagtcatgcttgatggcaaacttattaagacatgtaattttctctaattttttggtccataaacaaaaaaaaaaatgaaaaagaaattattgcaaaagacaaaaaaagaaatgaaagagcagttcgaaggaaaatgatcaaaacagaagtagagaaaagaacagcccaatcaaagctaaaactcgtgagaacctcttagttatcgttatccctaaccacacacgaagaaaaacaccgacccaaagccatatatccggtagaaataaagaagaagagaaaacagagagaagcagagtgagaactgagaaccagtaaaagaagaaaaatggcagctgagacagcgctaaggataacgggttcgagttctacagtttgtaatctaaatggttctcaaaggagaccaactcctctatcttctccaactcgttttctgggtctgcctcctcgagcttcttcttcctcagtttcctcttctctctctcatttcttgggaagtgtccgaattggctcaagacttcctatttcacgtcaccaacagggcaagagaaggaacttctctgtcttcgctatggccgctgaagagacaaagcgtgcagtaccattgaaagattatcgtaatattggaattatggctcacatagatgcaggaaagacaacaacaactgagcgtattctatactacacaggaagaaactataaaattggtgaggttcatgagggtactgctacaatggactggatggagcaagagcaggaaagaggtattacaataacgtcagctgctacaacgacattttggaaaaaccaccgaattaatattattgatacccctggccatgttgacttcacacttgaagttgagcgagctctcagggttttagatggagctatatgcttgtttgacagtgttgctggtgttgaaccacaatctgaaactgtgtggaggcaagctgataagtatggagtacccagaatttgctttgtcaataagatggatcgtctaggagcaaactttttccggacaagagacatgatagtgacaaatttgggtgctaaaccgcttgtgattcaactgccagttggtgcagaagacaattttcaaggagtggttgaccttgtaaagatgcaagctgtgctttggtcaggggaagaattgggtgcaaagtttgtttatgatgatattccagctaatcttcaggagttggctgaagagtaccggtcacagatgatagaaactttagttgaattagatgatcaagctatggagaactatcttgaaggtgttgaacctgatgaggaaaccattaagaaattaattaggaaaggcaccattggaagcagttttgttccagtattatgtggctcagctttcaaaaacaagggggttcagccattacttgatgctgtcatggattacttgccttcacctcttgacttgccagcaatgaagggaactgatcctgagaaccctgaagtgacaattgaaaggaaagcaagtgatgatgtaccattttctggactagctttcaagatcatgactgatccatttgtggggtcccttacgtttgtcagggtgtatgctgggaagctttctgcaggatcttatgcgttgaatgcaaacaaaggaaagaaagagagaattggtagacttttggaaatgcatgccaacagtagagaggatgttaaggtcgctatggctggtgatattgttgctcttgcaggtctaaaagataccattacaggtgaaactctttgcgatcctgaccatcccattgtccttgaacggatggacttccctgatcctgttattaaggttgctattgaacccaagactaaagctgacgttgataaaatggctactggtttgatcaagcttgcccaagaagacccttctttccacttctcacgggatgaagagataaaccagactgtaattgaaggaatgggagaactgcatctagagattattgttgatcgtctgaagagagagttcaaggtagaagctaatgttggtgcaccccaagtaaattaccgtgaaagcatttctaaagtttcagaagtaaagtatgtgcataagaaacagtcaggtggacaagggcagtttgctgatattactgtacgttttgagcccatggaggcgggtagtggatatgagttcaagagtgaaatcaagggaggagcagtgccaaaagaatatattcctggagtcatgaagggactggaggagtgtatgaataatggtgtacttgccggctttcctgttgttgatgtacgtgccgtgctagtagatggttcttaccacgatgttgattcaagtgtcttggcatttcagctggcagccagaggagccttcagagaggggattaggaaggctggcccaaggatgcttgaacctataatgaaagttgaggttgtcacacctgaagaacacttgggtgatgtgattggtgatctcaactcaaggagaggccagattaacagctttggtgataagcccggtgggctcaaggtggttgacgcccttgttccgcttgcggagatgttccagtatgttagcactctccggggaatgacaaaaggtcgtgcatcctacaccatgcaattagccaagtttgacgttgtccctcaacacatccagaacgagcttgcctcaaaagggcaagaagttgccgcttgatttggttttcctggggtcccaacaaccaggaacacaatatttttgttcactccataatttaaaaagcgcaacattacccttcttttcccattttttttttataaattctaatattcatgtcttagtttgagatataaacttgcaacagcattctgaagcacaagcactctgctctgggctcttctcttcgaaattgtgaatgctctataaatcagaatttgcaaaggaaggaattatctggttctgttccatgaacttaaaagttctaattagtctattcagtgtaaagttttgcgaaaatttgaggtaggttgtcgcttttatcaaggatgtagagttaagcagggacaaaatcattggagaaaaaaaatacataaaaaatgcccaaaggcgtc

SEQ ID NO: 7977 - DNA, 2594 bp, Ricinus communis
gaagaagggaagtgttttgggttatcccttaataacatccatccacaaaaaaactcgagacttttgagtgaggggaagagagacttggactaacacttagcagatacaaaaatggcagcagaaacagtgagattaactggttctgcttcttcttcactcagcagcgtaaatgggtctccaagaaggagaaccagttctctctccactccaattcggtttctgggtctccctcctcgagcttcttcaatttccgcttcttctatctcttcttctctttcccatttcatgggaagcgtgcgtattggattacagtctactactaaagccatttcacgtcaacagcagaggaggagaaatttctccgtttttgccatggctgctgacgaggcaaagcgtgcgataccattgaaagattaccgcaacataggaattatggctcacatagatgcaggaaaaactactacaactgaacgggttctgtactataccggaagaaactataaaataggggaagtgcacgaaggaacagctacaatggactggatggagcaagaacaagaaagagggatcaccattacttctgctgcaaccaccacattttggaataaccaccgcattaacattattgatacccctggccatgtcgacttcacacttgaagttgaacgagcactgagggttttggatggtgcaatttgcctgtttgacagtgttgctggtgtggaaccacagtctgaaactgtgtggaggcaagctgataaatatggagtgcctagaatttgctttgtcaataagatggaccgccttggagcaaacttttttcggacaagagacatgataattacaaacttgggtgctaagccgcttgttattcaaattccagttggtgcagaagataattttcaaggagttgttgatcttgtaaagatgaaagctatactttggtcaggagaagaattaggtgcaaaatttgcatatgacaatattccagcagatcttcaagacttggctgaagaataccgtgcgcagttgatagagactatagttgagttggatgatgatgctatggagaaatatctagaaggagttgaacctgatgaggaaactattaaaaaactaattaggaagggcacaattggaagcagttttgtacctgtcttatgtggctctgcgtttaaaaataagggtgttcagccattgcttgatgctgttgttgattatttgccttcacctcttgatttgccagcgatgaaggggactgatcctgagaacccagaagtgacaattgaaaggaccgcaagtgatgatgaaccatttgctggactagctttcaagatcatgagcgatccattcgtcggatccctgacatttgtgagagtttatggggggaagctaactgcaggatcttatgtactaaatgcaaacaaaggaaagaaggagagaattggaagacttctagaaatgcatgccaacagtagggaggatgttaaggtagctttggctggtgatattgttgcccttgcaggtctaaaagataccataactggtgaaacactatgtgatcctgataatccaattgtgcttgaacgtatggacttccccgatcctgttattaaggttgcaatcgaacccaagactaaagctgacgttgacaagatggcaaacggtttgatcaaacttgctcaggaggatccttctttccacttctcacgagatgaagaaatcaatcaaactgtaattgaaggaatgggggaactgcatctggagattattgtagatcgcctcaagagagaatttaaggtggaagctaatgtcggtgctccccaagtaaactaccgtgaaagcatttcaaaagtgtcagaagtgaagtacgtacataaaaaacaatctggtggacaaggacagtttgctgatataacaatgcgattcgagcccatggagcctggtagtggatatgagttcaaaagtgaaatcaagggaggcgcagtgcccagagaatacattcctggggtcatgaaaggactagaagagtgcatgaataatggagtgctggcaggctttccggttgtggatgtacgtgccgttttggtagatggttcttaccatgatgttgattcaagtgtcttggcatttcaactggcagctaggggagcttttcgggatggcatgaagagagctggcccaaagatgctagaaccgatcatgaaagtcgaagttgtcacaccagaagagcatttgggagatgtgattggtgatctcaactcaaggagaggtcagattaacagctttggtgacaaacctggaggcctgaaggtggttgatgctcttgtaccattggcagagatgttccaatatgttagtactcttaggggaatgacaaaaggtcgtgcatcctacaccatgcacttagccaagtttgacgttgttcctcaacacattcaaaaccagcttgctgcaaaggagcaagaggttgctgcttgattcctcccagagcggggacattattttttgtccaattgttactaataatagttcaataaaccagttttatttttatgtcttatccatttatatataattgcaaacgagattga

SEQ ID NO: 7978 - DNA, 3392 bp, Ricinus communis
tatgattaattactatagcaatgtagtagtctatcattgtttatttcatttgtcatttgatttcttgaaataaaatcagacgaaagagagtaagacttaattttgctaaaatgggctaatgtatgtaaatgatatcatataacacttaaaaaaaagttaaaatcaaattggggaataggcaatatggtcatttctgttaaaataaagggcaaacaatagaaaattccaattttctcttaaaacccttcaccgaaaataggcataaattggaggatgtgagaaaataggcggagccgaagaagggaagtgttttgggttatcccttaataacatccatccacaaaaaaactcgagacttttgagtgaggggaagagagacttggactaacacttagcagatacaaaaatggcagcagaaacagtgagattaactggttctgcttcttcttcactcagcagcgtaaatgggtctccaagaaggagaaccagttctctctccactccaattcggtttctgggtctccctcctcgagcttcttcaatttccgcttcttctatctcttcttctctttcccatttcatgggaagcgtgcgtattggattacagtctactactaaagccatttcacgtcaacagcagaggaggagaaatttctccgtttttgccatggctgctgacgaggcaaagcgtgcgataccattgaaagattaccgcaacataggaattatggctcacatagatgcaggaaaaactactacaactgaacgggttctgtactataccggaagaaactataaaataggggaagtgcacgaaggaacagctacaatggactggatggagcaagaacaagaaagagggatcaccattacttctgctgcaaccaccacattttggaataaccaccgcattaacattattgatacccctggccatgtcgacttcacacttgaagttgaacgagcactgagggttttggatggtgcaatttgcctgtttgacagtgttgctggtgtggaaccacagtctgaaactgtgtggaggcaagctgataaatatggagtgcctagaatttgctttgtcaataagatggaccgccttggagcaaacttttttcggacaagagacatgataattacaaacttgggtgctaagccgcttgttattcaaattccagttggtgcagaagataattttcaaggagttgttgatcttgtaaagatgaaagctatactttggtcaggagaagaattaggtgcaaaatttgcatatgacaatattccagcagatcttcaagacttggctgaagaataccgtgcgcagttgatagagactatagttgagttggatgatgatgctatggagaaatatctagaaggagttgaacctgatgaggaaactattaaaaaactaattaggaagggcacaattggaagcagttttgtacctgtcttatgtggctctgcgtttaaaaataagggtgttcagccattgcttgatgctgttgttgattatttgccttcacctcttgatttgccagcgatgaaggggactgatcctgagaacccagaagtgacaattgaaaggaccgcaagtgatgatgaaccatttgctggactagctttcaagatcatgagcgatccattcgtcggatccctgacatttgtgagagtttatggggggaagctaactgcaggatcttatgtactaaatgcaaacaaaggaaagaaggagagaattggaagacttctagaaatgcatgccaacagtagggaggatgttaaggtagctttggctggtgatattgttgcccttgcaggtctaaaagataccataactggtgaaacactatgtgatcctgataatccaattgtgcttgaacgtatggacttccccgatcctgttattaaggttgcaatcgaacccaagactaaagctgacgttgacaagatggcaaacggtttgatcaaacttgctcaggaggatccttctttccacttctcacgagatgaagaaatcaatcaaactgtaattgaaggaatgggggaactgcatctggagattattgtagatcgcctcaagagagaatttaaggtggaagctaatgtcggtgctccccaagtaaactaccgtgaaagcatttcaaaagtgtcagaagtgaagtacgtacataaaaaacaatctggtggacaaggacagtttgctgatataacaatgcgattcgagcccatggagcctggtagtggatatgagttcaaaagtgaaatcaagggaggcgcagtgcccagagaatacattcctggggtcatgaaaggactagaagagtgcatgaataatggagtgctggcaggctttccggttgtggatgtacgtgccgttttggtagatggttcttaccatgatgttgattcaagtgtcttggcatttcaactggcagctaggggagcttttcgggatggcatgaagagagctggcccaaagatgctagaaccgatcatgaaagtcgaagttgtcacaccagaagagcatttgggagatgtgattggtgatctcaactcaaggagaggtcagattaacagctttggtgacaaacctggaggcctgaaggtggttgatgctcttgtaccattggcagagatgttccaatatgttagtactcttaggggaatgacaaaaggtcgtgcatcctacaccatgcacttagccaagtttgacgttgttcctcaacacattcaaaaccagcttgctgcaaaggagcaagaggttgctgcttgattcctcccagagcggggacattattttttgtccaattgttactaataatagttcaataaaccagttttatttttatgtcttatccatttatatataattgcaaacgagattgatgaagaatacatcttgataacagtttacacgttaagaagattgttaaatctggaaaactcactctaaaaataagaagaaagtgttcttaataatgtaggccgattaccccaatatgatacgaatgagataatgaaaatgaacatcgacatgtctggagtaaatgtagaaaaacaaaacataacaaaaatctttccaacttaattttgttttcagcaaccgatccacactggagattacaattcagtaaggagaaaagagggctacatgcatgtccatggaattggttctgtctccaagtctacctgatctggactattccggcattgacaagtttctgaatcttattcatcaccatggggttcttcatgtggtcctgtgctgacttgggattctcttggaagtctaccaacacctgcaacatttaagccaaaataacattacctcgcagatacaaaactttgggatcaagaatttcaagcgtgtcaataaatggaaccgagag

SEQ ID NO: 7979 - DNA, 2527 bp, Tripterygium wilfordii
agagagaaccgggagacaaagaaaatggctgctgagactttcaaagtaactggttcgggttctacagtttgcagcttcaatggttctcagaggaggcctatccctctctgccctaaatttcgttttctgggtctttctcctagagtctctactcgttcttcaatttgctcttctcgttcacatttctttggcagcaagggaattggttcgaagcttcccgttttacgccaacggagccggggaaaattttctgtgtttgccatggctactgaagagtcaaagcgtgcagtgccattacaagattatcgaaatattgggattatggctcacattgatgctggaaagaccactactactgaacgagttctttattacactgggagaaactataaaataggagaggtacatgagggaacagccacaatggattggatggagcaagaacaagaaagagggattaccatcacttctgctgctactaccacattctggaacaaacaccggattaatattattgatacccctggccatgtcgacttcacactagaagtggagcgtgcacttagggtattggacggcgctatatgtttgtttgacagcgttgctggcgtggagccacaatctgaaactgtatggaggcaagcagataaatatggggtacctagaatttgctttgtgaataagatggatcggcttggtgcaaacttttttagaacaagagacatgatagtaaccaacctaggagctaaaccacttgtaattcaattgcccattggttctgaagatagatttcaaggagttgttgatctcgtcaagatgaaagctgtaatttggtcaggagaagaattgggtgccaaattttcctatgaggacattccagctgatcttcaagagttggctgaggattaccgtgcacagatgatagaaaccatagttgaacaagacgatggggctatggagagctacttagaaggtgtcgagcctgatgagcaaaccattaagaagttaattaggaagggagccattggaagcagttttgtgccggttttatgtggctccgcctttaaaaataagggagtccagccgctgcttgatgctgttgttgattatttgccttcaccacttgacgtccccgcaatgaaggggactgatcctgaaaacccagaagtgacagttgagaggagtgcagatgatgacgaacctttcgctggactagcttttaagattatgaatgatccatttgtgggatctcttacgtttgtgagagtgtatgctgggaagctaagtgcaggatcctatgcattgaatgcaaacaaaggaaagaaagagagaattggtagacttcttgaaatgcatgccaacagcagagaggatgtcaaggtcgctttagctggcgatatcgttgctcttgcaggtttaaaagatacaataacaggggaaacattgtgtgatccagaacatcctattgtgcttgagcggatggacttccctgatcctgtaattaaggttgcgattgaacccaagactaaagctgatattgataagatggcaactggtctgataaagcttgctcaagaagacccttcgttccacttctctagagatgaagaagttaaccagactgtaattgaaggaatgggagaactccatctggagattattgttgatcgtctcaagagggagtttaaggtcgaagctaacgtcggtgcaccccaagtaaattatcgtgagagcatttctagagtcacagaagttaagtatgtgcacaaaaaacagtcgggtggacaagggcagtttgctgacataacagtacgatttgagcccatggagtctggtggtggatacgagtttaaaagtgaaatcaagggaggtgcagtaccaaaagaatatattccaggggtaatgaaaggattggaggagtgtatgagtaatggtgttctagcaggatttcctgttgtagatgtgcgtgctgtattagttgatggttcttaccatgatgtagattcaagtgtcttagcatttcaactggctgctagaggtgctttccgggaggggatcagaaaagctgggccaaagatgctagaacctattatgaaagtcgaagttgttactccagaggagcacttgggagatgttattggcgacctaaactcaaggagaggccagattaacagctttggtgacaaacctggtggtcttaaggtggtggatgctcttgtcccactagcagagatgtttcagtatgtaagtacgctccgcggaatgacaaaaggccgtgcatcgtacacaatgcaattagccaagtttgatgttgtccctcaacacatccagaaccagctcgcttcaaaagagcaagaagttgctgcttgattttattcacttgatttcaatggatacttttgtgatatatatattttgagagaagcaaattttgtttcccttgtatgccagttacagacatgaattgacatgaaatagaaggaattgtggaaaggcatcatggtatttatgcatgtcaggtagataa

SEQ ID NO: 7980 - DNA, 2482 bp, Manihot esculenta
atggcggcagagactgtgagattaacgggttcgagtttgtattcgctatgcagcttcaacgggtctccaaggggagctaactcttcctctagaccaattcggtttctgggtctccctcctcgagcttctttctctccttcttcaatctcttcctcgctttctcattttttgggaagcatgcgttttggctcacagtcttccaaggtttacacttcacgtcaacaacagcagaggagaaacttctctgtctttgccatggccgctgacgagacaaagcgtgcagtaccattgaaagattaccgtaacattggaattatggctcacatagatgcagggaagactactacaactgagcggattctgtattatacaggaagaaactataaaataggggaagtacatgaaggaacagctacaatggactggatggagcaagaacaagaaagaggaatcaccattacttctgctgcaactaccacattttggaacaaacaccggattaacattattgatactcctgggcatgtcgacttcacacttgaagtagaacgagcactcagggtgttggatggtgccatatgcctatttgacagtgtagctggtgtggaaccacagtctgaaactgtgtggaggcaagctgataaatacggagtaccaagaatttgctttgtcaataagatggaccgccttggagcaaacttctttcgaacaagagacatgatagtaacaaacttgggtgctaaacctcttgttattcaacttccagttggttcagaagataattttcaaggggtgattgatattgtaaagatgaaagctatactttggtcaggagaagaattgggtgcaaagtttgaatatgcggatattcctgcagaacttgaagagttggctcaagaataccgggcactgttgatagagaatatagttgagttggatgatgatgttatggagaaatatctagaaggagttgaacctgatgaggaaaccataaaacaactaattaggaagggcacaattgctagcagttttgtgccggtcttatgtggatctgcttttaagaataagggggttcagccgttgcttgatgctgttgttgattatttgccttctccacttgatttgccatcaatgaagggtactgatccagagaaaccagaagtgacggttgaaaggaccgcaagtgatgatgaaccattttctggactggctttcaaaatcatgagtgatccatttgtgggatccctcacatttgtgagagtttatgcagggaagctagctgcaggatcttatgtattgaatgcaaacaaaggaaagaaggagagaattggaagacttctagaaatgcatgccaacagtagggaggatgtaaaggtagctttaacaggtgatattgttgccctagcaggtctaaaagatacaataactggtgaaacactctgcgatcctgatagccctattgtgcttgaacgtatggacttccctgaccctgtgatcaaggttgcaattgaacccaagactaaagccgatgtcgataagatggcaaacggtttgatcaaacttgctcaggaggacccttctttccacttctcacgagatgaagaaatcaatcagactgttattgaaggaatgggggaattgcatctcgagattattgtagaccgcctgaaaagagaattcaaggtggaagctaatgttggtgcaccccaagttaactaccgagaaagcatttccaaagtttcagaagtgaagtatgtgcataaaaaacagtcaggtggacaaggacagtttgctgatgtaactatacgatttgaacctatggaggcaggtagtggatacgagttcaaaagtgaaatcaagggaggtgcagtgccaagagaatatattcctggggtgatgaaaggactggaggagtgcatgaataatggagttcttgcaggctttcctgtcgttgatgtacgtgctgtactggttgatggttcttaccacgatgtggattcgagtgtcttggcatttcaactagcagctagaggagctttccgtgatggcatcaagaaagctgccccaaagatgctagaacctgtaatgaaagtcgaagtggtcacacctgaagaacatttgggagatgttattggtgatctcaactccaggagaggtcagattaacagctttggtgacaaacctggcggcctcaaggtggttgattcgctggttccactggcagagatgttccaatatgttagtactctcaggggaatgacaaaaggtcgtgcatcctacaccatgcaattagccaaatttgatgttgtccctcagcacattcaaaaccagcttgctacaaaggagcaagaagttgctgcttgattcctgggagtagcattagctttttgccagatagatagtttgatactgatgattcaatgaaccagttttgttttcacttgtacccacttcatatataattgcaaaagaatttgtccct

SEQ ID NO: 7981 - DNA, 2622 bp, Glycine max
acaacgcaaaagctgctgcctagtccttaccgaaaactagaggccagggtctgtagtgtgcgggtgggtttgtttatctcaaacacagaacagaggtgtagagaagaaagctctcaaaagtatggcggcggagtcatcactgagggtggcgactcccactatttgcaacctcaatggttctcagagaagaccaaccactctctctccgcttcgcttcatgggttttagccctcgaccctctcactctctcacttcctcttccctttcacacttcttcgggagcacaagaattaactccaattcttcctccatttcacgccaacatgctccaagaagaaacttttccgttttcgccatgtccggcgatgatgcaaagcggagtgttccattgaaggattaccgcaacatcggcatcatggctcacatagatgctggaaagactactacaacggaacgcattttgtactatactggaaggaactacaaaattggagaggtgcatgagggaacagcaactatggactggatggaacaagaacaagagagggggattaccattacttctgctgcaaccactacattctggaacaagcaccggatcaacattattgatactcctggtcacgttgacttcaccttagaagtggagcgtgctcttagggtgttggatggagctatatgcttgtttgacagtgttgctggtgtggagccacaatcagaaactgtgtggaggcaggctgataaatacggtgtcccgcgaatttgttttgtcaataaaatggaccgtcttggagcaaacttttatcgaacaagagacatgatagtaacgaatttgggtgctaaaccacttgtaattcagttaccaattggttcagaggataactttaagggagttatagaccttgttaggaataaggctatagtttggtctggagaagagctgggtgccaagtttgatattgtagatgttccagaagatcttcaagagcaggctcaggaataccgagcccagatgatagaaaccatagttgagttcgatgaccaggctatggagaactacctggaaggaattgaaccggatgaagaaactataaaaaaattaataaggaagggaaccatatcagccagttttgtgccagtgatgtgtggctcagctttcaaaaacaagggagtccaaccattgctcgatgcggtagtggattatctaccatcaccacttgacttgccagcaatgaagggcagtgaccctgaaaacccagaagaaacaatagagagggtagcaagtgatgatgaaccatttgctggactggcttttaagatcatgagtgatccatttgtaggctcccttacgtttgtcagggtgtatgctgggaagctaagtgctgggtcttacgtactcaatgcaaacaaagggaaaaaggagagaattggtagacttttagaaatgcatgcaaacagcagagaggatgttaaagtagctttagctggtgatattattgcacttgcaggtttgaaagatactattacaggtgaaacattgtgtgaccctgataatccaattgtgcttgagcggatggacttcccagatcctgttattaaggttgctattgaaccaaaaactaaagctgatgttgacaagatggcaactggtttaatcaagcttgcacaggaagacccttctttccacttctcccgtgatgaagagataaaccagacagtgattgaaggaatgggagaattacatcttgaaatcattgttgatcggcttaaaagagaatttaaggtggaagctaatgttggtgccccccaagtaaactacagggaaagcatttccaaaactgcagaagtgaagtatgtgcacaagaaacaatcaggtggacaaggtcagtttgcagatatcaccgtccggtttgaacccatggacccaggtagtggatatgagttcaagagtgaaatcaaaggaggtgctgtaccaaaggaatacattcctggtgtgatgaaaggattggaagagtgtatgagcaatggtgtgcttgctggctttccggtcgttgatgtacgagcagtactcacagatggttcttaccacgatgtagattcaagtgtgttggctttccagttggcagcaagaggagcttttagggaaggaataagaaaagctggaccaaggatgcttgagcctataatgaaggttgaagttgttactcctgaagaacatctaggtgatgtaattggtgatctcaactcaagaagaggacagatcaacagttttggtgacaaacctggtggccttaaggtggttgatgccctggtacctcttgctgagatgttccagtatgtcagcacactcagagggatgacaaagggccgtgcatcctacacaatgcaattagccatgtttgatgtggtgcctcagcacattcagaaccaacttgccacaaaagagcaagaagttgccgcttaatgtatttgcttggtctcctaacaaggaacttcttattgcatagttgtattatgtccattgtcatatagttgggtttgtttttggtattttttttattgtaattttccctttaccgatacaaggttagccaacaaaagaattttcagaagaaaaatagg

SEQ ID NO: 7982 - DNA, 2640 bp, Cleome spinosa
aagagtgacgaagtgacaggaggaggaggaagaaggaaaggagagaccttgacggaaactccaccttaaaaatggcggctgatgctctgagaattacgcgtttgagttctggttcggtggtttgtgatcttaatgggtcgcagagacgacccgtccttcttcctctgtctcatcgtgctcgatttctgggtcttcctcctcgagcctcttcttcttcgatttcctctttgtcctctgagcttttgggaagctttcgttttgggttgggttcggcgaacgtgtcccgccatggacagaactccaggaggaggcagttctctgttttcgccatggctgatgaggtgaagcgaactgttccactcaatgattaccgtaacatcgggattatggctcacattgacgccggaaaaacgactacaaccgagagaattctgtactacacgggaagaaactacaagatcggggaagtgcacgagggaacagccaccatggattggatggaacaagagcaagaaagaggaatcaccataacctcagctgcaaccacaacttactgggacaaacaccgcattaacatcatcgatacacctggacacgtggatttcactctcgaagtagagcgtgctcttagggttcttgacggtgccatatgcttgttcgacagtgttgctggtgttgagcctcaatccgagactgtgtggaggcaagctgataaatatggagttcccagaatttgctttgtcaataagatggaccgacttggggcaaactttttcaggacaagggatatgatagtgaccaatttgggtgcaaagcccctggtccttcaattaccgattggttccgaggatagtttcaagggtgttgtcgatctcgtgaagatgaaagctattgtctggtcaggggaagagttgggtgctaagtttgcttacgaggatattccagaagatcttcaagacttgtctcaggaatatcggagtcagatgatagaaacgatagttgagttggatgatgaagccatggagaactatttagaaggggtcgagcccgatgaggagactgttaagaaactggttagaaagggaaccatctcggccaagtttgttcccgtactgtgtggttcagcttttaagaataaaggagtgcagccattacttgatgccgtggtagactatttgccatcaccaatcgacttgccagcgatgaagggatcagatcccgagaacccagaagctacagttgaacggaaagcggatgatgatgagccattctccgggctagcattcaagatcatgagtgatcctttcgtgggttctcttacgtttgtgagaatctactcggggaaacttgcagccgggtcttatgtgctgaatgcgaacaaggggaagaaagagagaatcggaagactcttggaaatgcacgcaaacagcagagaagatgttaaggtggctttgacgggtgacatcgtggctcttgccgggcttaaagatacaatcacgggcgaaaccctgagtgacccggatagtcccgtcgtgcttgaacggatggacttcccggatcctgttatcaaggtagccatcgaaccaaagacgaaagcggatatagataagatggccactggcttgatcaagctcgcacaagaagacccgtcttttcatttctcccgggacgaagagataaaccaaacagtaatcgaaggaatgggagaactgcatctcgagattattgtcgaccggctcaagagggagtttaaggtcgaggccaatgtgggtgcaccacaagtgaactaccgggagagtatctctaaagtagcagaagtgaaatatgtacacaagaaacaatcgggtggacaaggtcagtttgctgatatcacagtccggttcgagccgttggaagcaggaagtgggtatgaattcaagagcgagatcaaaggaggagccgtaccgaaagagtacattccgggtgtaatgaaggggctggaggagtgcatgagcaatggcgtgttggccggtttccctgtggtagatgtccgagcggttctggtggatggttcataccatgatgtggattcaagcgttcttgccttccaactcgctgcgagaggagctttccgagatggggtaaagaaagctggtccgagaatgttggaaccaatcatgaaggttgaagtggttacacccgaagaacacctcggagatgtcattggagatctcaactctcgaagaggtcaaatcaacagtttcggtgacaaacccggcggtctcaaggtggtggatgcattggtgccattggcagagatgttccaatacgtgagtactctgagagggatgaccaaaggacgtgcttcttacactatgcaactcgctaagttcgacgttgtccctcaacacattcagaaccagcttgcttccaaagaccaagaagttgctgcttagtcctcatttccctctttttgttttgtttgatcgttttttaatacagaattttcagtgaagctgtttgtcttcagataacattgcggggcattttgtgaggcatacagttttgtcttctccatattcaatactgtaaacgaaacatttcttggaatcaaaatttgtccaaagcaatgggggacgaatctgttgcttttgatgcctc

SEQ ID NO: 7983 - DNA, 2476 bp, Manihot esculenta
atggcggcagagactctgagattaacgggttctgcttcatattcactctgtaccttcaatgggtctacaaggggagctaactcttcttcaaccccaattcggtttctgggtctccctcctcgagcttcagtctctccttcaatctcttcgtcgctttctcattttatgggaggcatgcgttttggctcacagttgtcgaaggtttccatttcatgtagacagcaacagaggaggagaaacttctctgtctttgccttggccgctgaggaggcaaagcgtgcggtaccattgaaagattaccgcaacattggaattatggctcacatagatgcaggaaagactactacaactgaacggatactgtactacacaggaagaaactataaaataggtgaagtacatgaaggaacagctacaatggactggatggagcaagaacaagaaagaggaattaccattacttctgctgcaactaccacattctggaataaacaccggatcaacattattgatactcctggccatgttgatttcacacttgaagtggaacgagcgctcagggttttggatggtgctatctgcctatttgacagtgtagctggtgtggaaccacagtctgaaactgtgtggaggcaagctgataaatatggagtaccaagaatttgctttgtaaataagatggatcgccttggagcaaacttctttagaacgagagacatgataataacaaacttgggtgccaaacctcttgttcttcaaattccagttggttcagaagacaattttcaaggggttgttgatcttgtaaaaatgaaagctataatttggtcaggagaagaactaggtgcgaagtttgtatatgatgatattccagtggatcttgaagacttggctcaagaatatcgagcattgttgatagagaatatagttgagttggatgatgatgctatggagaaatatctagaaggagttgaacctgatgaggaaattataaaaaaattgattaggaagggcacaattgccagcagttttgtgccagttttatgtgggtctgcttttaaaaataagggtgttcagccattgcttgatgctgttgttgattatttaccttctcctcttgacttgccagctatgaaggggactgatcctgagaacccagaagtaacaattgaaaggactgcaagtgacgatgaaccattttctggactagctttcaagatcatgagtgatccatttgtaggatccctcacatttgtgcgagtttatgcagggaagctagctgcaggatcttatgtactgaatgcaaacaaaggaaagaaggagagaatcggaagactgctagaaatgcatgccaacagtagggaggatgttaagttagcgttaactggtgatattattgctctggcaggtctaaaagataccataactggtgaaacactctgtgatcctgataatcctattgtgcttgaacgtatggacttccctgatcccgtgatcaaggttgcaattgaacccaagaccaaggctgatgttgataagatggctactggcttgatcaaacttgctcaggaggacccttcttttcatttctcaagagatgaagaaatcaaccagactgttattgaaggaatgggggaactgcatcttgagattattgtggatcgcctaaaaagagaatttaaggtggaggctaatgttggcgcaccccaagtaaactaccgagaaagcatttccaaagtttcagaagtgaagtatgtgcataaaaaacagtctggtggacaaggacagtttgcagatataactgttcggtttgaacctatggagccaggtagtggatatgagttcaaaagtgaaatcaagggaggtgcagtgccgaaagaatatattcctggggtgatgaaaggaatggaagagtgcatgagtaatggagtgcttgcaggttaccctgttgtggatgtacgcgctgtgttggtagacggttcttaccacgacgtggattcaagtgttttggcatttcaactggcagctaggggagcattccgagaaggcatgaagagagccggcccaaagatgctagaacccataatgaaagttgaagtggtgacacctgaagaacatttgggagatgttattggtgatctcaactctaggagaggtcagattaacagctttggcgacaaacctggcggcctaaaggtggttgatgctcttgttccactggcagagatgtttcaatatgtgagtacgcttagaggaatgacgaaaggtcgagcatcgtatactatgcaattagctaagtttgatgttgtccctcaacacattcagaaccagcttgcttcaaaggagcaagaagttgctgcttgattccctggaggaggttttgaactttgtcagattgattcaaggaaccagttttgttgtcatgtataaatgcagacaaatttagtgaagaaacactgttataccattgaacatc

SEQ ID NO: 7984 - DNA, 2442 bp, Prunus persica
aaacagataagaaaaaatggctacagagtcagtgagagtgtacagtttcagcttcaatgggtctcagacaaggccagccattcctctctcgccagctcgctttctgggtcttcgtccccgaccctcttcttctctcacctcatcttcgctttcccacttctttgggaatgtgcggctcagcagttccaactcctcaaagctctctattttacgccaacagagccgaagaaacctctctgttgtcgctatggctgctgatgatggaaagcgtgcagtgccattagaagattatcgcaatataggaattatggctcacatagacgcggggaagactactacaactgaacggattttgttttatactggaagaaactataaaataggggaggtgcacgaaggaacagcaactatggactggatggagcaagaacaagaaagaggcattaccataacttctgctgcaaccacaacattttgggacaaacacaggattaacattattgatactcctggccatgttgacttcacccttgaagtggagcgagctctcagagtactggatggtgctatatgtttgtttgacagtgttgctggtgtggaacctcaatccgaaactgtgtggagacaagctgatagatatggggtgcccagaatttgctttgtcaataaaatggatcgtcttggagcaaactttttcagaacaagagacatgatagtgacaaacttgggtgccaaaccacttgtacttcaaattccagtaggtgcagaagataattttaagggagttattgatctcgtgaagatgagagctatactttggtctggagaagagttgggtgcgaaatttgtttacgaggatattccatctgatcttctggagctggctcaagaatataggtcacagatgatagaaaccattgttgaattagacgatgaagctatggagggctatctagaaggagttgaacctgatgaagaaaccattaagaaattaattaggaagggaaccatctcaattagttttgtgccagtgttatgtggctcagcttttaaaaataagggggtacaacctttgcttgatgctgtcgtggattatttgccttcacctcttgacgtgccaccaatgaaggggactgatgcagataacccagaaatcattattgagagggctgcaagtgatgatgaaccatttgctgggctagcattcaagatcatgagtgatccatttgtgggatcccttacatttgtgagaatctatgcaggaaagctagctgctggatcctatgtactgaatgcaaacaagggaaaaaaggagaggattggtagacttctagaaatgcacgcaaacagtagggaggatgttaaggtagctttagctggtgatattgttgcgcttgcaggcctaaaagataccattacaggtgaaacattgagtgaccctgagcatcctattgtgcttgaaagaatggacttccctgatcctgtaattaaggtggcaattgaacccaaaactaaagctgatgttgataagatgggagctggtttggttaagcttgctcaagaagacccttctttccacttctcacgggatgaagagatcaatcagacagttattgaagggatgggagaattgcatcttgagattattgttgatcgcctcaaaagggaattcaaggttgaagccaatgttggagcaccccaggtaaattacagggaaagtatttccagggttgcagaaacgaggtacgtgcacaagaaacaatcgggtggacaaggtcaatttgctgatatcactgtgcgttttgaacccatggagcctggtaatggatacgagttcaagagtgaaatcaagggaggtgctgtgccaagagaatacatacctggggtgatgaaaggattagaggagtgtatgagcaacggtgtgcttgcaggctttcctgtcgttgatgtacgcgctgtactagttgatggttcttaccatgatgtcgactcaagtgtgttggcattccaattggcagccagaggagctttccgggaggggataaagaaagctgccccgaaaatgcttgaaccgataatgaaagtcgaagttgttacacctgaggaacatctgggagatgtgattggtgatctcaactccaggagaggtcagatcaacagcttcaatgataaacctggtggtctcaaggtggttgatgcgctggttcctcttgcagagatgttccaatatgttagtacactgcggggcatgacaaaaggtcgtgcatcctataccatgcaattagctaagttcgatgttgttcctcagcacattcagaaccagcttgctgccaaggaggaagaagttgcagcttgattttgtttccctgtgtaatcagggaccactaaaatatttcccgactcattatttaagatccaagaaaaacgagggttgttcttcct

SEQ ID NO: 7985 - DNA, 2717 bp, Populus trichocarpa
ggaatacagaagcccgagccaaagcagaagtgtttcgttatccccaacgacacaagcccaaccacaacacaaaaccagtagagagagactcaaggtaggtctcttaacacagaacaaaaaccaataaaaatggcagcggagacagtgaggctaacaggttcagcctcaggttcaagcacaccctgcaatttcaatgggtctcaaagaagaccaactcactttcttggtctcccttcttctcgtgcttcaatttcaatctcttcttctctctctcatttcctgggaagctctgcgcgcattgcctcacactcttctaagttctcaacttcacgccaactgcgagagaggaggagaaacttctccgtctttgccatggctgctgatgaggcaaagcgtacggtgcctttgaaagattaccggaacatagggattatggctcacatagatgcaggaaagactactacaaccgaacggattctgtactatacaggaagaaactacaaaataggggaggtacatgagggaacagctacaatggactggatggaacaagagcaagaaagagggatcaccattacttctgctgcaactaccacattttggaacaagcatcgcatcaacattattgatactcctggccatgttgatttcacacttgaagtggaacgagctctcagggttttggacagtgctatctgcttgtttgacagtgttgctggtgtggaaccacaatctgaaactgtgtggaggcaagcggataaatatggagtgcccagaatttgctttgtcaataagatggatcggcttggagcaaactttttccgaactcgagacatgatagtgacaaacttgggtgccaaaccacttgttattcaaatcccaattggttcagaagatagctttaaaggaattgttgatcttgtgaaaatgaaagctatagtttggtcaggagaagaattgggtgcaaagtttgcatatgaggatattccagctgatcttcaagagttggctcaagaataccgtgcacagatgatagagaccatagttgagctggatgatgaagctatggagggctatctagagggagttgagcctgaggaggaaacaatcaagatattaattaggaaaggaacgattgcaagcatttttgtccctgtcttatgtggctctgcttttaagaataagggggttcagccattgcttgatgctgtcattgattatttgccttcgcctattgacttgccagcaatgcagggttctgatcctgagaacccagaagtgacaattgaaagggctgcaactgatgatgaaccatttgctggactagcattcaagatcatgactgattcatttgtgggatccctcacattcgtgagagtgtattcagggaagctaagtgcaggatcttatgtaatgaatgcgaacaaaggtaaaaaagagagaattggaagacttctagaaatgcatgccaatagcagagaggacgttaaagtagctttaactggtgatatagttgctcttgctggtctaaaagataccataaccggtgaaactctttgtgatcctgataatcctattgtgcttgagaggatggacttccctgatcctgtcattaaggttgcaattgaacccaagactaaagctgatgttgataagatgacgactggtttggtcaaacttgcacaggaagacccttctttccacttctcacgtgatgaagaaatcaaccagacagtgatcgaaggaatgggagaattgcatcttgagattattgtagatcgcctcaagagagaatttaaggtagaagcaaatgttggtgcaccacaagtgaactaccgtgaaagcatttccaaagtagcagaagtgaagtacgtccacaaaaaacagtctggtgggcaaggacagtttgctgatataacagtgcggtttgagcccatggaggcagggactggatatgagttcaaaagtgaaatcaagggaggtgcagtgccaagagaatatgttcctggagtgatgaaaggactcgaggagtgcatgtctaacggagtgcttgctggctttcctgttgtcgacgtacgtgctgttttggtagatggttcttaccatgatgttgattcaagtgtgttggcatttcaactggcggccagaggggctttcagggaagggataaagaaagctggtccaagaatgctagaacctataatgaaagttgaagtggtcacacctgaagaacatttgggtgatgttattggtgatctcaactcaagaagaggtcagatcaacagctttggtgacaaacctggtggtttgaaggtggttgattcccttgttccactggctgagatgttccaatatgttagtacacttcgaggaatgacgaaagggcgtgcatcctacaccatgcaattagccaagtttgatgttgtccctcaacatatccaaaaccagcttgctgcgaaagaagaagttgctgcttgattttgtttttctgattccctgaagaggacggagcattgtattcttgtgaaatggatgccttttgtttcaagtaaccaattttgttttattttgtaccattcctatatgtaaaatgcaaaaggatttaggtttgagaaacgcggcattgattcaacctggaaaattattgttaaatttgactgaactatgtagagattaattacgagaataagagattaagggaagattgacaataccaa

SEQ ID NO: 7986 - DNA, 2688 bp, Citrullus lanatus
atccgaagaaaacttagccgttccctttaataaacttaaaatccccatttccgttcgagagaggaagcaagacgataatggcggcagaggcagtgagagcagcttcttccgtttgcaatttcaatggctctcaaagaaggcctgcaaaacctctctctcgaactcactttctccttcgttcttctcgaccttcccgctcccaattttttggtaccaaccttcgtttgacttcatcagcttcctctaagctctgtaattcacgtcaacaaaacagacgcaatctctctgtctttgccatggctgccgaagatgggaagcgtgcggtcccacttgaagactacaggaatatcggaatcatggctcacattgatgccggtaagacgactacaactgaacgtattctatactacacaggaagaaactacaagataggggaagtacatgagggagcagctacaatggactggatggagcaagaaaaagaaagaggaattaccattacttctgctgcaactaccacattttggaataaacaccgtataaatattattgatactccaggtcatgttgattttacccttgaggtggagcgagcacttagagtactggatggagcgatatgcctatttgacagtgttgctggagttgaaccacaatctgaaactgtttggaggcaggctgataagtatggagtgccaaggatttgcttcatcaacaaaatggatcgccttggagccaactttttccgaacgagagacatgattgtgacgaacttgggcgctaagccacttgttcttcaattaccaattggctcggaagataactttaagggtgttgttgatcttgtgaggatgaaagctatagtttggtcaggagaagagttgggtgcaaagtttcagtatgaagatattccagaagaccttgtggatcttgctcaagactatcggtcacagatgattgagactgttgttgagttggatgatcaagccatggagaactatttggaagggatcgaacctgatgagtctaccattaagaagcttattcggaagggaacaatatctgcttcttttgttcccgtaatgtgtggctcagctttcaaaaacaaaggggtccaaccattacttgatgctgttgtggactatttgccttcaccaatcgacttgccacccatgaagggaactgaccccgagaacccagaactgattgttgagagggctgccaatgatgacgaaccattttctggactagctttcaagatcatgagtgatccttttgtcggatcactaacatttgtgagggtatatgctggtaaactttctgcaggatcttatgtattgaactcgaataaaggaaaaaaagagagaattggtagacttctagaaatgcatgcaaacagcagagaggatgtaaaggtagcccttgctggggatattgtcgctctagctggtcttaaagataccattactggtgaaaccctgtgtgacccagatcatcctattgtacttgaacggatggacttccctgatcctgtgattaaggttgcaattgagcccaaaactaaagctgatgttgataagatggcaactggtttaatcaagctggctcaagaagatccatcgtttcacttctcgcgtgatgaagagataaaccagactgtgattgaaggcatgggagagttgcatcttgaaatcattgttgacaggctcaagagggaattcaaggttgaagctaatgtgggtgcgccacaagtcaactaccgagaaagtatttccaaagtttcagaagtaaagtatgtgcacaagaaacaatcaggtggtcaaggacagtttgctgatattacagtgcggttcgaacccatggagccaggcagtggatacgagttcaaaagtgaaatcaagggtggagcagtgccaaaagaatacattccgggtgtggtcaagggattggaagagtgtatgagcaatggtgttcttgctggctttcctgtggttgacgttcgtgctgtgctagttgatggtacgtaccacgatgtagattcaagtgtcttggcctttcaacttgcagctaggggagctttcagagaagggatgaggaaagcaggtcctagaatgcttgaaccaatcatgaaagtcgaagttgtcacaccagaggaacatctcggagatgtgattggagatctcaactccaggagaggtcagatcaacagctttggtgataagcctggtggtctcaaggtcgtggatgcactggttcctctagctgagatgtttcaatacgtgagtaccctgagggggatgacaaaaggaagagcttcatacacaatgcaattagccaagtttgatgttgtccctcagcacatccagaacgagcttgctgccaaagagcaagaagttgctgcttgattttggtttcagtttggaaacaacctgcgattctttgtctgttggaaagagggattcgtgttctattattaatttatgccatgtttgtggaaggattgctgttcctgcaagatttgaagagcgacctctcttactaaccaaggtgtaattattcaaatacttggctgtcggatctctaaaattcgacccaaatgcaaacaattttgaatgtaaaatcaatttcttcattaaggaaagccagagtatccgtttggatccttcttgaaatttttactacagatca

SEQ ID NO: 7987 - DNA, 2510 bp, Cleome gynandra
ggcccaaggcttcgttatccccacaccatacaaaagcaagaggtgtaaccgtagagtgacgaagaagaagaagaaaaaggagagaccttatcgaagactcgaccggaaaaaatggcggcggatgctctgagaattacgggttcgagttctggttcggtcgtttgtaatcttaatggatcacagaaacgacctgttcttctccctctgtctcatcgtgctcggtttctcggtcttcctcctcgatcttctccttcttcgatttcctcttcgggttctgagcttttggggagtttccgttttgggttgggttcatcgaacgtttaccgccatggacagacctccaggaggaaacagttctctgttttcgccatggctgatgaggtaaaacgtactgtcccgcttaaagattaccgtaacatcggaattatggcacacattgacgccggaaaaacaaccacgacggagagaattctgtattatacgggaagaaactataagatcggtgaggtacacgaggggacggccacgatggattggatggaacaagagcaagaaagaggaattaccataacatcggctgcaactacgacttattgggataaacatcgtattaacatcattgacacgcctggacacgttgatttcacgcttgaagtcgaacgtgctcttagggtacttgacggtgctatttgtttgtttgatagtgttgcgggtgttgagccacaatcggagacggtttggaggcaagcggataaatatggtgttccgaggatttgctttgttaataaaatggatcgtcttggagcgaattttttcaggacgagggatatgatcgttacgaatttgggtgcgaagccattagtgattcaaattccgattggttcggaagataacttcaagggtgttgttgatcttgtgaggatgaaagctattgtttggtccggagaagaattaggtgctaagtttgcttacgaggatattcccgaagatcttcaagatttggcacaagaatatcgtgccctaatgatcgaaacgatagttgaattggacgatgaagccatggaaaattacttagaaggagtcgagcctgatgagatgacgattaagaaattgattaggaacggaaccatttcaggcaagtttgttcccgtcctttgcggttccgctttcaagaataaaggagtgcaaccgttacttgacgccgtggtggattatttgccttcaccaatggatttaccagcgatgaagggatcggatcctgagaatcccgaagctataattgaacgtaatgctgatgacgccgagccattctcggggttagcattcaagatcatgagcgatccatttgtgggttcccttacatttgtgagaatctactcgggaaaactttcggctgggtcgtacgttttgaatgcgaacaaaggaaagaaggagaggatcggaagactattagaaatgcacgcaaacagtagagaagatgttaaggtagctttgacgggcgatatcgttgctttggccgggcttaaagatacgatcaccggtgaaacactatccgacactgatagtcctgtcgttcttgaacgaatggactttccagatcccgttatcaaggtagcaattgaaccaaagacgaaagcagatatagataagatggcaaccggcttgatcaagcttgctcaagaagacccgtcattccatttctcccgtgatgaagaaataaaccaaacgattatcgaaggaatgggagaattgcatcttgagatcatcgtagatcgactcaagagagagtttaaggtcgaggccaacgtcggtgcaccacaagtgaactaccgtgagagtatctcgaaagtagcagaagtaaaatacgtccataaaaaacaatccggtggacaaggtcagttcgctgatgttacgatcaggttcgagcccatggaagcaggaagtggctacgaattcaaaagcgagatcaaaggaggagccgtaccaaaagagtatattcccggtgttatgaagggactcgaagagtgtatgagcaatggtgtcctagccggctttcctgtggtcgatgttcgtgctgctttagtagatggttcataccacgacgtggattcaagcgttcttgccttccaacttgctgcaagaggagctttccgcgaagggataaagaaagccggtccaagaatgttggaacccattatgaaggtcgaagtggttacacccgaagaacacctcggagatgtcattggagatttgaactctagaagaggtcaaatcaacagctttggtgacaaacccggtggtctcaaggtggtggatgctctggttccattagccgagatgttccaatacgtgagtacattgagagggatgaccaaaggacgggcttcgtacacaatgcaactttcgaaattcgacgttgttcctcaacatattcagaaccagctctcatccaaagaccaagaagttgctgcttagacactgtaattttgtgatctgttcaataaacagtc

SEQ ID NO: 7988 - DNA, 2865 bp, Cannabis sativa
ataaaaaatacaatcttggggctcaaaatgaccgaaacattattagagagaatcgaaagtgaaagctgagaaaaactgataagcacctctcttatatctctcctcttctgtggacgttatccccaaaactcaactcaacccaacccaccctcacaccttactactctgtcctctcactcttgaaggacatggcggccaagtctctcaggctgtccaccaccacggcctcaccttcttcttcttcttcttcactcactaatttcaccttcaatgcctctcaaagaaggcctgccacgattctttctccacagggctttctggggcttcgtcctcgaccctcatcttctttaacttcctcttctctttcccacttctttgggaatggtcgtctcagctcaaaagctgttaagctcactggttcaacccagcaaagccgaagaagaaacctatctgttttcgccatggctgctgatgcttcagcggaaaagcgagctgtgccattgaaagattatcgaaatattggaatcatggctcatatagatgcaggaaagaccacaaccacagaaagggttctgttttatacaggaagaaactataaaataggagaggtacatgagggaacagctactatggattggatggagcaggaacaagaaagagggattaccataacttcagctgcaacaaccacattttggaacaagcaccggattaacataattgatactcctggccacgtggacttcactcttgaagtggagcgagccctcagggtattggatggtgcaatatgcttgtttgacagtgtcgctggtgttgaaccacaatctgaaactgtgtggaggcaagctgacaaatatggtgtacccaggatttgctttgttaataagatggatcgtatgggggcaaattttttcagaaccagagatatgattgttacaaatttgggtgccaaaccactggtgattcagcttccagttggtgctgaagataagtttaaaggtgttgttgatcttgtgaggatgaaagctataatttggtccggggaagagttgggtgcaaagtttgagtatacagatattccagaggatcttcaggagctggctcaagaatacagatctcaaatgatagagaacatagttgagctagatgatagtgctatggaaagctacctagaaggagaagagcctgatgaagaaaccataaagaagttaattaggaagggtaccatcggcggtagttttgtgccagtattatgtggctcagcctttaagaacaagggtgttcaaccattgcttgatgctgttgtagattatttgccttcaccactcgacgtgcctcctatgaagggtaccgacccagacaaccctgaaataataatagagaggtctgctaatgatgatgaacccttttctggactagctttcaagatcatgactgatccatttgtgggtacccttacatttgtgagaatctatgctgggaagctgtctgctgggtcatatgtgatgaacgcaaacaagggaaagaaggaaaggattggtcgacttctagagatgcatgctaacagccgagaggatgttaaagtagctttggcaggtgatattgttgcccttgcaggtctaaaagataccattactggtgaaacattatgtgatcccgacaatcctattgttctcgaacggatggacttccctgatcctgtcattaaggtggcaattgaacctaagactaaagctgatattgataaaatggctactggtttgattaagctcgcgcaagaagatccttcatttcatttttcacgggacgaagagattaaccagacagtcattgaagggatgggagaattgcatcttgagattattgttgataggttaaagagagaattcaaggtagaagctaatgttggagcaccccaagtgaactacagagaaagcatttccaaggtagcagaggtgaagtacatacacaaaaaacagtctggtgggcaaggtcagtttgctgatatcactgttcggtttgagccaatggaagcaggcagtggatatgagttcaagagtgaaatcaagggaggtgcagttccaaaagaatacattcctggagtcatgaaaggtttagaggagtgtatgaacaacggtgtgctagcaggctttcccgttgttgatgttcgtgcagcactagtagatggttcttaccacgatgtagattctagtgtattggcgtttcagcttgcagccagaggagctttccgggaagggatgaggaaagctggccctaagatgctcgagccaatcatgaaagttgaggttgtcacacctgaagaacatttgggagatgttattggtgatctcaactccaggagaggacagataaacagtttcggcgacaaacctggcggtctcaaggtggttgatgcactggttcctctagcagaaatgtttcagtatgttagtacactcaggggaatgactaaagggcgtgcttcctacaccatgcagttagccaagttcgacgttgtgcctcaacacatccaaaatgagcttgctgctgccaaggagcaagaagtcaccgcttgatctttctttttctcatgcttggcaaataataatagtttacaattttgtttggcaaatcatagtttgtttttttcaccttcatattttgtatcaggaactctcatgtcagattcaaacaagagaacaaaagatgtattataggatattcttttttaagtgtgtctagtaaatgcttcaaattcatgtcattcctcattttagcaaaagaaatatggctttatgagattatgtttgaagagaatcaatataaattaaggttataaaaatgaggttaatctaagtgaag

SEQ ID NO: 7989 - DNA, 2687 bp, Quercus alba
tcaacgcagagtacatgggataactaccagatggaagtgtgagagacagaagagaaggaagagagcccaaaacaacaaaagagaaaagctctctcactcacagtcatacagtaaaaatggcggcagagtcagtgagagtgtcagcttcctcagcgtgcaatttcagtttcaatggctctcaaagaaggcctacaatccctctctctccagctcgctttctgggtcttcgtcctcgacgacaatcatcttcttcttctgagttccttgccactgtgcgccttaactcaatatcttccaagccctccacttcgcagagcagaagaaatttctctgtcttcgccatggccactgaagagtcaaagcgtgcagtaccattgaatgattatcgcaatattggaattatggctcacatagatgcaggaaaaactaccactaccgaacggattctttactatacaggaagaaactataaaataggggaggtacatgatggaacagctacaatggactggatggagcaagaacaagaaagagggattaccataacttctgctgcaactaccacattttggaacaaacaccggattaatattattgatactcctggccatgtcgacttcactcttgaagtggaacgtgctctcagggtattggatggcactatatgcttgtttgatagcgttgctggtgtggaaccacaatctgaaactgtttggaggcaagctgataaatatggggtacccagaatatgctttgtcaataaaatggatcgtcttggagcaaactttttccgaacaagagacatgatagtgacaaatttgggtgctaaaccactggtgattcaaatacctattggttcagaagatacttttcagggagttgttgatcttgtgaagatgaaagctatagtttggtcaggagaagagttgggtgctaagtttgtctatgaggatattccaacagatcttcaagagctagcacaagagtatcgatctcagatgatagaaaccataattgacttagatgatcaagttatggagagctacctagaaggagttgaacctgatgaggaaaccattaagaaattaataaggaagggaaccatctcaagcagttttgtcccagtattatgtggctcagcttttaaaaataagggtgttcaaccattgcttgatgccgttgtggattatttgccttctccagttgatttgccagcaatgaaggggactgacccagagaacccagaactgataattgaaagggctgcaagtgatgatgagccattctctggactagctttcaagatcatgagtgattcatttgtgggttcccttacatttgtgagggtgtattcaggaaagctgactgctggatcctacgtactgaatgcaaacaaaaacaaaaaagaaaggattggtagacttctagaaatgcacgcaaacagcagagaggatgttaaggtagctttaacaggtgacattattgctcttgctggtttgaaagataccattacaggcgaaacactgagcgatcctgagaatcccattgtgcttgaacggatggacttccctgatcctgtgatcaaggttgcaattgaacccaagactaaagctgatgttgataagatggcaactgggttaatcaaacttgctcaagaagacccttcttttcacttctcacgggatgaagagatcaaccagacagtgattgaaggaatgggggaattgcaccttgagattattgtcgatcgactcaagagggagtttaaggtggaagctaatgttggtgcgcctcaagtaaactaccgagaaagtatttctagaatctcagaagtgaagtatgtgcacaagaaacagtcaggtgggcaaggtcagtttgctgacatcactgtacggtttgaacccatggaagcaggtagcggatacgagttcaaaagtgaaataaagggaggtgcagtgcccagagaatacattccaggggtgatgaaaggattagaggagtgtatgagtaatggtgtgcttgcaggatttcctgttgttgatgtacgtgctgtgctagtagatggatcttaccatgatgtcgattcaagtgtcctggcatttcagctggcagccagaggagcttttcgtgaaggggtgaggaaggctgccccaaagatgcttgaacccattatgaaagttgaagttgtcacacctgaggaacatttaggagatgtgattggtgatctaaactcaaggagaggtcagatcaacagctttggtgacaaacctggcggtctcaaggtggttgatgcactcgtcccactggcagagatgtttcagtatgtcagcacactccgggggatgacaaaaggccgtgcatcctatatcatgcaattagccaagtttgatgttgtccctcaacacatccagaatgaactcagctctgccaaggagcaagttgctgcttaatttattctccctcgtgaagaacagggagcaaaatatttttgtcaatttaatatttagaattcgactgaacgacataaatttttttgttttctttctttctttttcccctttccctatacttaccctgtaacatttcataaagcaatcttagacttactccaactctacacaaaaatgaacaagaaaaggctgtgatgaaaacattttgccaatatcatagcttcataattgagtaaa

SEQ ID NO: 7990 - DNA, 2925 bp, Citrus clementina
gaagaaaacaacaaaagataggcctcgctcaagcgttagccttaaggggagaagagaatagaagagaagagaagagaacataaccaaaaccagaactgaattacaaccgcttactttatcttttttccctggcgagtggccagtgagactccgtcacttaacagttcacagttgagtccactggtgttaaagtgaaaaactaaacatggcagcagagagaatgataacggcttcatgttcatcggcagtatgcaacttcaatatgaatggctctcaaaggaggcctgtgcctgtgcctgtgactgtccctcgctctctgggtctcctcccttctcgagcttcccatttcttgggaagcgtgcgtgtcttcagcccccgttctacttccaagctctctcccagaagcagaagacaattctctgtttttgctgtggccgctgaagagtcaaaacgtgtgatccccttgaaagattatcggaatattggtataatggctcacatagatgcagggaagactactacaactgaacgagtcctattttatacaggaagaaactataaaattggggaggtacatgagggaacagctacaatggactggatggaacaagagcaagagagagggattaccattacttctgctgcaactactacatattggaacaaacaccggattaacatcattgatactcctggccatgttgacttcacacttgaagtggagcgtgctctcagggttctggatggtgctatctgcttgtttgacagtgttgctggtgtggaacctcaatctgaaactgtatggaggcaagctgacaagtatggagttcccagaatctgctttgtcaacaagatggatcgtttaggagcaaactttttccgcacaagagatatgatagttacaaacttgggagctaaaccacttgtagttcaattacctgttggtgcagaagataactttaagggagttgttgatcttgtgaagatgaaagctataatatggtcaggagaggaattgggtgcaaagtttgcttacgaggatataccagctaatcttcagaaaatggctcaagaataccggtcacagatgatagaaaccattgttgaattggatgatgaagctatggaaagctatctggaaggaaatgagccagacgaagaaaccatcaaaaaattaatccggaaaggaaccattgctggcagttttgtccctgtgttatgtggttcagctttcaaaaataagggcgttcaaccattacttgatgctgttgttgactatttgccttcaccacttgacttgccagcaatgaagggaactgatcctgaaaatcctgaagcaacacttgagagggcagccagtgatgatgaaccatttgctggactagctttcaagattatgagtgacccgtttgttggttccctcacattcgtgagagtgtatgctgggaagctttctgcaggatcttatgtgctgaacgcaaacaaaggaaagaaggagagaattggtagacttttggaaatgcatgccaacagtagggaggatgtaaaggttgccttagcaggtgacatcattgctcttgcaggtcttaaagacaccattactggtgaaacactttgtgatgcagaccatccaattctgcttgaacgaatggacttccccgatcctgtgattaaggttgcaattgagcccaagactaaagctgatattgacaaaatggcaaatggcctgatcaaacttgctcaagaagacccttcattccacttctcacgagatgaagagatcaaccagacagtgattgagggtatgggagaattgcatcttgagattatcgtcgatcgcctaaagagggaatttaaggtagaagctaatgttggtgcaccccaagtcaactatcgtgaaagcatttctaaagtctctgaagtgaagtacgtacacaagaaacagtcaggcggacaaggacagtttgctgatatcaccgtgcgatttgagcctatggaggcaggaagtggatatgagttcaagagtgagatcaagggaggtgcagtgccaaaagaatatattcctggggtgatgaaaggactagaagaatgcatgagcaatggtgtgcttgcaggcttccctgttgttgacgtacgtgctgcactagttgatggttcctaccatgatgttgattctagtgtcttggcatttcaacttgcggccaggggagctttcagggagggcatgagaaaggctggccctaaaatgctggaacctataatgaaagtcgaagttgtcacacctgaagaacacttgggagatgtgattggtgatctcaactcgaggagaggtcagatcaacagttttggtgacaaacctggtggtttgaaggtggttgatgcgctggttccactggcagaaatgttccaatatgttagtgcactccgagggatgacaaaaggccgtgcatcatacattatgcagttagctaaattcgatgttgtccctcaacacatccagaaccaacttgcagcgaaagaacaagaagttgctgcttgaatgaatttttctgaggaaacaggaatcactatatattttttcatttacttgatataaatcaagggaaggtttctttttgtactaattttatagatgagctgaaaaaaacttagaaagttgtggacgtcaatctcatcatcgccgaacaacatcttgtatcattgtgtttgtgacgtaggatttgagaaagatttgatcttttccataagttatacggagaaagggtggtaatcttaaaccagaaggtgtgacaaatctaccttattagcatacggagactgcaatttaataatatgattgattttcttttcggactacactgttaagcatttgatcgataacataagtattattaaaactatcattaaatacacgctttattaatt

SEQ ID NO: 7991 - DNA, 2531 bp, Euphorbia peplus
aactccagtcccaactcccaaatggcggcagaaagtgttagattaacagcttcttcttcttcttcactctgcagcatcaatggctctgcaagaagagctgactcttcctcttctccttctattcggtttctgggtcttcctcctcgagcttctgtttcatcttctcctatctcttcttctctttctcatttctatggaaccacccgtctcaaagtattcaatttacgcccacaaaagcatacgagaaggagcttctctgtctttgctatggctgctgaagccgagggaaagcgtacagttccgttgagtgattaccgcaacatcggaattatggctcacattgatgctggaaagactactactactgagagggttctctactacacgggacgaaactacaaaattggggaagttcatgaaggtacagcaactatggattggatggagcaagaacaagaaagaggaatcaccattacttctgctgcaactactactttttggaacaaacaccggattaacattattgacactcctggccatgttgacttcacacttgaagtggagcgagcgctcagagttttggatggtgctatctgtttgtttgacagtgtggccggtgtagaaccacagtctgaaactgtttggaggcaagctgataaatatggggtaccaagaatttgctttgtcaataagatggatcgccttggagcgaacttttttcgaactagagacatgatagtgacaaacttgggtgctaaaccccttgttatccagattccaattggtgcagaagataattttaaaggagttgttgatctggtaaagatgaaagctatactgtggtcgggagaagaattgggtgcaaaatttgagtatggtgatattccggaggatcttaaagaagtggctgaggaatatcaagcgaaaatggtagaaactatagttgaattggatgatgaagctatggagaattatctagaaggagttgaacctgatgaagaaactataaaaagattaattaggaagggtacaattgaagggaattttgtgccggttttgtgtggttctgcttttaaaaataagggtgttcagccattgttagacgcagtcattgattatttgccatccccgcttgatgtgccaccgatgcagggtactgatcctgagaacccagaattgactattgatagaccagcaagtgacagtgaaccattttcgggactagcgttcaagattatgagtgatccatttgtgggatccctcacatttgtgagaatttattcggggaaactatctgctgggtcctacgtgttgaatgcaaacaagggaaagaaggagagaataggaagacttctcgaaatgcatgccaacagtagagaggatgtcaaagttgctttagctggtgatattgtggctcttgcaggtctaaaagatacgataacgggtgaaacgctctcggatcctgaaagtccaattgtccttgaacgtatggacttcccagatcctgtgatcaaagttgcaattgaacccaagaccaaagctgatattgataagatggctactggtttgatcaaacttgctcaggaggacccttcgttccatttctcccgagatgaagaaaccaaccagaccgtcatagaaggaatgggggaattgcatcttgagatcattgtagaccgcctcaaaagagaatttaaggtggaagcgaatgttggtgcgcctcaagtgaactaccgtgaaagtatctccaaaatttcagaagtgaagtatgtgcacaagaaacagtcaggtgggcaaggacaattcgctgatataacaatgcgatttgagccaatggattcgggcagtggatacgagttcaaaagtgaaatcaagggaggtgcagtcccgagagaatacattcctggtgtgatgaaaggaatagaagagtgcatgagtaacggagttttagcaggatttccagttgttgatgttcgtgctgtgttaaccgatggttcttaccatgatgtagattcaagtgtgttggcatttcagcttgcagccagaggagctttccgcgaagggataaggaaagctgcgccgaaaatgttggaacctataatgaaagttgaagttgtaacacccgaagagcatttgggagatgtaattggtgatctcaactcaagaagaggtcaaatcaacagctttggagacaaaccaggcggcctcaaggtggtggatgcattggttccactagcagagatgtttcagtacgtgagtacgctgcggggaatgacgaaaggtcgtgcatcgtatacgatgcaattagccaagtttgatgttgtgccacaacatattcagaaccaacttgctgccaaagagatggaagtggctgcttaattccttggcaagggggctttatagcgccatccatgtcttctctcttcttcttgtcaaaattgatacggttcacagaaacagttttgttttgtttttgcgtgtattcatttcgcatataattgcaaataaattaatgaaaaatgataaaaaaa

SEQ ID NO: 7992 - DNA, 2467 bp, Malus domestica
gataagaagaaacaatggctacagagtcagtgagagtgtacagttttagcttcaatggaggttctcagactcggccggccatgtctccctccccagctcgctttctcggtcttcgccatcgaccctcttcttccctcacttcgtcttcgctttcccacttctttgggaatgttcgtatcagctcccactcctcaaggctctcgaatttgcgccagcagagccgaagaaacctctctgtttttgccatggccgcagaggatggaaagcgtgcagtagctttagaagattatcgcaacataggaattatggctcacatagatgcagggaagacgactacaactgaaagaatcttgttttatactggaagaaactataaaataggggaggtacatgaaggaacagcaactatggactggatggagcaggaacaagaaagaggcattaccataacttctgctgcaactacaacattttgggacaatcacaggattaacatcatcgacactcctggccacgttgacttcacccttgaagtggagcgggctctaagggtgcttgatggtgctatatgcttgtttgatagtgttgctggtgtggaacctcaatctgaaactgtgtggaggcaagctgatagatatggagtgcccaggatttgctttgtcaataaaatggatcgtcttggagcaaacttcttccgaacaagagacatgatagtgacaaatttgggtgccaaaccacttgtacttcaaattccagttggtgcagaagataattttaaaggagttattgatcttgtgaagatgagagctatactttggtctggagaagagttgggtgctaaatttgtttacgaggagattccatctcatcttctggagctggctcaagaatacagggctgagatgatagaaaccatagttgagttggatgatcaagcaatggagggctatctagaaggagttgaacctgatgaggaaaccattaagaaattaattaggaagggaaccatcgcaattagttttgtgccagtattatgtggttcggcttttaaaaataagggggttcaaccattgcttgatgcagttgtggattatttgccttcaccacttgatgtgccaccaatgaaggggactgatgcagacaaccctgaaatcacgattgaaagggctgcaagtgatgaggaaccatttgctgggctagcattcaagatcatgagtgatccatttgtgggatcccttacatttgtgagaatctatgcaggaaagctaacggctggatcctatgttttaaatgcaaacaagggaaagaaggagaggattggtagacttctagaaatgcatgcaaacagtagggaggatgtaaaggtagctttagctggtgatatcgttgcacttgcaggcctgaaggataccattaccggtgaaacattgagtgaccccgatcatcctatagtgcttgaacgaatggacttccctgatcctgtaattaaggttgccattgaacccaaaactaaagctgatgttgataagatgggagctggtttggttaagcttgctcaagaagacccttctttccacttctctcgggatgaagagatcaaccagacagtgattgaaggaatgggagaattgcatcttgagattattgttgatcggctcaagagagaattcaaggttgaagcaaatgttggtgcaccccaggtaaactaccgggaaagcatttcgagaacctccgaagtgaggtatgtgcacaagaaacaatcaggtggacaaggtcaatttgcagatgtcaccgtacggtttgaaccaatggaggctggcggtggatatgagtttaagagtgaaatcaagggaggtgcagtgccaagagaatacattcctggggtcatgaaaggattagaggagtgtatgagcaacggtgtgctcgcaggctttcctgttgttgatgtacgcgctgtactagttgatggttcttaccatgatgtcgactcaagtgtgttagcatttcaattggcagcaagaggagctttccgggaggggataaagaaagctgccccgaaaatgcttgaaccaataatgaaagttgaagttgttacaccagaagaacatctcggagatgtgattggtgatcttaactcgaggagaggacagatcaacagcttcaatgacaaacctggtggtctcaaggtggtggattcactggttcctcttgcggagatgtttcagtacgtgagtacgctgaggggcatgacgaaaggtcgtgcatcgtatacaatgcagttagctaagtttgacgttgttcctcagcacattcagaaccagcttgctgccaaggaggaagaagttgctgcttgattttgtttccatgtatggtcagatcagagggaccttataatttaaatcccaactcattatttgagtaaaaacccttttttttttttttttttttttgactctgcatcaaaaaa

SEQ ID NO: 7993 - DNA, 2654 bp, Citrus sinensis
gaagaaaacaacaaaagataggcctcgctcaagtgttagccttaaagggtgaagtgaagaagagaagagaagagaacataaccaaaaccagaactgaattacaaccgcttactttatcttttatccctggcgagtggccagtgagactccgtcacttaacagttcacagttgagtccactggtgttaaagtgaaaaactaaacatggcagcagagagaatgataacggcttcatgttcatcggcagtatgcaacttcgctatgaatggctctcaaaggaggcctgtgcctgtgcctgtgactgtccctcgctctctgggtctcctcccttctccagcttcccatttcttgggaagcgtgtgtgtcttcagcccccgttctacttccaagctctctcccagaagcagaagacaattctctgtttttgctatggccgctgaagagtcaaaacgtgtgatccccttgaaagattatcggaatattggtataatggctcacatagatgcagggaagactactacaactgaacgagtcctattttatacaggaagaaactataaaattggggaggtacatgagggaacagctacaatggactggatggaacaagagcaagagagagggattaccattacttctgctgcaactactacatattggaacaaacaccggattaacatcattgatactcctggccatgttgacttcacacttgaagtggagcgtgctctcagggttctggatggtgctatctgcttgtttgacagtgttgctggtgtggaacctcaatctgaaactgtatggaggcaagctgacaagtatggagttcccagaatctgctttgtcaacaagatggatcgtttaggagcaaactttttccgcacaagagatatgatagttacaaacttgggagctaaaccacttgtagttcaattacctgttggtgcagaagataactttaagggagttgttgatcttgtgaagatgaaagctataatatggtcaggagaggaattgggtgcaaagtttgcttacgaggatataccagctaatcttcagaaaatggctcaagaataccggtcacagatgatagaaaccattgttgaattggatgatgaagctatggaaagctatctggaaggaaatgagccagacgaagaaaccatcaaaaaattaatccggaaaggaaccattgctggcagttttgtccctgtgttatgtggttcagctttcaaaaataagggcgttcaaccattacttgatgctgttgttgactatttgccttcaccacttgacttgccagcaatgaagggaactgatcctgaaaatcctgaagcaacacttgagagggcagccagtgatgatgaaccatttgctggactagctttcaagattatgagtgacccgtttgttggttccctcacattcgtgagagtgtatgctgggacgctttctgcaggatcttatgtgctgaacgcaaacaaaggaaagaaggagagaattggtagacttttggaaatgcatgccaacagtagggaggatgtaaaggttgccttagcaggtgacatcattgctcttgcaggtcttaaagacaccattactggtgaaacactttgtgatgcagaccatccaattctgcttgaacgaatggacttccccgatcctgtgattaaggttgcaattgagcccaagactaaagctgatattgacaaaatggcaaatggcctgatcaaacttgctcaagaagacccttcattccacttctcacgagatgaagagatcaaccagacagtgattgagggtatgggagaattgcatcttgagattatcgtcgatcgcctaaagagggaatttaaggtagaagctaatgttggtgcaccccaagtcaactatcgtgaaagcatttctaaagtctctgaagtgaagtacgtacacaagaaacagtcaggcggacaaggacagtttgctgatatcaccgtgcgatttgagcctatggaggcaggaagtggatatgagttcaagagtgagatcaagggaggtgcagtgccaaaagaatatattcctggggtgatgaaaggactagaagaatgcatgagcaatggtgtgcttgcaggcttccctgttgttgacgtacgtgctgcactagttgatggttcctaccatgatgttgattctagtgtcttggcatttcaacttgcggccaggggagctttcagggagggcatgagaaaggctggccctaaaatgctggaacctataatgaaagtcgaagttgtcacacctgaagaacacttgggagatgtgattggtgatctcaactcgaggagaggtcagatcaacagttttggtgacaaacctggtggtttgaaggtggttgatgcgctggttccactggcagaaatgttccaatatgttagtgcactccgagggatgacaaaaggccgtgcatcatacattatgcagttagctaaattcgatgttgtccctcaacacatccagaaccaacttgcagcgaaagaacaagaagttgctgcttgaatgaatttttctgaggaaacaggaatcactatatattttttcatttacttgatataaatcaagggaaggtttctttttgtactaattttatagatgagctgaaaaaaacttagaaag

SEQ ID NO: 7994 - DNA, 2873 bp, Eucalyptus grandis
tccgcgctttctcggcccctcgttatccccttctctcccacccctcgctgcggacgcgagcctctcccgcgctccacaccagaaatggcggcggagtcggtgcggctggccggtccgtccccggtgtgcagcttcggcggcgcccagcggcggcccgcggcgctcctcccttctcccgcgcccttcctctgcctccgccctcgcgcctcctccgtctccgcttccagctcccagttcctcgctgggctgcggtttggctcccggcgcttctcgaggcctcagcgccgggggcggagggagttctccgttctcgccatggccggcgaagatggaaagcgtacggtgccgttgaaggactaccggaacatcggaattatggcccacatagatgcagggaaaactactacgactgaacggattctatactacacgggaaggaactataagattggagaagtgcatgagggtacggctacaatggactggatggaacaagaacaggagagggggattaccatcacgtctgctgcaaccaccacattttggaacaaacacaggattaacatcattgatactcctggccatgtggacttcacccttgaagtggagcgagcacttagggtcttggatggtgccatttgcttgtttgacagcgtggctggagtggagccacagtctgaaaccgtgtggaggcaagctgataaatatggggtacctagaatctgctttgtcaataaaatggaccgccttggggctaacttctttcggacaagggacatgatagtcacaaacttgggtgctaaaccccttgtgattcagttgcctattggttcggaagataatttccaaggtgttgttgatcttgtcagtatgaaagccatagtatggtctggggaagagttgggtgcaaagtttgtgtatgatgatattccggctgatctgcaagagttggctcaagattaccgatcacagatgattgaaattatagttgaactagatgatgaagcaatggagaactaccttgaaggtgttgaaccggatgaggataccattaagaaattaattaggaaaggaactatgtcaagcaattttgtcccagtattatgtgggtcagcctttaaaaataagggtgttcagccattgcttgacgcagttgtggattatctgccttcacctcttgatgtgccaccaatgaagggttctgatcctgagaatccagaagcaacgattgatagggctgccagtgatgaggagccttttgctggactagcctttaaaatcatgagtgattccttcgtggggtccctcacatttgtgagagtgtacgcagggaagttaagtgcagggtcgtatgtgctgaatgcaaacaaaggaaagaaggagaggattggcagacttcttgaaatgcatgccaacagtagggaggatgtaaaagttgcgttggccggtgatattgtagctcttgctggtctgaaggatacaataactggggaaacgctttgtgacccagatgctcccattcttctcgagaggatggactttcctgatcctgttattaaggttgctattgagcctaaaactaaagctgatgtagacaagatggcgaatggtctgatcaaacttgctcaagaagatccctctttccatttctcgcgtgatgaagagatcaaccagacagtgattgaaggaatgggagaattgcatcttgagattattgttgatcggctcaagcgggaatttaaggttgaagctaatgttggggcaccgcaagtgaattacagggaaagcatttcgaaagtctccgaagtaaagtatgtgcacaagaaacagtcaggtgggcaagggcagtttgcagatatcaccgtacgatttgagcccttggagtctggaagtggttatgagttcaagagtgagatcaaaggaggggcagttcctaaagagtatatacctggagtaatgaaaggcttggaagagtgtatgagtaatggaattcttgcagggtttcctgttgttgatgtgcgtgctgcattagttgatggttcataccatgatgtggattcaagtgtcttggcattccagctggctgccagaggagcattccgggagggaatgaggaaagctggccctaagatgctagagcctataatgagagtggaagttataacacctgaagaccacctgggtgatgtgattggtgatctaaactcaaggagaggccagatcaacagttttggtgacaaacctggtggcctcaaggttgtcgatgccctcattccactagcagagatgtttcaatacgtaagtacgctccgcggaatgacaaaaggccgtgcatcctacaccatgcagctagccaagtttgacgtcgtcccacagcacatccagaaccaacttgcggcaaaggagcaggaagttgctgcttaaactaattttgcagacggtgaaagcaatgattttcttctcttctggtttctttgtaatttattttacaacttcgatatgtgaatgcgagtaggacttggaagatggagagagaagggatttgatgcaaattgctttggtgaactgaacctgatacgtgaagtcggaaaactgtaaattgcattgttctgcagtgggataagagtgaaattttgtgctctcagccttgattttttcaaatggggaattgaatattataaaatgaaagaaattcaatatcgacagaaagattttaaagagtgcccctgggaggcctgactcttgttaagtttcattaattgtgtgttgataatgtaaatgtttccattagaagcagatgacttttttgaattatattattgctcaatttcaaagtgagtgataagtgctatttatatattcattcgttttaa

SEQ ID NO: 7995 - DNA, 2342 bp, Cucumis sativus
acgataatggcggcagagtcggttagagcagcttcttctgtttgcaatttcaatggctctcagagaaggcctgcagctcccacccctctctctcgaactcaatttctccttcgttcttctcgaccttcccgctcccatttctttggtaccaaccttcgtttgacttcatcaccttcttccaacctatgtatttcacgtcaacagagcagacccaatctatctgtctttgccatggccgccgaagatgggaagcgttcggtccctcttgaagactacaggaatatcggaatcatggctcacattgatgccggtaagacgactacaaccgaacgtattctatactacacaggaagaaactacaagataggggaagtgcacgagggagcagcaacaatggattggatggagcaagaaaaagaaagaggaattacgattacttctgctgcaactaccacattttggaacaaacaccgtataaatattattgatactccaggtcatgtcgattttactcttgaggtggagcgggcacttagagtacttgatggagcgatatgcctatttgacagtgttgctggagttgaaccacaatctgaaactgtttggaggcaggctgataagtatggagtgccgaggatttgtttcatcaacaaaatggatcggctcggagccaactttttccgaacaagagatatgattgtgacaaacttgggagccaagccgcttgttcttcaattgccaattggctctgaagataactttaagggtgttgttgatcttgtgaggatgaaagcaatagtttggtcaggagaagagttgggtgcaaagtttcagtatgaagatattccagaagaccttgtggatcttgctcaagactatcggtcacagatgattgagactgttgttgagttggatgatgaagccatggagaactatttggaagggatcgaacctgatgaggctacaattaagaagcttattcggaagggagcaatatctgcttgttttgttccagtactgtgtggctcagctttcaaaaacaaaggggtccaaccattacttgatgctgttgtagactatttaccttcaccaattgacttgccgcccatgaagggaactgaccccgagaacccagaactgatagttgagagggttgccagtgatgatgaaccattttctggactagctttcaagatcatgagtgatccttttgtcggatcactaacatttgtgagagtgtacgctggtaaactttctgcaggatcctatgtaatgaattcgaacaaaggaaaaaaagagagaattggaagacttttagaaatgcatgcaaacagcagagaggatgtaaaggtagcccttgccggggatattgttgctctagctggtcttaaagataccattactggcgaaaccttgtgtgatccagatcatcctattgtacttgagcggatggacttccctgatcctgtgattaaggttgcaattgagcccaaaactaaagctgatgttgataagatggcaaccggtttaatcaagctggctcaagaagacccatcgttccatttctcacgtgatgaagagataaatcagaccgtgattgaaggcatgggagagttgcatcttgaaatcattgttgacaggctcaagagggaattcaaggttgaagctaatgtgggtgcgccgcaagttaactaccgagaaagtatttcaaaaatttcagaagtaaagtatgtgcacaagaaacaatcaggtggtcaaggacagtttgctgatattacagtgcggttcgaacccatggaggcaggcagtggatacgagttcaaaagtgaaatcaagggtggagcagtgccaaaagaatacattccgggggtggtcaagggattggaagagtgtatgagcaatggcgttcttgctggttttccagtggttgatgttcgtgccgtgctagtcgatggtacttaccatgatgtagattcaagtgtcttggcctttcaacttgcagctaggggagctttcagagaagggatgaggaaagcaggtcctagaatgctcgaaccaatcatgaaagttgaagttgtcacacctgaagaacatctgggagacgtaattggagatctcaactccaggagaggccagatcaacagctttggtgacaagcctggtggcctcaaggtcgtggatgcgctggttcccctagccgagatgtttcaatacgtcagtacactaagggggatgacaaaaggaagagcttcatacacaatgcaattagccaagtttgatgttgttcctcagcacatccagaacgagcttgctgccaaagagcaagaagttgctgcttgatt

SEQ ID NO: 7996 - DNA, 2641 bp, Catharanthus roseus
ttaacgagagagagagccagaagaagaggaggtagaacacacatagaaagtgtgtatctgtgtgagaaatggcagcagaatcagtagtgagaatgtcttcagcatcaactgcttcttcactctataacttcaatggcggctcatcaagaagacctctcctcattaattctctgcgccgtgctgctggtaaagccacctccggcagagttcggtcagtcccttcagaattcttcggaacccttcggcttagctccgcacagaaagtctccaatttgaaccagaaacagaggaaagtaaacaatttcactgtttttgccatggccgctgctgacgaaggaaagagaacagtaccactgaatgactaccgcaatattggaattatggctcacatagatgcaggaaagaccacaacaactgagcgaattttgtattatacgggtagaaactacaaaattggtgaggtgcatgagggaacagccacaatggattggatggagcaagaacaggagagagggattactattacatctgcagctactactacattttggaacaagcatcgaattaacataattgatactcctgggcacgttgacttcaccctcgaggtggagcgtgcactcagggttttggatggtgccatatgcttgtttgacagtgttgctggtgtggaaccgcagtctgaaactgtttggagacaagctgataaatacggagtccccaggatatgctttgttaacaaaatggatcgtcttggagcaaatttcttcaggacaagagacatgatagtgacaaacttgggtgccaagccacttgtcattcaaattccaattggttcagaggacaattttcaaggagttgtggatcttgtgaagatgaaagctatagtttggtcaggggaagaattgggtgcaaagtttgcctacgaagacattccagctgatcttcaagagctggctgaagaatatcgagcacagatgattgagaccattgttgagttggatgatgaagctatggaaaattaccttgaaggcacagagcctgatgaggaaacaattaagaaactaattaggaagggaacaatttccggcagttttgttccagttttatgtggatcagcgtttaagaacaagggggttcaaccactccttgatgcagtggtggattacttgccttctcctctggacttgcctgcaataaatgggactgaccctgagaacccagaaacaacactcgaaaagccagcaagcgatgacgaacctttcgctggattagctttcaagatcatgagcgatccgtttgtgggatctctgacatttgttagggtttattcagggaagctggccgccggatcttatgtgctgaatgcaaacaaaggaaagaaagagagaattggtaggcttttggaaatgcatgccaatagcagagaagatgtcaaagtagccttaactggtgatattgttgctcttgctggtttgaaagatactattacaggagaaacattgtgcgatcctgaaagtcccgtagtgcttgaaagaatggatttcccagatcctgttattaaggtggcaattgaacccaagacaaaagctgatgttgataagatggccaatggtttgattaagcttgcacaggaagatccatctttccacttctctagagatgaagaaaccaaccaaacagttattgaaggaatgggagaattgcaccttgacattattgtcgacaggctaaagagagagtttaaggtagaagctaatgttggtgcaccacaagtgaactatagggaaagcatttctaaaattgcggaagtcaaatatgttcacaaaaagcaatcaggtggtcaagggcagtttgctgatatcactgtaaggtttgaacccttggaggcaggtagtggatatgagtttaagagtgagataaagggaggagcggttccaaaagagtacattccaggtgtcatgaaaggtttggaagagtgcatgagtaatggtgtactggcaggctttcctgtagttgatgttcgtgctgttttggtggatggatcttaccatgacgttgattccagcgtcttggcgttccaactggctgcaagaggtgcttttagagagggtgttagaaaagctggtcctaggatgcttgaacctataatgaaggttgaagttgtcacccctgaagaacatttaggagacgtgattggtgatcttaactcaaggagaggccaaattaacagctttggagacaaacctggtggcctcaaggttgttgatgcattggtccctctggcagagatgttccaatatgtgagcaccttaagaggaatgacaaagggtcgggcttcgtacactatgcaattagccaaattcgatgttgttccacaacacattcaaaaccaacttgctgcaaaggaggaagccgttgcttcttaacgcagttaagagttttcttgaacagtgaggtgtagaattgctttgtttttcaatcccttgatgtcaagagtcgaaattgattctttttttgtaaggatgacgatactaatacagaaattaatagaaagttaaacattgcgacagtttgcgttctttcttttccatcttttttgctttatggtgtagagggtttgttatcagttgctgcattc

SEQ ID NO: 7997 - DNA, 2568 bp, Amsonia hubrichtii
caacgtgaaaaccagaaaaagagaacacacgaattcacgcagcgagagtgtgtgtttctttgtgagaaatggcagcagagtcagtggtgagaatgtcttcagcttcaactgcctcctcgccctgcaatttcaatggctcatcaagaagacctctgcttattaactcgctgcgacgttgtggtaaaagcagcaccggtagagttcgctcactcacttctgaattctttgcaagtcttcggcttagctcgactcgaaagctctcgactttgaaccagaaacagaggaaacacaacaacttcactgtttttgctatggccgctgaggaaggaaagagagcagtaccactaaaagactatcgcaatattggaattatggctcatatagatgcaggaaagaccaccacaactgagcgaattttgtactatacaggtagaaactacaaaatcggtgaggtgcacgagggaacagccacaatggactggatggagcaagaacaagagagggggattaccattacctctgctgccactactacattttggaacaaacatcggattaacataattgatactcctgggcatgttgactttacacttgaagtggagcgtgcgctcagggttttggatggtgcgatatgcttatttgacagtgttgccggtgtggaacctcagtctgaaactgtttggagacaggctgataaatacggagtccccagaatctgcttcgttaacaaaatggatcgtcttggagcaaatttcttccgaacaagagacatgatagtgacgaacttgggtgcaaaaccacttgtcattcaaatcccaattggttcagaggacaatttccaaggagttgttgatcttgtcaagatgaaagctatagtttggtcaggagaagaattgggtgcaaaattttcctataaagacattcctgctgaccttcaagagctggctcaagattatcgagcacagatgattgagaccattgttgagttggatgatgaagctatggagaattacctggaaggagtagagcctgatgaggaaacaatgaagaaactaattaggaaaggagctatttccagcagctttgttccagttttatgcgggtcagcatttaagaataagggggtccaaccactgcttgatgcagtggtggattatttgccttctcctcttgacttgcctccaataaaggggactgaccctgagaacccagaagtaacacttgaaaggccagccaatgatgatgaaccttttgctggattagctttcaagattatgagtgattcttttgttggatccctaacatttgttagggtttatgccgggaagctcactgcaggatcttatgtgctgaatgccaacaaaggaaagaaagagagaattggtagacttctggaaatgcatgctaatagcagagaagacgtcaaagtagccttaactggtgacattgttgctcttgctggtttgaaagatacaattacaggagaaacattgtgcgatcctgagagtcccgtagtgcttgaaagaatggatttcccagatcctgttattaaggtggcaattgaacccaagacaaaggctgatgttgataagatggccaatggtttgattaagcttgcacaagaagatccatctttccacttctctagagatgaagaaaccaaccaaacagttattgaaggaatgggagaattgcaccttgacataattgttgacaggctcaagagggagtttaaggtagaagctaatgttggtgcaccacaagtgaactacagggaaagcatttctaaagtcgcagaagtcaaatatgttcacaagaaacagtcaggtggtcaagggcagtttgctgatatcactgtaaggtttgaaccgatggaggcaggtagtgggtatgagtttaagagtgagataaagggaggagcagttccaaaagagtacattccaggtgtgatgaaaggtttagaagagtgcatgagtaatggtgtgctggcaggctttcctgtagttgatgttcgtgctgtattggtggatggctcttaccacgatgttgattcaagtgttttggcattccaactggctgcaagaggagcttttagagagggaattagaaaatctggtccgaggatgctagaacccataatgaaggttgaagttgtcacccctgaagaacatttaggagatgtgatcggtgatctcaactcgaggagaggccagatcaacagctttggagacaaacctggtggtctcaaggttgttgatgccttggttcctttggcagagatgttccaatacgtaagcaccctaagaggaatgacaaaaggtcgtgcttcctacgtcatgcaattagccaaattcgatgttgtcccacaacacatccaaaaccagctttctgcaaaggaggaagcggtttctgcttaatgtggttactctctgtttaagcagtagaagtagaggaatgccttagctttgactcccatgatgtcaggagtcaaagctggttctttttgtgagagcgacagtacacaatacagaaattaatagaaagttaaaccttgtaattgtgtag

SEQ ID NO: 7998 - DNA, 4091 bp, Eutrema halophilum
ttttatccaacggttcagaaacaaaccacgcaaagcccgaaaggcttcgttatctccaagccatacgaacaatacgttacccgaagagtagtgaagtgaccaaatttgatagacagagcagagaggaagaagaagaagaagcgattttgacgagctcccaaagcgataaaaatggcggcggatgctctgagaatttcgagttctagttccggttcgttggtttgtaatcttaatgggtcacagagaaggcctgttcttattcctctgtctcatcgtgctacctttctgggtcttcctcctcgagcttcatcttcttcgatttcctcatctcttcctcattttctgggaaaatctcgttttgggcttggttcttcgaagctatcacaccggagaaaacaattttctgtcttcgccgttgccgaaggagaggcgaagcgtgcagtgccacttaaagattaccgaaacattggtattatggctcacatcgacgccggaaagacgacaacaaccgagaggattctttactacacaggaagaaactacaaaatcggcgaagtgcacgaaggaacagctacaatggattggatggaacaagagcaagaaagaggaatcaccattacttcagctgcaaccacaacgttttgggacaaacacagaatcaacatcatcgatacccctggacacgtcgacttcactctcgaggtcgaacgtgctctcagggttctcgatggagctatatgcttgttcgacagtgttgctggtgtcgagcctcagtccgagactgtctggagacaagctgacaaatacggtgtgcctcggatttgctttgttaacaaaatggaccgacttggagccaactttttcaggactagggacatgattgtgaccaatttgggtgctaagccgttggtgcttcagttaccaatcggtgctgaagatgtgtttaaaggtgttgttgatcttgtgaggatgaaagctatagtttggtcaggagaagagcttggtgccaagttcagttacgaggatattccagaggatcttgaagatttggctcaagattatcgggcgcagatgatggaactgattgttgatttggatgatgaagtcatggagaactatctagaaggagttgagcctgacgaggccacagtgaagagactggtcaggaaaggaaccatcacagggaagtttgtgcctattctgtgtggctcagcgttcaagaacaaaggtgtgcagccattacttgatgccgtggttgattatctgccttcgccagttgaagttcctccaatgaatggaacagatcctgagaaccctgaaatctccattgagcggaaaccgaatgatgacgagccattcgctgggttagcattcaagatcatgagtgatcctttcgtgggttctcttacgtttgtgagagtttactcagggaaactcacagctggttcttacgtgctgaatgctaacaaaggaaagaaggagaggattggaaggctcttggaaatgcacgcaaacagcagagaagatgttaaagtggctttaacaggggacattgtcgctcttgcgggtctcaaagatacaatcactggtgaaacattgagtgatccagaaaaccctgttgtccttgaacgtatggacttccctgatcccgtcattaaggtagcgattgagccaaaaacaaaagcagacattgataaaatggcgacaggattgatcaagctcgctcaagaagacccgtcattccatttttcccgcgatgaagagatgaaccaaaccgtcattgaaggaatgggagagcttcatctcgagatcatcgttgacagacttaaaagagagttcaaggtcgaggctaatgtgggtgcaccgcaagtgaactaccgtgagagtatctccaaaatagctgaagtgaaatacacacacaagaagcagtcaggtggacaaggtcagtttgctgatattacagtccgttttgagccaatggaagcaggatcaggatatgagttcaagagtgagatcaaaggaggagcagtgcctagagagtatattcccggtgtgatgaaagggcttgaggagtgtatgagctccggtgtgcttgcgggttttccggttgttgatgtccgtgcttgtctggttgacggatcttaccatgatgtggactcgagcgtgctagctttccagcttgctgcaagaggagctttccgtgaagggatgaggaaagcaggtccaagaatgcttgaacctatcatgagagttgaagttgtgacaccagaagaacatcttggtgatgtcattggtgatcttaactcaagaagaggtcagattaacagctttggagacaaacctggcggtctcaaggtggttgattctttggttccattagcagagatgtttcagtatgtgagtacattgcgagggatgacaaaaggtcgagcttcttacacaatgcaattggctaagttcgatgttgttcctcagcatattcagaaccagctttcgtccaaggatcaagaagttgctgcttaagacagattttgttcttttttttttttctggactaatcctacaccgaaacattattgtgatttttgtttggtttatatagaaatgtaagcgaatcaaatctataaagacaaggatgttattatcttaaaacacacatgaatatgagaaggaaaatgttatatcagaatagtctggaaaaaatggtaaggactcgattttggtgctgagagttataaaagaaaaacaaatctgcgaagaaatcaatgtctttgcttctgagtttatttcatctggacgattcctgagctgataagcttttggattttgttcatgaccattggattctgcatgtgtttctgtgctgctgctggattctcctggagatcagacagtacctgtgtacaaagaaaaagtgttggattttggtgagacagcatcaacatggaaatcagaactaaacattaatttcagaactgtgaaaaaatcaagagaagttttagtgtgtttctttacctgtctcattacaggatctgtgagaatgttctggatttccgggtcttgcattcccttagcctgcaagaagtaaaagcaaaatcccaatttccgtaatcttaaactcttaatcgaaaaataacgaagttttataacactagttagaatctaacctgtctttctttcaactcctcaggagtaaggtcaccacggtttgccttgttaatctgttgtacacatctgcagaaaaggtttacaacaagttacaaaggcactaaaataacaagagtgaataaactctccgtgactttacaaatgtgcataccttctaacaccgtcaagaagttcctgattgttaggatcatatttgagaccctcctggtatgtttccattgcattgtcatactccttcatgaagaattggactgcaccttttctgctgtatccctttgagaatgttggatcgagctcgatacatttttctgcatccttcaatccttcgggcattgcccctagttttgtgtaacatgcagctcggttgctatatgcctatgtgaagttcaaacaagttattcaaacagacaagcaagggaaaaccatggtacacaagattgaagcacatatgatgatgaattggtcttactctcgggtcttttggattccttttgatcgcttcagtgtaatgcctcaccgcatcaggatacttctgctccttgaaaaattcattaccttgcatcacaaacacaagagattgttaattcaaccaactctcaaattaacaagatataattgcaaagcatatacctttctcacgctccgcatcaccaatactgggatcaaaatactcttgctgctccaactctttcttggctctctctgcctcattcagcctcttcaacgtttcagggttacgatgctctgtaagagctttctggtaagtctcaatcacaggttcgtagtcttttgagcatttagccatcttccccagagctgttccttttctagtcaaagctttagctaccatcttgtaatctgacctaagctctctacctctctcaactgccttatcacaatccttgatgcactcatcatactga

SEQ ID NO: 7999 - DNA, 2466 bp, Brassica napus
gagaagaagaagaagcgagagtttgacgagtacccaaagcgataacaatggcggcggatgctctgagaatctcgagttctagctcgttggtttgtaatctcaatgggtcacagagacgccctgttctcactcctctgtctcatcatcgttctacctttctcggtcttcctcctcgcgcttctctttctcatcttctcggtaaagctcgtattgggcttgactcttcaaagctatcacaccgaaggaaacaattctctgtcttcgccgccgccgaaggagaggggaagcgcgccgtgccgcttaaagactacagaaacattggcatcatggctcacatagacgctggaaagaccacaacaacggagaggattctctactacacaggcagaaactacaagatcggcgaagtccacgaaggaacagctacaatggattggatggagcaagagcaagagagaggaatcaccatcacttcagctgcaaccaccacgttctgggacaagcacaggatcaacatcatcgatactcccggacacgtggatttcactcttgaagtcgaacgtgctctgagagttctcgacggtgctatatgcttgttcgacagtgttgctggcgttgagcctcagtccgagactgtgtggagacaagctgataaatacggtgtgcctaggatctgctttgtgaacaagatggaccgtcttggagctaactttttcaggactagggacatgattgtgactaatctcggtgctaagcccttggtgcttcagatacctattggtgctgaagattcgtttaaaggcgtggttgatctcgtgaggatgaaggctatagtttggtcaggagaagagcttggtgccaagtttaattacgaggatattccagccgatcttgaagagttggctcaagagtatagggcggcgatgatggagctgattgttgatttggatgatgaggtcatggagaattatttagaaggagttgagcctgacgaggccacggtgaagagattggtgaggaaaggaaccatcacagggaagtttgtgcctattctctgtggctcagcctttaagaacaaaggtgtgcagccgttgctcgatgctgtggttgactatcttccttctccagttgaagttccgccgatgaacggaacagatcctgagaatccggaagttaccattgtccggaagccagatgatgaggagccgttcgctgggttagcgttcaagatcatgagtgatcctttcgttggttctcttacgtttgtgagagtctactcagggaaactcacagctggctcttacgtgctgaacgctaacaaagggaaaaaggagagaatcgggagactcttggagatgcacgcgaacagcagagaagatgttaaagtggctttaacgggtgacattgtggctctcgctggtctcaaagatacaatcactggtgaaacattgagtgatccggaaagccctgttgtccttgaacgtatggacttccctgatcccgtcatcaaggtggcgatcgagcccaaaacgaaagcggatattgataaaatggctacgggactgatcaagctcgctcaagaagatccctctttccatttttcgcgcgatgaggagatgaaccaaaccgtcattgaaggaatgggagagcttcatcttgagatcatcgtcgacaggcttaaaagagagttcaaggtcgaggctaacgttggagcgccgcaagtgaactaccgtgagagtatttccaaagtagctgaagtgaagtatactcacaagaagcaatcaggtggacaaggacagttcgctgatatcacagtcaggtttgagccgttggaagcaggatcaggatacgagttcaagagtgagatcaaaggaggagctgtgccaagagagtatattccaggtgtcatgaaagggcttgaggagtgtatgggctccggtgtgcttgcgggttttccggttgttgatgtccgtgcttgtttagttgatggatcttaccatgatgtggactcgagcgtgttagctttccagcttgctgcgagaggagctttccgtgaagggatgaggaaagcaggtccgaggatgcttgaacctatcatgagagttgaagttgttacgcctgaagaacatcttggtgatgtcattggtgatcttaactctagaagaggtcagatcaacagctttggagacaaacccggtggcctcaaggtggtagattctctggttccattagcagagatgtttcagtatgtgagtacattgagagggatgacaaaaggtcgtgcttcttacacaatgcaattggctaagtttgatgttgttcctcagcatattcagaaccagctttcctccaaggatcaagaagttgctgcttaagtcagacagattatgttttcatgttcagaaactacactgaagacatacaaatgtgctatcttgataatgtttaatcatttctatagttttg

SEQ ID NO: 8000 - DNA, 2703 bp, Eutrema parvulum
aagcccaaaaggcttcgttatccccaagccacacgaacaatacgttagccaaagagaagagtgagtgaccaaattgatagaagaagaagaagaaggaagaagaagaagaagaagaagaagaagaaggagaagcgatttttgacgagctccaaagcgatacaaatggcggcggatgctctgaggatttcgagttctagttccggttcgttggtttgtaatcttaatgggtcacagagacggcctactcttattcctctgtctcatcgtgctacctttctgggtcttcctactcgagcttcatcttcttcaatttcctcttctcttcctcattttattggtaaagctcgtattggtcttggttcttcgaagctatcacaccggaggaaacaattctctgtctttgccgttgccgaaggagaggggaagcgtgctgtgccacttaaagattacagaaacattggtattatggctcacatagacgctggaaaaaccacaacaacggagaggattctttactacacaggaagaaactacaaaatcggcgaagtgcacgaaggaacagctacaatggattggatggaacaagagcaagaaagaggaatcaccattacttcagctgcaaccacaacgttttgggacaaacacagaatcaacatcatcgatacacctggacacgttgatttcactcttgaagtagaacgtgctctcagggttctcgatggagctatatgcttgttcgacagtgttgctggtgtcgagcctcagtccgagactgtgtggagacaagctgataaatacggggtgcctcggatttgctttgtgaacaaaatggaccgtcttggagctaactttttcaggaccagggacatgattgtgactaatttgggtgctaatccattggtgcttcagataccaattggtgctgaagatgtgtttaaaggtgttgttgatcttgtgaggatgaaagctatagtctggtcaggagaagagcttggtgcgaagttcagttacgaggatataccagaggatcttcaagatttggctcaagagtatagggcggcgatgatggaattgattgttgatttggatgatgaagtcatggagaactatttagaaggagttgagcctgacgaggcgacggtgaagagattggttagaaaaggaaccatcacagggaagtttgtgcctattctgtgtggttcagcctttaagaacaaaggtgtgcagccattgcttgatgctgtggttgattatctgccttcgccagtcgaagttcctccgatgaatggaacagatcctgagaacccggaacttatcattgtgcggaaaccagatgatgaggagccattcgctgggctagcattcaagatcatgagtgatccttttgtgggttctcttacatttgtgagagtttactcagggaaactcacagctggttcttacgtgctgaatgctaacaaaggcaagaaggagagaatcggaagactcttggaaatgcatgcaaacagcagagaagatgttaaagtggctttgacaggcgacattgttgctcttgcgggtctcaaagatacaatcactggtgaaacactgagtgatccggaaaaccctgtcgtccttgaacgtatggacttccccgatcccgtcatcaaagttgcgattgagccaaaaacgaaagcagacattgataaaatggctacgggattgatcaagctcgctcaagaagacccatctttccatttttcacgcgatgaagagatgaaccaaaccgtcattgaaggaatgggagaacttcatctcgagattatcgttgacagacttaaaagagagttcaaagttgaggctaacgttggtgcaccgcaagttaactaccgtgagagtatctccaaaatagctgaagtgaaatacactcacaagaagcaatcagggggacaaggacagtttgctgatattacagtccggtttgagccactggaagcaggatcaggatacgaattcaagagtgagatcaaaggaggagccgtgccaagagagtatattcctggtgtcatgaaaggacttgaggagtgtatgtgctctggtgtacttgcgggtttcccggttgttgatgtccgtgcttgtctagttgacggaaattaccatgatgttgactcgagtgtgctagctttccagcttgctgcaagaggagccttccgtgaagggatgaggaaagcagctccgagaatgcttgaacctatcatgagagttgaagttgttacacctgaagaacatcttggtgatgtcattggtgaccttaactctagaagaggtcagatcaacagctttggagataagcctggtggtctgaaggtggtggattctctggttccattagctgagatgtttcagtatgtgagcacattgagagggatgacaaaaggtcgtgcttcttacacaatgcaattggataagttcgatgttgttcctcagcatattcagaaccagctttcgtccaaggatcaagaagttgctgcttaagacagattttgttttttgttcaggactaatcctacagaaaaactattgtgattttgtttggtttatataagttatgtaagctaatcaaatctattaagacaaagtattgtcttaaaaaagcacaatggatatgagaaaaatgttatatcaaaatagtctgaaaaatgggaaaaactcgattttggtttg

SEQ ID NO: 8001 - DNA, 2845 bp, Medicago truncatula
tctttatcccaaacaccaaagggatagaagaaagctttaaactatggcagcagaatcatttcaagtggcaacttcttctctctgtagtcttaatggctctcaccgaaaacctacccttctttctccacttcgtttcatgggcacatgttttcgcccagtacaatcccgttctttctcttcatcttcattatcacaattctttcgaacttctccaattaaacccacttctccccaacttgttcgaacaagaagaaatttctcagttttcgccatgtccactccagatgaggcgaagcgtgctgttccattgaaagattatcgcaacattggtatcatggctcacatagacgctggaaagacaactacaactgaacggattctcttctatactggaaggaactacaaaattggagaggtgcatgagggaacggcaacaatggactggatggaacaagaacaagaaagagggattaccattacttctgctgcaaccaccactttctgggataatcacaggatcaacatcattgatactcctggtcatgttgacttcaccttagaagtggagcgtgctcttagggtgctggatggagctatatgcttgtttgacagtgttgctggtgtggagccacaatcagaaactgtgtggaggcaagctgatagatatggagtcccgcgaatttgtttcgtcaataaaatggaccgccttggagcgaactttttccgaacaagagacatgatagtgacaaatttgggtgctaaaccacttgtacttcagctaccaattggtgcagaagattcctttaagggagttattgatcttgttaggatgaaagccatagtttggggtggagaagaacttggtgccaagtttacttatgaagatatacctgtagatctcctagagcaggctcaagattacagatctcagatgatagaaaccatagttgagctagatgatgaggctatggagaactatctagaaggagttgaaccagatgaagcaactataaaaaaattaatcaggaagggatccatagcagccacttttgtgccagtgatgtgtggatcagctttcaaaaacaagggagtccaaccattgttagatgctgtagtggattatctaccatcaccacttgacgtaccaccaatgaagggcactgatcctgaaaacccagaagcaacaatagagaggatagctggtgatgatgaaccattttctggactagcttttaagatcatgagtgattcatttgtaggctcccttacatttgtcagggtgtactctggaaagctaactgcagggtcttatgtactcaattcaaacaaagggaaaaaggagagaattggtagacttttagaaatgcacgcaaacagcagagaagacgttaaagtggctttaacaggggatattgttgctcttgctggtttgaaagatactataacaggtgaaacgttgtgtgaccccgagagtccggtcgtgcttgagcggatggacttccctgatcctgtgattaagattgcaattgaacccaaaactaaagctgatattgacaagatggcagctggtttagtcaagcttgcacaagaagacccttctttccacttctcccgtgatgaagagataaatcagacagtgattgaaggaatgggagaattgcatcttgaaatcattgttgatcgtctcaaaagagaatataaggttgaagctaatgttggtgctccccaagtaaactacagggaaagcatttccaaaatccatgaagcgaggtatgtgcacaagaaacaatcaggtggacaaggtcagtttgcagatataaccgtacggttcgaaccaatggagccaggtagtggatatgaattcaagagtgaaatcaaaggaggagcagttccaaaagaatacattcctggggttgttaaaggattggaagagtgtatgagcaatggtgttctggccggatttccagttgtcgatgtacgtgcagtacttgtggatggttcttaccatgatgtagattcaagtgtgttggctttccagttggcagcaagaggagcttttcgggaaggaataagaaaagccggaccgagaatgcttgaacctataatgaaagttgaagttgttactcctgaagaacatttaggagatgtaattggtgatctcaactcaagaagaggccaaatcaatagttttggtgacaaaccaggtggactcaaggtggttgattcattagtacctcttgctgagatgtttcagtatgtcagtacactaagagggatgacaaagggtcgtgcatcatactctatgcaattagccatgtttgatgtggtacctcaacacattcagaatcaacttgccacaaaagtgcaagaagtttctgcataatttatttccttggtgtcctaaccacgagggttatcttccttttgatacttgtattatgattgttctatagtcattttattttttggggggtattttttattgtattttttcatgtactaatacaaggttagcaaaaaaaaaaaaaaaaagcattcagaaggaaaaaggaacacggtttttcttccatgaactgttattggacaaattttgatgtatatttatttttttgggagaaagtaaggcgtttaaacttggattttgcagaacccatagttatttacacatctgtagtttgtcaacatggtaatgtgttttgattagaagtgatgttcattctgaatgatgttggcttacttcatctaatttctggtttctagtagtattatcattattccaatctatatcagtatcaatataaaatataaatgtataagacattgctatgacaacagctttttatgt

SEQ ID NO: 8002 - DNA, 2742 bp, Fragaria vesca
cattttcgggtcgtatcagataaagcgccaaaaccccccaccacgaccctctctctctcctctcttctcttctctcacaaacacatagagtgagagagataaggaaaaatggctgcagagtcagtgagagcagttcagagtttcagcttcaatgggtctcagacaaggccaaccatccctctctccccacctcgctttctgggtcttcgtcctcctcgctcttcttcttcttctctcacttcctcttccctttcccacttcttcgggaatctccgtctcgcctccaactcctcaaagacctctactttgggccgcagaaacctctctgttctcgccatggccgccgatgatggaaagcgtgcagtaccgttagaagattatcggaatattggaattatggctcacatagatgcagggaagactactacaactgaacgggttttgtactatacgggaagaaattataaaataggggaggtgcatgaaggaacagcaactatggactggatggagcaggaacaagaaagaggcattaccataacttctgctgcaactacaaccttttgggacaaacacagaattaacattattgatactcctggccatgtggacttcacccttgaggtggagcgagctctcagggtgcttgatggcgcaatatgcttgtttgacagtgttgctggggtggaacctcagtctgaaactgtatggaggcaagctgataaatatggggtgcccaggatttgctttgtcaacaaaatggatcgacttggggcaaattttttccgcacaagggacatgatagtgtcgaatttgggtgccaaaccacttgtacttcaaattccagttggtgctgaagataattttaagggagttattgatcttgtgaagatgagagctataatttggtcaggagaagaattgggtgcaaaatttacgtatgaggatattccctctgatcttcaggagctggctgatgaatacagatcactgatgatagaaaccatagttgagttggatgatgaagctatggaggggtatctagaaggggttgaacctgatgaggccgccattaagaaattgattaggcagggaaccatctcagctagttttgtgccagtattatgtggctcagcttttaaaaataagggggttcaaccattgcttgatgctgttgtggattatttaccctcaccacttgatgtgccaccaatgcagggaactgatgcagataacccagaaatcacaattgagagggctgcaagtgatgacgaaccatttgctgggctggcattcaagatcatgagcgatccatttgtgggatcccttacatttgtgagagtctatgcaggaaagctaagtgctggatcatatgtgctgaatgcaaacaagggaaaaaaggagaggattggaagacttctagagatgcatgcaaacagtagggaggatgttaaggtcgctttaactggtgatattattgcgcttgcaggtctaaaagatactgttactggtgaaacattgagtgaccctgagcatcctattgtgcttgaacgtatggaattccctgatcctgtgattaaggtggcaattgaacccaaaactaaagctgacgttgataagatgggtgctggtttggttaagcttgctcaggaagacccttcgttccacttctcaagagatgaagaggttaatcagacagtgatcgaaggaatgggtgaattgcatcttgagattattgttgatcgcctcaagagggaattcaaggtcgaggctaatgttggagcaccccaggttaactaccgtgaaagcatttctaaagtcgctgaagtaaagtatgtgcacaagaaacaatctggtggacagggtcaattcgcagatatcactgtccgatttgaacccatggagcccggtaatgggtatgagttcaagagtgaaatcaagggaggtgcagtgcccagagagtacattcctggggtgatgaaaggactagaggagtgcatgagtaacggtgtgcttgcaggctttcctgtcgtcgacgtgcgtgctgtactaaccgatggttcttaccacgatgttgactcgagtgttttggcattccagttggcagcgagaggagctttccgagagggtatgaagagagctggcccaaaaatgcttgaacccataatgaaagttgaagtagttacacctgaagaacatttgggagatgtgattggtgaccttaactccaggagaggtcagatcaacagctttagcgacaaacctggtggtctcaaggtggtcgatgctgaggttcctcttgcggagatgttccaatacgttagtacactaaggggcatgacaaaaggtcgtgcatcctacacgatgcaattagctaagtttgatgttgttcctcagcacattcagaaccaactttctgccaaggaggaagaagttactgcttgatttggtttacatgtacaaatgtacaatagttgatcggggtccaagaaaatgagggcgtctttttttaaattttttgcctcgtgtacttttaagatttttgcctctgtaccaaaagaaacaataagtttattaacttataccaattcgtcctcagatattggcattatctattagtctgaactctgaactcttgaaatggacagtgatattgaagttcttgacaaacatatcaatactttccagagtcaaatatcagaactagctgcagaatgaatgcgagtatttatgagactcatt

SEQ ID NO: 8003 - DNA, 2641 bp, Arabidopsis thaliana
aagcccaaaaggcttcgttatccccaagccatacgagagattacgagtaagtgatacgttagccaaagagtgtcaccaattgattcaatatcccaagaggaagaagaagaagcaagagaagaagaagatagaagcgatttttataaaaatggcggcggatgctctgagaatctcgagttctagttctggttcgttggtttgtaatcttaatggttcacaaagacgacctgttcttcttcctctgtctcatcgtgctacctttctgggtcttcctcctcgtgcttcatcttcttcgatttcttcttcaattcctcagtttctgggtacttctcgtattgggctaggttcttccaagctctcacaaaagaagaaacaattctcagtcttcgctgcagctgaagccgaggcgaagcgggctgtaccgcttaaagattaccgaaacatcggtattatggctcacatagacgcgggaaagacgacaacaaccgagaggattctttactacacaggaagaaactacaaaatcggtgaagtgcatgaagggacagctacaatggattggatggaacaagagcaagaacgaggaatcaccattacttcagctgcaaccacaacgttttgggataaacacaggatcaatattattgatacaccgggtcacgtcgatttcactctggaagttgaacgtgctttaagagttctcgatggagctatatgcttgttcgatagtgttgctggtgttgagcctcagtctgagactgtgtggagacaagctgataaatatggtgtgcctaggatttgctttgttaacaagatggacaggcttggagctaactttttcaggactagggacatgattgtgaccaatttgggtgctaagccgctggtgcttcagataccaattggtgctgaagatgtctttaaaggtgttgttgatcttgtgaggatgaaagctatagtttggtcaggagaagagcttggtgcaaagttcagttacgaggatattccagaagatcttgaagatttggctcaagagtatcgggcggcgatgatggaattgattgttgatttggatgatgaggtcatggagaactatttagaaggagttgagcctgacgaggccacggtaaagagattggttagaaaaggaaccatcacgggcaagtttgtgccaattctatgtggttcagcctttaagaacaaaggagtgcagccattgctcgacgctgtggtcgattatctgccttcgcccgttgaagtcccgccgatgaatggaacagatcctgagaacccggaaattaccattatacggaaaccagatgatgacgagccatttgctgggctagcattcaagatcatgagtgatccttttgtgggttctcttacatttgtgagggtttactcagggaaaatctcagctggttcttacgtgttgaatgctaacaaaggaaagaaggagagaatcggaagactcttggaaatgcacgcaaacagcagagaagatgttaaagtggctttgacaggtgacattatcgctcttgcgggtctcaaagatacaatcactggtgaaaccttgagtgatccagaaaaccccgttgttcttgaacgaatggacttccctgatcccgtcatcaaggtagcgattgagccaaaaacaaaagcagacatcgacaaaatggcgacagggttgatcaagctcgctcaagaagacccgtctttccatttttctcgtgatgaagagatgaaccaaaccgtcattgaaggaatgggagaacttcatctcgagattatcgttgacagacttaaaagagagttcaaggtggaggctaacgttggtgcaccgcaagtcaactaccgtgagagtatctccaaaatagctgaagtgaaatacacacacaagaagcaatcaggtggacaaggtcagtttgctgatattacagtccggtttgagccattggaagcagggtcaggatacgaattcaagagtgagatcaaaggaggagctgtgccaagagagtatattcctggtgtcatgaaaggacttgaggagtgtatgagcaccggtgtgcttgctggtttcccggttgttgatgtccgtgcttgtctagttgacggatcttaccatgacgtagactcaagcgtgctagctttccagcttgctgcaagaggagctttccgtgaagggatgaggaaagcgggtccgagaatgcttgaacctatcatgagagttgaagttgttacaccagaagaacatcttggtgatgtcattggtgatcttaactcacgaagaggtcaaattaacagcttcggagacaaacccggtggtctcaaggtggtcgactctctggttccattggcagagatgtttcagtacgtgagtacattgagagggatgacaaaaggtcgagcttcttacacaatgcaactggctaagttcgacgttgttcctcaacatattcagaaccaactttcatccaaggatcaagaagttgctgcttaaacagattttgttttgcctagacataaaaacttattgtgattttgtttggtctatatagacatgtaagctaatcaaatttgtgaagacaaggttgttattgtcttaaaacgcatggatatgagaaagaaagaaaaattgata

SEQ ID NO: 8004 - DNA, 2619 bp, Arabidopsis lyrata
agtgatacgttagccaaagagtgaccaattgattcaatatcatcaagaagaagaagaagaagaagaagaagaagaagaaagaagcgattttgataaaaatggcggcggatgctctgagaatttcgagttctacttcgggttcgttagtttgtaatcttaatggttcacaaagacgacctgttcttcttcctctgtctcatcgtccaacgtttctgggtcttcctcctcgagcttcatcttcttccatttcttcttcaattcctcagtttctgggtacttctcgtattgggcttggttcttccaagctctcacacaagaagaaattctcagtcttcgctgcagccgaaggagaggctaagcgcgctgtaccgcttaaagattaccgaaacatcggtattatggctcacatagacgcgggaaaaactacaacaactgagaggattctttactacacaggaagaaactacaaaatcggtgaagttcatgaagggacagctacaatggattggatggaacaagagcaagaaagaggaatcactattacctcagctgcaaccacaacgttttgggacaaacataggattaatattattgatacaccgggtcacgtcgatttcactcttgaagttgaacgtgctcttagagttctcgatggagctatatgcttgttcgatagtgttgctggtgttgagcctcagtctgagactgtgtggagacaagctgataaatacggtgtgcctcggatttgctttgttaacaaaatggacaggcttggagctaactttttcaggactagggatatgattgtgaccaatttgggtgctaagccattggtgcttcagattccaattggtgctgaagatgtctttaaaggtgttgttgatcttgtgaggatgaaagctatagtttggtcaggagaagagcttggtgccaagttcagttacgaggatattccagcggatcttgaagatttggctcaagagtatcgggctgcgatgatggaattgattgttgatttggatgatgaggtcatggagaactatttagaaggagttgagcctgacgaggccacggtaaagagattagttagaaaaggaaccatcaccggcaagtttgtgcctattctatgtggttcagcctttaagaataaaggtgtgcagccattgcttgatgctgtggttgattatctgccttcgccggttgaagtcccgccgatgaacggaacagatcctgagaacccggaagttaccattatacggaaaccagatgatgacgagccatttgctgggttagcattcaagatcatgagtgatccttttgtgggttctcttacatttgtgagggtttactcagggaaaatatcggctggttcttacgtgttgaatgctaacaaaggaaagaaggagagaatcggaagactattggaaatgcacgcaaatagcagagaagatgttaaagtggctttgacaggtgacattatcgctcttgcgggtctcaaagatacaatcactggtgagaccctgagtgatccagaaaaccctgttgttcttgaacgaatggacttccctgatcccgtcatcaaggtagcgattgagccaaaaacgaaagcagacattgataaaatggcgacaggattgatcaagctcgctcaagaagacccgtctttccatttttcccgtgatgaagagatgaaccaaaccgtcattgaaggaatgggagaacttcatctcgagattatcgttgacagacttaaaagagagttcaaggtggaggctaacgttggtgcaccacaagtcaactaccgtgagagtatctccaaaatagcggaagtgaaatacacacacaagaagcagtcaggtggacaaggtcagtttgctgatattacagtccggtttgagccattggaagcgggatcaggatacgaattcaagagtgagattaaaggaggagctgtgccaagagagtatattcccggtgtcatgaaaggacttgaggagtgtatgagctccggtgtgcttgctggttatccggttgttgatgtccgtgcttgtctagttgacggatcttaccatgatgtggactcaagtgtgctagctttccagcttgctgcaagaggagctttccgtgaagggatgaggaaagcgggtccgagaatgcttgaacctatcatgagagttgaagttgttacaccagaagaacatcttggtgatgtcattggtgatcttaactcacgaagaggtcaaattaacagcttcggagacaaacccggtggtctcaaggtggtggattctctggttccattagcagagatgtttcagtatgtgagtacattgagagggatgacaaaaggtcgagcttcttacacaatgcaactggctaagttcgatgttgttcctcagcatattcagaacaaactttcagacaaagatcaagaagttgctgcttagaacagattttgttttgcctacacttaaaacttattgtgattttgtttggtctattatataggcatgtaagctaatcaaatttgttattgtcttaaaacacatggatatgagaaaaaaaatcgatatatcagaaaagtctgaaaaatgggacgaattcgatcttagtgtttgg

SEQ ID NO: 8005 - DNA, 2694 bp, Lippia dulcis
gtgtgtgtggagagcaaaaaaatggcggcagcatcagcggagtctctgatgaaaatgtcatctaatgcttcttcaaccctctgcaacttgaatggttcttcgaggaggcccttgccgcccgtatctcgctctacgcgacgtcgtaagagtaattcttctgcgacagttcgcgctctttcttcctcttttctggggagtatgcggctgagctctgctgcagcaaacctgtccaatttgcaacaaaaacagcagagaaggaacttctcggtctttgccatggctgccgatgacaagagaacagtgcctttaaaggactatcgtaacattggtatcatggcccacatagatgcaggcaaaaccaccacaaccgaacgaatcctgtattacaccggtcgaaactacaaaataggtgaggtgcatgaggggacagccacaatggactggatggagcaagaacaagaaagaggcatcacaatcacttctgctgcaaccaccactttctggaacaagcaccgaatcaatataatcgacactcctggccacgttgacttcaccctagaagtggaacgagctctcagagtcctagatggagcaatctgtctgttcgacagtgtcgctggcgtggagcctcaatcagaaactgtatggagacaggctgataaatatggtgttccaagaatttgttttgttaataaaatggatcgtcttggcgccaatttctacagaacaagggacatgatcgtgacgaacctaggcgcgaagcctcttgtgcttcagctcccagttggtgcagaggatacttttaaaggggttattgatcttgttaagatgcaagctattctttggtccggggaagaattgggtgcgaaattttcatacgaggagattccagaagatcttcttgaatttgctcaagaatacagagcccagatgattgaaaacatagttgagcttgatgacgcagctatggaaagctatttggaaggaatcgagcctgatgaggagacaattaagaagttaataaggcaagggactattgcgagcagcttcgttcctgttttgtgtggctcggcttttaagaacaaaggtgttcagcctttactcgatgctgttgttgactacttgccctctcctattgagttgccagcaatgaagggaactgaccctgacgacccggagttggaaattgaaaggaagccgagtgatgaagagccgttttctggattggcgttcaagattatgagtgattcttttgtgggttctcttacatttgtgcgggtatattccggcaagctcgaagctggatcgtatgtgctgaattccaacaaagggaagaaagagaggattggaagactcctggaaatgcatgccaatagcagagaagatgttaaagtcgccctaacgggtgatattgtagctctcgcgggcctaaaagatacaattactggagaaacgttgtgtgatccagaaaatcccgttgttcttgaacggatggatttcccagatcctgttattaaggttgcaattgaacctaagactaaagctgatgctgataagatgactgttgggttgcttaagcttgcccaagaagatccctctttccacttctcacgagatgaagaggtccaccagactgttattgaaggaatgggagaattgcaccttgaaattattgttgataggctcaagagggaatttaaggtggaagccaacgttggagcgccccaagtcaactatcgtgaaagcatttcgaagaccacagaaatcaaatacgtccacaagaaacaatcaggcggcgctggtcaatttgctgatgtcaccattagattcgagccgctagaagcaggaagtgggtatgagttcaaaagtgagatcaaaggaggagcagtgcccaaagaatacattcctggtgtgatgaaaggattggaagaaagcatgtgtaatggagttttggctggatatcctgttgttgatgttcgtgcagtgttggttgatgggtcataccacgatgttgattcaagtgttctagctttccagctggctgccaggggtgcttttagggaagggattcgaaaagcaggcccacaaatgcttgaaccgattatgaaggttgaagtcgtcacacctgaagaacatttgggggatgtgattggagatctcaactcgaggagaggtcagattaacagctttggggataaacctggtggattgaaggtggttgatgcattggtgcctctagctgagatgtttcagtatgtgagttctcttcgaggaatgacgaaaggtcgtgcttcttactctatgcaattggccaaatttgatgttgttcctcagcatattcagaaccagcttgctgcaaaggaggaggctgttactgcttgatttggttttccctgatttgtagttgagaaacataattgtttgttgttgcaaagatgattctttttgtgaggaatggacactgaagatagaagataaagaagagactgttgtatttgtgaacttgccaaatgcggtatgattagtgagggcatttactcgtgtatcattgaatgctgcaatcaagtttttttctgtttgttgtaactggtgatttactgctggtactgaagctagtttatatacagcaaaagtgagatagatacgaagaactacctcctctatgttaatatagttagataaaatgttctgttg

SEQ ID NO: 8006 - DNA, 2530 bp, Tabernaemontana elegans
accagaatcacgcagccagagagtgtgtgtttctgtgtgagaaatggcagcagagtcagttgtgagaatctcttcagcatcaactgcctcctcactttgcaacttcaatggctcttcaagaaggccgctgcttattaactctctgcgacgtggtggtaagagcagcaccactggagctcgctctcttacttctgaattctttggaagtcttcggcttagctcgactaaaaaactctcaactttgaaccagaaacagaggaaacacaacaacaacttcactgtttttgccatggctgccgaggaaggaaagagaaaagtaccgctgatagactatcgcaatattggaattatggctcatatagatgcaggaaagaccaccacaactgagcgaattttgtactacactggtagaaactacaagattggtgaggttcatgaggggacagccacaatggactggatggagcaagaacaagagaggggaattaccattacgtctgccgccactactacattttggaacaagcatcggattaacataattgatactcctgggcatgttgactttacacttgaagtggagcgtgcgcttagggtcttggatggtgcaatatgcttatttgacagtgtcgccggtgttgaacctcaatctgaaactgtctggagacaagctgataaatacggagtccccagaatatgctttgttaacaaaatggatcgtcttggtgcaaatttcttccgcacaagggacatgatagtgacaaacttgggtgcacagccacttgtcattcaaataccaattggttcagaggacaatttccaaggagttgttgatcttgcaaggatgaaagctatagtttggtcaggggaagaattgggcgcaaaattttcctatgaagacattcccgctgaccttcaacagctggctcaagaatatcgagcacagatgattgagaccattgttgagatggatgatgaagctatggagaattatctggaaggagtagagcctgatgaggaaacaattaagaaactaattaggaagggaactatttctggcagttttgttccagttttatgtgggtcagcatttaagaacaagggggttcaaccactgcttgatgcagtggtggattatttgccttctcctattgacttgcctccaataaaggggagtgaccctgagaacccagaagtgacgcttgaaaagccggctgatgatgatgaaccttttgctggattagccttcaagattatgggcgatccttttgtgggatccctaacatttgttaggatttattctgggaagcttagtgcaggatcttatgtgctgaatgcaaacaaaggaaagaaagagagaattggtagactattggaaatgcatgctaatagcagagaggacattaaagtagccttaaccggtgatattgttgctcttgctggtttgaaagatacaattacaggagaaacgttgtgtgatcctgagagtcctgtagtgcttgaaagaatggatttcccagatcctgttattaaggtggcaattgaagccaagacaaaggcagatgttgataagatggccaatggtttgattaagcttgcgcaagaagatccgtctttccacttctccagagatgaagaaaccaaccaaacagttattgaaggaatgggagaactgcaccttgaaattattgttgacaggctcaagagggagtttaaggtagaagctaatgttggtgcaccacaagtgaactacagggaaagcatctctaaagtcgcagaagtcaaatacgttcacaagaaacagtcaggtggtcaggggcagtttgctgatatcactgtaaggtttgaacccatggaagcaggtagtggatatgagtttaagagtgagataaagggaggagcagttccaaaagagtatattccaggtgtgatgaaaggtttagaagagtgcatgagtaatggtgtgctggctggttttcctgtggttgatgttcgtgctgtattggtggatggctcttaccatgatgttgattcaagtgttttggcattccaactagctgcaagaggagcttttagagagggcattagaaaagctggtcccaggatgctagaaccaataatgaaggttgaagttgtcacccctgaagaacatttaggagatgtgattggtgatctaaactcaagaagaggccagatcaacagctttggagacaaacctggtggtctcaaggttgtggatgccttggttcctcttgcagagatgttccaatatgtaagcaccctaagaggaatgacaaaaggtcgtgcttcctacaccatgcacttagccaagttcgatgttgtcccacaacacatccaaaatgagctttccgcaaaggaggaagcagtttctacttaatgtggttagcctttgttttttaagcagagggagtagtggagtgcttttgcactcccatgatatcaggagttgaagtcgattctttttgttagaatgacagtacacaaatagagaaattaatagaaacttaga

SEQ ID NO: 8007 - DNA, 2930 bp, Aristolochia fimbriata
acgaccaaattcctctccttgtgggcccagattggtttccgggaactggttattgggggacccacatgagtgagtggggttcattggaggtggcagttttgatatttcgggaaagacgcgggggcaaaatgttgatgtcttttatataggggtctcctagttctatcttcattcgaatgggcgaaagccgagcctcgtagtttccattatccagcacggagtgcgggagagccataaagatggcggcagaatccgttagaatttctgcgccttcggcctccggtgcggctctcaggaacttgggttcttctcggagggctcttcctctcccttcaaatggcttccttggactcagaaactacgggcggggatttccccacgccgcgcgctcggaattgtttggaaacgtccgtctcagttcgaaatcgttgttacccaccttgcaaccacgaaagggcaggctctccgtcgtcgccatggctgcggaagatggaaagcgggaggtgccactaaaagattatcgcaatatcggtatcatggctcacatagatgcaggaaagactacaacaactgaaagagttctctactacactggaaggaattacaagattggtgaggtacatgaaggaactgcaacaatggactggatggaacaggaacaagagagaggcatcaccataacttctgcggccaccaccaccttttggaacaaacacaggatcaatattattgacacacctgggcatgtggactttactcttgaagttgaacgagctcttagagtgctggatggtgctatttgcttgtttgatagtgttgctggtgtggagcctcaatccgaaactgtgtggagacaagctgacaaatatggtgtccctaggatttgctttgtcaacaaaatggatagattaggagcaaattttttcagaaccagggatatgatagtcacaaatctgggtgctaagcctctggttattcaacttcctataggtgcagaagataactttaaaggagttgttgatctggtgacgatgaaagccattgtctggtctggagaagaattgggcgcaaaatttgtatatgaggagataccagaagacctccaggacctagctcaggaatacagaacacaaatgattgagttgctagttgagatggatgacgaggctatggagaattaccttgaaggagttgaacctgatgaagcaaccatcaagaaacttattagaatgggaaccattgcagcaaaatttgtacctgtattatgtgggtccgcttttaaaaataagggtgttcaacctttgcttgatgcagtagtggattacctaccttccccgcttgacgtgcctccaatgaacggaactgacccagagaaccctgagttggttattgaaaggaaggctagtgatgatgagccattttctggacttgcattcaagatcatgagtgacccatatgttggttccctgacatttgtgagagtctatgcaggtaagctgagtgccggttcttatgtactaaatgcaaacaaagggaagaaagaaagaataggcagacttctggagatgcatgcaaacagtagggaggatgttaaggtagctttaactggtgatatcattgcccttgcgggattgaaagatacgataactggtgaaacactatgtgatccagaccatccagttgtcttagaaaggatggatttccctgaccctgtcattaaagttgcaatagagccaaaaactaaagctgatgtcgataagatggcaattgggctgatcaaactagctcaggaagacccatcattccacttctcgagagatgaagaaatcaaccaaactgttattgaaggaatgggagaactccaccttgagattattgttgatagactgaagagggaattcaaggttgaagcaaatgtgggtgcgccacaagttaactaccgcgagagcatctctagggtatctgaagtgaaatatgttcacaagaaacaatcaggaggacaagggcagtttgcagatattacggtaaggtttgagcccatggaggctggtagtggatatgagtttaagagtgaaataaagggtggtgcagttcccaaagaatacattcctggtgtgatgaaagggttggaagagtgcatgagtaatggtatccttgctgggtatccagttgtggatgtccgtgctgttttggtcgatggatcctaccatgatgtcgattcaagtgtgttggctttccaactggcagcaaggggtgccttccgtgagggtgtaagaaaggcaggtcctagaatgttagaacctataatgaaagttgaagtcgtcaccccagaagagcacttgggtgatgttattggtgaccttaactcaaggagaggtcaaattaacagttttggtgataagcctggtggtctcaaggttgtggatgctctggtacctctagcagagatgttccagtacgtgagtacactccggggaatgacaaaaggtcgtgcatcttacacaatgcaactggccaagtttgatgtggttccgcagcacattcagaaccagctttcgtccaaagaggaagctgttgctgcttgatttcatacaatgcccatcactgctacacgagctgtaggtgccggcgattttccttcttagaatatgtactccgagagtctgaaatgttgtacgttatttatttttatagcgaaagtgtaattagtaactttttttttttttctttttggtattttttggagtaaaaggagttgccaataagcggtacaagctatactcttggctttgtcttcttgaaataacccaacagaaagccagaaaagaaaaggatactgatcccatgtgtgaactgataatgaattaaacttcaaggcttggttgacgcttcaaaataaatatcctggttgaggagcgccttcaatctta

SEQ ID NO: 8008 - DNA, 2624 bp, Flaveria ramosissima
atccatatattcatactatcaagagttgtatcccattgtcacttccagataataatctatctagtggcgcgagttttccaatggcggcagaagctgttaccgccgcttcactctgcaacttctccggcaacaatggtggttcctccgcccgcccgccgctccgccgctacctactttctccctccgcctccctccgtcgccaccaccaccaccaacgttcgcttacgtcatctttcttcgggacgcaacgactcaatccaacaaaattgacttctcacgttcagaagaggaatctctcggttgttgctatggctgcttctgaagatgcaaaacgtgaggttccattgaaggactaccgcaacattggcattatggcccacatagatgctggaaaaacaaccacaacagagcgggtactttactacactggtagaaactacaagattggtgaggtacatgagggtactgccacaatggactggatggaacaagaacaggaaagaggaatcaccataacttcagctgcaaccaccacattttggaacaatcaccgcatcaacatcattgatacacctggccacgtggacttcacacttgaggtggaacgtgcacttagggttcttgatggtgctatttgcttgtttgatagtgttgctggtgttgaaccacagtcagaaacagtgtggagacaagcagataagtatggggtgccaagaatttgctttgttaacaaaatggatcggcttggtgctaacttttttagaacacgtgacatgatagttacaaatttgggtgctaaacctcttgtgctccaactcccaattggggcagaagatgttttcaaaggggttatagatcttgttaggatgaaagccatagtgtggtcgggtgaagaattaggtgccaaattttcatatgaagatattccttctgaccttcaagaattatctgaagagtatcgcgcattgatgctcgagaccattgttgaattagatgacgcggtcatggaagggtatcttgaaggggtggagcccgatgaagagaccgttaagaagttgattagaaagggaaccataggaggtagttttgtaccagttttatgtgggtctgctttcaagaacaaaggggttcaaccattgcttgatgctgttgttgactatttaccctctcctcttgacctgccacctatgaagggtaccgacccagagaacccagaaatcgaaattgatcgggttgcaagtgatgatgaaccgtttgctgggttagctttcaagatcatgaatgacccatttgtcgggtcacttacatttgtaaggatatatgctgggaagcttgctgctggatcttatgtgatgaatgcaaataaaggaaagaaagaaagaattgggagactacttgaaatgcatgccaatagcagagaagatgttaaagtggcattagctggtgatattgttgctcttgcagggttaaaagataccattactggagaaacattatgtgatcctgagaagcccattgtgcttgagagaatggatttccccgatccagttattaaagttgctattgagcctaagaccaaagcagatgttgataaaatggcaaatggattaatcaagcttgcccaagaagatccatctttccatttctcgcgtgatgaggaaattaaccaaacggttattgaagggatgggagaattgcatcttgagattatcgttgatagactcaagagggaatttaaggtggaagcaaatgtaggtgcaccacaagtaaactaccgtgaaagcatttccaaggtgtcagaggtgaagtatgtccacaagaaacagtcaggtggtcaaggacagtttgcagatataaccgtacggtttgagccattagaggcaggtagtggatacgagttcaagagtgagatcaagggtggtgcggtcccaagagaatacatcccaggtgtaatgaaagggttagaagagtcaatgactaatggagtacttgcgggcttccctgttgttgaccttcgtgcagtattaactgatgggtcctaccatgatgttgactctagtgtactagccttccagctggcagccagaggagctttccgtgaaggagtaaggaaagcaggacccaagattttggaacccattatgagagttgaagttgtgacacctgaagaacatttgggagatgttattggtgatctcaattccagaagaggacagattaatagctttggtgataagcctggtggcctcaaggtggtggattcccttgtgccgcttgcggaaatgttccagtatgtgagtactttaagaggaatgacaaaaggtcgagcatcctacactatgcaactagcgaaattcgatgtggtaccacaacacattcagaaccagctctctgctgccaaggaagaagcagttgcaacttgatctgtctttcagtgattctatttaatgtttgttatttttttttctttctactttttattgttttataggacataagaaaatcctccaattttccatcaaaagatatacgaagcaacattcttgattatctattcattaaaatttatgcttatttgctcgatgttgaatacctacttagttaacatgttctgtagtttagaa

SEQ ID NO: 8009 - DNA, 2526 bp, Flaveria ramosissima
aataataatctatctagattctagtggcgccagtgttccaatggcggcagaagctgttaccgccgcttacctctgcaacttctccggcaacaatggtggttccgccgcccgccgccacctcctctctccctccgcctccctccgtcgccaccaccaccaccaacaacaacgttcgcttacgtcatctttcttcggaacacaacgactcaatccaactaaattgacttctcgcgttcagaagaggaatctctcggttgttgctatggctgcctctgaagatgcaaaacgtgaggttcctctgaaggactaccgcaacattggcattatggcccacatagatgctggaaaaactaccacaacagagcgtgtactttactacactggtagaaactacaagattggtgaggtacacgagggtacggccacaatggactggatggaacaagagcaggagagagggatcaccataacttcggctgcaaccaccacattctggaacaatcaccgcatcaacatcattgatacacctggccacgtggacttcacacttgaggtggaacgtgcacttagggttcttgatggtgccatttgcttgttcgatagtgttgctggtgttgaaccacagtcggaaacagtgtggagacaagcagataagtatggggtgcctagaatttgttttgttaacaaaatggaccggcttggtgctaacttttttagaacacgtgacatgattgttacaaatttgggtgctaaaccacttgtgctccaactcccgattggggcagaagatgttttcaaaggggttatcgatcttgttaggatgaaggccatagtgtggtctggtgaagaattaggtgccaaattttcatatgaagatattccttctgaccttcaagaattgtctgaagagtatcgagcattgatgctcgagacaattgttgaattagatgacgaggttatggaagggtaccttgaaggggtggagcctgacgaacagaccgttaagaagttaattagaaagggaaccataggaggtagttttgtaccggttttatgtgggtctgctttcaagaacaaaggggttcaaccattgctcgatgctgttattgactatttaccctctccacttgacttgccacctatgaagggtaccgacccagagaacccagaaatcgaaattgatcgggttgcaagtgatgatgctccttttgctgggttagctttcaagatcatgaatgacccgtttgtcggatcacttacttttgtaaggatatatgctgggaagcttgctgctggatcttatgtgatgaatgcaaataaaggaaagaaagaaagaattgggagattacttgaaatgcatgcaaatagcagagaagatgttaaagtagcattagctggtgatattgttgctcttgcaggattaaaagataccattactggagaaacattatgtgatcctgagaagcccattgtgcttgagcgaatggatttccctgatccagttattaaagttgctattgagcctaagaccaaagcagatatcgataaaatggcaaatggattaattaagcttgcccaagaagatccgtctttccacttctcacgtgatgaagaaattaaccaaacggttatagaagggatgggagaattgcatcttgagattatcgttgataggctcaagagggaattcaaggtggaagcaaatgtaggtgcaccacaagtaaactaccgtgaaagcatatccaaggtatcagaggtgaagtatgtccacaagaaacagtcaggtggtcaaggacagtttgcagatataaccgtaaggtttgagccattagaggcaggtagtggatacgagttcaagagtgagatcaagggtggtgcggtcccaagagaatacatccccggtgtgatgaaagggttagaagagtcaatgaccaatggagtacttgcaggcttccctgttgttgaccttcgggcagtattgactgacgggtcctaccatgatgtcgactctagtgtactagccttccagctggcagctagaggagctttccgtgaaggagttaggaaagcaggacccaagattttggaacccatcatgagagttgaagttgtgacacctgaagaacatttgggagatgttattggtgatcttaattccagaagaggacagattaatagctttggtgacaagcctggtggcctcaaggtggtggattcccttgtgccgctagccgaaatgttccagtatgtgagtactttaagaggaatgacaaaaggtcgagcatcctacactatgcaactagcgaaattcgatgtggtaccacaacacattcagaaccagctttctgctgccaaagaagaagcagttgcaacttaatctttctttcagtgattctatttagtgtttgttattttttttctttcacttttttatgttttataggacataagaaaatacctccaattttcctatcaaaagaatatacaaagcaacattcttgattatgtattcataaatttagttgc

SEQ ID NO: 8010 - DNA, 2570 bp, Ambrosia trifida
tccatatattatttgcagttattatctcatcaccatattatctaatctaatctactggtgcgtctcttccaatggcggcagaagcagttacaatgtcatccaacgccgccctctgcaacttctccggcagcaatattaccacctccctccgccgccgctacctcctctctccctccacctccctccgtccccgtcaccctactcttacctcatctttctttggtacccaacgcctcctcactcctaccaattttaattccaattcgacttctctttcccagaagaggaatctttcggtctttgctatggctgcctctgaagatgtgaaacgtgaggttccgttgaaggactaccgcaacattgggattatggctcacatagacgcgggaaagactacgacaacagagcgtgtgctttactacactggtagaaactacaaaatcggtgaggtgcatgagggtaccgctacaatggactggatggaacaagagcaggagagagggatcactataacttcagctgcaaccaccacgttttggaacaaacaccggattaacattatcgatacgcctggccatgtggacttcacacttgaggtggaacgagcacttagagttcttgacggtgccatttgcttgtttgatagtgttgctggggttgaaccgcagtcggagacggtgtggagacaagcggataagtatggggtgccgagaatttgttttgtgaacaaaatggaccggcttggtgcgaacttttttaggacacgggatatgatagttacaaatttgggtgctaaaccgcttgtgctccaactcccaattggggcagaagatgtttttaaaggggttatagatcttgttaggatgaaggccatagtttggtctggtgaagaattaggtgctaaatttgcatatgaagatattcctgctgatcttcaagagttagctgaagaatatcgtgctttaatgctcgagaccattgttgaattagatgacgaggttatggaagggtatcttgaaggagttgagcctgatgaagcaaccgttaagaggttaattcggaagggaaccattgggggtagttttgtaccggttttatgtgggtcggctttcaagaacaaaggtgttcaaccattgcttgatgctgttgttgactatttaccttctccacttgacttgccacctatgaagggtactgacccagagaacccagaaattgaaattgaacgggttgcaagcgatgatgaagcgttttctgggttagctttcaagatcatgaacgacccgtttgtcgggtctcttacatttgtaaggatatattcagggaagcttgctgctggatcttacgtaatgaacgcaaataaaggaaagaaagaaagaattgggagattacttgaaatgcacgcgaacagccgagaagatgttaaagtagcattagcaggtgatattgttgctcttgcagggttgaaagataccattaccggagaaacactatctgatgccgagaagcctattgttcttgaaagaatggatttccctgatccagttattaaagttgccattgagcctaagaccaaagcagatgttgataaaatggcaaatggattaatcaagcttgcacaagaagatccgtctttccacttctcacgcgatgaagaaattaaccaaacggttatcgaagggatgggagaattgcatcttgagattattgttgataggctcaagagggaattcaaggtggaagcaaatgtaggcgcaccgcaagttaactaccgtgaaagcatttccaggatggcagaggtgaagtatgtccacaagaaacaatcaggcggtcaaggacagtttgcagacataaccgtacggttcgagccattagaagcaggtagtggatacgagttcaagagtgagatcaagggtggtgcggtcccaagagaatacatccctggtgtaatgaaagggttagaagagtcaatgtctaatggagtactcgctggcttccctgttgttgacctccgtgcagtattgactgatgggtcctaccatgatgttgactctagtgtactagccttccagctggcagctagaggagctttccgtgaaggagttaggaaagcggctcccaagattttggaacccattatgagagttgaagttgtgacacctgaagaacatttaggagatgttattggtgatcttaattccagaagaggacagattaatagctttggtgacaagcctggtggcctcaaggtggtggattcgcttgtgccgctagcagaaatgttccagtatgtgagtacgttaagaggaatgacgaaaggtcgagcttcttacactatgcaactagcgaaattcgacgtggtacctcaacacattcagaaccagctttcagctgccaaagaagaagcagttacagcttaatctctcttcctgtaattctattttatgtttgtaatttttttcagttctcatgttttataggacaatatgaaatgcctccaattttccagcaacagatatacgaagcaacatgtttatttatccattcataaattttgctcaaaaaagaaa

SEQ ID NO: 8011 - DNA, 2869 bp, Solanum lycopersicum
taaacaagtacaaatataaacacactataaccagaaaaacagaggaggagaaaaagaaatggcagcagagtcagtgacaagaatgtcatctgctgcttcttcactttgtaactttaatgggtctaaaagacccgtacccgtttctaacagggtcacttcttctaggaggaatcgatgtgttaaactacagtcacttgcttctgcttccatgtctgaattctttggtagttcacgagtgttctctgttaatggttctagaagcttagggttatctcagaaaacaagaaagaatggattttctgttattgctatggctgctgctgaagaggagaagagaacagtgcctttgaaggactatcgcaatataggaattatggctcatatagatgcagggaagacaactacaacggaaagggtcctttactatactggcagaaactataaaattggtgaagtgcatgagggaactgccacaatggactggatggagcaagagcaagagagggggattacaattacttctgctgctactaccaccttctggaacaagcatcgcatcaacattattgatactcctggtcacgtggacttcactcttgaagtagagcgtgcccttagggttttagatggtgctatatgcttgtttgacagtgttgctggtgtggaacctcaatcagaaactgtttggagacaagctgataaatacggagtccctaggatatgtttcgtaaataagatggatcgtcttggagctaatttcttccgaacaagagacatgatagtaacaaacttgggtgctaaaccacttgtaattcagataccaattggtgcagaggatacattcaaaggattagttgatcttgtgatgatgaaagctattgtttggtccggagaagaattaggggcaaagttttcctatgaggacattcctgctgatcttcaagagctagctgaggagtatagggcactgatgattgagactgtagttgaattggatgatgatgttatggagaaatacctggaaggagttgaacctgatgaggcaaccatcaaacagttgatcaggaagggaactatatctggtaattttgtccctgtattgtgtggctcagctttcaagaacaagggggttcagccgctgctcgatgcagttgtggattatttgccttctccagttgacgtgccacccatgaatggaactgaccctgacaacccagaagtaatcattgagagggcccctagtgatgatgaaccatttactggtttggcatttaagatcatgaatgatccttttgttgggtctctcacatttgttagggtatattcaggaaagcttagtgcaggatcgtatgtattgaatgcaaacaaaggcaggaaagagagaattggcagacttctggaaatgcatgctaacagtagagaggatgtaaagacagcgttaactggtgatattgttgctcttgctggattgaaagatacaattacaggagagacattgtctgatcccgagaagcctgttgtgcttgagcgcatggatttcccagatcctgttataaaggttgcaattgaacctaagaccaaggcagacattgataagatggcgcaaggtttaataaaactggcacaagaggatccgtctttccatttttcacgtgatgaggagattaaccagacagttattgagggaatgggagaattacatcttgagatcattgtagatcgactgaaaagggaatttaaggtggaagctaatgtcggagctccacaagtcaactaccgcgagagcatttccaggaactcagaagtaaaatacgtgcataagaagcagtctggtggttcaggacagtttgctgatatcacagtaaggtttgaacccatggaagcaggtggtggatatgaattcaagagtgaaatcaagggaggtgcagtgccaaaagaatatatccctggtgttatgaagggattagaagaatgcatgagtaacggagtactggcaggctttccagttgttgatgttcgtgctgtgctagtagatggatcttaccatgatgtggattcaagtgttttggcattccagctggctgctcggggagcttttagggaagggatgagaaaagctggtccacaattgctagaacccataatgaaggttgaagtagttacaccagaagaacatctaggggatgtgattggtgaccttaactcaaggagaggccagatcaacagctttggagacaagcctggaggtctcaaggtggtggattctttagttccattagcagagatgttcaattacgttagtaccttgcgaggaatgacaaaggggcgtgcatcgtatgttatgcagttagccaaatttgacgttgtccctcaacacattcaaaaccagcttgccaaaaaggaggaagcagctgctgcttagtcagtcatcttccagattttggatccacaaacttgaaaataggtatttttactcgacgaagatgttaaggcttgcacaacattctttttgtacgtaccagcatgaaacaccgatggagaatagctgatatttagttatgcgtctgagttttttcagacgtttgtgtatgttgttgagttataagctgagactccgaagagacggaagaaagaaagaaggaaatgtgtatacatgcatttaagatgtctctacatccaaaagaagcatcaatattttagggcaagattgagtgtgtctccgattgtgggattatttttcttactatagaaataaatatatgctttgtaacaatctgatgctctttattgagatcttaggtgtaacatctgacgattttgagttgcttatttcacgtttgtttttactttgcacttctgttataatatt

SEQ ID NO: 8012 - DNA, 2869 bp, Solanum lycopersicum
taaacaagtacaaatataaacacactataaccagaaaaacagaggaggagaaaaagaaatggcagcagagtcagtgacaagaatgtcatctgctgcttcttcactttgtaactttaatgggtctaaaagacccgtacccgtttctaacagggtcacttcttctaggaggaatcgatgtgttaaactacagtcacttgcttctgcttccatgtctgaattctttggtagttcacgagtgttctctgttaatggttctagaagcttagggttatctcagaaaacaagaaagaatggattttctgttattgctatggctgctgctgaagaggagaagagaacagtgcctttgaaggactatcgcaatataggaattatggctcatatagatgcagggaagacaactacaacggaaagggtcctttactatactggcagaaactataaaattggtgaagtgcatgagggaactgccacaatggactggatggagcaagagcaagagagggggattacaattacttctgctgctactaccaccttctggaacaagcatcgcatcaacattattgatactcctggtcacgtggacttcactcttgaagtagagcgtgcccttagggttttagatggtgctatatgcttgtttgacagtgttgctggtgtggaacctcaatcagaaactgtttggagacaagctgataaatacggagtccctaggatatgtttcgtaaataagatggatcgtcttggagctaatttcttccgaacaagagacatgatagtaacaaacttgggtgctaaaccacttgtaattcagataccaattggtgcagaggatacattcaaaggattagttgatcttgtgatgatgaaagctattgtttggtccggagaagaattaggggcaaagttttcctatgaggacattcctgctgatcttcaagagctagctgaggagtatagggcactgatgattgagactgtagttgaattggatgatgatgttatggagaaatacctggaaggagttgaacctgatgaggcaaccatcaaacagttgatcaggaagggaactatatctggtaattttgtccctgtattgtgtggctcagctttcaagaacaagggggttcagccgctgctcgatgcagttgtggattatttgccttctccagttgacgtgccacccatgaatggaactgaccctgacaacccagaagtaatcattgagagggcccctagtgatgatgaaccatttactggtttggcatttaagatcatgaatgatccttttgttgggtctctcacatttgttagggtatattcaggaaagcttagtgcaggatcgtatgtattgaatgcaaacaaaggcaggaaagagagaattggcagacttctggaaatgcatgctaacagtagagaggatgtaaagacagcgttaactggtgatattgttgctcttgctggattgaaagatacaattacaggagagacattgtctgatcccgagaagcctgttgtgcttgagcgcatggatttcccagatcctgttataaaggttgcaattgaacctaagaccaaggcagacattgataagatggcgcaaggtttaataaaactggcacaagaggatccgtctttccatttttcacgtgatgaggagattaaccagacagttattgagggaatgggagaattacatcttgagatcattgtagatcgactgaaaagggaatttaaggtggaagctaatgtcggagctccacaagtcaactaccgcgagagcatttccaggaactcagaagtaaaatacgtgcataagaagcagtctggtggttcaggacagtttgctgatatcacagtaaggtttgaacccatggaagcaggtggtggatatgaattcaagagtgaaatcaagggaggtgcagtgccaaaagaatatatccctggtgttatgaagggattagaagaatgcatgagtaacggagtactggcaggctttccagttgttgatgttcgtgctgtgctagtagatggatcttaccatgatgtggattcaagtgttttggcattccagctggctgctcggggagcttttagggaagggatgagaaaagctggtccacaattgctagaacccataatgaaggttgaagtagttacaccagaagaacatctaggggatgtgattggtgaccttaactcaaggagaggccagatcaacagctttggagacaagcctggaggtctcaaggtggtggattctttagttccattagcagagatgttcaattacgttagtaccttgcgaggaatgacaaaggggcgtgcatcgtatgttatgcagttagccaaatttgacgttgtccctcaacacattcaaaaccagcttgccaaaaaggaggaagcagctgctgcttagtcagtcatcttccagattttggatccacaaacttgaaaataggtatttttactcgacgaagatgttaaggcttggacaacattctttttgtacgtaccagcatggaacaccgatggagaatagctgatatttagtcatgcgtctgagttttttcagacgtttgtgtatgttgttgagttataagctgagactccgaagagacggaagaaagaaagaaggaaatgtgtatacatgcatttaagatgtctctacatccaaaagaagcatcaatattttagggcaagattgagtgtgtctccgattgtgggattatttttcttactatagaaataaatatatgctttgtaacaatctgatgctctttattgagatcttaggtgtaacatctgacgattttgagttgcttatttcacgtttgtttttactttgcacttctgttataatatt

SEQ ID NO: 8013 - DNA, 2612 bp, Ambrosia trifida
cacaaaaaaacttatcccaaaaattggagtattttctatccaaaacaaaacacagacaactccaccaatccatatattatttgcagttattatctcatcaccatattatctaatctaatctactggtccgtctcttccaatggcggcagaagcagttacaatgtcatccaacgccgccctctgcaacttctccggcagcaatattaccacctctctccgccgccgctacatcctctctccctccacctccctccatccccgtcaccctactcttacctcatctttctttggtacccaacgcctcctcactcctaccaaatttaattctaattcgacttctctttcccagaagaggaatctttccgtctttgctatggctgcctctgaagatgtgaaacgtgaggttccgttgaaggactaccgcaacattgggattatggctcacatagacgcgggaaaaactacgacaacagagcgtgtgctttactacactggtagaaactacaaaatcggtgaggtgcatgagggtaccgctacaatggactggatggaacaagagcaggagagaggtatcactataacttcagctgcaaccaccacgttttggaacaaacaccggattaacattattgatacgcctggccacgtggacttcacacttgaggtggagcgagcccttagagttcttgacggtgctatttgcttgtttgatagtgttgctggggtcgagccgcagtcggagacagtgtggagacaagccgataagtatggggtgccgagaatttgttttgtgaacaaaatggaccggcttggtgcgaacttttttaggacacgggatatgatagttacaaatttgggtgctaaaccacttgtgctccaactcccaattggggcagaagatgtttttaaaggggttatagatcttgttaggatgaaggccatagtttggtctggtgaagaattaggtgctaaatttacatatgaagatattcctgctgaccttcaagaattagctgaagaatatcgcgctttaatgctcgagaacattgttgaattagatgacgaggttatggaagggtatcttgaaggagtcgagcctgatgaagcaaccgttaagaggctaattcggaagggaaccattgggggtagttttgttccggttttatgtggttcggctttcaagaacaaaggggttcaaccattgcttgatgctgttgttgactatttaccttctccacttgacttaccacctatgaaaggtactgacccagagaacccagaagttgaaattgaacgggttgcaagcgatgatgaagcgttttctgggttagctttcaagatcatgaacgacccgtttgtcgggtcgcttacatttgtaaggatatattctgggaagcttgctgctggatcttacgtaatgaacgcaaataaaggaaagaaagaaagaattgggagattacttgaaatgcacgcgaacagcagagaagatgttaaggtagcattagcaggtgatattgttgctcttgcagggttgaaagataccattaccggagaaacactatctgatgccgagaagcctattgttcttgaaagaatggatttccctgatccagttattaaagttgccattgagcctaagaccaaagcagatgttgataaaatggcaaatggattaatcaagcttgcacaagaagatccgtctttccacttctctcgtgatgaagaaattaaccaaacggttatcgaagggatgggagaattgcatcttgagattattgttgataggctcaagagggaattcaaggtggaagcaaatgtaggcgcaccgcaagttaactaccgtgaaagcatttccaggatggcagaggtgaagtacgtccacaagaaacaatcaggtggtcaaggacagtttgcagacataaccgtacggttcgagccattggaggctggtagtggatacgagttcaagagtgagatcaagggtggtgcggtcccaagagaatacatccctggtgtaatgaaagggttagaagagtcgatgtctaatggagtacttgctggcttccctgttgttgacctccgtgcagtattgactgatgggtcttaccatgatgttgactctagtgtactagccttccagctggcagctagaggagctttccgtgaaggagttaggaaagcggcacccaagattttggaacccattatgagagttgaagttgtgacacctgaagaacatttaggagatgttattggtgatcttaattccagaagaggacagattaatagctttggtgacaagcctggtggcctcaaggtggtggattcacttgtgccgctagcagaaatgttccagtatgtgagtacgttaagaggaatgacaaaaggtagagcatcttacactatgcaactagcgaaattcgacgtggtacctcaacacattcagaaccagctttcagctgccaaagaagaagcagttacagcttaatctctcttcctgtaattctattttatgtttgttaattttttttcagttctcatgttttataggacaatatgaaatgcctccaattttccatcaacagatatacgaagcaacatgtttatttatc

SEQ ID NO: 8014 - DNA, 2449 bp, Ambrosia trifida
gttacaatgtcatctaacgccgccctctgcaacttctccggcagcaatattaccacctctctccgccgccgctacctcctctctccctccacctccctccgtccccgtcaccctactcttacctcatctttcttcggtacccaacgcctcctcactcctaccaattcgacttctctttcccagaagaggaatctttccgtctttgctatggctgcctctgaagatgtgaaacgtgaggttccgttcaaggactaccgcaacattgggattatggctcacatagacgctgggaaaactacgacaacagagcgtgtgctttactacactggtagaaactataaaattggtgaggtgcatgagggtaccgctacaatggactggatggaacaagagcaggagagagggatcactataacttcagctgcaaccaccacgttttggaacaaacaccggattaacattatcgatacgcctggccacgtggacttcacacttgaggtggagcgagcccttagagttcttgacggtgccatttgcttgtttgatagtgttgctggggttgaaccgcagtcggagacggtgtggagacaagcggataagtatggggtgccgagaatttgttttgtgaacaaaatggaccggcttggtgcgaacttttttaggacacgggatatgatagttacaaatttgggtgctaaaccgcttgtgctccaactcccaattggggcagaagatgtttttaaaggggttatagatcttgttaggatgaaggccatagtttggtctggtgaagaattaggtgctaaatttgcatatgaagatattcctgctgatcttcaagagttagctgaagaatatcgcgctttaatgctcgagaccattgttgaattagatgacgaggttatggaagggtatcttgaaggagtcgagcctgatgaagcaaccgttaagaggttaattcggaagggaaccattgggggtagttttgttccggttttatgtggttcggctttcaagaacaaaggggttcaaccattgcttgatgctgttgttgactatttaccttctccacttgacttgccacctatgaagggtactgacccagagaacccagaaattgaaattgaacgggttgcaagcgatgatgaagcgttttctgggttagctttcaagatcatgaacgacccgtttgtcgggtcacttacatttgtaaggatatactctgggaaacttgctgctggatcttacgtaatgaatgcaaataaaggaaagaaagaaagaattgggagattacttgaaatgcacgcgaacagccgagaagacgttaaggtagcattagcaggtgatattgttgctcttgcagggttgaaagataccattaccggagaaacactatctgatgccgagaagcctattgttcttgaaagaatggatttccctgatccagttattaaagttgccattgagcctaagaccaaagcagatgttgataaaatggcaaatggattaatcaagcttgcacaagaagatccgtctttccacttctcacgcgatgaagaaattaaccaaacggttatcgaagggatgggagaattgcatcttgagattattgttgataggctcaagagggaattcaaggtggaagcaaatgtaggcgcaccccaagttaactaccgtgaaagcatttccaggatggcagaggtgaagtacgtccacaagaaacaatcaggtggtcaaggacagtttgcagacataaccgtacggttcgagccattagaagcaggtagtggatacgagttcaagagtgagatcaagggtggtgcggtcccaagagaatacatacctggtgtaatgaaagggttagaagagtcgatgtctaacggagtactcgctggcttccctgttgttgacctccgtgcagtattgactgatgggtcctaccatgatgttgactctagtgtactagctttccagctggcagctagaggagctttccgtgaaggagttaggaaagcggctcccaagattttggaacccattatgagagttgaagttgtgacacctgaagaccatttaggagatgttattggtgatcttaattccagaagaggacagattaatagctttggtgacaagcctggtggcctcaaggtggtggattcgcttgtgccgctagcagaaatgttccagtatgtgagtacgttaagaggaatgacaaaaggtagagcatcttacactatgcaactagcgaaattcgacgtggtacctcaacacattcagaaccagctttctgctgccaaagaagaagcagttacagcttaatctctcttcctgtaattctatttatgtttgtaattcttttcacttgtcatgttttataggacaatatgaaatgcctccaattttccagcaacagatatacgaagcaacatgtttatttatccattca

SEQ ID NO: 8015 - DNA, 2463 bp, Arnica chamissonis
gcgcgacactttcaatggcggcagaagctgttaccgccgcttcactctgcaacttctccggtagcaatgttggttcctcgagcaggccgccactccgttgcttcattctttctccctctacctccctccgtcgccatcatctccaccagcaacgtagtcttacgtcccctttcgtcggaacgcaacgcctcactccaatcaaatcgacctctcactttcagaagaggaatctttcggtttttgctatggctgctactgaagattctaaacgtgaggttccattgaaggactaccgcaacattggcattatggcccatatagatgctggaaaaactaccacaacagaacgtgtactttactacactggtagaaactacaaaattggtgaggtacatgaaggtaccgccacaatggactggatggaacaagaacaggaaaggggaatcaccataacttcagctgcaacgaccacattctggaacaaacaccgtatcaacatcattgatacacctggtcacgtggacttcacacttgaggtggaacgtgcccttagggttcttgatggcgccatttgcttgttcgatagtgttgctggtgttgaaccacagtcagaaacggtgtggagacaagcagataagtatggggtgccaagaatttgttttgttaacaaaatggaccggcttggtgctaacttttttagaacacgtgacatgatagtgtcaaatttgggtgccaaaccacttgtgctccaactcccgattggggccgaagatgtttttaaaggggttatagatattgttaagatgaaagccattgtttggaatggtgaagaattaggtgccaaattttcatatgaagatattccttctgatcttcaagaattatctgaagaatatcgagcattaatgtttgagaccattgttgatttagatgatgaggttatggaagggtatcttgaaggggtcgagcctgatgaagaaaccgttaaaagattaattaggaagggaaccataggaggtagttttgtaccggttttatgcgggtcagctttcaagaacaaaggggttcaaccattgcttgatgctgttgttgactatttaccttctccaattgacttgccacctatgaagggtaccgaaccagataacccggaaattgaaattgaacgggttgcaagtgatgatgaaccgttttctgggttagctttcaagatcatgaacgacccgtttgtcgggtcacttacatttgtaaggatatatgctgggaagcttgctgctggatcttatgtactgaatgcaaataaaggaaagaaagaaagaattgggagattacttgaaatgcacgcaaatagcagagaagatgttaaagtagcattagctggtgatatcgttgctcttgcagggttaaaagataccgtgaccggagaaacattatgtgatcctgagaagcctattgttcttgagagaatggatttccctgatccagttattaaagttgctattgagcctaagacgaaagcagatgttgataaaatggcaaatgggttaatcaagcttgcacaagaagatccgtctttccacttctcacgtgatgaagaagttaaccaaacagttattgaagggatgggagaattgcatcttgagattatcgttgataggctcaagagggaattcaaggtagaagcgaatgtaggtgcaccacaagtgaactaccgtgaaagcatttccagggtgtcggaggtgaagtatgtccacaagaaacagtcaggtggtcaaggacagtttgcagatataactgtacggttcgagccattagaggcaggtagtggatacgagttcaagagtgagatcaagggtggtgcagtcccaagagaatacatcccaggtgtaataaaagggttagaagaatcgatgtctaatggagtactagcgggataccctgtggttgacgttcgtgcagtattgactgatgggtcctaccatgatgttgactccagtgtactagccttccagctggcagctagaggagctttccgtgaaggagttaggaaagcagcacccaagattttggaacccattatgagagttgaagttgtgacgcctgaagaacatttgggagatgttattggtgatcttaactccagaagaggacagattaatagctttggtgacaagcctggtggcctcaaggtggtggattcgcttgtgccgctagcggaaatgttccagtatgtgagtactttaagaggaatgacaaaaggtcgagcatcttacactatgcaactagcaaaattcgatgtggtacctcaacacattcagaaccagctttctgctgccaaagaagaagcagttacagcttaatcgtaattcctgtaatttgattcaatgttcgtaatttttaacttctcatgttttataggaccatatgaaaatcctcaattttccacaaaaaggtatacgaagc

SEQ ID NO: 8016 - DNA, 2458 bp, Helianthus annuus
ctcttccttcctatggcggccgaagcttcactctgcaacttctccggcaccaatgtctcctcgccgcccctccgccgctacctcctctccccctcctcctccttccgctgtcgccatctccgccaacaacgtaatcttacgtcatctttcttcggaacccaacgcctcaattccaccaaattcaactcaaattctcacttccagaagcgaaatctctccgtttttgccatggctgcttccgaagatgtgaagcgtgaggttccgttgaaggactaccggaacaccggtatcatggcacacatagacgccggaaaaacgacgacaacagagcgtgtgctttactacacgggtagaaactacaaaatcggtgaggtgcacgagggtacggctacaatggactggatggaacaagagcaggagagggggattacgataacttcggctgctacgaccacgttctggaacaaacaccgaatcaacattatcgatacacctggccacgtggacttcacgcttgaggtggagcgagcgcttagagttcttgacggtgccatttgcttgtttgatagtgttgctggggttgaaccgcagtcggaaacggtgtggaggcaagcggataagtacggggtgccgaggatttgttttgtgaacaagatggaccggcttggtgctaacttttttagaacgcgtgatatgatagttacgaatttgggtgctaaaccgcttgtgctccaactcccgatcggtgcagaagatgtgtttaaaggggttatagatcttgttaggatgaaagccatagtttggtccggtgaagaattaggtgctaaatttgcgtatgaagatattcccgctgatcttcaagagttagcggaagaatatcgcgcgttaatgctcgagacgattgtcgaattagatgacgaggttatggaagggtatcttgaaggggttgagcccgatgaagcaacagttaagaggttggtaaggaagggaaccatcgggggtagtttcgtaccggttttatgcgggtcagctttcaagaacaagggggttcaaccgttgctcgatgccgttgttgactatttaccatctccgcttgacttgccgcccatgaagggtaccgacccagagaacccggagatcgaaatcgaacggcttgcaagtgatgacgaagcgttttccgggttagctttcaagatcatgaacgacccttttgttgggtcacttacattcgtacggatatattccgggaagcttgctgctggatcctacgtaataaacgcaaataagggaaagaaagaaagaatcgggagattacttgaaatgcacgcgaatagccgagaagacgttaaggtagcgttagctggtgatattgttgctcttgcagggttgaaagataccattaccggagaaacactatcagatcccgagaagcctattgttcttgaaagaatggatttccctgatcccgttattaaagttgctatcgagcctaagaccaaagccgatgtcgataaaatggcaaatgggttaatcaagcttgcgcaagaagatccgtctttccacttctcgcgtgatgaagaaattaaccaaacggttatcgaaggaatgggagaattgcatcttgaaattattgttgataggctcaagagggaattcaaggtggaagcgaatgtaggtgccccacaagtaaactaccgtgaaagcatttccaggacggcagaggtgaagtacgttcacaagaaacaatcaggtggtcaaggacagtttgcagatataaccgtacggttcgagccattagaggcaggtagcggatacgagttcaagagtgagatcaagggtggtgcggtcccaagagaatacatccctggtgtaatgaaagggttagaagagtcgatgtctaacggagtactcgcaggcttccctgttgttgaccttcgtgcagtgttgactgatgggtcctaccacgacgttgactctagtgtactcgccttccagctggcagctagaggagctttccgtgatggagttaggaaagcggcacccaagattttggaaccgataatgagcgttgaagttgtgacacctgaagaacatttgggagatgttatcggtgatcttaattcgagaagaggacagattaatagcttcggtgacaagcctggtggcctcaaggtggtggatgcgcttgtgccgcttgcggaaatgttccagtatgtgagtacattaagaggaatgacgaaaggtcgagcgtcttacactatgcaactagcgaaattcgatgtggtacctcaacacattcagaaccagctttctgctgccaaagaagaagcagttacagcttgatctttcttcctgtaattctatttaatgtttgtaatttttttggcttctcatgttttataggaccatatgaaaatcatccaattttccacaagaagatatacgaagcaacatgttt

SEQ ID NO: 8017 - DNA, 2644 bp, Triphysaria pusilla
ctctcattatcccttacttcgtatgactgctcgctctgtttccacttcttctccgtcacagaaatagcacacactagtgtgtgaagaaaacgaaaatggcggcagcatcggcagaggcgatgatgaaaatctcatctaatgctctctgcaacttaaatggttcttcgaggaggcctttgcccccaacctctcagtccctacgacgtcgtaagagtaattactcctctcggacggttcgagctctttcttcttcttttctcgggagcctagggttcgcttctacttctactaggctctcaatattgcaaaaccaacagaaaagaaggaatttctctgtatttgccatggctggtgatgataaaagaacagtcccactaaaggactaccgtaacatcggaatcatggcccacatagacgctggaaaaactacaacgaccgagcgagtcctttactacactggtcgaaactacaaaatcggggaagtgcacgagggcacagccacaatggactggatggagcaagaacaagaacgagggattaccatcacctcagccgccaccaccacgttctggaataagcaccgaatcaacataatcgacacccccggccacgttgacttcacccttgaagttgagcgtgcccttcgcgtcctagacggtgcgatatgcttgttcgacagtgttgccggtgtcgagccccagtctgaaaccgtctggaggcaggccgataaatatggtgtcccaagaatatgtttcgtcaacaaaatggaccgtctcggggcgaactttttccggacgagggacatgatcgtgtccaacctcggggcaaaaccgcttgtgctccaaatcccgattggcgcggaggatacttttaagggggttatcgatctagtgaagatgcaagcaattatttggtctggcgaggaattgggtgcgaaattttcatacgaggagattcctgaggatcttaaggagttgtcggaagaatacagggctcagatgattgaaaacatagttgagcaagatgacgaagctatggagggatatctggaagggatcgagcctgatgaggccatgattaagaagctaattaggctaggaaccattgcgaacagttttgttccagttctatgcgggtcagcctttaagaacaaaggggttcagccgttactggatgcggttatagattatctgccctctccccttgacgtgccaccgatgaaggggacagaccccgacgaccccgagttgatcattgagaggaaaccgagcgatgacgagccgttttctgggttggcttttaagataatgagtgattcttttgtgggttcgcttacgttcgtacgagtgtattctggaaagcttggtgctgggtcgtatgtaataaatgcgaacaagggaaagaaagagaggattggtcgactcttggaaatgcacgctaacagtagagaggacgtcaaggtggccttaactggcgatattatagctcttgcgggtttaaaggacacgattactggggagacattgtgtgatccggagaatcctgttgttcttgaacggatggacttcccggatcctgtgatcaaggttgcgattgaaccaaagacgaaagctgatattgataagatggcggttggtttaattaagctagctcaggaagatccgtctttccacttttcccgagatgaagagattaaccaaacagttattgaaggaatgggtgaattgcaccttgaaattattgtggataggctcaagagggagtacaaggtggaagccaatgttggagcacctcaagtcaactaccgtgaaagcatttccaaggtcacggaagtcaaatacgttcacaagaaacaatccggtggttcaggtcagtttgctgatatcacggttaggtttgagcctctagaagcaggaagtggatacgagttcaaaagcgagatcaagggaggttcagtcccaagagagtacattccaggtgtggagaaaggattagcagagagcatgccgaacggggtcttagctggctatcctgtggttgatgtgcgtgcagtactagtagacgggtcctaccatgatgtcgactcgagtgttttggccttccaactggcggccagaggagcatttagagaaggaataaggagggctggcccacagatgctcgaaccaatcatgaaagttgaagttgtcacacctgaagatcatttgggagatgtgattggcgatctcaactcacgaagaggtcagatcaacaactttggagataaacctggtggcttgaaggtggttgatgcggaggtaccgctagctgagatgtttcagtatgtgagtactcttcgaggaatgacaaaaggacgagcttcttacactatgcagttggccaaatttgacgtcgtccctcaacatattcagaacaagctggccgataagggcgaagccgttactgcttgatatgggttttcaggtttcttgctagttaaacacaatgtaacatttcaaagatgatttttttgtgtgtgtgcgtaactgtaaacaagtcaaactgggggatgtaaaatacataaaggggcagcctcgattgtctgcattatttatgaacttgttaaatgagttttgattttttaacgacatttgattttttaatc

SEQ ID NO: 8018 - DNA, 2531 bp, Lactuca sativa
cattacccgaaaatttttagtggcggagattacacatggcggcagaatctgttgccgcagcttcactctgcaacttctccggtaacaatggtagttcctcaagcaggccgctccgtcgcttctttctctctcccgccacctccctccgtcgccgtagtcttacctcatcttttttcggaacccaacggctgacaacaaacatatcgacttctcactttcaaaagaagaacctttcggttttcgccatggctgctggtcccgaagatggaaagcgtggggttccattgaaggactacagaaacatcggcatcatggcccacatagatgcaggaaaaaccacaacaacagaacgtgttctttactacacaggaagaaactacaaaattggcgaagtacatgaaggaacagctacaatggactggatggaacaagaacaagaaagaggaatcaccataacttcagcagccaccaccaccttctggaacaaccaccgcatcaacatcatcgatacaccaggccacgtggacttcacccttgaagtagaaagagcccttagggttcttgatggagccatttgcttgtttgatagtgttgcaggtgttgaaccacaatcagaaaccgtttggagacaagctgataaatatggagttccaagaatttgctttgttaacaaaatggacagattaggagcaaacttctttagaacacgtgacatgattatttcaaatttaggtgctaaaccacttgtgttacaactcccaattggggcagaagatgtgttcaaaggggttattgatcttgtaagaatgaaagccatagtttggggaggtgaagaactcggtgctaagttttcatatgaagatattccttctgatcttcaagaattatcagaagaatatcgcgctttattggttgaaaatattgttgagctagatgatgttgtcatggaggcgtatcttgaaggggtagagccagatgaggacacaatcaagaaactaatcagaaagggtacaatcgggggtagttttgtcccagttttatgtggatcagctttcaaaaacaaaggagtacaacctttacttgatgctgttgttgactatttaccctcacctcttgatgttccccctatgaagggtactgatccggaaaatccagaaattgaaattgaaagaattgcaaatgataatgaaccgtttgctggtttagctttcaagattatgaatgatccttttgtggggtcccttacttttgtaagggtatatgcgggaaaacttgctgctggatcttatgttatgaatgcaaacaaaggaaagaaagaaagaattgggagattacttgaaatgcacgcgaatagtagagaagatgttaaagttgcattaactggtgatattgttgcccttgcagggttgaaagatacgattactggagaaacattgtgtgatcctgaaaagccgattgtgcttgaaagaatggatttccctgatccggttattaaagttgctattgaaccaaagactaaagcagatgttgataagatggcgaatgggttgattaagcttgcacaagaagatccatcttttcatttttcacgtgatgaagagattaatcaaacggttattgagggaatgggagaattgcatcttgagattattgttgataggctcaagcgggaattcaaggtggaagcaaacgttggagcaccacaagtgaactaccgtgagagcatatcgcgtgtatccgaggtcaaatacgtccacaaaaaacaatcaggcggacaagggcaattcgcggacataaccgtacggttcgagcctctagaagcgggaacgggatacgaattcaaaagcgaaatcaagggtggggcggtcccacgtgagtacattccaggtgtaatcaaagggctagaagagtcaatgtccaatggggtagttgcagggtaccctgtggttgaccttcgggcagttttgaccgatgggtcctaccatgatgttgactccagtgtccttgcgttccagctggcagcacgaggggcgtttcgggaaggtgttaggaaagctgctccaaagatcttggagccgattatgagagttgaagttgtgacgcctgaagaacatttgggggatgtgattggggatttgaattcgagaagagggcagattaatagctttggtgataagcctggtggacttaaggtggtggattctttggtcccacttgcggaaatgtttcagtatgtgagtactttaaggggaatgacaaaagggagagcttcttacacaatgcaattagctaaatttgatgttgtgcctcaacatattcagaaccagctttctgctgctaaagaagaagctgtggcagcttgatcttcatcttcatctttgtgctatttaatgataggggaattttctgattttcacttcatatgtcaatataggaaaaaaaaaacaaaaacaaaggattcgagttttggttgaatgatataccatgtaacatttttaatttattaattcgtggtgattttgtgtttgttg

SEQ ID NO: 8019 - DNA, 2563 bp, Aquilegia formosa
atggcttcagagtcattaagaatatctgtttctggttcaactttctgcaactttcatggctctagaagacctcattctgttcaagctcatcaatttcatggttttaataactttaatcgttcttcttttgtttctgaattcttgggtaatgttcaacttagctcgaaatcatcttcaaaggtatctctttcacaaggggagaagaagagactttctgttgttgccatggctgctcctgaagaggtgaagcgagcgataccattgaaggactaccgtaatattggtattatggcgcacatagatgcaggaaaaactactaccacagagcgagttctctactatactggaaggaattataagataggtgaagtgcatgaaggaacagctacaatggactggatggaacaggaacaagaaagggggattacaataacatctgctgctactactaccttttggaataaccatcggattaacattattgacactcctggccatgttgacttcactcttgaggttgagcgtgctctcagggtcctagatggtgctatatgtttgttcgacagcgttgctggtgtggaaccacaatctgaaacagtatggagacaagctgatagatacggggtccctagaatatgctttgtcaataagatggaccgtcttggggcgaactttttccgaacaagagatatgattgtcacaaacttgggtgctaaacctcttgttcttcaaataccagttggtgcagaagatacttttcgaggagttgttgaccttgtgagaatgaaagctatactttggtcaggggaagagttgggagcaaagtttgtatatgaggatattccagatgatcttaaggatttagctgatgattacagaacacgattgatggaattaataattgatttggatgataaggttatggaagattatctagaaggagttgagcctgacgaacaaactattaagaaattagtgagaaaaggaagtattggtggcagctttgtgccagttttatgtggatcggcttttaaaaacaaaggggttcaaccactgcttgacgcagttgtggattatctgccttccccacttgacgtgccaccaatgtacgggacagatcccgaggatccagaagtaacaattgcaagagctgcaagtgacgacgaaccatttgctggattagctttcaagattatgagtgattcctttgtagggtcccttacatttgtcagagtttacgcagggaaactttcagcaggatcttatgtgctgaatgcaaataaagggaagaaagaaagaataggaagactgctagaaatgcatgcaaatagtagagaagatgtcaaagttgctttagcgggtgatattattgcccttgcaggtcttaaagatactatcacaggtgaaacattgtgtgaccctgagcatcctcttgtgcttgagagaatggactttcctgatcccgtcattaaggttgccatagaacccaagactaaagctgatattgataagatggctgttggactaatcaaacttgctcaagaagacccatctttccacttctctagagatgaagagatcaatcaaactgttattgaaggaatgggggagttgcatctggagattattgtggataggcttaagagggaatacaaggttgaagctaatgtgggtgctccacaagttaactaccgtgaaagtatctcgaaggtcgcagaagtgaagtacgtccacaagaaacagtctggtggagctggacagtttgcagatatcacagtaagatttgagccgttgaaaccaggaactgggtatgagtttaagagtgaaataaaaggaggtgcagttccaaaagaatatattccaggagttatgaaaggtttagaagaatgcatgagcaacggtgtccttgctggctatcctgtagtggatgtccgagcttgtttagttgatgggtcttaccatgatgtggattcaagtgttttggcatttcagctggcagcccgaggagctttccgagagggaatgagaagagctggtccgagaatgctggaacctatcatgagagttgaagttgtcactcctgatgaacatttaggagatgttattggtgacctcaactctagaagaggccagatcaacaacttcggcgataagcctggtggcctcaaggttgtcgatgctcttgtgccactggctgagatgtttcagtatgtgagtaccctcagagggatgacaaaaggccgtgcatcctacagtatgcaactggccaactttgatgttgttcctcaacacatccaaaaccagctcgctacgaaagatcaacctgttgctgcatgatgtaattaattttagctgctgggaagcaacaattatacagagcagccccaatttttggtcttttcttggtatatacgatccaagctattgttttgtacttgtcttatatattggaaatgcaaataccattttactgaagcagagatgaagacattttagacataattgatatgaactcgattgatgcagatttgctttttaaagaacaaccgcaaacatttgtttt

SEQ ID NO: 8020 - DNA, 2619 bp, Vitis vinifera
caaaacctcaactcaaaaaccccgagagtgagaggcagagagaaagaaggagaagcagtggaaagcaaaccaaaaagaacatggcagagtcagtgagaatgtcagccactggttcctcactccgtagcttcagtggctcccggaggcctatccctctctctcccagtcgattcctcctcccttctcgtcattcttcctcttcctatcggtcacaatttgtgggaaatgttcatctcaggtcaagactctccaaggcctcaaatttacaacaacagaggggaaagttctctgtttttgccatggctgctgatgaatcaaagagaacagtgccactggtagactatcgcaatattggaattatggctcacatagatgcaggaaaaactactactactgaaaggattctgtactacacaggaagaaactataaaataggtgaggttcacgagggaacggctacaatggactggatggagcaagaacaagaaagaggaattactataacttctgctgcaactaccacattttggaacaaacatcggattaacattattgatacccctgggcatgtcgacttcactcttgaggtggagcgggctctcagggttttggatggtgctatatgcttgtttgacagtgttgctggtgtagaacctcaatctgaaactgtatggagacaagctgataaatatggggtgcctagaatttgctttgtcaataaaatggatcgtctcggggcaaacttcttccggaccagagacatgatagtgacaaacttgggcgctaaaccacttgtgattcaattaccaattggtgcagaagataattttcgaggagttattgatcttgtaaagatgcaagctgtgttatggtcaggagaagaattgggtgcaaagtttgcgtatgatgatattccatctgatcttctagaactggctcaagactatcggtcacagatgatagaaaccatagttgagttggatgatgaagctatggaaggctatctggaaggagttgagcctgatgaggaaactatcaagaaattaatcaggaagggaaccatttcagccagctttgtcccagttctgtgtggctcagcatttaaaaacaagggagttcaaccactgcttgatgcagttgtggattatttgccttcaccattggacctaccggcaatgaaaggaactgaccctgagaacccagaggtgacagttgaaagagctgcaagtgatgaagaaccatttgctggtctagctttcaagattatgagtgaccccttcgtggggtcccttacttttgtgagagtttatgcagggaagctagctgcaggatcttacgtgctgaatgcaaacaaaggaaagaaagaaagaattggaagacttctggaaatgcatgccaacagcagagaggatgttaaggtagctttagcaggtgatattgttgcacttgcaggtctgaaagatacaattactggtgaaactttatgtgatccagagaatcctattgtgctcgagcgaatggacttccctgatcctgttataaaggttgctattgagcctaaaactaaagcagatgttgataaaatggcatctggcttggtcaagctagctcaagaggatccatctttccacttctcacgggatgaagagatcaaccagacagtcattgaaggaatgggagaattgcatcttgagattatcgttgacaggctcaagagggaatttaaggtggaagctaatgttggcgcaccccaagtaaactaccgtgaaagcatttctaaagtctcggaggtgaagtatgtgcacaagaaacagtcaggtggacaaggacagtttgctgatatcactgtaaggtttgagcccattgaggcaggtagtgggtatgagttcaagagtgaaattaagggaggtgctgtgccaaaagaatacattccaggggtgatgaaaggattggaggaatgcatgagtaatggtgtgcttgcaggctttcctgttgttgatgtacgtgctgtgttagttgacggatcgtaccatgatgtggattcaagtgtcttggcattccagctggcagccagaggcgcattccgtgaggggatgaggaaagctgctccaaagatgctggaacctattatgaaagtcgaagttgtcacacctgaagaacacttgggagatgtgatcggtgatctcaactcaaggagaggccagatcaacagctttggtgacaaacctggtggtctcaaggtggtggatgctctggtccccctggcagagatgttccaatatgttagtacgctccgaggaatgacaaaaggccgtgcatcctataccatgcaattagccaagtttgaagttgttcctcaacacatccagaatgaactcgctgctaaagagcaagcagttgctgcttgatttggctttcctttcgccaagaccacagaagggaagcttcataattttttatttactttgtctttgggcctagaaaaaactgttttccttttccatttttccccctcttctgtatcaattttatatatgaaatgcaagtccctttgaaggaaaaggctgaacgtcttaaggctggagaataaactcattttggggctggagagacgtgaga

SEQ ID NO: 8021 - DNA, 2720 bp, Sorghum bicolor
gccgctcgctcgcgcgcataaaacccacaggcccccgctcgcgacagcctcgcggcgcaggcgagcaggcgaggggagagacgagagagctcgcggcaaagccacaccaagagcgaaaaagagccagagagacagttctccatggccgccgaggtgcccgtgcgagcccccgccgccgcggcgcggtccgcgcgcagccggccggccgccgccgccgccgtcgtctccgcctcgtccgcctcgcgcctcctcctcggctaccgccccttccacgcgccgcgcttcgccgctgggcgcgccgcggtggcaggccccgtggccggactccgcccgcgctcgcgcaggccgcgcctctcggtcgtcgccatggctggcagcgaccgtcaagtgcctttacatgattaccgcaacattggtattatggcccatatagatgcaggaaagacaacaactactgagcgcattctgtattacactggaaggaactacaagattggtgaggttcatgagggaacagctacaatggactggatggaacaagaacaagagagaggaataaccattacatctgcagcaacgactgccttctggaacaaacacagaatcaacattatagatactcctggtcacgtcgacttcactcttgaggttgaacgtgctctcagggtgttggacggtgctatatgtctctttgacagtgttgctggggtagaaccacaatctgaaaccgtgtggcgccaggcagataaatatggggttccaagaatatgtttcgtgaacaaaatggatcgccttggagctaatttctttagaactagagacatgatagttgcaaacttgggtgccaaaccattggtgattcagttgccgattggttcggaggacaatttccaaggagttattgatctagtcagaatgaaagctattgtatggacaggggaggagctgggtgcaaaatttgaatacaaagacatacctgatgatctccaagagctggctcaagattatcgtgttcagatgctggaaactattattgaattggatgatgaagttatggagaattatcttgaaggaactgaaccagatgaggaaactgttaagaaattaatcagaaagggaacaatctctgccagctttgttccagttttatgtggttcagcattcaaaaacaaaggtgtccaaccattgcttgatgctgttgttgattacttgccatctccacttgatctaccttcaatgaagggtactgacccagaagaccctgaaataatatttgaaaggcaaccaagtgatgatgaaccattttctgggttagctttcaagatcatgactgatccatttgtggggtcattgacatttgttcgcatatactccgggaagctggtagctggttcatatgttctcaatgcaaataaagataagaaagaaagaattggaagactccttgagatgcacgcaaacagtaaggaagatataccagttgctgtgacaggtgacatagtagcgcttgctggtctgaaagacacaattactggtgaaacactctgtgacccagacaagcctgtagtgcttgaacgtatggaatttcctgatcctgtcattaaggttgctattgaacccaagaccaaagctgatgccgacaaaatggctaatgggttaattaagcttgctcaagaagacccgtcattccacttctctagagacgaggaaactaaccagactgttattgaaggaatgggagaactgcatcttgatatcattgtagacagactaaagagggagttcaaggttgaagcaaacgttggagctccacaagtcaactaccgcgaaagtatttccaaagttgcagaaatacaatatgtccacaaaaagcaatctggtggatctgggcagtttgcagacattattgtgcgttttgaacctttggaagctggaagtgggtatgagttcaagagtgaaatcaagggaggggcagtgcccaaagaatatgtaccaggagtgatgaaaggattggaagaaagcttacccaatggtgtcctcgctggttacccagttgtggacttccgggctgtgctggttgatggctcatatcatgatgtcgattcaagtgtcttagcattccaaattgcagccagaggagccttccgtgagggaatgaggaaagctggtccaaggcttctcgagcctataatgagagttgaagtgataactcctgaagagcatctgggtgatgttattggtgatttgaactctaggagaggacaagttaacagcttcggggataagcctggtggactcaaggtggttgatgcttttgtgccacttgctgagatgttccaatacgtcagcaccctccggggcatgactaaggggcgagcatcctacacgatgcagctcgccaagtttgacgtcgtcccacagcacatccagaaccagctctccaccaaaacggaggaagctactgcttaattttcatttcccgtagataaatccatactgcaacagcagggcaggttgataggaagggcatcaagtgtatgtagctttgtagtgtatttaaccccgtgagggggcattatttgccattgattttggacctgataatggccttgtcgaggttttgcgatgagaggacagtgaaaatatatgtttttggttccttgctcctgttgagaagctgagaagttgcaccgttctccctcttgttctattacgatatg

SEQ ID NO: 8022 - DNA, 2628 bp, Phalaenopsis aphrodite
ggcgacatgaggaagacagataactcgtggtttccattcgttatctgccagtgagtcgagcgtggaagcgtagtgtagcagaaagctccgagtaagagcaggagaggagcaaaatggcttgtgaaaccataaaggtaacagcttcaccctcctcctgcagcttacatggctcgcttagacgcctatctctcgcttcgcgccgctcccttgcgcacaactccatccttgcccccggtctccgtcgaaccgccgtctccgatttattcggcggccttcgcctgaggtctggaactactgttcatctgtctcagggtagaaaggaaaagttcctagtcatggcagctgctgaagatgattcaaagcgaaaagtgcctcttaaggactacagaaatattggcattatggctcacatagatgcaggcaaaactactaccacagaacgcattctatattatactggaagaaattataagattggggaggttcatgagggaactgccacaatggactggatggaacaggaacaagagagaggtatcactataacttctgcagcgacaactaccttttggaacaatcacagaattaatattattgatacacctggtcatgttgatttcacactggaagtagagcgtgctctcagggttttagatggagcaatatgcttatttgatagtgttgcaggcgtcgagccacaatctgaaactgtatggagacaagccgataaatatggagtccccagaatatgttttgttaataagatggatcgccttggggctaattttttcagaacatgtgaaatgatagtcacaaatttgggtgctaaaccacttgtcctgcaattaccgattggtgcagaagatagctttagtggagttgttgatgttgtaaaaatgaaatctattatttggaccggagaagaattaggtgctaaattttcttatgaacgcataccggaagatctccaagaattggctgagaactacaggactcaactgatggaaactattgttgagttagatgataaggccatggaaaactatctggaaggaattgaacccaatgagcagaccatgaaatccttaattaggaaaggaaccatttcaggtgcttttgttcctgttttatgtggttcagcattcaaaaacaagggagttcaaccattgcttgatgctgtagtagattacttgccttcaccaatagacttgccaccattgaagggctctgatccagaagatccagagagggtccttgaaagatttcccagcgatgatgatccttttgctggattggcctttaagatcatgaacgacccttttgttggatctctcacatttgttagggtatattctgggaaattgtctgctggatcatatgctcttaattcaaacaaaggaaagaaggagagaataggaaggctcttagagatgcatgccaatagtagagaggatgtcaaatcagcattgacgggtgatattgttgcacttgctggcctaaaagagacagtaacaggtgaaacactttgtaaccctgacaaacctattgtgcttgaacggatggatttcccagaccctgtcattaaggttgctatagagcccaagacaaaggctgatcttgataagatggctgttgggcttattaagcttgctcaagaagatccatcttttcatttctcaagagatgaggagactaaccaaactgttattgaaggaatgggagagcttcatcttgagatcattgttgatcggcttaagagggaattcaaggttgaggcaaacgtaggtgcaccccaggtaaattatcgtgaaagcatctcaagagtttcagaagtgcaatacatacacaagaaacagtctggaggccagggtcagtttgctgatatcacggtgaggtttgagcctttggaacctgggagtggttatgaatttaagagtgagataaagggtggagcagttccaaaggaatacattcctggagtgatgaaaggcttagaagagtgtatgagcaatggtgtgcttgcaggctaccctgttgtcgatgttcgggctgttttagttgatgggacttatcatgatgttgattcaagtgtattggcatttcaattggctgctagaggtgctttccgagaaggaatgagaaaatctgctccgaaaatgcttgaacctataatgaaagttgaagtagtcacacccgaagagcatttaggtgatgtcattggtgatttgaactctagaagaggccaaattaataactttggggataaacctggtggtctgaaggttgttgatgctttggttccattggctgaaatgttccaatacgtgagcacgcttcgtggaatgacaaaagggcgcgcttcctacacgatgcagctagccaatttcgatgttgttccccaacatatacagaatcagctctcctctaaagaacaagttgccgtttgattttgttcggtttgaagtggagacatggctttgcaccgatttatcaagcactttgattgtcattcatgggagaataaccttgttttcatattagaaaaaaaaatgtaaaaattaaatcatttgtgagaatgcaatatgtagtttgctatttactcatttaattaccatatattccccaaca

SEQ ID NO: 8023 - DNA, 2599 bp, Panicum virgatum
cgagagagagctcgaggcaaggagctacgaacaaaagcaaccagaggcaaatctccatggcagccgaggcgcccgtgcgagcccccgccgcggcgcggtccgcgcgccggccggccgccgtcgtccccacctcgtccgcctcgcgcctcctcctcggccaccgccccttcctcgcgccgcgcttcgccgccgggcgcgccgcggtgaccggccccgcggctgggctccgcccgcacccgcgcaggccgcggctctcggtcgtcgccatggctgccagtgatcgccaggtgcctttgcaggattatcgcaatatcggtattatggcccatatagatgcaggaaagacgacaactacagaacgcattctgtattacactggaagaaactacaagattggcgaggttcatgagggaacggctacgatggactggatggaacaagaacaggagagaggaataaccattacatctgcagcaaccactgccttctggaacaaacacaggatcaacattattgatactcctgggcatgtcgacttcactcttgaggttgagcgtgctctcagggtgttggacggtgctatatgtctctttgacagtgttgccggggtagaaccacaatccgagaccgtgtggcgtcaagcagataaatatggggttccaagaatatgttttgtgaacaaaatggatcgtcttggagctaacttcttcagaactagagacatgatagttgcaaatttaggtgccaaacctctggtggttcagttgcctattggttcagaggacaatttccaaggagttgttgatttagtcagaatgaaagctattgtatggacaggggaggagctgggtgcgaaatttgattatcaagacatacctgctgatctccaggagatggctcaagactaccgtgttcagatgctggaaactattattgaattggatgatgatgtgatggagaaatatcttgaaggaactgaaccagatgaggaaactgttaagaaattaatcagaaagggaacaatttctgccagctttgtcccagttttatgtggttcagccttcaaaaacaagggtgtacaaccattgcttgatgctgttgtcgattacttgccatctccacttgatctacctgcaatgaagggtactgacccagaagatcctgaagtgatccttgaaaggcacccaagtgatgatgaaccattttctgggttagctttcaagatcatgactgatccatttgtggggtcactaacatttgttcgcatatactctgggaagctggtagctggctcgtatgttctcaatgcaaataaagataaaaaggaaagaattggaaggcttctagagatgcatgcaaacagtaaggaagatataacagttgctgtgactggtgacatagtagcgcttgctggcctgaaagacacaattactggtgaaacactatgtcaggaagataagcctgtagtgcttgaacgtatggaatttcctgatcctgtcattaaggttgctattgaacccaagaccaaagctgatgctgacaaaatggctactggattaatcaagcttgctcaagaagacccatcattccacttctctagagacgaggaaaccaaccagactgttattgaaggaatgggagaattacatcttgatatcattgtagacagattaaagagagagttcaaggttgaagcaaacgttggagctccacaagtcaactaccgtgaaagtatttccaaagtcgcagaagtacaatacgtccacaaaaagcaatctggtggatctggtcaatttgcagacattattgtgcgctttgaacctttggaagctggaagtgggtatgaattcaagagtgaaatcaagggagggtctgtgcccaaagaatatgtaccaggagttatgaagggattggaagaaagcttacccaacggtgtccttgctggttacccagttgtggacttccgagctgtgctggttgatggctcataccatgatgttgattcaagcgtcttggcattccaaattgcagccagaggcgccttccgtgaaggaatgagaaaagctggtccaagacttctggagccaataatgagagttgaagtgataactcctgaagatcatctgggtgatgttattggtgacttgaactccagaagaggtcaagttaacagcttcggggataagcctggaggactcaaggtggttgatgcgtttgtgccactcgccgagatgttccagtacgtcagcaccctccgggggatgaccaaggggcgcgcgtcctacacgatgcagcttgccaagttcgacgtcgtcccgcagcacatccagaaccagctctccgcggcgaaaacagaggaagctgctgcttaattttcattctcgtagatattacccatacggccacggcagagcaggttgataggaaggacatcaaggtgtatgtagcgtcgtagcgtgtccaaaccccgcgaggggacattatttgccattgattttggacctggtaatggcctttgtcgagttttctcgatgagaaaaacattaattgtaagtttttggttccttgctcctgttgagaactcgtgcctcattctccc

SEQ ID NO: 8024 - DNA, 2494 bp, Zostera marina
ttcaataacgtggacacaggtggagcagtgaaatggcgggagatacactgagattaccggtgcatcccatttcggggaacttctccagaaacagacctcaaacaccgcctctctcagtattctcaactcgacgtggatcgtttgcgagtcgatacggacattcgccggctcccaggtccgatttctttgggaattcgtgcgtcaggttgaaatcagtggtgcccatttcgagaaatgggatgcggaaggtttctccttttgtatccatggccgctcccgaagagtccaagagagtggtggcgctcgaagattaccggaacatcggaattatggcgcatatagatgcaggcaagacaactacgacagagcgcgtgttgttctacactggtaggaattacaagattggagaagtgcatgaaggaacagctacaatggactggatggaacaagaacaagagcgaggtatcacaattacctcagcggcaacaaccaccttttgggataaacataggataaacatcattgacacacctggtcatgttgatttcacattggaggtggaacgtgctctcagagttcttgatggtgcgatatgcttgtttgacagtgttgctggtgtagaaccacagtcagagactgtgtggagacaagctgatcgttacggagtccctaggatatgcttcgtcaataaaatggaccgacttggtgcaaatttcttccgtacgagagacatgattatcgaaaatctcggtgcaaatcctctagtgcttcagattccgataggtgcagaagatacctttaagggcatagttgacatcgtcaaaatgaaagctgtggtctggtccggagaagaactaggtgccaaatttgcatacgaggacattccatccgacctcgtagatattgctcaggagtacaggatgagtatgttagagacgattgtcgaattggatgacgatgtaatggagaagtatctagaaggcattgaaccagacgagaagacaataaaatctataattcgaaaaggaaccatatctgcaaaatttgttccagtgttatgtggatcggcatttaaaaacaagggtgttcaaccacttcttgatgccgtagtggattatcttccatcaccaattgatgtcccaccaatgaaaggtactgatccagatgaccctgaaattataattgagagaggtgcaaatgatgaagaaccattctctggtttggctttcaagatcatgggtgatacattcgtcggttcccttacatttgttagagtttactctggtaaattaactgccggatcctacgtccttaatgcaaataaaggaaaaaaagagaggattggaaggcttttggagatgcatgctaatagcagagaagatgttaagacggctgtagctggtgatattgttgctcttgcaggtttgaaaagtaccattacaggtgaaacactatgtgatcctgataaaccgatcgttctcgagcggatggacttccctgatccagtcattaaggtcgcgatcgaaccaaagacaaaggctgatatagataaaatggcggtgggattgattaaattagcacaagaggatccttcttttcatttctcaagagatgaagaaattaaccagactatcattgaaggtatgggcgagctccaccttgagatcattgttgaccgactaaaacgagagcacaaggtcgaagcaaatgtgggtgcaccgcaagtgaactaccgtgaaagcatatcgaagatatcagaggtgaaatacatccacaaaaaacagtctggtggggcaggtcaatttgcagacatcactgtgagatttgagccgatggagccaggttctgggtatgaattcaagagtgagataaagggaggtgcagtgccgaaggagtacatccctggagtgattaaaggattagaagaatgtatgaacaatggagttcttgcagggtatcctgttgtcgatgtatgtgctgctttagtcgatggtaattatcatgatgttgattcaagcgttttagcgttccaattggcggcgaggggtgcttttcgcgatggaatgaggaaagcagggccaagaatactggagcctataatgagagttgaagtaattacaccagaagaacacttgggtgatgttatcggcgatcttaactcacgaagagggcatattagcacctttggcgataaacctgggggactaaaggttgttgattccttggttccattggctgagatgttccagtatgtgagcacgcttcgaggaatgacgaaaggtcgagcttcttattccatgcaactcagcaaattcgacgtcgttcctcaacatattcagaaccaaattgccaacaaagatgaaccagtcacagcttcataaatgttatattgttaacttttgatttttatcttattgagttttaatttaagaagtaaacggaaattaatctaagaataatttaaattatctgaataatttaagatttatatctc

SEQ ID NO: 8025 - DNA, 2709 bp, Zea mays
gccgccgctcacgcgcataaaacccacagtccgctcgcgacagcctcacggcgcaggcgagaaggcgaggagagggagctcgccggcaaaggccaccaagagcgaaaaggaaccacagaggcagtctccatggccgccgaggcgcccgtgcgagcccccgccacggcgcggtcctcgcgccggccggccgccgccgtcgtctccgcctcgcgcctcctcctcggccaccgccccttccttgcgccgcgcttcgctgcggggcgcgccgcggtggcaggccccgcggccggactacgcccgcgcccgcgcaggccgcgcctctcggtcgtcgtcatggccagcagcgatcgccaagtgcctttacatgattaccgcaatattggtattatggcccatatagatgcaggaaagacaacaactactgagcgcattctgtattacactggaaggaactacaagattggtgaggttcatgagggaacagctacaatggattggatggaacaagaacaagagagaggaataaccattacatctgcagcaacgactgccttctggaacaaacacagaatcaacattattgatactcctggtcacgtcgacttcactcttgaggttgaacgtgctctcagggtgctggacggtgctatatgtctctttgacagtgttgctggggtagaaccacaatctgaaactgtgtggcgccaggcagataaatatggggttccaagaatatgtttcgtgaacaaaatggaccgccttggagctaacttctttagaactagagacatgatcgttgcaaatttgggtgccaaaccattggtgattcagttgccgattggttcggaggacaatttccaaggagttgttgatctagtaagaatgaaagctattgtatggacaggggaggagctgggtgcaaaatttgaatacaaagacatacctgctgatctccaagagatggctcaagactatcgtgttcaaatgctggaaactattattgaattggatgatgaagttatggagaaatatcttgaaggaactgaaccagacgaggaaactgttaagaaactaatcagaaagggagcaatttctgccagctttgtcccagttttatgtggttcggcattcaaaaacaagggtgtccaaccattgcttgatgctgttgtcgattacttgccatctccacttgatctaccttcaatgaagggtactgacccagaagaccctgaaataatatttgaaaggcaaccaagtgacgatgaaccattttctgggttagctttcaagatcatgactgatccattcgtggggtcactaacatttgttcgcatatactccgggaagctgatagctggttcctatgttctcaatgcaaataaagataagaaagaaagaattggaagacttcttgagatgcacgcaaacagtaaggaagatataccagttgctgtgacaggtgacatagtagcgcttgctggtctgaaagacacaattactggtgaaacactctgtgacccagacaagcctgtagtgcttgaacgtatggaatttcctgatcctgtcattaaggttgctattgaacccaagaccaaagctgatgccgacaaaatggctactgggttaatcaagcttgctcaagaagacccgtcattccacttctctagagacgaggaaaccaaccagactgttattgaaggaatgggagaattgcatcttgatatcattgtagacagactaaagagggagttcaaggttgaagcaaacgttggagctccacaagtcaactaccgtgaaagtatttccaaagttgcggaaatacaatatgtccacaaaaagcaatctggtggatctgggcagtttgcagacattattgtgcgttttgaacctttggaagctggaagtgggtatgagttcaagagtgaaatcaagggaggggcagtgcccaaagaatatgtaccaggggtgatgaaaggattggaagaaagcttacccaatggtgtcctagccggttacccagttgtggacttccgggctgtgctggttgatggctcatatcacgatgtcgattcaagtgtcttagcattccaaattgcagccagaggagcattccgtgagggaatgaggaaagctggtccaaggcttctagagcctataatgaaagttgaagtgataactcctgaagagcatctgggtgatgttattggtgatttgaactctagaagaggacaggtcaacagcttcggggataagcctggtggactcaaggtggttgattcttttgtgccacttgctgagatgttccaatacgtcagcaccctccggggcatgaccaaggggcgagcgtcctacacgatgcagctcgccaagtttgacgtcgtcccacagcacatccagaaccagatctccgtggcaaaaacagaggaagctgctgcttagttttggttttccgtagatatatccatacagcaacaggagagcaggttgataggaaggacatcaaggtgtatgtagctttgtagtgtaaatctcttaaggcttgttcggatgattggaggggattgatatggattgagagagattttaatttactatggattgaaacttcctcaattcatatggattggactagaaccgaacatggtctaagggagcattatttgccattgattttgcacctgataataatggcctttgttgagttttcac

SEQ ID NO: 8026 - DNA, 2825 bp, Setaria italica
gccgccgctcgcgcgcataaaacccacagccttccgctcgcgacggtcctcgcggcgcaggcaggcgaggcaaggagagagagctcgcggcgaagagccacgaagagaagggacaaacactaggagcagtctccatggcagccgaggcgcccgtgcgagcccccgccgcggcggcgcggtccgcgcgccggctggccgccgccgccgtctccgcctcgtccgcctcgcgcctcctcctcggccaccgccccttcctcgcgccgcgcttcgcagccgggcgcgccgctgtggccggccccgcagccggactccgcccgcgcccgcgcaagccgcggctctcggtcgtcgccatggccggcagtgatcgccaagtgcccttggaggattatcgcaatatcggtattatggcccatatagatgcaggaaagacgacaactacagaacgcattctgtattacactggaagaaactacaagattggcgaggttcatgagggaacagctacgatggattggatggaacaagaacaggagagaggaataaccattacatctgcagcaaccacggccttctggaacaaacacaggatcaacattattgatactcctgggcatgtcgacttcactcttgaggttgaacgtgctctcagggtgttggatggtgcaatatgtctctttgacagcgttgctggggtagaaccacaatctgaaactgtgtggcgccaagcagataaatatggggttccaagaatatgttttgtgaacaaaatggatcgccttggagctaacttctttagaactagagacatgatagttgcaaacttgggtgccaaacctctggtgattcagttgcctattggttcagaggacagtttccaaggagttgttgatctagtcaggatgaaagctattgtatggacaggggaggagctgggtgcgaaatttgaatatcaagacatacctgctaatctccaagagatggctgaagactatcgtgttcagatgttggaaactattattgaattggatgatgaagttatggagaaatatcttgaaggaattgaaccagatgaggaaactgttaagaaactaatcagaaagggaacgatttctgccagctttgtcccagttttatgtggttcagccttcaaaaacaagggtgtccaaccattgcttgatgctgttgtggattacttgccatctccacttgatctacctgcaatgaagggtactgacccagacgaccctgaactggtccttgaaaggaacccaagtgatgatgaaccattttctggcttagctttcaagatcatgactgatccatttgtggggtcactaacatttgttcgcatatactccgggaagctggtagctggttcatatgttctgaatgcaaacaaagataaaaaggaaagaattggaaggcttctagaaatgcatgcaaacagtaaggaagatataacagttgctgtgactggggacatagtagcgcttgctggcctgaaagacacaattactggtgaaacactatgtgaaccagataagcctgtagtgcttgaacgtatggaatttcctgatcctgtcattaaggttgctattgaacccaagactaaagctgatgctgacaaaatggctactgggttaatcaagcttgctcaagaagacccatcattccacttctctagagatgaggaaaccaaccaaactgttattgaaggaatgggagaattacatcttgatatcattgtagacagactaaagagagagttcagggttgaagcaaacgttggagctccacaagtcaactaccgtgaaagtatttccaaagtcgcagaagtacaatacgtccacaaaaagcagtctggtggatctgggcagtttgcagacattattgtgcgctttgaacctttggaagctggaagtgggtacgaattcaagagtgaaatcaagggagggtcagtgcccaaagaatatgtaccaggagttatgaagggattggaagaaagcttacccaacggtgtccttgccggttacccagttgtggacttccgagcagtgctggttgatggctcgtaccatgatgttgattcaagtgtcttagcattccaaattgcagccagaggcgctttccgtgaaggaatgaggaaagctggtccaagacttctggagcctataatgagagttgaagtggtaactcctgaagaccatctgggcgatgttattggtgatttgaactctagaagaggtcaagttaacagcttcggggataagcctggtggactcaaggtggttgatgcgttcgtgccacttgccgagatgttccagtacgtcagcaccctccgggggatgacaaaggggcgtgcatcctacacgatgcagcttgccaagttcgacgtcgtcccgcagcacatccagaaccagctctccgcggcgaaaacagaggaagctgctgcttaattttcatttcccgtagatatacccacacgccgacagcagagcaggtttataggaaggacatcaagatgtatgtagcgttgtagcgagtccaaccctgcgaggggacattatgtgccattgattttggacctggtaatggccttgtcgagttttctcaatgagaaaaacagtaattgtaagtttttttgtttccttgctccagttgagagttcgtgcgtcattctcccgtcttcttgttcggttctccatttgcttgttgcacttgcatcttcaacaaagatacgttgtctttcacatgtgacgttgtaaagactaatgcatatgagcacagcacagaatactgcttaccttgacaacaaggtcctgatc

SEQ ID NO: 8027 - DNA, 2620 bp, Distylium racemosum
atgagcaagagcagtctagacaactagactctaatgcattcctaagtcttctgcaagataagaaaggctttaggaattttgtagctcgtagggatttaatcccatcaataatggcagagacccaaagccttgccaagtgctttacttgcagtttacagaagagcaatggtcgccataggcatattagcagaaaaagcaagaatggatttctgctgaattcctttcatggagtgaagagtagaggatggtttccttcaagctcatcatcattgcagggattgaaattcagccagctgcttcacaaggcctctgtttcaacctcacccaatgtctccgggagactacccattgtttgcatggctgcagacggacgtgaggttccactggcagattacaggaatatcggaattatggcgcatatagatgcagggaaaactactactacggagaggattttatattatacaggcaaaaactacaaaattggggaggttcatgaagggactgctacaatggactggatggagcaggagcaagaaagaggcataacaattacttctgctgcaacaacggccgtctggaataatcatcgaataaacattattgatactccaggtcatgtggactttactttggaagtagagcgagctcttagagtacttgatgggactatctgtttgtttgacagtgtcgctggtgtggagccacagtctgagactgtatggagacaagcagataagtatggagttcccaggatttgctttgttaacaaaatggatcgacttggagcaaactttttcaggactagagacatgataatagcaaacctaggggcaaaacctcttgttgtgcaaatcccaattggggcagaggatagcttccaaggaattgttgatctgatcaaattgaaggctgtcgtttggtctggagaagaactaggtgcaaagttcagctatgaggacattcctgcagatcttgtagatttggccatggaatataggaatcaaatgattgagactatagtggaacttgacgatgaagccatggagaagtatcttgagggagaggagcttgatgagaaaacaatcaagaaattgatcagaaagggtactatatccattaaatttgttccagttctttgtggttcagcatttaagaacaagggtgtgcagcctttactggatgctgttgtggattatttgccttcgcctcttgatttgccaccaattaagggaatagatgcagagaatccagaggtgaccctagaaagatgtccgagtgatgatgaaccatttgcaggacttgcttttaaaattatgacagatcccttcgtggggtctcttacatttgtacgagtgtattcgggcaagctaaatgctggaacatacgtgcttaattctaataaaggaaaaaaggagaggattggacgactattgcaaatgcatgcaaatagtcgagatgatgtcaaggttgctgtgacaggggacatagtggcgcttgctggcttgaaggatactataactggagagactctgtgtgatccagataatcccattgtgctggaaagaatggaatttcctgatcctgttattaaagttgcaattgaacctaaaacaaaagctgatgtagacaagatgtcatttggtcttgtcaaacttgcccaggaagatccgtctttccacttctcaagagacgaggagaccaatcaaactgttatagaaggaatgggggagttacatcttgaaataattgtagatcgtttgaagagagaattcaaggttgaggcaaatgtgggtgctcctcaagtgaactaccgagaaagtatctcaaggatagcagaagtgaagtatgtgcacaagaaacaatcagggggtcaaggtcagtttgcagatgtaagtgtaagatttgaacctatggaagctggtagtgggtatgaattcaagagtgaaatcaaaggtggagctgtgcccaaggagtatattccaggtgtaatgaagggattagaagagtgcatgagcaatggtattctggcaggctaccctgttgttgatgtgcgggctgtccttacagatggatcttatcatgaagtggactcaagtgcactagcattccagcttgcagctcgtggtgctttcagggaaggcataagaaaggcaggcccaaggttgctggaacctataatgaaagttgaagtggtgacacctgaggagcatttgggggatgttattggtgatcttaattcaaggcgtggtcagatcatcagctttgaggacaaaccaggcggactaaaggtgattgattctttggtgccactggcagagatgtttcagtatgtgagtagactacgcggtatgaccaaaggccgtgcatcttacacaatgcaagttgccaagtttgatgtggtacctcagcatattcaaaatcaaatcgctacaaagtcgctggaagttgctgcttgagggtttgcaaaacattttatcgttatcatcgactgaaagtccaagcaatcttgccattctgccccattgtaaacatgtctaacacaagaaaacacttttctctacttatttgcttgattcattggttaattgaataaaagctttatcctaaaaatttactt

SEQ ID NO: 8028 - DNA, 2614 bp, Zea mays
acaaaacccacaaccgccccgctcgcgacagactcgcggcgcaggcgaggggagagagctcgcggccaaagtccaccgagagcgaaagcagccgcagaggaggtagtctccatggccgccgaggcgcccgtgcgggcccctgccgcggcgcggtccgcgcgccggccggccgccgtcgtctccgcctcgcgcctcctcctcggctacggccctttcctcgcgccgcgcttcgccgccgagcgcgccgcggtggcaggccccgcggccggactctgcgcgcgcccgcgtaagccacgcctttcggtcgtcgccatggccggcaccgatcgccaagtgcctttacatgattaccgcaatattggtattatggcccatatagatgcaggaaagacaacaactactgagcgcgttctgtattacactggaaggaactacaagattggcgaagttcatgagggaacagctacgatggactggatggaacaagaacaagagagaggaataaccattacatctgcagcaacgactgccttctggaacaaacacagaatcaacattattgatactcctggccacgtcgacttcactcttgaggttgaacgtgctctgagggtgttggacggtgctatatgtctctttgacagtgttgctggggtagaaccacaatctgaaactgtgtggcgccaggcagataagtatggggttccaagaatatgtttcgtgaacaaaatggaccgccttggagctaacttctttagaactagagacatgatagttgcaaacttgggtgccaaaccgttggtgattcagttgccgattggttcggaggacaatttccaaggggttgttgatctagtcagaatgaaagctattgtatggacaggggaggagctgggtgcaaaatttgaatacagagacatacctgctgatctccaagagatggctcaggattatcacgttcaaatgctggaaactattattgaattggatgatgatgttatggagaaatatcttgaaggaaccgaaccagacgaggaaactgttaagaaattaatcagaaagggaacaatttcagccagctttgtcccagttttatgtggttcagcattcaaaaacaagggtgtccagccattgcttgatgctgttgtcgattacctgccatctccacttgatctacctccaatgaagggtactgacccagaagaccctgaaatactacttgaaaggcaaccaagtgatgatgaaccattttctgggttagctttcaagatcatgactgatccgttcgtggggtcactaacatttgttcgcatatactccgggaagctgatagctggttcatatgttctcaatgcaaataaagacaagaaagagagaatcggaaggcttcttgagatgcacgcaaacagtaaggaagatataccagttgctgtgacaggtgacatagtagcgcttgctggtctgaaagacacgattactggtgaaacactctgtgacccagacaagcctgtagtgcttgaacgtatggaattccctgaccctgtcattaaggttgctattgaacccaagaccaaagccgatgctgacaaaatggctactggcttaatcaagcttgcccaagaagacccgtcattccacttctctagagacgaggaaacgaaccagactgttatcgaaggaatgggagaactgcatcttgatatcattgtagacagactaaagagggagttcaaggttgaagcaaacgttggagctccacaagtcaactaccgtgaaagtatttccaaagttgcagaaatacaatatgtccacaaaaagcagtctggtggatccgggcagttcgcagacattcttgtgcggtttgaacctctggaagctggaagtgggtacgagttcaagagtgaaatcaagggaggggcagtgcccaaagaatatgtaccaggagtgatgaaagggttggaagagagcttacccaacggtgtcctggccggttacccagttgtggacttccgggccgtgctggttgatggctcgtatcatgatgtcgactcaagcgtcttagcgttccaaatcgcagccagaggagccttccgtgaggggatgaggaaagccggtccaaggcttctcgagcctataatgagagttgaagtgataactcctgaagagcacctgggcgatgttatcggtgatctgaactctagaagaggacaggttaacagcttcggggataagcctggtgggctcaaggtggtcgatgcttttgtgccactcgctgagatgttccagtacgtcagcaccctccgggggatgaccaaggggcgagcgtcctacacgatgcagctggccaagtttgacgtcgtcccgcagcacatccagaaccagctctccacagcaaaagcagaggaagctgctgcttagtttttcgtttccccgtagatatatccatacagtacagcgtccgcagagcaggttgataggaagcgcgtcaagttgtatccgtgtatgtagctttgtagcgtcttgaacttgaaccccgtcacggggcattatttgccattgattttggacctgtagtggacagtgaaattacatggcttcgttttcttgctcctgt

SEQ ID NO: 8029 - DNA, 2866 bp, Cedrus atlantica
gaaattttgcaggtttagggttcttaaccagaacttctgtaaatggcggaagctctcaagctctctccatgcttctcttacagtttgcataattacagtagccgtcgtaagtatagtagcagaaggagcaaggaggggatttcgctgaattcatttagtggattgaaggccttagatggttttcctctacgctcgccatcaatccagggtttcagacccaatgacttgttgcttcgcaaggcctctgtttcaacctccaccagtgtccgtggaagaacatccattgtttccatggctgcagatggaccatcacgggtggtgccactgtcagactatagaaatattggaattatggcccacatagatgcaggtaaaaccactactacagagagggttctttactacacagggaaaaactataaaatcggggaggttcatgagggtactgctacgatggattggatggagcaggagcaagaaagaggcataactataacttctgctgcaactacatgtgcgtggaataatcaccgtataaacattattgatactcctggtcatgtggacttcacattggaagtggagcgtgctcttagagttcttgacggttctatctgtttatttgacagtgttgctggtgttgaaccacaatcagagactgtatggagacaagcagataggtatggtgttcccagaatttgctttgttaacaaaatggatcgacttggagcaaactttttcaggacaagagacatgataataacaaacctaggggcaaaacctcttgttctgcaaattccaataggcgcagaagatcgttttaagggagttgttgatttggtgaaaatgaaggctgtgttgtggtctggagaggaattgggtgcaacgttcagctacgaggacattccagcagatcttctagatttagccacagaatataggaatcaaatgattgaaactatagtagaacttgatgatgatgccatggagaattatctcgagggagtggaacctgacgagaaaacaatcaagaggttgatcagaaagggcaccatagctatcagttttgttcctgttctttgtggctcagcatttaagaacaagggtgtacagcctttattggatgctgttgtggattatttgccttcccctcttgacttgccaccaatgaagggaacagatgttgatgatccagaagtaaccctagaaaggcttgctagtgatgatgaaccgtttgcagcgcttgcttttaaaattatgacagatccctttgtgggatctcttacatttgtccgaatttactctggtgtcctaacagctggatcttatgtgcttaattccaacaaagggaagaaggagagaattggacgtttattacaaatgcatgcaatcagtcgagacgatgtgaagattgctgtgacaggggatatagtggcacttgctggtttgaaggatacaataacaggagagagtctttgcgatcctgataaacccattgtgctggagagaatgaactttcctgaacctgttattaaagttgcaattgaaccgaaaacaaaagctgacgtggataagatgtctatgggtcttgtcaaacttgctcaggaagatccttcttttcacttctcaagagatgaggaaagcaatcaaactgttatagaaggtatgggggagttgcatcttgaaatcattgttgaccgtttgaagagagaattcaaggttgaggctaatgtgggtgctcctcaagttaactaccgagaaagcatctcaaaaactgcagagactaagtatgtgcacaagaaacaatcaggtggtcaaggtcaatttgcagatgtaagtgtaagatttgaacctctagaacctggcagtggttatgagttcaagagtgagattaagggtggagttgtgcccaaagagtatattccaggtgtcatgaaggggttggaagagtgtatgagcaatggtattctagcagggtatcctgttgttgatgtgcgggctgtccttacaaatggatcatatcatgaggtagactccagtgcactggcattccagcttgcagctcgtggcgctttcagggagggcatcagaaaggcaggtccaaggttgctagaacctataatgaaggttgaagttgtaacacctgaggagcatctaggggatgttattggtgatatcaattcaaggcgtggccagatcaacacttttgatgacaagccaggaggactgaaggtgattgatgctttggtgcctctagcagagatgtttcagtacgtgagcacacttcgtagtatgaccaaaggccgtgcctcctatactatgcaacttgctaagtttgatgttgtacctcagcatattcaaaaccaactttcttcgaaggtgcaagaggtcgctgcttgaaaatttgtaaattttttatgaattagcatcaattggctatccataccaaacctaaacttttggttcattcttcatatatgcatcatgatgtactgttgtctcacctatttggattgatgcattggtaaattggaccaaaaggcaagctcaatctcatttttgcacgagtgtttgtgatgtaaaggaaaaccaaagtttaagattttgctctgcaaaactttacaacatttctagataccctttctttccaagtattgctatacctgacagaggttaaacaatgcttatccctattctgtaatagccaacaaactggctcatgataagatacaaaaattgtcttcccaagatttcaactttcttagtatgatgaaaaccagggctttttttgttatctggaacagcaataagttgtgcctcttagattgcctaattcatccgagtttggcatgaccagaagaagtgt

SEQ ID NO: 8030 - DNA, 2627 bp, Cephalotaxus harringtonia
ttaagccgatcccacaatctgctgcagcagcaatacaaggagggcctgaaggattttgtagggtttagggttttcattaaatcaaattcagtcaataatggctgaaactctcaagcttgccaagtgcttctcttgcagtagcttacagaacaacaacagccttggccacaagcataatggtagcagaagaataagcaaaaatggtgttgtagtaaattcctttcataaactgaagagtttggcaggttttcctctaccctcatcgtcactccagggcgcgaacctcaatatcagccagttgcttcacaaggcctctctttcaaatgtttcaaggagaatccccattgtttgcatggctgtagatggtgagatgggacgcgaggtaccgctctcagattataggaatattggaattatggcccacatagatgcagggaaaactactaccacagagaggattctattttacacaggcagaaattacaaaattggggaggttcatgaagggactgctacgatggactggatggagcaggagcaagagagaggcataacaatcacttctgctgcaacaacagctgtctgggataatcatcgtataaacattattgatactcctggtcatgtggacttcactttggaagtggagcgtgctctgagagtacttgatgggactatctgtttgtttgacagtgttgctggtgtggagccacagtcagagactgtatggagacaagcagataggtatggagttcccaggatttgctttgttaacaaaatggatagacttggagcaaacttttccaggacgcgagacatgatagtaacaaacctaggggcaatacctctagttgtgcaaatcccaatcggggcagaggatagctttcaaggagttgttgatttgatcaaaatgaaggctgtattgtggtctggagaagaattgggtgcaaagttcagctatgaggacattccagaagatcttctagatttagccatggagtataggaatcaaatgcttgaaaatatagtggaacttgatgacgatgctatggagaaatatcttgagggagaggagatcgatgaaaagacaatcaagaaattgatcagaaagggtaccatatctattaaatttgttccagttctgtgtggttcggcatttaagaacaagggtgtgcagcctttattagatgccgttgtggattatttgccttcccctcttgatgtaccaccactgaagggaacagatccagaggatccagaggtgatcctagaaagacgcccaagtgacaatgaaccatttgcaggacttgcttttaaaattatggcagattcatttgtggggtctcttacttttgtacgagtttattctggcaagctcaatgctgcatcatatgtgcttaattccaacaaagggaagaaggagagaattggacgattattgcaaatgcatgcaaatagtcgagaggaagtcaggcttgctgtggcaggggacatagtggcacttgctggtttgaaggatactataactggagagacgctttgtgatccagataatcccattgtactggaaagaatgaactttcctgatcctgttattaaagttgcaattgaacctaaaacaaaagctgatatggacaagatgtctatgggtcttatcaaacttgctcaggaagatccttctttccacttctcaagagatgaggaggccaaccaaacggttatagaaggaatgggggagttgcatcttgaaatcattgttgatcgtttgaagagagaattcaaggttgaggctaatgtgggtgctcctcaagtgaactatcgggaaagtatctcaaagacatcagaagttaggtatgttcacaagaaacaatcaggtggtcaaggtcagtttgcagacataactgtaagatttgaacctatggaagctggcagtgggtatgagttcaagagtgcaattaaaggtggagttgtgcctaaggagtttataccaggtgtagtgaagggattagaagagtgcttgggcaatggtgttctggcaggataccctgttgtcgatgtgcgggctatccttttagatggaacatatcatgatgtggactccagtgtactagcattccagctcgcagctcgtggtgctttcagggaaggaataagaaaggcaggtccaaggttgctggaacctataatgaaagttgaagttgtgacacctgatgagcatttaggggatgttattggtgatctcaattcaaggcgtggtcagatccacagcttcggtgacaagccaggaggactaaaggtggtcgatgctttggtgccgctggcagagatgtttcagtatgtgagtacactccgcagtcagaccaaaggccgtgcatcttataccatgcaacttgctaagtttgatgtggtacctcagtatattcaaaatcaactttctacgaagtcacaagaggttgctgcttgaggttttgctgaaattctatgagttagtattggctggatgtccaagcaaccattgtactcttttttattctaaatgtatttaatggatgaaaaatattattgtcttgcctatttgttttattcattagaaaattgaatgaaaacactatgcacaattttatttt

SEQ ID NO: 8031 - DNA, 2588 bp, Platanus occidentalis
agcggagacacacagcagaaatggcagcagagtccatgagaataaccacctctggttctctcaacaacttccatggctctcgaaggcgtctcctctctctcccaaacgtttccttggcctcaactttcaccctcgatctttctctgcttctgaattgttcggaaatgttcgtctctgctcgaaatcttcgaagctatcggttctacaagaacagaagagaagtgttgttgtttccatggctggtgatgatactaagcgttcagtaccattgaaggattaccgcaatattggaattatggctcacatagatgcaggaaagactaccacaaccgaacggattctctactatactggaaggaactataagataggtgaggtacatgaggggacagctacaatggactggatggagcaggagcaagaaagagggatcaccataacttctgctgcaactaccactttctggaataagcatcggattaacattattgacactcctggccatgttgacttcacacttgaagtggagcgagcactcagggtcttggatggcgctatatgcttatttgacagtgttgccggggtggaaccgcagtccgaaactgtgtggagacaagctgataaatatggggttcctagaatatgctttgttaataagatggatcgtcttggggcaaattttttccgtacaagggacatgatagtcacaaacttgggtgctaaacctctggtgattcaaataccggttggtgcagaagataattttcaaggagttattgatcttgtgaaaatgaaagctataatttggtcaggagaggaattgggtgcaaaatttgtgtatgcggatattccagctgatcttcaagagttggctcaagattacagaacccagatgatagaaaccatagttgagttagatgataaagctatggagaactacctagaaggagttgaacctgatgaacaaaccattaagaagttgattagagagggaaccatctctagcagttttgtgccagttttatgtggctcagcatttaaaaacaaaggggttcagccattacttgatgcagtggtggattatttgccttcaccacttgaagtaccagcaatgaaaggcactgaccctgagaacccggaagtgacaattgaaagggctccaaatgatgatgaaccctttgctggactagctttcaaggtcatgagcgattcgtttgtggggtcccttacatttgtgagagtgtatgcagggaagctaactgcgggatcttatgttctcaatgcaaataaagggaaaaaggagagaatagggagacttttagaaatgcatgccaatagtagagaggatgttagggtagcattaacaggtgatattattgctcttgctggtctaaaagataccatcactggtgaaacactgtgtgaacctgagaaccctattgtccttgaacggatggactttcctgatcctgttattaaggttgcgatagaaccaaagactaaagcagacgttgataagatggctgtcggactcatcaagctcgctcaagaagacccttctttccacttctcaagagatgacgagaccaatcagactgtcattgaaggaatgggggagttgcatctcgagatcattgttgaccgacttaagagggaattcaaggtagaagccaatgttggagcaccccaagtgaactaccgcgaaagcatatctaaagttgcagaagtgaagtatgtccacaagaaacagtctggtgggcaaggacagtttgcggacatcacagtaaggtttgaacccttggaagcaggtagtgggtatgagttcaaaagtgaaataaagggaggtgcagtgccaagagaatatatcccaggagtgatgaaaggcttggaagaatgcatgagcaatggtgtactcgctggctatcctgttgttgacgttcgtgcagcattagtcgatggctcttaccatgatgtcgactcaagtgtcttggcattccagctggcagcaagaggagctttccgggaggggatgaggaaagctgctccaaagatgctggaacccatcatgaaagttgaagttgtcacacctgaggagcacttgggtgatgtgattggagacctcaactcaagaagaggacagatcaacagctttggtgataagcctggtggtctaaaggttgttgattccctggttccattggctgagatgtttcagtatgtgagtacactcaggggaatgacaaagggccgtgcatcctacaccatgcaattggccaagttcgacgttgtcccacaacacatccaaaatcaacttgccacgaaggagcagccgcttactgcttaatttcattgatttcactgcagggcagcaaacccagtacagagaaccatcaaaatttttgttgacttggtgttaagatccaagacactggtttgtatgtaacatttcataggtgggaaatgatcgtataatttcaagaggtaaaaatgtataaattgattcatacagccccgacttgaatttttgataaattaatcgacctaccatttgattggcatcgggtttctaacattaaagcagtttaaca

SEQ ID NO: 8032 - DNA, 2659 bp, Triticum aestivum
gagcagcggcccgaagcacacataagcgcggccaccacagcgctcacccacgagcgcaggcggcagcaggcagggagcgaaggccaaggcactcttacacagcagtgcaatggccgccgaggcactcccgcgggccgccgcgtcggcgcgccggccgtccgtggccgccgcttccgcctcgcgcctcctcctcggccaccgccccttcctcgcgccgtccgcgtcccgcttcgccgccgggcgcgccgcggtggccggcccggccgccagcctccgcccgcgcccgcgcaggccgcgcctctcggtcgtcgccatggccggcaatgatcgccaagttcctttggaggattaccgcaatattggtattatggctcatatagatgctgggaaaacaacaactacagagcgcattctctattacactggaaggaactacaaaattggtgaggttcatgagggaacagccacaatggattggatggagcaagaacaggagagaggaataaccattacatctgcagcaacaactgccgtctgggacaaacatagaattaacattattgacactcctgggcacgtcgatttcactcttgaggttgaacgtgctctcagggtgttggatggtgctatatgtctctttgacagtgttgctggggtagagccacaatctgaaactgtgtggcgccaagcagataagtacggagttccaagaatatgttttgtaaacaaaatggatcgccttggagctaacttctttagaactagggacatgatagtggcaaatttgggtgcaaaacctttggtgatacagttgccgattggttcagaggacaatttccaaggagttgttgatctaataagaatgaaggctattgtatggacaggggaggaactcggtgcacaattttcataccaagacatacctgctgatctcgaagagttggctcaagactatagacttcagatgatcgaaactattgttgaattggatgatgaagctatggagggctatctagaaggaaaggaaccagatgaggcaactgtgaagagattaatcagaaaaggaacaataggtgccagctttgtccccattttatgtggttcagccttcaaaaacaagggtgtccagccattgcttgatgctgttgttgattacttgccatcaccacttgacctgccaccaatgaagggtactgacccagatgacccggaattgattcttgaaagacgtcctagtgatgatgaaccattttctgggttagctttcaagatcatgactgatccatatgtggggtcactaacgtttgtccgcatatactcagggaagctgatcgctggttcatacgttctcaattcaaacaaagataagaaggaaagaattggaaggcttctagagatgcatgcaaacagtaaggaggatataacagttgcggtgacaggtgacatagtagctcttgctggtctgaaagatactattactggtgaaacactctgtgacccagataatcttgtagtgcttgaacgtatggaatttcctgatcctgtcattaaggttgctattgaaccaaagaccaaagctgatgctgataaaatggcaaatggactgataaagcttgctcaggaagatccatccttccacttctctagagacgaggaaaccaaccagacagttattgaaggaatgggagaattacaccttgacatcattgtagacagattaaagagagagttcaaggttgaggcaaatgttggagctcctcaagtcaactaccgtgaaagtatttccaaaattgcagagattcagtatgtccacaaaaagcagtctggtggttcagggcagtttgcagatattattgtgcggtttgaacctatggaggctggaagtgggtatgaattcaagagtgaaataaagggaggggcagtgccaaaagaatacgtaccaggcgtgatgaaggggattgaagaaagcttgcccaacggtgtccttgctggttacccagttgtggatctacgagcagtgctggttgatggctcctaccacgatgttgattcaagtgtccttgccttccaaattgcagccaggggggccttccgtgaaggattgaggaaagctggcccacgactcctggaacctataatgagggttgaagtgattacccctgaggagcatttgggtgatgttattggtgacttgaactctagaagaggacaagttaacagcttcggagataagccaggtggacttaaggtggttgatgctttcgtgccgctggccgagatgttccagtatgtcagcactctgaggggaatgtccaaggggcgcgcgtcgtacacaatgcagcttgccaagttcgacgttgtcccacagcatatccagaaccagctttctgcggcaaaagaggaagctgctgcttaaatcttcagtattcgtagataatatatatgaggacggcagagcaggtgagtataggacatcaaggtgtatgtagctttgtagtgtcgaacccagtgggtgatattatttgccattgtttttggacctgataatgtccataattttgcaagctgttataatttcataatgaccttgtcaagttctcacaaacgagaaaacagttcgttataaattttgcttacatgcttcagtccagtatttgct

SEQ ID NO: 8033 - DNA, 1885 bp, Sorghum bicolor
gcacaaacaacactcgcttcgctgtaatctcgcttcgctgtaatcgcgtcaggctgctcattcatcagggagagggggaaaaaacagaggggaaaaaaaattcaattgggaacagcgaagaactagtttatcaaagaaagaagaataacttctataagaaagatcgccaaattcccgattcatcttcttcgctcgggtttcagagacataacgcgcggcaatttagccaagatggtggcgatcgagaacaaccagagccaggtccaagtggcggtggcggcggaggcggtgccggtgccggtgccggggccgcggatccccagggaggcgcggagcctgctgcacgagctggcggcggcgtgggcggacgtggcggactgccgcgcgctggaggtcgtgccgctcaagggtgccatgaccaacgaggtctaccaggtgcgctggctcaccggccctgccgctgccggcgagaaggaggagcctaggagggagagggaggtgaggaaggtgctcgtgcggatttacggcgacggcgtcgaccttttcttcgaccgcgaggacgaggtgcgcaccttcgagtgcatgtcccgccatggccagggtccccgcctcctcggccgcttccccaacggccgcgtcgaggagttcatccacgcaaggacattgtcagctgccgaccttcgtgatccggaaatttcagctcttgtggcgtctaaactgagagaattccacaaccttgacatgcctggtcccaaatctgtgctcatttgggacagactgaggaactggctcagaactgccaagaacttgtgcccatctgaagaagccaaggaatttcggttggacagtctggagaacgagattactgcattggagaatgagtgttcaggtgattaccaatggattggtttctgtcacaatgatcttcagtatggcaatatcatgattgatgaagagaccaacgtgctgaccatcattgattttgagtatgcaagcttcaacccggttgcatatgacattgctaaccatttctgtgagatggcagcagactatcattcatcaaagcctcatatactggactacagcagatatccagatgttgatgagcagaagcgcttcgttaagacctacctgaacatttctggtgaggaaccggatgcagaagttgtggagaacctgctccaacgcattgataagtacatgctcgccagccatctagtatggggcctctggggaataatttcggaccacgttaacgacattgactttgactacaaggagtatgcgaggcagagattcgagcagtactggcagaagaagtctgcaatcttaacatcttgaacatgtgtataaacacccgtggcctcaggagctccctgagggcctgtgctgcacacagaaagttgtgcaatgtcactgacacagagagaagctgtgaaagaagcaacactgacgacaacgatgaataatcccgttttgggatcgggaagttatttctccgcaactcaatgagctccagccttcaggcttcagcttcagaaatgaagaagctatggggatttggctgtccgtttatagtacgagggcaattaagataaagatccagtccggggttgcgtgttgtatgtttagtttggctagcactgccgagagccgtggtgctgttgtggtgtccatagtttctatatgcttgatgttaatgtgctggagaatttggctttgtgcttgaggagtccttagctttgggacaacgcatcctctgtatactaggtagatgtatataaacataaaacagctatgggaatttggctttgtacttattttttctcgagcaggctggatagcctgtatttcattaaaaaggcaaatttggctttgtagtttg

SEQ ID NO: 8034 - DNA, 2050 bp, Sorghum bicolor
cgttctcagaattatggaaaattagagggggcagccgcaaaacctcgctcaaccgactctatttatacggcaccccgtcctgatccgcgaagcacaaacaacactcgcttcgctgtaatctcgcttcgctgtaatcgcgtcaggctgctcattcatcagggagagggggaaaaaacagaggggaaaaaaaattcaattgggaacagcgaagaactagtttatcaaagaaagaagaataacttctataagaaagatcgccaaattcccgattcatcttcttcgctcgggtttcagagacataacgcgcggcaatttagccaagatggtggcgatcgagaacaaccagagccaggtccaagtggcggtggcggcggaggcggtgccggtgccggtgccggggccgcggatccccagggaggcgcggagcctgctgcacgagctggcggcggcgtgggcggacgtggcggactgccgcgcgctggaggtcgtgccgctcaagggtgccatgaccaacgaggtctaccaggtgcgctggctcaccggccctgccgctgccggcgagaaggaggagcctaggagggagagggaggtgaggaaggtgctcgtgcggatttacggcgacggcgtcgaccttttcttcgaccgcgaggacgaggtgcgcaccttcgagtgcatgtcccgccatggccagggtccccgcctcctcggccgcttccccaacggccgcgtcgaggagttcatccacgcaaggacattgtcagctgccgaccttcgtgatccggaaatttcagctcttgtggcgtctaaactgagagaattccacaaccttgacatgcctggtcccaaatctgtgctcatttgggacagactgaggaactggctcagaactgccaagaacttgtgcccatctgaagaagccaaggaatttcggttggacagtctggagaacgagattactgcattggagaatgagtgttcaggtgattaccaatggattggtttctgtcacaatgatcttcagtatggcaatatcatgattgatgaagagaccaacgtgctgaccatcattgattttgagtatgcaagcttcaacccggttgcatatgacattgctaaccatttctgtgagatggcagcagactatcattcatcaaagcctcatatactggactacagcagatatccagatgttgatgagcagaagcgcttcgttaagacctacctgaacatttctggtgaggaaccggatgcagaagttgtggagaacctgctccaacgcattgataagtacatgctcgccagccatctagtatggggcctctggggaataatttcggaccacgttaacgacattgactttgactacaaggagtatgcgaggcagagattcgagcagtactggcagaagaagtctgcaatcttaacatcttgaacatgtgtataaacacccgtggcctcaggagctccctgagggcctgtgctgcacacagaaagttgtgcaatgtcactgacacagagagaagctgtgaaagaagcaacactgacgacaacgatgaataatcccgttttgggatcgggaagttatttctccgcaactcaatgagctccagccttcaggcttcagcttcagaaatgaagaagctatggggatttggctgtccgtttatagtacgagggcaattaagataaagatccagtccggggttgcgtgttgtatgtttagtttggctagcactgccgagagccgtggtgctgttgtggtgtccatagtttctatatgcttgatgttaatgtgctggagaatttggctttgtgcttgaggagtccttagctttgggacaacgcatcctctgtatactaggtagatgtatataaacataaaacagctatgggaatttggctttgtacttattttttctcgagcaggctggatagcctgtatttcattaaaaaggcaaatttggctttgtagtttgtacttgttctagctcaaaagggtcgatcaagtgcggttttctattgacaagcaatgtagatccatgaaaccctc

SEQ ID NO: 8035 - DNA, 1780 bp, Panicum virgatum
cccaaacaaaacttgctttgaaatctcgcttcactgcgaacgctgcagcggaggaagaaaaagaaagaagaagaaaaaaaaacaattcgtagcggaaatcagcaagcaaaagaagaaaataatttccataagaaatcgcccaatcccccttcctccttttctcttgaggcttcggaacgtgcggggaacttagccaggatggtggcgatcgagaaccagagccaggtcgcgcgggcggcggcggcggaggcggtgccggcagcggggccgcggatccccaaggaggcgcggcggctgctgcacgacctggcggcggcgtgggcggacgtggcggactgccgcgcgctccaggtcgtgccgctcaagggcgccatgaccaacgaggtgtaccaggtgcgctggctcaccggcgtcccctccgcgggcggcgaggcggaggagccccggggggagagggaggtgaggaaggtgctcgtgcggatatacggcgacggcgtcgacctcttcttcgaccgcgaggacgaggtgcgcaccttcgagtgcatgtcccgccacggccagggtccccgcctcctcggccgcttccccaacggccgcgtcgaggagttcatccacgcaaggacactgtcagctgccgaccttcgcgatcctgagatttcagctctcgttgcttccaaactgagggaattccacaaccttgacatgcctggtcccaaatctgtgctcatttgggacagactaaggaactggctcaaaactgctaagaacttatgctcgtctgatgaagccaaagaatttcggttggacagcctggagaatgagattactgcattgcagaatgatgtttcaggtgattaccactggattggtttttgtcacaacgatcttcagtacggcaacatcatgattgatgaagagaccaacatgctgaccatcattgattatgagtatgcaagctttaacccagttgcatacgacattgctaaccatttctgtgagatggcggctgactatcattcagcaaatcctcatatcctggactacagcaaatatccagatactgatgagcagaaacgtttcgtcaagacatacctgagcatttctggtgaggaacctgatgcggaagaggcggagaacctgctccaaagcattgagaagtacacgctcgccagtcatctagtatggggcctctggggaataatctcggatcatgtcaacgatattgacttcgactacaaggagtatgcaaggcagagattcgagcagtactggcagaagaagactgcaaatctgcaatcttgacttcttgaacatgtgaataaaacacccatggcctcaagggctccttgaggacctgtgttgcgaacacgaggtcgctgacaaagcgagaagatgttgaaaatgatactgacaacaatgatgacgaagaaccccttcttgggatcagggagctcatgttccggaacttgattggcttcggcttcatgaaggaagaagctatggggcttcggttgctcgtttgtacagtacgaaggcaaggcaacgatgataaaagccccggggttgcttgctgtatgcttagtttggctagcattgccgtgggctgttttgctgttgtgtttccagtttctgtatgcttgatgctaatatagtggagattttggctatgtactttgagacaatgcatagtttgtatagtgtgtacgtagctaaaggtagaataattgttgccataacagctatacatattgtggagatcgatgataagcagtttcaaagg

SEQ ID NO: 8036 - DNA, 1488 bp, Setaria italica
ctcgactccactccactcccctccccctgtttccacttcccccagccggcgcggctcaggctccgcgctaatggcggtcgacccgcggcaggtggtggcggggttcctcaccctctccatgttcgtcatgctcggcaacatgatcaagcacgaccacttctcctcccccggcccccagctgggcttggaggcaacaggtgcagagtttaacacaatgaagcttgacgataatgctgaaatgagcaatatcaatacgggtggagttgagaacctaatggacgctgatgaggaggttaaaccttgctggaccataccaagtccaaaaactcaaccatctaatggttacgtgacattctccttgactatgggaccagaatatcacatctcacagatcacagatgctgtggttgttgcaaggtatctaggtgcaacacttgtacttccagatataagaggaaatgaattaggaaacaagagaaaattccaagacatgtacaatgtggataaattcatgagaaacctggaaggtgttgtggaagtaatagaggaactacctgatgaagtgagtgctaagaagccagcacttattagagtaccaaaccgagtgactgaaagcttcatcacggacaccatccagcccatcttccaaacaaacaactacttaagacttgcggtcattttctcctcagtgagtttaagaccgagggagactaataacaaggacttggatgcgactgcttgccttgcaatgttcagtggcctcgaattgaaacatgaatattctgaagtggccagaaaaatgctggatggtcttaaagaattaagcaagaaatcagatgggaaggtcttggcaattgatttgcggaccgacttgctagaaaagaaggcttgcaaaacaaccagaggcgctagaagaaaaggctgctataacactgatgaggttttgggtttcctgaggagtgttggcttctctgctaatacaaccatctacttgactgagacctggtggcacaaaggcctcaatgatctgaaggaagaatttccaaacacctataccaaggatgacataataccagctgagaacaaaggcgagttcctgaaagccagcaacgccgacctagcgagggctctggacctcgagatctgctcccagagcgacgtgttcgtcccagccatcgccggcctgttctatggccacgtgaccggtaagaggatcgcgtcgggccgtacccaaatcctcgtgccttcccctagcgcctcgacccaggcttcagacttcatctccacttacatctccagcaagaaccacctcgcatacaaatgctactgctagcatggcttttctaccgtcgctaataagaagatcggctgaagctagccgctgggcagtgctgcgctctgggtgcatatacaagtacctcgagttgacatgatgtacactagttaaggttttgttacgaggaatattaattgtcgtgtgttgtatgt

SEQ ID NO: 8037 - DNA, 1602 bp, Setaria italica
ctccactccactcccctccccctgtttccacttcccccagccggcgcggctcaggctccgcgctaatggcggtcgacccgcggcaggtggtggcggggttcctcaccctctccatgttcgtcatgctcggcaacatgatcaagcacgaccacttctcctcccccggcccccagctgggcttggaggcaacaggtgcagagtttaacacaatgaagcttgacgataatgctgaaatgagcaatatcaatacgggtggagttgagaacctaatggacgctgatgaggaggttaaaccttgctggaccataccaagtccaaaaactcaaccatctaatggttacgtgacattctccttgactatgggaccagaatatcacatctcacagatcacagatgctgtggttgttgcaaggtatctaggtgcaacacttgtacttccagatataagaggaaatgaattaggaaacaagagaaaattccaagacatgtacaatgtggataaattcatgagaaacctggaaggtgttgtggaagtaatagaggaactacctgatgaagtgagtgctaagaagccagcacttattagagtaccaaaccgagtgactgaaagcttcatcacggacaccatccagcccatcttccaaacaaacaactacttaagacttgcggtcattttctcctcagtgagtttaagaccgagggagactaataacaaggacttggatgcgactgcttgccttgcaatgttcagtggcctcgaattgaaacatgaatattctgaagtggccagaaaaatgctggatggtcttaaagaattaagcaagaaatcagatgggaaggtcttggcaattgatttgcggaccgacttgctagaaaagaaggcttgcaaaacaaccagaggcgctagaagaaaaggctgctataacactgatgaggttttgggtttcctgaggagtgttggcttctctgctaatacaaccatctacttgactgagacctggtggcacaaaggcctcaatgatctgaaggaagaatttccaaacacctataccaaggatgacataataccagctgagaacaaaggcgagttcctgaaagccagcaacgccgacctagcgagggctctggacctcgagatctgctcccagagcgacgtgttcgtcccagccatcgccggcctgttctatggccacgtgaccggtaagaggatcgcgtcgggccgtacccaaatcctcgtgccttcccctagcgcctcgacccaggcttcagacttcatctccacttacatctccagcaagaaccacctcgcatacaaatgctactgctagcatggcttttctaccgtcgctaataagaagatcggctgaagctagccgctgggcagtgctgcgctctgggtgcatatacaagtacctcgagttgacatgatgtacactagttaaggttttgttacgaggaatattaattgtcgtgtgttgtatgttggttacttgtttggggattgaaatttggtataacagcgaggagcaaagaattgcaagtatgctgtaaaatgagcatgaggtctacctgttgctgcggaaactgtgaaatgcgtgagct

SEQ ID NO: 8038 - DNA, 1534 bp, Panicum virgatum
actcctcccccctgtttccggcagccttggcggctcggctccgcaggctcggacgcaatggcggtcgacccgcggcaggtggtggccgggttcctcacactctccatgttcgtcatgctcggcaacatgatcaagcacgaccacttctcctcccccggcaccgagctgggcttgggggcaacaggtgcagagtttaacacgatgaagcttgatgataatgctgaattgaacaatatcaatacgtctggggtagagagcctaatagacactaacgaggaggttaaaccttgctggaccaaaccaagtccaaaaactcaaccgtctaatggttttgtgacattctccttgactatgggaccagaatatcacatctcacagatcacagatgctgtggttgttgcaaggtatctaggtgcgacacttgtacttccagatatcagaggaaatgaattaggaaataagcgaaaattccaagacatgtacaatgtggataaattcatgaggagcctagatggtgttgtcgaagtaatagaggaactacctgatgaagtgagtgctaagaagccagcagttattagagtaccaaaccgggtgactgaaagctttatcacagacactatccagcccattttccaaacaaacaattacttaagactcgcgatcattttctcttcagtgagtttaagaccaagagagactaataacaaggacttggatgcgactgcttgcctcgcaatgttcagtggcctcgaactgaagcatgaatattctgaagtggccaggaaaatgtcagataagcttaaagagataagcaagaaatcagatgggaaggtcttggcaaattgatttgcggactgacttgctagaaaagaagagttgcaaaacaaccagaggcgctagaagaaagggctgctataatgcagatgaggttctgggtttcctgaggaatgttggcttctctgctaatacaaccatctacttgacagagacgcggtggcacgagggcctgaatgacctgaaggaagaatttccaaacacttataccaaggatgacataataccagctgagaacaaaggtgaattcctgaaagccagcaactccgacctagcgagggctctggacctcgagatctgctcgcagagcgacgtgttcatcccagctatcgccggtctgttctatggccatgtgactggtaagaggatcgcgtcgggccatacccaaatcctcgtgccctctcagtccagcgccttgactcaggcctcagacttcatctccacctacatctccaacaagaaccaccttgcctacaaatgctactgctagcatggcattttctagtgtcactaataagacctgctgacgtgagccgctggacagtgatctgggtgcgtatacaagtaccttccgttgacgtgttgtacactagttgaacttttgtcatggggaatattaattagcgtatgttgttggttacttgcttggacattgaaatttggcacaacagcgagtaacaatgaattgcaagtacggtgt

SEQ ID NO: 8039 - DNA, 1583 bp, Pennisetum glaucum
gcgccccctgtttccactcccactctcccggccggcgcggctcaggctccgcccaaatggcggtcgacccgcggcaggtggtggctgggttcctcaccttctccatgttcatcatgctcggcaacatgatcaagcacgaccacttctcctcgcccggcacccagctggacttggaggcaacaggtgcggagtttaacacaatgaagcttgatgataatgctgagatgaacaatatcaatacgggtggagttgagaacctaatggatgctgaggaggaggttaaaccttgttggaccaaaccaagtccaaaaactcaaccatctaatggttatgtgacattctccttgaccatgggaccagaatatcacatctcacagatcacagatgctgtggttgttgcaaggtatctaggtgcaacacttgtacttccagacataagaggaactaaattaggaaacaagagaaaattccaagacatgtacaatgtggacaaattcatgaggagcctggatggtgttgtcgaagtaatagatgaactacctgatgaagtgagtgctaagaagccagcacttgttagagtgccaaaccgggtgactgaaaacttcatcacagacaccatccagcccatcttccaaacaaacaactacttaagacttgcagtcattttctcctcagtgagtttaagaccaagggagatgaataacaaggacttggatgccactgcttgccttgcaatgtttagtggcctcgaattgaaacatgaatattctgaagtggccagaaaaatgttggatggacttaaagaattgagcaagaaatcagatgggaaggtcttggcaattgatttgcggaccgacttgctagaaacgaaggcttgcaaaacaaccagaggcgctagaagaaaaggctgctatagtgctgatgaggttctgggtttcctgagaagtgttggcttctctgctaatacaaccatctacttgactgaaacctggtggcacaaaggcctgaatgatctgaaggaagaatatccaaacacctataccaaggatgacataataccagctgagaacaaaggcgagttcctgaaatccacaaacgccgacctggcgagggctctggaccttgagatctgctcccagagcgacgtgttcgtcccagccatcgccggcctgttctatggccatgtgactggtaagaggatcgcgtcgggccatacccaaatcctcgtgccttcccccagtgcctcgacccaggcttcggacttcatctccacttacatctccagcaaaaaccaccttgcctacaaatgttactgctagcttggccttcctactgccactaataagatcggctgaagtgagccgctaggcagtgctgcgctctgggtgcatatacaagtacctcctgttgacatgatgtacactagctaaggttttgttatgaagaatattaatcagtcgtgtgttgtatgttggtacttgtttggggatcgaaattcgggataacagcgaggagcaaagaatttgcaagtatgctgtaaaatgaacatgtggttcggcatgtgaaaagggtgtgcttcatct

SEQ ID NO: 8040 - DNA, 2266 bp, Trigonella foenum-graecum
tgttgttgtcatataagattacaaaacgaggcgataccgtggatgagaagattaagaagcttgatgttgaactcaatagatacaaatgacatgttaagaaaacaagacctggtcttgctcaggaggctgttaaagctagagtcatgcgagttcttaaacagaagcgaatgtggttcatcatgtacaacagaactactataagcaatatccattttgaagaaagcatacagagacaacaatcataaggttttgcattttggtcctgattcttgttctgtggaatctagtttattagtagaagtcgatgtcgaggcttggggagtagaaccatacaaattagatgacgtaggtgcaaagtgaaaaagtcttgcacgcaaggcattgttcacgtggcactgtggctgacttaaagcttcctctaccttgacgtgcaaagtcatttcctcttgccatatgtcagatgctttggattacttatctccaaaatgcctcattaaaaccatgcctgagtcagcgagggtatctgctaatggtgttgttatcttttcagattgatggttgattttccagatgctccgaacagaggaaaaattatgagagtcattttagcgaaagaagatttggcagccgatgttgagttggaagcagtagcaaatatgacggatggatactcaggaagtgacctaaagaatttgtgtgtcacagcagctcagtgcccaataagggagatcttggagaaagaaagaagaagcttagcattggctgagaacaaacctgaacctgagttgtgtagcagtgcagacattagtcccttaaagatggaggattttagatcttcctttgtagtaaacgatgaacaggtgttgtattgtttatataatggaggcgctgcattcgttgaatctcgttgttgcttgatggtacgagacggacgtagaagtaaaacacagcagagttgtattgttttgtctatcttcctctccgtgactcactgaatcccttacgaagaaaaacaatgagttccgaagttgtaggtgaagattgcctttcatgggcagcaagagatgcttctggagttctgtcgccttacaaattcaaccgcagggatctcgggagtgaagatgtttatgttaaaattacacactgtggcgtttgttatgctgatgtaatttgggcaaggaataaacatggggattcaaagtatcctgttgtgccgggacacgagattgctggggttgtggcaaaggttggtcctaatgtccagcgtttcaaggttggtgaccatgttggagtgggtacttacatcaactcgtgcagggaatgtgagtattgtaatgatagactagaaaaccattgtgccaagggatcagtttacacctttaatggtgtggattatgatggtacaattacaaaaggaggatactccaattccattgtagtaaatgaaaggtattgcttcatgatacctaaaagctatcctttagcttcagcaggtcctttgctttgtgctggaatcaccgtttattctcccatgatgcgccataagatgaatcaacctggtaagtctcttggagtgattggtcttggtggccttggtcatatggcagtaaaatttgggaaggcgtttggtttgcgtgtaacagttttcagcactagcatgtcgaagaaagaggaggcgctgagccttcttggtgcagacaaatttgttgtttcatctaatcaagaagaaatgagggcgttggctaaatcattggattttataattgacacggcatcaggtgatcacccgtttgatccttacatgtcactgttgaagatatctggtgttctggtcttagttgggttcccaagtgaagtcaaattcagccctgcaagccttaatttaggatcaagaactgttgccggaagtgttacaggtggtacaaaagaaatacaggagatggttgacttctgtgctgcaaacgggattcacccagatatagaactgattccaattgggtactcgaacgaagctcttgagagggtcataaataaggacgtgaaatatcggtttgtaatagacattgaaaactccctcaagtagagaaatatgaagttgattctgaagttagacatggaaggactacctttttagatgtccagtgctccataatgactgccagatatgtagatgattcaaatttgatatatctagtaatgcaaataaagctatgaatattataatgtttgggtaaaaagaataatataaacgtgatgaagtttgttg

SEQ ID NO: 8041 - DNA, 1436 bp, Glycine max
atacatttgccttttctttcttactcatcacgttcgtttcgtggatccttactcatcacaagtgtgagaaaaattatgagttccaaaggtgttggtgaagattgcctgggatgggcagcaagagatgcatccggagttctatcaccttacaaattcagtcgcaggactcttgggaacgaagatgttcatattaaaattacgcactgtggtgtttgcttcgctgatgtagtttggacaaggaataaacatggtgactcaaagtatcctgtcgtgcctggtcatgagattgctgggattgtgacaaaggttggcgccaatgtccaccattttaaggttggcgaccatgttggagtggggacttatataaactcatgtagggattgtgagtattgtaatgatggacaagaagttcattgtaccaagggatctgtatacacttttaatggtgttgattttgatggtacaattacaaaaggaggatactccagttacatagtagtccatgagaggtactgcttcatgataccaaaaagctatccattggcttccgcagctcctttgctttgtgctggaattactgtttattcaccgatggtccgccacaagatgaatcaacctggtaaatctctaggagtgattggtcttggtggcctcggtcatatggcggtgaaatttggaaaggcatttggtttgagtgtaacggtttttagcactagtatatccaagaaagaggaggcactgagcctgcttggcgcagacaaatttgttgtttcatctaatcaagaggaaatgacggcgttggctaaatcgttggactttataatcgacacagcatctggtgatcactcgtttgatccttacatgtcactgctgaagacatatggtgtttttgtcctagttggtttccctagtcaagtcaaatttatccctgcaagccttaatataggatcaaagactgttgccggaagtgttacaggtggtacaaaagatatacaggagatgattggcttctgtgctgcaaacgagattcacccaaatatagaggtgattccaatcgagtatgccaatgaagctcttgagaggctcataaatagggacgtcaagtaccggtttgtaatagatgttgagaattccctgaaagaaaaatgagttgttgcctcccaaattggacattattggacttcaccttgttcgataaataatgatggtcggagttcgtaatttacttacatagagttgatttgaattttctttaattattttgtgaactaatattatgtgattataagaatattttggatttttaaataataataattatggaaattaatatggtgttattttaattttaataatagatgttgtaagtagtttgcttctaaagtgtaaaaattcaatcaagattggaatgcatgataagtttattgattttgtaa

SEQ ID NO: 8042 - DNA, 1364 bp, Cajanus cajan
caaaaatgaaagtaaaagattgtttccactctccacttgcacttccattcgctttctctttcttcttcatctggtggatccttacacagcatcgcacaggagtagaaaaattatgagttcccaaggtattgttgaagactgcctaggatgggcagcaagagatgcatccggagttctctcaccttacaaattcagtcgcaggactcttgggaacgaagatgtttatattaaaattacgcattgcggtgtttgctatgctgatgtagcttggacgcggaataaactcggtgactcaaagtaccccgttgtgcctggtcatgagattgctggcattgtgacaaaagttggctccaatgtccaccgtttcaatgttggtgaccatgttggagtggggacttatgtcaactcatgtagggattgtgaatattgtaatgacaggctagaagttcattgtaccaaaggatcaatttacacttttaatggtgttgattttgatggtacaattacaaaaggaggatactcaagttacatagtagtccatgagaggtattgcttcataatcccaaaaagctatccattggcttcagcagctcctttgctgtgtgctggaattactgtttattcaccgatggtgcgccacaagatgaatcaacctggtaaatccctaggagtgattggtcttggtggcctcggtcatatggcagtgaaatttggaaaggcatttggtttgaatgtaacagtttttagcactagcatatccaagaaagaggaggcactgagcctacttggtgcggacaaatttgttgtttcatctaatcaagaggaaatgaaggcattggctaagtcgttggacttcataattgacacagcatctggtgatcacccgtttgatccttatatgtcactattgaagacatatggtgtttttgtcgtcgttggtttccctagcgaaatcaaattcatgcctgcaaaccttattttaggatcgaagactgttgccggaagcgttacaggtggtacaaaagatatacaagagatgattgacttttgtgctgcaaagggtatttacccaaatatagaggtgattccaatcgagtatgccaatgaagctcttgacaggctcataaataaggatgtcaaatatcggtttgtaatagatattgagaacagtctctaattagattgtaacgagaggctcataaatgttcttcaattaattaattatataaatgttttagattattagcaactgaaaaagtcagtctctgattacatttaaatttttaatggctattgatactcattagagttccttcaagattgaagtagtaaaaagtctcttctacttaacaaaaaaaaaaaaa

SEQ ID NO: 8043 - DNA, 1406 bp, Cajanus cajan
tgaaagtagaagattgtttccactctccacttgcacttccattcgctttctctttcttcttcatctggtggatccttacacagcatcgcacaggagtagaaaaaattatgagttcccaaggtgtcgctgaagattgcgtaggatgggctgcaagagatgaatccggagttctatcacctcacaaattcagccgcagggctcttggaaatgaagatcttcatattaaaattacacactgtggtgtttgttatgctgatgtagtttggacaaggaatttacatcgcgactcaatgtaccccgttgtgcctggtcatgagattgctgggattgtcacaaaggttggctccaatgtccacagtttcaatgttggtgaccatgttggagtggggacttatgttagctcatgtagggattgtgagtattgtaatgacaggctagaagttcattgtaccaaaggatcagtttacacttttaacggtgttgattttgatggtacaattacaaaaggaggatactcgagttacatagtagtccatgagaggtattgcttcatgatcccaaaaagctatccattggcttcagcagctcctttgctttgtgccggaattactgtttattcaccgatggtgcgccacaagatgaatcaacctggtaaatctctaggagtgattggtcttggtggcctcggtcatatggcagtgaaatttggaaaggcatttggtttgagtgtaacagttttcagcactagcatatccaaggaagaggaggcactgagcctgcttggtgcagacaaatttgttgtttcatctaaccaagaagaaatgacggcgttggctaaatcattggactttataattgacacagcatctggtgatcacccgtttgatccttatttgtcacttttgaagacatatggtgtttttgtcctagttggtgtccctagtgaagtcaaattcagccctgtaagtcttgttataggatcgaagactgttgcgggaagcattacaggtggtacaaaagatatacaagagatgattgacttctgtgctgccaatggaatttacccaaatatagagctcattccaatcgagtacgccaatgaagctctcgagaggctcataaataaggatgtcaaatatcggtttgtaatagacattgagaactccctaaaataatactagagaaaaatggacatgattggactacaccttgttcgataaataatgatgctctccttggtatgcgagtatcagttagttccacacatttaagcctatatgttgctgatagttaagtagttttggtttttgtcaacagttatctcatactagtatctctaagtgttgtataaataccaaccttttgtatcagaatcattttaatcaatgtctcaattctctgttctc

SEQ ID NO: 8044 - DNA, 1350 bp, Castanea mollissima
agaaatcagaacctggacacactctctctatctctctcaattctgaaactgaaagaaaacccaatggccgatcaaaatctgaagcccgagcttttcgaactcgacaatggaaccatgcgtgtactcatcaccaacttgggttgcaccatcacttccttgtctgtaccagacaaagatggcaaattggctgatgttgttcttggattcgactctcttgaaccatatctgaaaggtgctgcgccctattttggcagcattgtgggtcgggttgcaaaccgaatcaaagatgggaagtttaaactcaatggggtcgattactctttgcctatcaacaagcccccaaacagtctccatggtgggcacaagggatttgataaaaaggtttgggaggcaactaatattacgaagggcgagaatccatccatcactttcaaatatcacagttctgatggggaggaaggttacccgggtgatgtctctgtgacagcaacttacacgcttacttcaagcacaacaatgaggcttgacatggaagctgtgccaaacaagccaactccaatcagcttagctcagcatacatattggaatttagctggccacaactctggaaacattcttgaccattcaattcagattatggcaaaccatgttactcctgtggatcagaacacaatcccaactggtgaaatcatgccagttaagggtaccccctttgatttcactgctgagaagaggataggtgagtcaatccatgaggttggtttagggtatgaccacaactatgttctagactgtggggaggaaaaagcaggtttgaaacatgctgcaaaagtgaaggacccatcaagctctaggatcctcaacttgtggagcaatgcccctgggatgcagttttacactgggaactatgtgaatggggttgttggtaaaggaggcgccgtttatggaaagcatgctgggctatgtttggagactcagggattcccaaatgccataaaccaaccaaacttcccttctattgttgttcaacctggtgagaagtatcaacacacaatgttgtttgagttttcagttgaataaagtggcagtctttaaaggagcagatgtcagaataaggttgacttttggttttcttgctaccaatgagtgttggaaccggatgatgagaactattcatataatcttgcttataacagatttagaggatgttctttgtgtcgaagttccgaagaaagcttaatgttattaaagagttaaactctttcaaagaaatctccacacccctccccctttcccaagggcgggtgcttttctctcacttaagctgtttgactgacaaagatcacaaca

SEQ ID NO: 8045 - DNA, 1422 bp, Quercus alba
aattcccgggatgaaatagtatccgattctctcacagctcagaaatcagaacctgagtacacactctctctatctctcaattctcaaactgaaagaaaacccgatggccgatcaaaatctgaagcccgagcttttcgaactcaacaatggaaccatgcgtgcactcatcaccaacctgggctgcaccatcacttccttgtctgtacctgacaaagatggcaaattggctgatgttgttcttggattcgactctcttgaaccatatctgaaaggtgctgcaccctattttggcagcatcgttggtcgggttgcaaaccgaatcaaagatgggaagtttaaactcaatggggttgattactctttgcctatcaacaagcccccaaacagtctccatggtgggcaccagggatttgataagaaggtttgggaggcaactaatattacgaagggcgagaatccatccatcactttcaaatatcacagttctgatggggaggaaggttacccgggtgatgtctctgtgactgcgacttacacgcttacttcaagcacaacaatgaggcttgacatggaagctgtgccaaacaagccaactccaatcagcttagctcagcatacatattggaatttagctggccacaactctggaaacattcttgaccattcaattcagattagggcaaaccatgttactcccgtggatcagaacacaatcccaactggtgaaatcatgccagttaagggtaccccctttgatttcactgctgagaagaggataggtgagtcaatccatgaggttggtttagggtatgatcacaactatgttctagactgtggggaggaaaaagcaggtttgaaacatgctgcaaaagtgaaggacccatcaagctctaggatccttaacttgtggagcaatgcccctgggatgcagttttacactgggaactatgtgaatggggttgttggtaaaggaggcgctgtttatggaaagcatgccgggctatgtttggagactcagggattcccaaatgccataaaccaaccaaacttcccttctattgttgttcaatctggtgagaagtatcaacacacaatgttgtttgagttttcagttgaataaagtggcagtctttaaaggagcagatgtcagaataaggttgacttttggttttcttgctaccaatgagtgttggaaccggatgatgagaactattcatataatctgcttataacagatttggaggccgttctttgtgtcgaagttctaaagaaagcttaatgttattaaagagttaaactctttcaaagaaatctcccctcttcccaagggcgggtgcttttctctcactctggctgtttgacttacaaagatcacaacataattactgcatttttctatcaattagtaaaatggtgtggtat

SEQ ID NO: 8046 - DNA, 1367 bp, Trigonella foenum-graecum
cggccggggggaactaactaagacaattaattgatcaaccaaaatggccgcaacgcaaactcagctgattcctcatgtcacacttggaacccaaggctttcaggtttcaaaattgggatttgggtgtatgggactcactggagcttacaatgatcctcttcctgaacaagatgctatttccgtaattaactatgcattcagcaaaggaatcactttttttgatactgctgatgtttatggagttactggtgctaatgaaattttacttggaaaggctttaaagcaattaccaagagaaaagatccaggtggctacaaaatttggtatatccagaagagatggttctggtatcactggtatgagcatcaagggttcaccggattatgtgcgctcatgctgcgaagctagcttgaaacgtcttggtgttgaatacattgatctctattatcagcatagagtcgatacttctatgcctattgaggatacagtaggcgaacttaagaaactggtggaagagggaaaagtgaagtatattgggctatcggaagccagcccagatacaataaggagagcgcacgccgttcatcccatcacagctgtacaaatagagtggtctctatggactcgcgacgttgaggacgagatagttcctctctgcagagaccttggtattggaattgtaccatatagtcctcttggtcgtggcttttttggtggtaaaggagttctggaaaatgtgccagcagttagctccctgacttctcatccccgcttccaagctgagaacttggacaagaacagaagcatatatgataggattgaaagtctaggcaagaagcatgggtgcactcctgctcagttagcattagcatgggtgctccaacaaggtcaggatgttgtgcctattcccggaacaactaagattaagaatctggatcaaaacctttgtgcattagcagtgaaactatcagaagaggacctgagagaaatttctgcagcagttcctgtggatgatatagcaggtagtagatactacaatggattggatcatttttcctggaagtttgctaacacacctccaaaagtttcaagggtgtcaacctgaagtataaatcccttttagttggagaatgcagtgagtcatgaataaagcgcaacaataatttctctatttgtacttgactcaattatgacttggcttatgaacgaatcaagactgcctttttacattttgttctgctgttttgattcgataaataacaagggatttcgatcaaattctcataggattccatgttagatgaacgtgaatcaacagactaatacaaaccaaatgtagatgataaaattaaggataatgctatgta

SEQ ID NO: 8047 - DNA, 1993 bp, Glycine max
tgcaacataaactcaaactcaaccgttcacacacacacttagcgtgacaccaaggacgtcgtcgttttaaccctcgacttgccgtaacgtaactgcagaacgcaacgacttgaatgaatgccatggtgaggaaaaaggagtgacaaaaaaagtattattactataaaaagcagtgtcgtatactgaaaaaacgacaacgaaatggagtgcgttgcggcgaggaacttggcggcaatggcgttctgcgtgagtcctttgtcgtcgaggttgaggctgcggaggaagaagctgtggagaagacgaaccgcgtcgtcgtcgtcgtcgtgcggcggccgcggcgtgcggtgtctgaaggtggaggcgaaggccgggagcgagagctgcgtggcgacgaaagaggacttcgccgacgaggaggattacgtgaaggccggtggctccgaactcgttttcgtccaaatgcaacagaacaaagccatggaaatgcaatccaagctcgcggataagttgccacctataggagatgatatactggatctagttgtgattggttgtggtccggctggtcttgctcttgctgctgaatcagccaagttaggactgaaagttgggcttattggtccggatctcccttttacaaacaattatggtgtgtgggaggacgaatttaaagatctcggacttgaaggttgcattgagcatgtttggaaggataccattgtctatctcgacaataaggaccccatttttattggtcgttcctatggacgtgtcagtcggcatctgcttcatgaggagttgttaagaaggtgtgtcgagtcaggtgtctcgtatcttagctcaagagtagaaagtgttattgagacgagtaatggtcatagtcatgttgtctgtgaatatgacgttgtagtgcccagcaggcttgttactgttgcatcaggagctgcttcagggaaactgttgcaatatgaggtcgggggtccaaaggtttctgtccaaacagcttatggtgtggaagttgaggtggaaaacaatccttatgatccaaatctgatggttttcatggattacagagactacatgaagcaaaatgttcaatgtccagaagcaaattatccaacatttctttatgcaatgcccatgtcccatacaaaagtgttctttgaggaaacctgtttagcatcaaaagatgctatgccttttgatttactaaagaagaagctcttttcgagattaaatacaatggggatcagaattaagaaaacttatgaagaggaatggtcttatatcccagttggtggatccctaccgaacacagaacaaaagaaccttgcatttggtgcagctgccagcatggtgcatccagctacagggtactccgttgtgagatctttgtcagaagctccaaaatatgcttcagtaattgctactattttgaaagatggtcatgccaaggacatcattactcaagaaagaagaaaggagaatctatctatgcaagcttggaatacactttggcctcaagaacggaaacggcagagagcattctttctttttggattagccctaattctgcagctggacattgagggcattcgaacattctttcgtactttcttctgcttacctgattggatgtggcagggatttcttggctcctccctctcatctacagatcttgtattatttgcattctacatgttcataatagcaccaaataacttaagaatgggtctagtcagacatctactttcggatcctactggtgcaactatgataaagacttacttaacgatatagtacgtttctataacttatttattccccaccctaggtaccctgtattgggacacgggttagattactataggagcctcaatagtagttcgtagattcttgtatagacatacatattttattaaaaccagagatatgttcttatgatttttatatcccatctgatattaaagtgcactacgtttatttatatttt

SEQ ID NO: 8048 - DNA, 1766 bp, Glycine max
aatggagtgcgttgcagcgaggaacttggcggcaatggcgttttgcgtgagtccttcgtcgtcgaggttgaggttgcgacggaagaagctgtggagaagacgagccgcgtcgtcctcgtcgtcgtgcggcggcggccgcggcgtgcggtggctgaaggtggaggcaaaggcggggagcgagagctgcgttgcgaccaaagaggacttcgccgatgaggaagattatgtgaaggccggtggctccgaactcgttttcgtacaaatgcaacagaagaaagccatggaaatgcagtccaagctcgcggataagttgccacctataggagatgatatactggatctagttgtgattggttgtggtccggctggtcttgctcttgctgctgaatcagccaagttaggactgaaagttgggcttattggtccggatctcccttttacaaacaattatggtgtgtgggaggacgaatttaaagatctcggacttgaaggttgcattgagcatgtttggaaggataccattgtctttcttgacaataaggaccccatttttattggtcgttcctatggacgtgccagtcggcatctgcttcatgaggaattgttaagaaggtgtgtcgagtcaggtgtctcgtatcttagctcaagagtagaaagtattattgaggcaaccaatggtcatagtcatgttgtctgtgaatatgacattgtagttcccagcaggcttgttactgttgcatcaggagctgcttcagggaaactgctgcaatatgaggtcgggggtccaaaggtttctgtccaaacagcttatggtgtggaagttgaggtggaaaacaatccttatgatccaaatctgatggttttcatggattacagagactacatgaagcaaaatgttcaatgtccagaagcaaattttccaacatttctttatgcaatgcccatgtcccgtacaagagtgttctttgaggaaacctgtttagcgtcaaaagatgccatgccttttgatttactaaagaagaagctcttttcaagattaaatacaatggggatcagaattacgaaaacttatgaagaggaatggtcttatatcccagttggtggatcgttaccgaacacagaacaaaagaaccttgcatttggtgcagctgccagcatggtgcatccagccacagggtactctgttgtgagatctttgtcagaagctccaaaatatgcttcagtaattgctactattttgaaagatggccatgccaaggacattattacgcaagaaagaagaaaggagaatctatctatgcaagcttggaataccctttggcctcaagaaaggaaacgccagagagcattctttctttttggattagctctaattctgcagctggacattgagggcattcgaacattctttcgtactttcttctgcttacctgattggatgtggcagggatttcttggctcctctctctcatctacagatcttgtattatttgcattctacatgttcataatagcaccaaataacttgagaatgggtctagtcagacatctgctttcggatcctactggtgcaaccatgataaagacttacttaacgatataatacgtttctataacttatctattcccacgctaggtaccctgtattgggagacgggttagattactataggagccacaatagtagttcgtagattcttgtatagacatgcatattttagttaacaccagaaatgttcttttatgatttttatatcccgtctgct

SEQ ID NO: 8049 - DNA, 2023 bp, Vigna unguiculata
  misc_feature (1973)..(1973): n is a, c, g, or t
gcgatctccaaccagaaagcgaactcaactattgcacgaaaacacacacacacatttagcgtgatgcagagtacgtcgccgttttaagaatcgatggtgtaacaacatcttcagtgcttcacacacaaatacttaatgtcatggtgaggaggagggagtgataaagaaactaccaaatcagtggcgtatactgaaaacgacaacgaaatggagtgcgtttcagcgagaaacctggcggcaatggcgttttgcgtgagtccttcgccaaggttgagattgcggaagaagaagctgtggagaagacgaaccgcgtctggaggccatggcgttcgctggcgctcgcggtggctgaaggtggaggcgaaggcagggggcgagagttgcgtggcgaccaaagaagacttcgctgatgaggacgattacgtgaaggccggtggctccgaactcgttttcgtacaaatgcaacagaacaaagccatggaaatgcaatccaagctcgtggataagttggcccctataggagatgatatactggatctagttgtgattggttgtggtccggctggtcttgctctagctgctgaatcagccaagttgggactaaaagttgggctcattggcccggatcttccttttacaaataattatggtgtgtgggaggacgaatttagaggtctcggacttgaaggttgcattgaacatgtttggaaggataccgttgtctatctggacaacaaggatcccgtttttattggacgttcctatggacgtgtcagtcggcatctgcttcatgaggaattgttaagcaggtgtgtcgagtcaggtgtcacatatcttagctcaagagtagaaaatattattgaggcgagcaatggtcacagtcatgtcgtctgtgaatatgatattatagtgcccagcaggcttgttactgttgcatcaggagctgcttcggggaaactgttgcaatatgaggtcgggggtccaaaggtttctgttcaaacagcttatggtgtggaagttgaggtggaaaacaatccttatgatccaaatgtgatggttttcatggattacagagactacgtgaagcaaaatgttcaaggtctagaagcaaattatccaacatttctatatgcaatgcccatgtcccgtacaagagtgttttttgaggaaacctgtttagcgtcaaaagatgcgatgccttttgatttactaaagaagaagctctttttgagattaaattcaatggggatcagaattactaaaacttacgaagaggaatggtcttatatcccagttggcggatccttaccaaacacagaacaaaagaaccttgcatttggtgcagctgccagcatggtgcatccagccacagggtactccgttgtgagatctttgtcagaagctccaaaatatgcttcagtaattgctaatattttgaaagatggccatgccaaggacaatattacccaagaaagaagaaaggagaatttatctatgcaagcttggaatacactttggccacaagaaaggaaacggcagagggcattctttctttttggattagctctaattctgcagctggacattgggggaattcgaacattctttcgtactttcttctgcctacctgattggatgtggcagggatttcttggctcctcactctcctctacagatcttgtattatttgctttctacatgttcataatagcaccaaataacttgagaatgagtctagtgagacatctgctttcagatcctactggtgcaatcatgattaaggcttacttagcggtatagtacgtttcttttacttatttcccacgttaggtactcgtattgggagacaggttagattactataggagccattacagtaattagtaggttcttgtatagacatacatattttaatctgatatggtcttatgaattttatatcccatctgcaattaactgcacgtccattttanacggttgtagctcttttggcggtagaaatgttttccatcattttcttcca

SEQ ID NO: 8050 - DNA, 2016 bp, Cajanus cajan
gttcacacacactctctctcagcgtgacactgagaacgttgtcgttttgagactcgagtttttgtaactgatttggtgcttggaagcgacgcttgcatgccatggtgaggagcaaggagtgatataaaagttagtgccgtgtaccagaaacgacaacagaatggagtgcgttggagcgaggaacgtggcggcaatggcgttttgcgtgagtcctgcgtcgaggttgaggctgcggaggaagaagctctggaggagacgagcctcctcctcctcgtcgtcgagcggccacggcgttcgttgccgttcgcggtggctgaaggtggaggcgaaggcggggagcgagagttgcgtcgcgaccaaagaggacttcgccgatgaggaggattacgtcaaggctggtggctccgaactcgttttcgtccaaatgcagcagaacaaagccatggaaatgcaatccaagctcgcggataagttaccacctatctcgataggagatgatatactggatctagttgtcattggttgtggtcctgctgggcttgctctggctgctgaatctgccaagttaggactaaatgttgggcttattggtccagatcgccctttcacaaataattatggtgtgtgggaggacgaatttaaaggtcttggacttgaaggttgcattgagcatgtttggaaggataccgttgtctatcttgacaataaggaccccgttttaattggacgttcctatggacgtgtcagtcggcatctgcttcatgaggaattgttaagaaggtgtgtcgagtcaggtgtctcgtatcttagctcaagagtagaaagtattgttgaggctagcaatggtcttagtcatgttgtctgtgaatatgatattgtagtgccctgcaggctagttactgttgcatcaggagccgcttcagggaaactgttacaatatgaggtcgggggtccaaaggtgtctgtccaaacagcttatggtttggaagttgaggtggaaaacaatccttatgatccaaatttgatggttttcatggattacagagactacatgaagcaaaatgttcaatgtccagaagcaaattatccaacatttctttatgtaatgcccatgtctcgtacaagagtgttctatgaggaaacctgtttagcgtcaaaagatgcgatgccttttgatttactaaagaaaaagctcttttcaagattaaatacaatggggatcaggattgcaaaaatttatgaagaggaatggtcttatatcccagttggtggatccttgccaaacactggacaaaagaaccttgcatttggtgcagctgctagcatggtgcatccagccacaggctactccgttgtgagatctttatcagaagctccaaaatatgcttcagtaattgcaactattttgaaagatggccatgccaaggacgttttttctcttgaaagaagaaaggagaatctatctatgcaagcttgggatacactttggccacaagaaaggaaacggcagagagcattctttctttttggtttagctctaattctgcagctggacattgagggcattagaacattctttcgtactttcttctgcttacctgattggatgtggaagggatttcttggctcctctctctcatctacagatcttgtattatttgcattctacatgttcataatagcaccaaataacttgagaatgagtctagtcaaacatctgctttcagatcctactggtgcaactatgataaaaacttacttaacgatatagtacgtttttataactcattccccacgttaggtaccctgtgttgggagacaggttagattactaaaggagccataatagtaattagtaggttgttgtatagacatacatatcttattaaaaatttaaactacatatgttcttaagttatgatttttatttcccatctgctgttaaattgcacgtccatttttatgcgcctcttgtagctctctggtaaagaaaaaaaaagtaaaaaactctgacgt

SEQ ID NO: 8051 - DNA, 719 bp, Trigonella foenum-graecum
cggccgggggacaataaggcaacgacaactacgtaataaccacactactataaaaaacacaactccacacaaacctcaaacctcaccaaacaaaaacacaaaagagacccacaaactctaaaatcaattatttccaacaaaaccagcaaagcaaaaacatggctggtttaagaatcatcacttttgtgtcattcatggtagctatggtgttgttgatgataaacactacagaggcacaaacaacagaaataccctcttgtgcttcaaatctaattccatgtgctgggtaccttaactcaaccaaaccacctagctcttgctgtgatccaataaaaaaaacagttgaaactgaactcacatgtctttgtaacctcttctatgctcctggtttgcttcaaagctttaacatcagtactgctcaggctcttaccttaagtcgtaactgtggtgttaccagtgatcttaccagctgcagacacaatgggtcagcaccagctccgactgccggcgggtccccaccaggtcgtgataaaggagctgcaggcagagtctcattcactggattttctttcctagtcttattggcatccatgttgttcaattaggaaagtggctgtgtctgtttactcttcagaaacctcttctgtatttaatttatctatctatgtagtaatttcatacattgattggctactgagatatttcagtgagtttatttt

SEQ ID NO: 8052 - DNA, 2841 bp, Glycine max
catagtagtagtggagaggtctttcattattcagttggatttagcaccaccaagatgaaggttcaagaaacgaggtcgcatgttcatgcacttggggaagaagagaaggtgatgacaaggaagcagaaggctgagtccaaggcacatgaagtggaacattctccaaagaaggccaaggtggaaaaagaagatggccacatcaacgggaaatctgaaactggcgttgcagaagaatatgatgagttctgcaaagccacaaccgagcaccttcctttggaacaaatgagagacattctggaggccaatggccttgattcttctggctctgatcttgaaattacaagaagatgccaagacttgctgttttatggtgcattggacaaatgctcggtttgcaatgggagtttggagtttgatggcagacgttatgtttgcagagggttctacagtgagtgggctagttgcactttcagcaccagaaaccctccaaggaaacaggaacccattaagttacctgattctgttcagaactctctggcttcagacttgctaaagaaatatcaggacccgagtcacaggcctcacagggatctaggcttagcagaaaaaccctttactggaatgatgatctctctgatgggtcgtcttactcggacacaccattattggaaaacaactattgaaaagcatggagggaaggtggcaaactctataattgggtcaacttgtttggtagcttcacctgctgagcgagaacgtggtggcacatccaaacttgcagaagccatggagaggagtataccagtggttagggaggcttggttgattgacagcattgaaaagcaagaaccacaacctttggaagcttatgatcttgtctctgatctttctgtggatggcaagggtatcccctgggacaaacaagatcctggggaagaggctatcgaatcactctcagcagaactcaagctttatgggaagagaggagtctataaagataccaagttgcaggaacaaggtggaaagatatttgaaagagatgggatactatacaactgtgccttctctgtttgtgaccaagggcgaggactgaatgactactgtgtcatgcaactgattgttgtcccagagaatcgtttgcatctgtactttaagaaagggagagttggggatgatccaaatgcagaggagcgattagaagagtgggacaatgtagatggtgctctgaaagagtttgtgaggctctttgaggaaataacaggaaatgagtttgaaccttgggaaagagagaagaagttccaaaagaaacctttgaagttttaccccattgacatggatgatggaattgaagttagacatggggcactaggtcttcggcagctggggatagcagcaacacactgcaaacttgagcctttggttgcaaattttatgaaggtcttgtgcagccaggagatatataagtatgcattgatggagatgggttacgactgtccggaccttccaataggaatggttacaaatcttcatctgaaaaaatgtgaggacgttctcttagaattcatagacaaggtgaaatcattgaaagagactgggcccaaggctgaggctgtgtggactgattttagccaaagatggttcactctgatgcactccacaaggcctttcaattttagagattaccaagagattgcagatcacgctgctgctgcgttagagggggtgagagacataacccaggcttctcacctcataggagatatgactggctcaaccattgatgacccgttatcagagacatacaagaaattgggttgctcaatttctgccttggacaaaagttcagatgattacgagatgattgtgaaataccttgaaaaaacttatgagccggtcaaagttggtgacattgaatatggggtgtcagtggaaaacatttttgcggttcaaacaggtggttgcccttcctatgaagacattataaaactaccaaataaggttcttctatggtgtggatcacgaagctcaaacctcttgaggcacttgcaaaagggattcttgccagcaatatgctcattacctattccgggttatatgtttggcaaagctattgtctgttctgatgctgcagcagaggctgcaagatatggttttactgctgtggacaggccagaaggattcttggttttggccattgcttctctaggaaatgagattaccgagttgaaaaccccacctgaggatgcatcatctttggaggaaaagaaggttggagtgaagggaccggggaagaagaaaacagatgaatcggagcattttgtttggaaagatgatataaaagttccttgcggtaaactagttgcctcagaccatcaagatagccccctggaatacaacgagtatgctgtctacgataaaaagcgggcacgcataagctacttggtgggagtgaagtatgaagagaaggaagagaagggtgcggtgattgacacagctgaatgatgggaccaaaaaggatgtaagggaagcttttcttttttgtgatgcgggaattgaaagctatgaccatctatgtactagtagtttctctagttagtggaaaatttatgtcattttgatgtatatttacatgtgataaaataggctgtatgtggtgtcacattttgatgtatgtataggtaaatggcccgttagttagggtaagtaaatattttgtcctacacatgacggcatgagaatggaactacatctaacactatgttgtttcagtcctagttgactactctgtctgtatgaatgagatgatatagtagaaatggtataatgatgtccttttgttta

SEQ ID NO: 8053 - DNA, 2371 bp, Cajanus cajan
ggggatcaacggaaaatctgcaactgatgttacagaagaatataatgagttttgcaaagccacaaacgagcacctgcctttggaacaaatgaaagagattctggaggctaatggccttgattcttctggctctgatcttgaaattacacgaagatgccaagacttgctgttttatggtgcattggacaaatgctcggtttgcaacgggagtttagagtttgatggcagacgttatgttcgcagaggtttctacagtgagtgggctagttgcattttcagcaccagaaaccctccaaggaaacaggaacccattaagttacctgattctgttcagaactctctggcttcagatttgctaaagaaatatcaggatccgagtcacagaccacacagggacctaggcttagctgaaaaaccctttactggaatgatgatatctctgatgggtcgtcttactcggacacaccattattggaaaacaactattgaaaagcatggagggaaggtggcaaactctataattggggcaacttgtctggtggcgtcacctgctgagagagaacgtggcggcacatccaaacttgcagaggccatggagaggggtattccagtggttagggaagcttggctgattgacagcattgaaagcaagaaccacggcctttggaagcttatgaccttgtctctgatctttctgttgacggcaagggaatcccctgggacaaacaagatcctggggaggaggctattgaatcgctctcagcagaactcaagctttatgggaagaggggggtttataaagataccaagttgcaggaacaaggtggaaagatattcgaaagagatgggatattatacaattgtgccttctctgtttgtgatcaagggagacgactgaatgactactgtgtcatgcaactgattgttgtcccagagaaccgtttgaatctctactttaagaaagggagagttggcgatgatccaaatgcagaggagcgattagaagagtgggacaacgtggacagtgctctgaaagagtttgcgagactctttgaggaaattactggaaatgagttcgaaccttgggaaagagagaagaagttccagaagaagccattgaagttttaccccattgacatggatgatggagttgaagttagacacggagcactaggtcttcggcagctgggaatagcagtaacgcacagtaaacttgagcctttggttgcaaactttatgaaggtcttgtgcagccaggagatatataagtatgcattgatggagatgggctacgactctccggaccttccaataggaatggttacaaatcttcatctgaaaagatgtgaggacgttctcttagaattcatagacaaggtgaaagcattgaaagagactgggcccaaggctgaggctgtttggactgattttagccaaagatggttcactctgatgcactccacaagacctttcaattttagagattatcaagagattgcagatcatgctgctgctgccttggagggggcgagagacataaccctcgcttctcacctcataggtgatatgagtggcgcaaccattgatgacccattatcagagacatacaagaaattgggttgctcagtttctcccttggacaaaagttcaaatgattacgagatgattgtgaaataccttgaaaaaacttatgagccagtcaaagttggtgacattgattatggggtgtcagtggaaaacatttttgcggtccaaacaggtggttgcccttcctatgaagacatagtgaaactgccaaataaagttcttctatggtgtggatcacgaagctcaaatcttttgaggcacttgcacaaggggttcttgccagcaatatgctcactaccggttcccggttatatgtttggcaaagctattgtctgttccgacgctgcagcagaggctgcaagatatggttttactgctgtggacaggccagaagggttcttggttttggccattgcttctctaggaaatgagattactgagttgaaaagcccacctgaggatacatcgtctttggaggaaaagaagattggggtgaagggactggggaagaagaaaacagatgaatcagagcattttgtttggaaagatgatattaaagttccctgcggcagactagttgcttcagaccatcaagatagtcccctggaatacaacgagtatgctgtctacgaacctaagcaggtacgtataagctacatggtcgaagtgaagtatgaagagacgggtgctgtgatcgacacaactgagtgattgagcaaaaagatgacgggggatggaatgcacgagttgaaagatatgatcatcttgtctgaagttgtactag

SEQ ID NO: 8054 - DNA, 1222 bp, Glycine max
agcaccgtgtccacaagattcttagagctcggcaaccttattgggacctcaacttctacattaatctttccaccagacatcagcttccatgattttctgcactctattctgaggtgaccaattctgttcttcttttctcgcataataaagtaatcaataagcacataaaccttcgaggacatggcatcagccttgtccacgaccagtgtgctttgctggaggaatcctcagcacatgcatattatctcaccctcttcacagacacttcaaaatggaactctaagaactgtagctgcttcagcctcaaaagatatcagcatagaaagtgacaagtgttcctctttgttggtgaacagaagaacaattttggcttctggggtttccttgttgtctttcccgggtgagagtttggctgtggtgaaacaaggccttctagcagggagaattcctggcctgtccgagccagatgaacaaggttggaggacctatcgcaggccggatgagaagtcaggaggacatggtgttggatggagtcctattattccatacagcttcagagtgcctgaagaatgggaagaggtaccagtatcaatagcagatcttggtggcacagagatagatttgagatttgccagctctaaggaaggacgtttgtttgtcattgttgctcctgttcttagattctccgatgatcttggtgacaatgctacaatagaaaaaattggacctccagagaaagtgatcaatgcatttggtccagaaatgattggggaaaatgtagaagggaaggttctgagcgttagtgcagcagaacatgaaggaagaacttactaccagtttgagctagagcctccccatattttcattactgccactgcagctggcaaccgcttatatttgtttggagtaacaggcagcggtcttcagtggaagagacactacaatgatttgaagaagatagctgaatctttccgggttgtataactaaaatcttctgtgaacccagagctaattgaaatgcagctttctatatttgtagtgtagtacaacaaagaggttgtttcccactactttgtctgactgggatttatgtgaatcaagagatcatataggcaaaatctttgtaccttcaatataccaaaccagtcgtgttatatttcaaagttgctgttctacgttctaagtacacatcaaatgctatgaaattttatagtgataatta

SEQ ID NO: 8055 - DNA, 1125 bp, Cajanus cajan
ggggatcggacatcggttcctatgattttctgcaatcttgttttctgagttgacgaaattcttttcccctttctctagcatcctaaagtaaccaataagcacataaaccttcgtggacatggcaacagccttgtccacgaccagtgtgcttcgctggaggaatccacagcacatgcatatctcaccctcttcacagacactttgccactcctcactccaaaatggaactttaagaactgtagctgcttcagcctcaaaagacatcaacagagaaagtgagaagggttcttctttgttggtgaacagaagaacagtcttggcttctggggtttccttgttgggcttcccgggtgagagtttggccgtggtgaaacaaggccttctagcagggagaattcctggtctgtctgaaccagatgaacaaggctggaggacatatcgcaggccagatgaaaagtcaggaggacatggggttggatggagtcctattatcccatacagcttcagagtgcctgaagaatgggaagaggtaccagtatcaatagcagatcttggtggcacagagatagatttgagatttgccagctctaaggaaggacgtttgtttgtcattgttgcccctgttcttagattctctgataatcttggtgacaatgctacaatagaaaaaattggacctccagagaaagtgatcaatgcttttggtccggaaatgattggggaaaatgtggaagggaaggttctaagttctaatgtagcagaacatgaaggaagaacatattatcagtttgagctagagcctcctcatattttcattactgccactgcagccggcaatcgcttatatttgtttggtgtaacaggcagtggtcttcagtggaagagacactacgatgatttgaagaagatagctgagtcttttcgggtcgtataattagaatcctctgtgaactaagagatcattgaaatgcagctttccgtatttgtagtatagtacaacgaagaggttgtttcccactactttgtctgattgggatttatgtgaatcgagagatcatatatgttaaatctttgaaccttcaatataccaaaccagttttgttacatttggtaggtgtcattcta

SEQ ID NO: 8056 - DNA, 1135 bp, Glycine max
attaggacctcaacttctacattaatctttccatcagacatcagtttctatgattttctgcactcttgtattctgagctgaacaaattctgttcttctctcgtatagtgaagtaaacaataagcacataaaccttcgtggacatggcaacaacagccttgtccacgaccagtgtgctttgcaggaggaaacctcagcacatgcatattatcctaccctcttcacagacactccaaaatggaactctaagaactgatgtaactgcttcagcctcaaaagataatatcagcatagaaagtgagaagtgttgttcctctttgttggtgaacagaagaacagttttggcttctggggtttccttgttgggtttcccgggtgagagtttggctgtggtgaaacaaggccttctagctgggagaattcctggcctgtccgagccagatgaacaaggttggaggacgtatcgcaggccggatgagaagtctggaggacatggtgttggatggagtcctattattccatacagcttcagagtgcccaaagaatgggaagaggtaccagtatcaatagcagatcttggtggcacagagatagatttgagatttgccagctctaaggaaggacgtttgtttgtcattgttgctcctgttcttagattctctgatgatcttggtgacaatgctacaatagaaaaaattggacctccagagaaagtgatcaatgcatttggtccagaaatgattggggaaaatgtagaagggaaggttctgagcgctaatgtagcagaacatgaaggaagaacttactaccagtttgagctggagcctcctcatattttcattactgccaccgcagctggcaaccgcttatatttgtttggtgtaacaggcagcggtcttcagtggaagagacactacgatgatttgaagaagatagctgaatcttttcgggttgtataactagaatcttctgcgaacccagagataattgaaatgcagctttctatatttgtattgcagtacaacaaagaggttgtttccctctactttgtctgactgggatttatgtgaatcaagagattatatatgcaaaaatctttgtaccttcaatataccaaaccagttttgttacatttc

SEQ ID NO: 8057 - DNA, 1061 bp, Phaseolus coccineus
  misc_feature (22)..(22): n is a, c, g, or t
  misc_feature (82)..(82): n is a, c, g, or t
cgacaatctgcagtcttgtatnctgagctgcccaaattcttttcccttttcaatctcatcctaaagtaaccactaagcacancaaccttcgtggacatggcaacagccttgtccacaaccaccgtgctatgctggaggaatccgcagcacatgcatgtcccaacctctccacatacactttgccactcctcacagcaaattgggattctaagaactctgactactttagcctcaaaagacagagaaagcgagaagtgctcctctttggtgaacagaagaacaattttggctgctggggtttccttgttgggttttccgggtgagagtttggccgtggtgaaacaaggccttcttgctgggagaattcctggcctgtccgaaccagatgaacaaggttggaggacgtatcgcaggccagatgagaagtctggtggacatggtgttggatggagtcctataatcccatactccttcagagtgcctcaagaatgggaagaggtaccagtatcaatagcagatcttggtggcacagagatagatttgagatttgccagctctaaggaaggacgcttgtttgtcattgttgctcctgttcttcgattctctgatgatcttggtgacaatgctacaatagaaaaaattggacctccagagaaagtgatcaatgcatttggtccagaagtgattggcgaaaatgtagaagggaaggttctgagctctaatgtagcagaacatgaaggaagaacgtattaccagtttgagctagagcctcctcatgttttcattactgccactgcagctggcaatcgcttatatttgtttgctgtaacaggcagtggtcttcagtggaagagacactacgatgacttaaagaagatagctgagtcttttcgggttgtataatttgaatcttttgtgaaccgagagatcgttgaaatgcagctttctgtatttgtagtatagtacaagaattggttgtttctcaatactgtgactaatttggaatttttatgttgaatctttgaaccatcaataatataccaaacattgttacattcggt

SEQ ID NO: 8058 - DNA, 964 bp, Lotus japonicus
gaatgttgagagttgtgagatcatccgttcccagattcttcaccacaacccctcttcccaccttttcaccctttgcttcttctcgtttctcagttcgttccatcgctgattctgctgctcctttccagaaaatccagattcaaagggaagacactacatttgatgcatatgttgttggcaagcacgatgctcctggaattgttgtgcttcaggagtggtggggtgtggattattaaatcaaaaatcatgctgtcatgatttctcagcttggtcgtggatttaaggctcttattccagatctgtacagaggaaaggttggtctagatgttgccgaagcgcagcatttgtttgatggtcttgattggcaaggtgcggtgaaggatgtccgcgcttcagttgactggcttaaaacaaatggttcgaggaaggctggtgtaactggcttttgtatggggggtgctctcgctattgccagctctgtcttggttccagatgttgatgctgctgtagctttctatggttttccttcgtctgagcttgcagaccctgcccaagccaaggctcctgttcaggctcactttggagagctggatgattttgttggcttttcggatgttacggctgcgaaggccttggaggagaaattgaaggcatctggagttccacacgaggtacacatatatcccggcaacagacatgcatttatgaacagatctccagaaggaatcaataggaggaagagcatgggaatgcctgatgaagatgaagctgcagttcagctcgcctggtctcgcttccagtcatggatgacacattacttgtctagttagttaatttatcactagctgaagtatgatataatgctatactctatcttaggtagaaaagtaacatgactgctgtaatctctaactaaatgtgttgcttccgtacttgtgataaaattgacttggaggataattta

SEQ ID NO: 8059 - DNA, 1317 bp, Populus trichocarpa
aaacccagcggagtggagagtaatgataagaggagagaataataataaagattaaagagtatgttactgttcatcagcttccagaatcttcgccgccgccagtagaaatcccttctccatctccggttcacgctttcaagttcgtgcaatggccggatctgcgtctcaacctttcaagaaaatccaaatccagagagacgatactacatttgatgcatatgttgtcgggaaagaagatgctcctggtattgttgtacttcaagagtggtggggtgtcgatttcgagatcaagaaccatgctgtcaaaatctcccaacttggccctggattcaaggcccttattccagatttgtatcgaggaaaggtcggtttggacgttgctgaagctcagcatttgatggatggtcttgattggcaaggtgctgtcaaggatatccaggcttcggttaattggctcaagacaaatggttcaagcaaggctggagtaactggattttgcatggggggtgctctctctattgcaagttctgttctggttcctgaggttgatgctgttgttgcattctatggtgttccttcatcgcagctcgctgaccctgctcaggctaaggcacctgttcaggctcattttggagagcttgataattttgttggcttttcagatgttacggctgccaaggctctggaggaaaagctgaaagcatcaggaattccatatgaggtgcacatttatccaggcaatgcacatgctttcatgaacaggtctccagaaggtgtgatgaggaggaagggcatggggctgcctgatgaggatgaagcttctgctgagttggcttggtcccgattcacaacatggatgacccgttacttatctgcataagtgagtggtcggtttgatatacccatcttgcctgcttgctatctagcgtaaatagcagcttggtatgttacctagatgtaagttggaaggtctgggataaattatgcgtgctcccctcctgtgcaagtctgataatggcacaagtgatgtttgtaaagtgattgagtttgtttttaacagctgctgttgtgatttggcatgacatctttcgctttcctgttaccctcgtttcttgcctggaatttaagtttcatggactgccagtatgctccatgcagcaatcctgctcaaatctctttctgtaagcactgtctccataaagtcccagagaacatgcagtgtataaatttggtttgtctgttggttgattgtcatcatcccgcacagatacatagattgcctggacgaataataaagagtgaaacataatgatctga

SEQ ID NO: 8060 - DNA, 1624 bp, Phaseolus coccineus
  misc_feature (4)..(4): n is a, c, g, or t
  misc_feature (6)..(6): n is a, c, g, or t
  misc_feature (192)..(192): n is a, c, g, or t
accncntcaaacgattcaacaaccattctctgatctaactttcaacgcaaactgcacaatcgcttccttcttcaaattcatcttctttctctcattcttctcttcaatttcatcttcaaaactctcatcaatttttttttattattattattatttaataacaacaataagaacactgttttcattcattcncactttctgtcaaaccttttcaatttcaatttcaatttctgttattcaattatgcaacgcgctctctctttctctctctagagagttcggtctgccatgtcatcacaaaccgccgcggcggaggcgccgctgctccgcaaccgccaagacgcggcccgagcgccggcgctggcgctcctcctcggccgcgccggccgccgagggccatccatgctggtgcgggagacggcggcgcgcgagctcgaggagcgccgcgcggactggggctactccaagccggtggtggcgctcgacatgtcgtggaacatggcgttcgtcgtcgtctcggtggtgatgctcgcatgcaccaccggcgagcggccgaactcgccgatccgcgtgtggatcgtggggtacgggctgcagtgccttgtgcatgtggtgctcgtctgggtagagtaccggcgccgtagccggagagactcgcgccgcggccagggggcgcgggacttggagagccaagccggaagtgacaacgatgatggcggcaacgacagcgacagcgatgacggtgatgggagctctggcaattcgtctcgctcccggttcacaaaacgatgtgaatcattaaatactggggtttcattcctttggtggatagtgggcttttactgggttgtctctggtggtgatatacttctgcaagatgccccacgattgtactggttggctgttgtctttctggcatttgatgtctttttcgccatcttttgtgttgtcttggcgtgcttgattggtattgctctttgttgttgtttaccctgcatcattgctatcctctatgcggttgcaggacaggaaggtgcgtcagaagcagatcttagcatacttcaaaaatacagatttcgaataccaagcaatgaggataagtccagtggtggaggtggatcaatggttcccatagaaaccagcagtgcttacttggcaactgaacgaatacttttaccagaggatgcggaatgctgtatttgcctctgttcatacgaggacggagcagagctccatgctcttccttgcaaccatcactttcattcttcatgcatagtgaaatggctgaagatgaatgccacttgtcctctctgcaagtacaatattctcaagggaaatgaacaagtgtgacagaaaagtgaagaacctaccaagtaccaactgcatctttcaacagctcttgtttattatgtgtatatagttttaaaacaaaactcgctgtgttttgatcgttggttcgttttatctgtttctgtagagaaaagatagcatttatttatgaataagttaactagtgtagtctacttggcattcacttgaaacttgtccactttatgaattgtttattacttttctgacggaaactggttgagtaatcatagcttttgttcatttttattgtgtt

SEQ ID NO: 8061 - DNA, 2025 bp, Tripterygium wilfordii
gcataacgtcacgcaaacgcccgccgccgcttccttctgtctcaaaagagatgttcggagtgagcacagccgccacggcctcccgcacaactgccgttttcgctgcgaactctttgggctctcgactgccgttgtctcagagacataccactcctctctcttgctctgtctcccaacaggttcatacaacttctctgcgctcttgttgtaatcatccagtcaaagccatggccgagcatcaaactacttcagtaccaaacaacgagcttaaagcctctgcttcttcctctggcaagaagcaagctctaatatctttgtcggacaagaatgatttggcccttcttggtactggtctccaggaattgggatacacaattgtatcaaccggaggaacagcatccactttggaaaatgcaggcgtctgtgtgactaaggtggaggagcttacctgtttccctgagatgcttgatggtcgtgtgaagactttacaccccaacgtacatggtggcattctcgctagaagagaccaaaagcatcacatggaagctctcagtaaacatggcattggtacttttgatgtggtagtggtgaacttgtaccccttttatgataaagttacttcaactggaggaattgcctttgaagacggaattgagaacattgatattggtggccctgccatgatcagagctgctgctaagaatcacaaggatgtcctggtagttgtcgatgcacaagactatcccgcactcttagaatttctcaaaggaaatcaggatgaccaacagttccgtagaaagcttgcttggaaggcttttcagcatgttgcttcttatgattctgcagtttcagagtggctatggaagcaaactgtgggagataagtttcctcccaggttaacggttcctctggaattgaagagttctcttcgttatggtgaaaacccccaccaaaatgctgcattttatactgacaagagtctttctgaggttaatgctggtggtattgctactgcaattcaacaccatggaaaggaaatgtcgtataataactacttagatgctgatgcagcatggaattgtgtttcggagtttcggaatccaacttgtgttgttgtaaagcatacaaatccttgtggggtagcatcacgtgatgatatccttgaagcctataggctggctgtgaaagcagacccagtcagtgcatttggtggtattgtagcattcaacatagaagttgatgaggctcttgcaaaggaaattcgtgagttcagaagcccaacagatggagaaacccgaatgttctatgagattgtggttgctcccagttacacaaagaagggacttgagattcttcgcggaaagtcaaagactctaaggatccttgaggcaaagaagaacgagaaaggaaagctttcattgagacaagttggcggtggatggttggctcaggattcagatgaccttaccccgaaagatataaaattcaatgtggtctctcggagaactccagaagaaagtgagctaagtgatgccgagtttgcatggctttgtgtgaagcatgtcaagagtaatgctattgtcatagcaaagaataactgcatgttgggtatgggaagtggtcagccaaaccgcctggagagtttgagaatagccttgaagaaagcgggagaggaggttaaaggggctgctttggctagcgatgcattcttcccttttgcttggaaagatgcagttgaagaggcatgcgagagtggagtcggtgttattgcagagcctggcgggagtatcagagatggggatgccatagattgctgcaacaagtatgaagtttctttactctttaccaatgtgaggcactttaggcattgagaacaacgatgacatttttctctgttttccgctataacacccctgaagttcagtgatgaacttagggtttatgtaccttatgtatctttattttacgaataacttattctcagaccttccgaacttaattttttcttcgtgtctcttataatag

SEQ ID NO: 8062 - DNA, 1213 bp, Zea mays
gctctgcatgccggcctttagccacttgccgcccctgagtctgcctcccaacgtaattcgctgtcacacacacccaacgctctcccctgagcctgcctcccgatgccacctcccttgtttaccgacccaacgcgtggagtttggggattatggaatgcttaacaacaagttttccaagaaatgttggaaaagagtacatctgttcaagcaagttggtgtccggaaaccaatggatccccaaaaggatttgctgctacgtctcttgttcgacaaactccagtcgatgccacaagttcactgatgtggcatgccccatgagcccagttattcgaaaaaggttacgctggagatgctttgctgcaagtttgaacttagaagatggccctgcaccctctgactcgacgtcatcttcatcagagcagactactgatgctgatggaactactaatggtgatgtatctgaaaatctgctttctcgaaagccaagctctgatgagttaaaggctcttttggctgattcggaacgaagtaggcttttgagaagactgagtgaagcaaatcaatataaccgattcctcaagagacagttgcaaataaaggatgatgcagtcgtaaaattcaaaggtgaacttgctgttttggaactagaaatgcaggctctggttggcctagctgaagaggttgctaattttgatgttccgttagggtctaggaagataaacggaaaatatattcaatctcatcttctctccagattagaagctgtccatgataagattatggaacaggtaaagagtgttgacgctttaaagacccaagaaattcctgtctactggattggcatggctgagaatgtgcagatcatgggttcattcgacggatggtcacagggcgaggcgatgtccatggagtattcaggtgactacggaagattctctgcaactctgaagctaagacctggaaggtacgagatcaagtttttggttgatggggaatggagattgtcgcctgaatatcccactgctggagatggactgacgcagaacaatattcttgttgtggagtaatacaacttcctcatctaccatttcagtcatccaaacaatgccgaagtgcacctacatctacatgtcttcttccatctgtaatactatgcttactatgtggacatgtggttgcctcacagaaatcgaataaattagcctatcctggc

SEQ ID NO: 8063 - DNA, 2449 bp, Zea mays
cgagagcaggagacagaggggctccccccccacccccgagcccaaacgcagctagctccccattccacccaagctcccgcagccagatgctctcccccgctcgagccccaccgccgccgcccgtccccgccgccgggtagaccgcccgatccgacggcgcccgccgcacccatgggccgcggcggcgcgcgcgcggcccccgccgccgcggtgccgccctggcacgcgctcccggacgaggtctgggagcacgccttctccttcctccccgcggactcggaccggggcgccgccgcgtgcgcctgccacgcctggctccgcttcgagcgccgctcgcgccgccgccttgccgtcgccaactgctacgccgcgtccccgcgcgacgccgtcgagcgcttccccgccgtccgcgccgtcgaggtcaagggcaagccccacttcgccgacttcggcctcgttccgcccgcctggggcgccgacgccgcgccctgggtcgccgccgccgccgccggctggccgctgctcgaggagattagctttaagcgcatggtcgtcaccgacgactgcctcgagatgatcgcggcctccttcaggaacttccaggtgctgcgcctcgtctcctgcgagggcttcagtacagccggcctcgctgccattgccgctgcttgcagaaatctaagagaacttgaccttcaggagaatgagattgaggattgctctattcattggctcagtctatttccagtatctttcacttctttggtaactctaaatttttcatgcctagagggggatgtcaatatcactgtacttgaacaattagtaaccagatgcagcaacctcaagactctcaagctcaacaatgctatacctcttgacaagcttgctaacctccttcgcaaggctcctcagattgtagaactcggaacaggaagattctctgcagattaccatccggatctcttttcgaagcttgaagcagcatttgctggctgtaaaagcttaagaaggctctctggggcttgggatgccgttccagaatacctgccagcattttattgtgtatgcgaaggcctcacatcactaaatctgagctatgctactgtacgaggccctgaactgattaaattcattagcagatgcaaaaatttgcaactcttatgggtgatggacttgattgaagaccatggtcttgctgttgtggcatcgtcttgtaacaaactgcaggagttgcgggttttcccttctgctcctttcgaagcagctgagcaggtctctttgactgaaagaggtcttgttgatgtatctgccagttgcccaatgctggagtcagtcctctacttttgcagacggatgaccaacgaggcccttattaccatcgcgaagaaccggcccaacttcacttgcttccgcctatgcatcattgagcctcacacaccagattacattacacaccagcctcttgatgcaggttttagtgccattgtggaatcatgcaagggcctcaggcggctttctgtttcaggccttctcacggacagtgtatttaaatccatcggggcacatgctgaccgtcttgagatgctctcgattgccttcgccgggaacagtgatttgggcctccattacatcctatcgggctgcaagagcttgaagaagctagagattagggactgcccatttggtgacaagcccttgctggcaaacgctgccaagctggagacaatgcgatccctttggatgtcgacgtgctcaatgaccttgggcgcatgccggcagcttgcgcgcaagatgccccgtcttagtgtggaggtcatgaatgatcctcgacggggattccccttggactctctaacagatgagagccctgttgagacgttgtatgtctaccggacaatttcaggtccaaggtccgacacaccagcttgtgtccagattctctaaggggcagctgtggtctacaaaggtactatggaagcatccattttcaatcacatcatgtaccttcaacaccttactagcataacctggatcgtctccttgaagtagcaaggctggtgacctcggtaatcctgtcataatctctgcttagctgtacaactgtttctgggagtttagggtgagagactcagggtccctttcaggtgttaataactgtagggaggacactcgatgagttacaggaactactagatagcgtcttgaggaaacttgggtttgttttcttagcgtgcctagttcttttcatgtataaaaaaatatgggatcattccaatgctgccacaatgtactgtactattggaacaattgtacttggagcctctacttttttgagttttgaccccctccccccccccccccccccccccccccactgattatgggttgctgttgctcccgcctgtgatttgtgaatgctatataaaagcttgtacgtggctctgccttc

SEQ ID NO: 8064 - DNA, 2646 bp, Setaria italica
ctgcagctagctccccccattccagctcccgcagccagatgctttcccccgtgagagccctaccgccgccacccgcagagctcctcccccggcccgtcccagccgccgggtagcctgatccgacggcccccgccgcccccatgggccgcggcggctcgcgcgcggcaccagccgccgcgatgccgccgtggcacgcactcccggacgaggtctgggagcacgccttctccttcctccccgcggactcggaccggggcgccgccgcggccgcctgccgctcctggctccgcgccgagcgccgctcgcgccgccgcctcgcggtagccaactgctacgccgcgtccccgcaggacgccgtcgagcgcttcccatccgtccgcgccgtcgaggtcaagggcaaacctcacttcgcggacttcgggctcgtaccgcccggatggggtgccgccgctgcgccatgggtcgccgccgccgccgatgggtggccgctgctcgaggagctcagcttcaagcgcatggtcgtcaccgacgactgcctcgagatgatcgcggcctccttcaggaacttccaggtgctgcgcctcgtctcctgcgagggattcagcaccgcggggctcgctgccattgccgccggctgcagaaatctaagagaacttgacctgcaggagaatgagattgaggattgctctattcattggctcagtctctttccggaatccttcacttcgttggtaactctaaatttttcatgcttagagggggatgttaatataactgtacttgaacgactagtaaccagatgtcgcaacctcaagactctcaagctcaacaattctatacctctcgacaagcttgctagccttcttcgcaaagctcctcagattgtagagcttggaacaggaagattctctgcggattaccatctggatctcttttcaaagcttgaagcagcatttgctggttgtaaaaacctaagaaggctttctggggcttgggatgctgttccagagtacctgccagcattttattgcgtatgcgagggcctcacatcactaaatctgagttatgctactgtacgaggccccgaactgataaaattcgttagcagatgcaaaaatttgcaactcttatgggtgatggatttaattgaggaccacggtcttgctgctgtggcatcatcttgtaataaactgcaggagttgcgggtcttcccttcttctcctttcgatgcagctgagcaggtttcattgactgaaagaggtcttgttgatgtctctgctggttgcccgatgttggaatcagtcctctacttctgcagacggatgaccaatgaggcccttattaccatcgcaaagaaccggcccaacttcacttgcttccgcctatgcatcatagagccacatacaccagattacatcacgcatcagcctcttgatgcaggttttagtgccattgtggaatcatgcaagggccttaggcggctttctgtctcaggccttctcacagaccgtgtatttaaatccatcggggcacatgctgatcgtctcgagatgctctcaatcgcctttgctgggaacagcgacttgggccttcattacatcctttcgggctgcaagagcttgaagaagctggagatcagggactgcccattcggtgataagcccttgctggcaaatgctgccaagctggagacaatgcgatccctttggatgtcgtcgtgctcactgaccctgggcgcatgccgacagcttgcacgcaagatgcctcgccttagtgtggaggtcatgaatgatcctcgacgtgcatgccccttggactcacttacagatgagagccccgccgagacgatgtatgtctaccggacaattgcaggtccaaggtctgacacaccaacctgggtccagattgtttaaggggtggcaacctgcagtaagggaaggtactatggagcatccattttcagtctggtttgtaccttcaacacatcccttgcataacatggatagtctccttgaagtagtaaggctggtgatctggataacccccatcataatctctgttcagatgtaaaactgttgctgcgagtttaagggcaagactcggggcccctttcaggtgttaataactgtagggaggagactggatgagttacagaaactactagatagcgtcttgagaaaacttggatttgttttcttagcgtgtttagttcttttcatgtataaaaaaatatgggatcattccaacgtcgcagtgtacttgtgctatcagaacaattgtaccaggagcctctgcttttttgacctcccctctcaaattatgggttgtcgctccaacttgtagtgatttgtgaatgtagaataattcaagcttgtctgtggccctttatttcacccggcgttatggagaaatgtacccggctgggttttagtctgtagtatcctcctgtggctgctagtgaactttaaattgcttctgaatctgttgttggctgcaagatgtttctttgtaagccaatgtaaaatttaccactagggcagcataacttggtgtttttctatggcacagtgaatataatgtaatgacatgtatccatccatgtggtatcggctgagtgctgaacacatggatcttcctagttctgtg

SEQ ID NO: 8065 - DNA, 1777 bp, Setaria italica
cgacggcccccgccgcccccatgggccgcggcggctcgcgcgcggcaccagccgccgcgatgccgccgtggcacgcactcccggacgaggtctgggagcacgccttctccttcctccccgcggactcggaccggggcgccgccgcggccgcctgccgctcctggctccgcgccgagcgccgctcgcgccgccgcctcgcggtagccaactgctacgccgcgtccccgcaggacgccgtcgagcgcttcccatccgtccgcgccgtcgaggtcaagggcaaacctcacttcgcggacttcgggctcgtaccgcccggatggggtgccgccgctgcgccatgggtcgccgccgccgccgatgggtggccgctgctcgaggagctcagcttcaagcgcatggtcgtcaccgacgactgcctcgagatgatcgcggcctccttcaggaacttccaggtgctgcgcctcgtctcctgcgagggattcagcaccgcggggctcgctgccattgccgccggctgcagaaatctaagagaacttgacctgcaggagaatgagattgaggattgctctattcattggctcagtctctttccggaatccttcacttcgttggtaacttagagggggatgttaatataactgtacttgaacgactagtaaccagatgtcgcaacctcaagactctcaagctcaacaattctatacctctcgacaagcttgctagccttcttcgcaaagctcctcagattgtagagcttggaacaggaagattctctgcggattaccatctggatctcttttcaaagcttgaagcagcatttgctggttgtaaaaacctaagaaggctttctggggcttgggatgctgttccagagtacctgccagcattttattgcgtatgcgagggcctcacatcactaaatctgagttatgctactgtacgaggccccgaactgataaaattcgttagcagatgcaaaaatttgcaactcttatgggtgatggatttaattgaggaccacggtcttgctgctgtggcatcatcttgtaataaactgcaggagttgcgggtcttcccttcttctcctttcgatgcagctgagcaggtttcattgactgaaagaggtcttgttgatgtctctgctggttgcccgatgttggaatcagtcctctacttctgcagacggatgaccaatgaggcccttattaccatcgcaaagaaccggcccaacttcacttgcttccgcctatgcatcatagagccacatacaccagattacatcacgcatcagcctcttgatgcaggttttagtgccattgtggaatcatgcaagggccttaggcggctttctgtctcaggccttctcacagaccgtgtatttaaatccatcggggcacatgctgatcgtctcgagatgctctcaatcgcctttgctgggaacagcgacttgggccttcattacatcctttcgggctgcaagagcttgaagaagctggagatcagggactgcccattcggtgataagcccttgctggcaaatgctgccaagctggagacaatgcgatccctttggatgtcgtcgtgctcactgaccctgggcgcatgccgacagcttgcacgcaagatgcctcgccttagtgtggaggtcatgaatgatcctcgacgtgcatgccccttggactcacttacagatgagagccccgccgagacgatgtatgtctaccggacaattgcaggtccaaggtctgacacaccaacctgggtccagattgtttaa

SEQ ID NO: 8066 - DNA, 2433 bp, Brachypodium distachyon
ggtagggaggagagaaggagtagagagaagaccaaagggcagagagcagagcccagaagagaagagaagagaagagaagagagactctcttgcatctctctccagatgctctccctaccgccgcctccccacgcgctccaccggcccgtcccagcagccgccgccgggtagacacacgcacgcagcccggccccctaacggccagcgccgccccgatgggccgcggcgtcggctcgcgctccggcggcggcgccgcgcagcctccgtggcactcgctcccggacgaggtctgggagcacgccttctccttcctccccgccgccgccgaccgcggcgccgcggcgggcgcctgccgcggctggctccgcgccgagcgccgctccaggcgccgcctcgccgtcgccaactgctacgccacgtccccgcgcgacgccgtcgagcggttcccctccgtgcgcgccgccgaggtcaagggcaagccgcacttcgccgacttcgggctcgtcccgcccgcctggggcgccgaggccgcgccctgggtcgccgccgccgccgacggctggccgctgctcgaggagctcagcttcaagcgcatggtcgtcaccgacgagtgcctcgagatgatcgcggcctccttcaggaacttccaggtcctgcgcctcgtctcctgcgagggattcagcaccgccgggctcgccgccattaccgagggttgcagaaatttgagagaacttgaccttcaagagaattatattgaggattgttccagtcattggctcagtagctttccagaatccttcacttctctggaaactcttaatttttcatgcttagatggggaggtcaattttgcagtacttgagcggctagtgaccagatgtcacaatctcaagactctaaagctcaataatgcaatccctcttgataaggttgctagtctccttcgtaaggctccgcacatagtagaacttggaactggcaaattctctgctgattatcatccagatctctttgcaaagcttgaagcagcatttgcaggttgtaaaagcctgagaaggctatctggggcttgggatgctgttccagattacctgtcagcattttatggtgtatgtgaaggcctcacatcacttaatctgagttatgctactgttcgaggccctgagctcattaaatttattagcagatgcaagaatctgcagcaattatgggtcatggatctcattgaggaccatggtctagctgtcgtggcatcaacttgcagtaaactacaagagttgcgggtcttcccttctgacccttttggtgctgggcaagttttgttgactgaaagaggtcttgttgatgtttctgccagttgtcccatgttggagtcggtcctctacttctgcaggcggatgacgaatgaggctcttattacaattgcaaagaaccgtcccaacttcacctgcttccgcctatgcatccttgagccccgtactccagattacatcacacaacagtctcttgatgcaggtttcagtgccattgtggaatcatgcaagggccttaggcgcctctctgtctccggccttctcacagatcttgtatttaaatcaatcggtgaacatgctgatcgtcttgagatgctttcaatagccttcgctgggaacagcgatctaggcctgcactatatcctctcaggctgcaagagcctaaagaagctggagatcagggactgcccatttgggaataagccgttgctggcaaatgctgccaagctggagacaatgcgatccctttggatgtcgtcatgctcgttgaccctgggcgcatgccgacagcttgcacaaaagatgcctcgccttactgtggagatcatgaacgatcctggacgagcatgtcccttggatgcacttccggatgaaagccctgttgagaaattgtatgtgtaccggacaattgccggtccaaggtctgacacaccagactacgtccagattgtttaagggcgtcatgctatatgggggtactctgggtgttcattttcaacctcaattggtaccttctgcaatctgcatcttcctagcataacatagagtttttttaaggcaagtagaaaggctggtggtttgatgaacctatcataagatctctacttgacaaatgtaggatgagactcgaggccttttttcaggtgttaataactgtagggggctcggtggattacagaaactactagatagcgtcatgagaaaaccttggtttgttttctttagcgtgtttagttccttttatgtataaaaatatggcaccattttaatcttgtaatgtactgtattactggataaactgtacctgagctgagtttgtcacctctaccttttggccttcctttttctaattatgggttgttctggatgctaaataatcatggcatgtatttcttgtggt

SEQ ID NO: 8067 - DNA, 1941 bp, Oryza sativa
gaggagaagaggaggcttcaccttcccaaccaaacccaacctcgagcacaagcggagcagatgccgccgccgccgccgccgcgcgcgccgcgccgcgccgccgggtagctcagcgcaaaaaagccacagccgcccgcccgcccgatccgttgcagcatggggcgcggcggctcgcgcgcggcgtgcgccgccgcggcgccgccgtggcactcgctcccggacgaggtctgggagcacgccttctccttcctccccgccgccgcggacaggggcgccgcggcgggggcgtgcagctcgtggctccgcgccgagcgccggtcgcgccgccgcctcgccgtcgccaactgctacgccgccgcgccgcgggacgccgtcgagcggttcccgtccgtgcgcgccgccgaggtcaagggcaagccccacttcgccgacttcggcctcgtcccccccgcctggggcgccgccgcggcgccgtggatcgccgccgccgccgacgggtggccgctgctcgaggagctcagcttcaagcgcatggtcgtcaccgacgagtgcctcgagatgatcgccgcgtccttcaggaacttccaggtgctccgcctcgtctcctgcgacggcttcagcaccgcgggcctcgccgccattgctgccggttgcagacacctaagagaacttgacctgcaagagaacgagattgaggattgttctattcattggctcagcctcttcccggaatcgttcacttctctagtaactctaaacttttcatgcttagagggggaggtcaatatcactgtacttgaacggttagtgaccagatgtcacaacctgaagactcttaagctcaacaatgctatcccccttgacaagcttgctagcctccttcataaggctcctcagctagttgaactcggaactggcaaattctctgctgattaccattccgatctgtttgcaaagctggaggcggcgtttggaggttgtaaaagcttgagaaggctttctggggcttgggatgctgttccagattatctgccagcattctattgtgtatgtgaaggcctcacatcacttaatctgagttatgctactgtgcgaggtcctgagctcatcaaattcattagtagatgcagaaatttgcaacaattatgggtgatggacctcattgaggatcatggtttagctgttgtggcatcatcttgcaataaacttcaagagttgcgggtcttcccttctgacccttttggtgcaggattcttgactgaaagaggtcttgttgatgtctctgcaagttgtccaatgttggagtcagtgctctacttctgcagacggatgacaaatgaggcacttattaccattgcaaagaaccgtcccaacttcacttgcttccgcctatgcatccttgagccacacactccagactacatcacacgggagcctcttgatgcaggtttcagcgccattgtggagtcatgcaggggccttaggcgtctctctatctcaggccttctcacagatcttgtgtttaaatccattggggcacatgctgatcgtcttgagatgctttcaatcgccttcgctgggaacagcgacttgggcctgcattacatcctctcaggctgcaagagcctgaagaaactggagatcagggactgcccatttggtgataagccattgctggcgaacgcagcaaagctggagacaatgcgatccctttggatgtcgtcgtgcttgttgaccctgggcgcatgccgacagcttgcacgcaagatgccccgccttagtgtggagatcatgaacgatcctggaaggtcatgccccttggattcgcttccggatgaaacacctgttgagaaactgtacgtctaccggacgatcgcaggtccaaggtgtagaatgaaaattcacagcctttttcaggacatggaaatgcatggactctag

SEQ ID NO: 8068 - DNA, 1588 bp, Glycine max
gaaaaagagagagagagagagagagaaagtgtaatggcaatggcaacaatgggagagagtccacgaagcccagaagcgaagttggggatgcgagtggaggatctttgggacgttcaggagccacagttgagtcccactgagaagctcaacgcttgttttgaaagcatccctgtctctgcttttcctttggatccttcaaacacagaaattgagattaaatcagacgcgaccctagcagatgctgttaagatattggcgcgacacaacgtattcagcgcacctgtggtggatgttgaggcgcctgaagatgctagttggatggatagatacatcggaattgttgagtttgctggaattgttgtatggattttgcatcagtctgaacctacatctcctaggtgtccatccactccatccagtgcaagggctattgcagctgcagctaatggagcggcttttgctctagaacttgaagccttaggcctcggatctgctgcaacaactgcaggaaacttttttgaggatctcacttcttctgaactttataagaataccaaggttcgtgatatttcagggacattccgctgggcgccgtttcttgctttagagagatcaaactcatttctaaccatgctcttgctgctttctaagtacaagatgaagagtgttcctgtgttggatttaggctctggtacaattgataacattattacacaatctgctgtgattcatatgctggcagaatgcgctggacttcagtggttcgaaagttggggaaccaagaagctatctgaagttggtcttcccctggtgacaggaaatcaaatcatcaaggtttatgaggatgaaccagtcctccaagcatttaaagtaatgaggaaaaagagggttggaggggtgcctgtaatcgaaagagagaccaaaaaggcagttggtaatataagtttgcgagacgttcaattcttgctaactgcaccagaaatctatcatgattatagaggtattacagtaaagaacttcctgactgaggttagaagctacttggagaagaataaaaatgcatccccaatgttaagtgaatatgtcacatgcaaaaaggactgcacaatcaaagaattgattcagctgcttgatcaagagaagattcatagagtctatgtagtggaggatgatggggatctgcaaggactaatcacactaagagatatcatctcaaggctagtacacgaaccgcgtggctattttggtgatttctttgatggcgttctaccgctgcctgcaaacaccagagtttaacaggcaaggttacaagggagaataacctgctggtgcagctttttcttttttgtttttgaaatatttttttcaagtaaaaagggaaaaaaaatacaaatagatctatgtgcttctcttcagggttgaagacgagtggttggatctttatataacgtgtaggcagtttgcaagttaattgcatcacttttattaagtgttagagtgagatttgtgtgtactgtaaattctggtgtaagtgtaagtaaccataagttttgttaacttttgaaatgcattttcttttcccttcact

SEQ ID NO: 8069 - DNA, 1109 bp, Glycine max
atgccgaaaacctcaaaagttattacatgcaaagctacgatatgctgggggattggaaagcctataacggtggaagagatacaagtagacccaccaaaagcaaccgaagttcgtgttaagatgctctgtgccagtatatgccacacagatatctcaagcaccgaaggattcccacatggcaagtttcctctagcacttggacacgaaggagttggagttatagagagtgttggtgatcaagtcaagaatctgaaagaaggggatgtgaactgtgtttcagaaaaaaccaatttgtgtctgaaatatcctgtaatgtggaccggtctaatgccagataacacttcaagaatgtccatccgaggagagaggatataccatattacaagttgtgctacatggtcagagtacatggttagtgatgccaactatattctcaaagttgatccaaccattgatcgagcccatgccagtttcatctcatgtggcttttcaactggctttggagctgcttggaaggaagccaatgttgaaagtggatccactgtagctgttttcggtcttggtgctgttggattaggggctgtaattggagccaaattgcagggagcaagtaggataattggaattgacacaaatgagaacaagagagaaaaaggagaagcttttggaataactgactttataaatccgggtgattctgataattctgcttcagaattggttaaggaactaactggtggaatgggtgtggactattcctttgagtgtactggagtttccactgtactcactgaatccttggaagccacaaaaattggaacagggaaaacaatagtaattagtgtaggagctgaacctattttgccagtaggtctttttgccattctgcatggtagaactttgaaaggtactctttttggagggctaaaagccgtatcagacctttcaattgtagctgagaaatgccagaaaaaggaatttcctcttcaagaactcttcacccatgaagtcacattggccgatataaacaaagcatttgagctagtaaaacaacccaattgtgtcaaagttgtcatcaatatgtcatagtagcaattgtttctagtgaa

SEQ ID NO: 8070 - DNA, 1290 bp, Glycine max
atttacacttcgtttgatttaattaagaaactgcatttcttctacaatgccaaacacctcgcaggttatttcatgcaaagctgcaatatgctggggggctggaaagcctgtaacggtggaagagatacaagtagacccaccaaaagcaacagaagttcgagttaagatgctatgtgccagtttatgccacacagacatctcaagcattcaaggattcccatatatcaattttcctctagcacttggacacgaaggagttggtgttgtagagagtgttggtgatcaagtgagaaatttgaaagaaggggatgtagtaattccaacatacataggcgagtgccaagaatgtgagaactgtgtttcaggaaaaaccaatttgtgtctgacataccctataagattgactggtctactaccagataacacttcaaggatgtccatccgaggccagaggctacaccatgtcttaagttgtgcaacatggtcagagtacatggttagtgatgccaactatactctcaaagttgatccaaccattgatccagcccatgccagtttcatctcatgtgggttttcaactggttatggagctgcttggaaggaggccaaggttgaaagtggatccagtgtagctgtttttggtcttggagctgttggattaggggctataagtggcgccaaaatgctgggagcaactaagataattggaattgacaaaaatgagatgaagagagaaaaaggagaggcttttggaatgactgactttataaaggctggtgattcagctaaatctgtttcagaattggttaaggaaatgagtggtgggatgggtgtggattattcctttgagtgcagtggagttgcccctttacttactgaatctgtggaagccacaaaagtgggaacaggtaaaacaatagcaattggtacaggaacagaacctattatcccgtttggtcttacttccattatgtatggtagaactttgaaaggttctgtttttggggggctaaaagccatatctgacctgtccatcgtagctaacaaatgccagaaagaggaattccctcttcaagaactattcacccatgaggtcccattgacagatataaacaaagcatttgaactattgaaaaagcccaattgtgtgaaagttgtcatcaagatgtcacattgacaacagtttccagaataagacaagaaaacttcaatagagtgcaaagattcatatgcaattatacgactttagaggataataatatgaggcgttgttataaagacgttggtact

SEQ ID NO: 8071 - DNA, 2450 bp, Solanum phureja
agggtattttgtttcttcaagtgtgctattggtcaatactgtgcttctcaccattaacgttttacgtcgcctccatcagacctggttgtctcttgttataggattaattagatgggcaagctagggaagaaagcgaggaagtttgccaagaagaatcttccgtcagtgcttcgagatcgccgaaagaagaaagctttattcaaaaagagatattcatccaaaaatgtgcagagtaatgttgaagaccaagccaaattaatagatcactcaaatgaaagaaacactgaagttgaagcttttgaagacttgcctcttgaggcaccattcatggaaaatgactgtgatggtgttgtcgattcttcagacagtgatggatatctttcggaggatataagctatgaaaatgaaacagaaagtgaacctgggaaacttttagaaggtgacaaatgtactagtgaattgatgatgcagaatataaaaattcaggaaaatcttgctggacaaaagagaaagctggaaaggttgaagaggaaggatccaagtttctctaagtttttagaaaagcacaaggacattgaagcaatgcaaaatggagtagtgttctcagatgaggatgagatgagtaatcatggaagggactcggtggctgaagacaatcaaggtaaaaacaagggaagagttttgacagtatctgccattagttcttggtgtcgactgatcaaagaagagcacaaggaggaagcatttgtttgtttattaaatgcttatcgagcagcatgccactatggtgctgaatccattggcctaaggtttcagaatgctgagacattctgcagcttagtaatgtctgttctttccgaagcagataatatacttcggggacttttggggctatcatcctccagttacaagaaagaagcagtactagaactgaaggataccccacaatgggttaatgtaaagcctctcatcaaatcatacttgaggagtacattatctctgttggatcaggttactgattcagaaattctggctttcgctttgactcggctcagggattctttaccattttttgctgctttcccatatctcttgcagaggctcattaagacgacaatacatttatgggctacaggtggggggatgctatcatcagcatctttttcgatcgtactggatgtggcctctctatttacaactgatttttttgacaattgcttagcaaaagcttttgtggcttatcttgctcagtcgagagctacagatattgtcaataacaaacatttgcagttcctaagaaattccttagttgacttgtgctccctagatgttcaaaaatcattgtctaaagccaccgtgtctgtccgtcagcttgcaaaagtattacagtggggtttgcgtacaaagaaaaaggaagctcttcaaaggatctgcagttgggagtacgccaattgtattaatctctgggttggttttatagcacgcaatgtacgggattatgatcttcaggcctttttcttcactatggttcaacttataaatggagtggtgcgcctgtttcctggaccgagatatttccctttacgactcaattgcattcaatggcttaatgatctgtctaattctactggagttttcatccctattacttcatttgtgttggatgttttggaatataaaacagttggagggcgtggaaaacctggacctactctcttctttcagtctgttctaaagttgccaaagagttgcttgaagtctcagacgttccaagatgaatgcattacatctgcaattgaacaactatcatcacactttttacaatggagctaccacatttctttccctgagctagcaactgttccactcatccgtctgaaaaagtttaatgagtcaaagacaaaggaaagtctatgccgtgcggtaaaacatttgattgagcaggtggagaaaaatgttgattctgtgcaaaagaaaagaaatgaggttgccttttcaccaaatgatcatcaatctgttgaaacattccttcagtttgagaagtccagtctcagttctccattttctcagtactacagaagtgtacttgacaaggctgctctaaggggctcacataagaatgaaaagattagtttgccaaggcgagataaatcaaagcgtaaaagagatgacagtttgatcaacgtttcaggccacaaggatctggatactgttaatggagcaaagaagcgggtcaaaagacgagctccgaaggcataattgttgtatcatttttttgtttgctataggttttgataattttctaattggcccctaccaggttggaaattttgagctgggtaaacatgttatgatattctttagctgggtaaaaatcaattttgttgttgcttatttttcaaaacagaaaatagaaaaaagattttgctcctattgaggtccttgaattg

SEQ ID NO: 8072 - DNA, 2247 bp, Solanum tuberosum
aacgcgaaaccctatgttactgagtcaactcctttatataccctcgtctccgaccaaacgctttttctttcttcccaaaaattccgatctatttttctacctctccggcactcttaaacaagagaaaaaaaggataatcatggaagataaatccattccattcgaatcaactcactccgtatcaaacaatgataacaatcacggatggcaaaaggtgacatatgtgaagaagcagaaaaagaagcagcaaaaactctcggattcaggcaaggtaatcgccaatggatctgctatttccggcgccgataatgtgtataagtcgcttgagaagcactccgatgaacgccgcaagagaattgcagctcatacggctgcgatgtacggtgttggcgatgctccggttagatcggcgatgaaacaccggtcggatgatgaagacgaggataacgatgctgaaggtggtgctgagaatggtgtggctggggagaagaagaaggacaaggtaaaaaaaccgaagaagccaaaagttactgtggctgaagctgctgcgaagatcgatgcagctgatctagatgcttttctcgctgatataactgtttcctatgaatctcagcaagaaatacaattgatgcgttttgcggattactttggacggtcatttgcggcagtggctggttcacaatttccgtggttgaaattgttcagggagtcccctatcagtaaaattgcagatgttcctgtttcacatcttcctgaaccagtttataaaacatcagtggattggatcaaccaacgttctttcgaggctcttggatcgtttgtgctgtggggactagacagtattcttgtggacttaacagcccaactcgcaggttctaagggctccaagaaaggtggccaacaaacatcgtcaaaatctcaggttgccatgtttttagttttggcaatggtactacgacgaaagcctgatgttttaatcaccatactcccgacgcttcgggaaagtccaaagtatcaagggcaagacaaacttatagttattgcatggatgatagtccaggcctgtcagggcgatctctgcgttggattgtacttgtgggcacatcataccttgcctttagttggaggaaaatcaggttccaatccgcagacgagggacttgattttgcaggtggtagaaaggatcctctctgcaccaaaagctcgtacaattttagtaaatggggctgttaggaagggagagcgtctgatgccgccttcatcccttgacctgcttctacgagtgactttccccgctccttctgcgcgagtcaaggcaactgaaaggtttgaggcagtatatcccactcttaaggaggttgcgcttgctggttcccctggaagcaaagcaatgaagcaagtttcacaacagatacttctactagctgtaaaggccgttggaggaggcaatccagaactatctcgagaggcagcaaacatattcaattggtgtttgacccagagtgctgactgttacaagctgtgggacaagatttacctggataacatagaagcaagtgttgcagtgttgagaaagctcactgaggggtggaaggagttattgaggagacagtcttctcccgaggctttgaaggagactctcaagagcttcagacagaagaatgagaaatcattaactggtggagtggatgctcaccagtcacacttcagagatgcagacaagtactgtaaaatgttgttagcaaggctgtctcgtggacatgggtgtctgaaaggatttgttgttgttcttttggctatggcggtgggaggtgctattgtgtcacagaacttggaggattgggatttgaataagttttcagctttgcttaatgtcccacagtcatcctaagtaatctgcaccagatgagcaatgttcttttttaacagttgatggtctcagcagcggttcagaaaacttaaaataactttttggagaaacaggtagctactgaagcggaacttggagatatagggatacttatattttcatgaaagaatgagtcatgtttaatttatcaaagtcttgttttgatccgtctgttagtttaagtggtagtaggcatgttagatgttactcagttttcaacatcttttttcagttcaagtaaattgaccattaccagaatacagatgtaatttcaacgggtatgaaagaatccaaaaaggatttaataattggtaggttgagtatttcaacttatttgc

SEQ ID NO: 8073 - DNA, 2196 bp, Solanum phureja
aacgggaaaccctatgttactgagtcaactcctttatataccctcgtctccgaccaaacgctttttctttcttcccaaaaattccgatctgtttctctacctctccggcactaaggataatcatggaagataaatccattccattcgaatcaagtcactccgtatcaaacaacgataacaatcacggatggcaaaaggtgacatatgtgaagaagcagaaaaaaaagcagcaaaaactctcggattcaggcaaggtaatcgccaatggatctgctatttccggcgccgataatgtgtataagtcgcttgagaagcactccgatgaacgccgcaagagaattgcagctcagacggctgcgatgtacgctgttggcgatgctccggttagatcggcgatgaaacaccggtcggacgatgaagacgaggataacgatgctgaaggtggtgctgaaaatggtgtggttggggagaagaagacggacaaagtaaaaaaaccgaagaagccaaaagttactgtggctgaagctgctgcgaagatcgatgcagctgatctagatgcttttctcgctgatataactgtttcctatgaatctcagcaagaaatacaattgatgcgttttgcggattactttggacggtcatttgcggcagtggctggttcacaatttccgtggttgaaattgttcagggagtcccctatcagtaaaattgcagatgttcctgtttcacatcttcctgaaccagtttataaaacatcagtggattggatcaaccaacgttctttcgaggctcttggatcgtttgtgctgtggggactagacagtattcttgtggacttaacggcccaactagcaggttctaagggctccaagaaaggtggccaacaaacatcgtcaaaatctcaggttgccatgtttttagttttggcaatggtactacgacgaaagcctgatgttttaatcactatactcccgacgcttcgggaaagtccaaagtatcaagggcaagacaaacttacagttattccatggatgatagtccaggcctgtcagggcgatctctgcgttggattgtacttgtgggcacatcataccttgcctttagttggaggaaaatcaggttccaatccgcagacaagggacttgattttgcaggtggtagaaaggatcctctctgcaccaaaagctcgtacaattttagtaaatggggctgttaggaagggagagcgtctgatgccgccttcatcccttgacctgcttctacgagtgactttccccgctccttctgcgcgagtcaaggcaactgaaaggtttgaggcagtatatcccactcttaaggaggttgcgcttgctggttcccctggaagcaaagcaatgaagcaagtttcacaacagatacttctactagctgtaaaggccgttggaggaggcaatccagaactatctcgagaggcagcaaacatattcaattggtgtttgacccagagtgctgactgttacaagcagtgggacaagatttacctggataacatagaagcaagtgttgcagtgttgagaaagctcaccgaggggtggaaggagttatcgaggagacagtcttctccggaggctttgaaggagactctcaagagcttcagacagaagaatgagaaatcattaactggtggagtggttgctcaccagtcacacttgagagatgcagataagtactgtaaaatgttgttagcaaggctgtctcatggacatgggtgtctgaaaggatttgttgttgttcttttggctatggcggtgggaggtgctattgtgtcacagaacttggaggattgggattggaacaagttttcagctttgcttaatgtcccacagtcgtcctaagtaatctgcaccagatgagcaatgttctttttttaacagttgatggtctcagcagcagttggttcagaaaacttaaaaataactttttggagaaacaggtagcggaacttggagatatagggatacttatattttcatcaaagcatgagttatgtttaatttatcaaagtcttgttttgatctgtctgttagtttttaagtggtagtaggcatcttagatgttactcagttttcaacatcttttttcagttcaagtaaattgatcattaccagaatacagatgtaatttcaaccggtatgaaagaatccaaaaaggatttaa

SEQ ID NO: 8074 - DNA, 1708 bp, Eutrema halophilum
acattctagagacttccacttcacaaaacctcgaacaaaagcaaaacgcaattaagcataagagagtcattcacacagaacacagcagccacaacaacaaataacacatcttcgtctctctgctccgccatcaaaagagagacaattttctctctttctctctctctctgatctgtagggttttcgtaagaagggagaaaaaatgttcgggcgaggaccctcgaagaagagcgacaacactaagttctacgagatcttaggtgttccaaagaccgcatctccagaagatctcaagaaagcttacaaaaaagctgcaatcaagaaccatcccgataagggtggagatcccgaaaagttcaaagagctagctcaggcttatgaagttcttagtgacccggagaagcgagagatttatgatcagtatggagaggatgcactcaaggaaggaatgggtggtggaggaggtgggcatgacccgtttgatatcttctcatccttctttggtgggagcccatttggaggtggtggtagcagccggggaaggaggcagaggcgtggtgaagatgttgtccatcccctgaaggtttctcttgaagacgtgtaccttggaacaacgaagaagctttcactttctaggaatgctctctgctcaaagtgtaacggaaagggttcaaaatctggagcctccctgaaatgtggtgggtgtcagggtacaggtatgaaggtgacaattaggcagctcggacctggaatgatccagcagatgcagcatgcctgtaatgagtgcaaaggcacaggtgagaccatcaacgatcgggacaggtgtccacaatgcaaaggagacaaggtgatccctgagaagaaggtgcttgaagtgaatgtagagaagggaatgcaacacagtcagaagatcacattcgaaggacaagcagatgaagcgcctgacaccgtcactggagatatagtgtttgtccttcagcagaaagagcatccaaagttcaagagaaagggagaagacctctttgtagagcacactctttctctgaccgaagctctatgtggcttccaattcgtcctgacccacttggatggcagaaatcttctcgtcaaatctaatccgggggaggtcgtgaaacctgattcatacaaggcgataagcgatgaagggatgccaatataccagaggccattcatgaagggtaagctctatatccacttcacagtggagttcccggactctcttagccctaaccagaccaaggcgcttgaagctgttttgcctaagccttcaacaactcagctgagtgacatggagatagatgagtgcgaggagactacgctgcacgatgtcaacattgaagatgagatgagaaggaaagcacaagctcaaagagaggcttatgatgatgacgatgatgatgatgaacatcctggaggtgcacagagggtgcaatgtgcccagcagtaagtaaccctttagagagagagagacctttgcccacatgggttttgtctccaacatttgcctcatccttatattattttaagtgtattggagtcttaatgcagtttggtacggtttagacttttgcccacttcggtggtaaaccatcttgtttttcgttaaaatttatgcagtattacaattttgtgtttttgatattaaaatttgtagtaatttaatataatcaagaagacgtctttttct

SEQ ID NO: 8075 - DNA, 1635 bp, Arabidopsis lyrata
ttctagagagttccatccaactccacaaaacctcaaacaaaagcaaacgcaattagccttcataagagagaagtcctctcacagaaacagcagccacatcaaccaaacaatacctcgaaagagagtctcttttctctctctttctcccttcaatctctagggttttcgttagaacggcgaaaagatgttcggtagaggaccctcgaagaagagcgacaacactaagttctacgagatcttaggtgttcctaagaacgcatcaccagaagatctcaagaaagcttacaaaaaagctgctatcaagaaccatcctgataagggtggagatcccgagaagttcaaagagttagctcaagcttatgaagttcttagtgacccggagaagcgtgagatttatgaccagtatggagaggatgcactcaaggaaggaatgggtggtggaggaggtggacatgatccatttgatattttctcatccttctttggtagaagcccctttggagatggtggtagcagccggggaaggaggcagaggcgtggtgaggatgttgttcatcctttgaaggtttctcttgaggatgtttaccttggaacaatgaagaagctctcactttctaggaatgctctctgctcaaagtgtaacggaaaggggtcaaaatctggagcctccatgaaatgtggtggatgtcaaggttctggtatgaaggtgtcaattaggcagctcggacctggaatgatccagcagatgcagcatgcatgtaatgaatgcaaaggaacaggtgagacaatcaatgatcgcgacagatgtccgcaatgcaaaggagacaaggtgattcctgagaagaaggtgcttgaagtgaatgttgagaagggaatgcaacacagtcagaagatcacattcgaaggacaagcagatgaagcgcccgacactgtcactggagatatagtgtttgtccttcagcagaaagagcatccgaagttcaagagaaagggagaagacctctttgtggagcacacactttctctaacagaagctttatgtggcttccaatttgttctgactcacttggatggcagaaatcttctcattaaatctaatcctggggaggtcgtgaaacctgattcatacaaggcaattagcgatgaaggaatgccgatataccagaggccattcatgaagggtaagctctacatccacttcacagtggagttcccagactcgctgagccctgatcaaaccaaagcactggaagctgtgctgcctaaaccctcaacaactcaattgagtgacatggagatagatgaatgcgaggagaccacgctccacgatgtcaacattgaggatgaaatgaagaggaaggcacaagctcaaagagaggcttatgacgatgacgatgaagatgatgaccatccgggtggtgctcaaagggtgcaatgtgctcagcagtaagtaactccttagagagagactattacccacatgggtttggctccaaccatttgtctcttgctttttcattctaagtgtattggagtcttatgggagtttggtacggtttaagaatttgcccacttcggtggaacatcaacttgtttatcttttttctctgactcttaaaattaaggccttattac

SEQ ID NO: 8076 - DNA, 1649 bp, Arabidopsis thaliana
acattctagagagttccaaactccacaaaacctcaaacaaaagcaaacgcaatttagcctcttcataagagagaagtcctctcagagaaacggcagccacatcaaccaacccaaacatcgaaagagagacacttttctctctctctttctctatctccttccaatctctctagggttttcgttacaacggcgaaaagatgttcggtagaggaccctcgaagaagagcgacaacactaagttctacgagatcttaggtgttcctaagagcgcttcaccagaagatctcaagaaagcttacaaaaaagccgctatcaagaatcatcctgataagggtggagatcccgagaagtttaaggagttagcacaagcttatgaagtgcttagtgacccggagaagcgtgagatttatgaccagtatggagaggatgcactcaaggaaggaatgggtggtggaggaggtggacatgatccatttgatattttctcatccttctttggtggaggcccctttggaggtaataccagccggcaaaggaggcagaggcgtggtgaggatgttgttcatcccttgaaggtatctcttgaggatgtgtaccttggtacaatgaagaagctttcactttctaggaatgctctctgctctaagtgtaacggaaagggatcaaaatctggagcctccttgaaatgtggagggtgtcagggatctggtatgaaggtgtctattaggcagcttggacctggaatgatccagcagatgcagcatgcatgtaatgaatgcaaagggacaggtgagaccatcaatgatcgggacaggtgtccacaatgcaaaggagacaaggtcattcctgagaagaaggtgcttgaagtgaatgtggagaagggaatgcaacacagtcagaagatcacatttgaaggacaagcagatgaagcgcctgacactgtcactggagatatagtgtttgtccttcagcagaaagagcacccaaagttcaagagaaagggagaagacctctttgtggagcacacactttctctaaccgaagctttgtgtggcttccaatttgttctgactcacttggatggcagaagtcttctcattaaatctaatcctggggaggtcgtgaaacctgattcatacaaggcaataagcgatgaaggaatgccgatataccagaggccattcatgaagggtaagctctacatccacttcacagtggagttcccggactcgttgagcccagatcagaccaaagcactggaagctgttctacctaagccgtcaacagctcagttgagtgacatggagatagatgaatgcgaggagaccacgctccacgatgtcaacattgaggatgagatgaggaggaaggcacaagctcaaagagaggcttatgatgatgacgatgaagatgatgaccatccgggtggtgctcaaagggtgcaatgtgcccagcagtaagtaactccttagagagactttgacccacatgggtttgggctccaaccaatttgtctcttgctttttcattctaagtgtattggagtctttatgggagtttggtacggtttaagaatttgcccacttcggtggaacatcgaaacttgttttctctttttcctctgactttaaaaattaaggccttattac

SEQ ID NO: 8077 - DNA, 1506 bp, Raphanus sativus
  misc_feature (8)..(9): n is a, c, g, or t
  misc_feature (12)..(12): n is a, c, g, or t
  misc_feature (19)..(19): n is a, c, g, or t
  misc_feature (162)..(162): n is a, c, g, or t
  misc_feature (201)..(201): n is a, c, g, or t
  misc_feature (237)..(237): n is a, c, g, or t
  misc_feature (318)..(318): n is a, c, g, or t
  misc_feature (772)..(772): n is a, c, g, or t
  misc_feature (913)..(913): n is a, c, g, or t
  misc_feature (916)..(916): n is a, c, g, or t
  misc_feature (922)..(922): n is a, c, g, or t
  misc_feature (933)..(934): n is a, c, g, or t
  misc_feature (952)..(952): n is a, c, g, or t
ccgagaanncanaagaagnaaaaaaaacaaacttggtctccgtgagaaaagatgttcgggcgaggagcgacgaagaagagcgacaacacaaagttctacgagatcttaggcgtacccaagaccgcatctcccgaagatctcaagaaggcttacaaaaaagcngcaatcaagaaccatcccgacaagggtggagatcctganaagttcaaagagctagcacaggcgtatgaagttctnagcgacccagagaagagagagatatacgatgagtacggagaggatgcactcaaggaaggaatgggtggtggaggaggaggngggcatgacccttttgatatcttctcatccttctttggaggtggcagcccctttggaggtggtggtagcagcagagggaaggaggcagaggcgtggtgaagatgttgttcatcctttgaaagtttcccttgaggatctctaccttggtactaccaagaagctctctctttctagaaacgctctctgctctaagtgcaacggaaagggttcgaaatctggagcctcgatgaagtgcggtgggtgtcagggtacgggtatgaaggtgacaatcaggcagcttggacctgggatgatccagcagatgcagcatgcttgtaacgagtgcaaaggcacgggggagaccatcaacgatcgtgacaggtgtccgcagtgcaaaggagacaaagtcgtccctgagaagaaagttcttgaagtgaatgttgagaaagggatgcagcacagtcagaagatcacnttcgaaggacaagcagatgaagcgcctgacacagtcactggagatatagtgtttgtaattcagcagaaagagcacccaaagttcaagagaaaaggagaagacctctttgtagaacacacactctctctcaccgaagctctntgnggcttntccttcgtccnnacccacttggatggcagnaatcttctcatcaaatctcatcccggggacgtcgttaaacctgattcatacaaggcaataagcgatgaagggatgccgatataccagaggccattcatgaagggtaagctctacatccacttcacagcggatttcccggactcgctaacccctgaccagaccaaagcatttgaagctattctgcccaaaccttcgactactcagctgaccgacatggagatagatgagtgcgaggagacaacgctgcacgatgttgacattgaggatgagatgagaaggaaagcacaagctcagagagaggcttatgatgatgacgagggcgatgatgaccatcctggaggtgcgcagagggtgcaatgtgcccagcagtaactaagtaaccctttagagaaaggacgtgatgagggggtttggctccaacgtttgcctcttccttttctttattttcagtgtatttggaagtcttatggagtttgctatggtttagactttggtggaaaaccaacttgtttcgttctctcactctttaaattaatgacgtattgaaattttgt

SEQ ID NO: 8078 - DNA, 1620 bp, Eutrema halophilum
aagaccttgaacagaagcaaacccaattagtcttcgaacagcagccacaacaaactccgtctccctctccctcttctctctccgccattaaaagactctcagtttcttctctcttcttttagggttttcgtaagaacggagaaagatgttcggaagaggaccttcgaggaagagtgacaacaccaagttctacgagatcctcggtgttcccaagaccgcatcaccggaagatctcaagaaggcttacaagaaagccgccatcaaaaaccatcccgacaagggtggagatcccgaaaagttcaaagagctagctcaggcttatgaagttcttagcgatccggagaagcgtgaggtctacgatcaatatggggaggatgcactcaaggaaggaatgggtggtcctggtggtggccacgacccatttgatatcttctcgtccttctttggtcaatctggaaacccattcggaggtggtagcagccgagcaaggaggcagaggcgcggtgaagatgttgttcatcctctgaaggtttccctagaggatctttatctgggaacaacaaagaagctctcactttctaggaaggctttgtgttcaaagtgtaacggaaagggttcaaagtctggagcttcaatgaaatgtggtggatgtcagggaacgggaatgaaggtctcgatcaggcagtttggacctggaatgattcagcagatgcagcatgcttgtcatgattgcaagggcacaggagagaccatcaacgaccgtgacaggtgtccacagtgcaaaggtgagaaggttgtctccgagaagaaggtgcttgaagtagctgtggaaaagggaatgcaacacagtcagaagatcacattcagtggacaagcagatgaagcgcctgatacagtcactggagatatagtgttcgtcattcagcagaaggagcacccaaaattcaagagaaagggagaagatctctttgtggagcacaccctttctctaacagaggccctttgtggcttccagttcgtcttgacccatttggatacaagacagcttctcatcaaatccaatcccggggaggtagtgaaacctgattcatacagggcgataagtgacgagggaatgccgatacaccaaaggccgttcatgaagggtaagctttacatccacttcactgtagagttcccggaatcgctgagccccgaccagacaaaggccattgaagcggttttgccaaagccgtcaaaggctgctctgagcgatatggaaatagatgagtgcgaagagacgacgctgcacgatgtcaacattgaggatgagatgagaaggaaggctcaagctcaaagagaggcttatgatgacgatgaggaagatggcccaggcggtgctcagcgtgtgcaatgtgcccagcagtgatccacttgcccattttagtgatatccagcatttgctttcgtttttttttccttttctttgtattatttttgcgtctctttatagactttgccaactcggtgggaagaacctcgtcctaattcaaatcgttattacaattttttgttttgcgttttgagaataaaagacttcgtagttcttgggatttttgtcctctccatcaacatgtcaat

SEQ ID NO: 8079 - DNA, 1589 bp, Thellungiella halophila
gaaacccaattagtcttcgaacagcagccacaacaaactccgtctccctctccctcttctctctccgccattaaaagactctcagtttcttctctcttcttttagggttttcgtaagaacggagaaagatgttcggaagaggaccttcgaggaagagtgacaacaccaagttctacgagatcctcggtgttcccaagaccgcatcaccggaagatctcaagaaggcttacaagaaagccgccatcaaaaaccatcccgacaagggtggagatcccgaaaagttcaaagagctagctcaggcttatgaagttcttagcgatccggagaagcgtgaggtctacgatcaatatggggaggatgcactcaaggaaggaatgggtggtcctggtggtggccacgacccatttgatatcttctcgtccttctttggtcaatctggaaacccattcggaggtggtagcagccgagcaaggaggcagaggcgcggtgaagatgttgttcatcctctgaaggtttccctagaggatctttatctgggaacaacaaagaagctctcactttctaggaaggctttgtgttcaaagtgtaacggaaagggttcaaagtctggagcttcaatgaaatgtggtggatgtcagggaacgggaatgaaggtctcgatcaggcagtttggacctggaatgattcagcagatgcagcatgcttgtcatgattgcaagggcacaggagagaccatcaacgaccgtgacaggtgtccacagtgcaaaggtgagaaggttgtctccgagaagaaggtgcttgaagtagctgtggaaaagggaatgcaacacagtcagaagatcacattcagtggacaagcagatgaagcgcctgatacagtcactggagatatagtgttcgtcattcagcagaaggagcacccaaaattcaagagaaagggagaagatctctttgtggagcacaccctttctctaacagaggccctttgtggcttccagttcgtcttgacccatttggatacaagacagcttctcatcaaatccaatcccggggaggtagtgaaacctgattcatacagggcgataagtgacgagggaatgccgatacaccaaaggccgttcatgaagggtaagctttacatccacttcactgtagagttcccggaatcgctgagccccgaccagacaaaggccattgaagcggttttgccaaagccgtcaaaggctgctctgagcgatatggaaatagatgagtgcgaagagacgacgctgcacgatgtcaacattgaggatgagatgagaaggaaggctcaagctcaaagagaggcttatgatgacgatgaggaagatggcccaggcggtgctcagcgtgtgcaatgtgcccagcagtgatccacttgcccattttagtgatatccagcatttgctttcgtttttttttccttttctttgtattatttttgcgtctctttatagactttgccaactcggtgggaagaacctcgtcctaattcaaatcgttattacaattttttgttttgcgttttgagaataaaagacttcgtagttcttgggatttttgtcctctcc

SEQ ID NO: 8080 - DNA, 2139 bp, Eutrema parvulum
aagaccttgaacagaagcaaacccaattagtcttcgaagagcagcagccacaacaaactccgtctccctctcctctccgccattaaagtctctcaatttccttctctctccctctgttttttagggttttcttaagaacggagaaagatgttcggaagaggacattcgaggaagagcgacaacaccaagttctacgagatccttggtgttcctaagaccgcatcacccgaagatctcaaaaaggcttacaagaaagctgccatcaaaaatcatcccgacaagggtggagatcccgagaagttcaaggagctagctcaggcttatgaggttcttagtgatccagagaagcgtgagatctatgatcaatatggggaggatgcactcaaggagggaatgggtggtggaggcggtgggcatgacccgtttgatatcttctcgtccttctttggtggaggtggacacccattcggaggtggcagtagccggggaaggaggcagaggcgtggtgaagatgttgttcatcccctgaaggtttccctagaggacctttatctcggaacaacaaagaagctctcactttctaggaaggctttgtgctcaaagtgtaacggaaagggttcaaagtctggagcttcaatgaaatgtggtggatgtcagggaacaggaatgaaggtctcaatcaggcagtttggacctggaatgattcagcagatgcagcacgcttgtcatgattgcaagggtacaggagagaccatcagtgatcgggacaggtgcccacaatgcaagggagagaaggtcgtctccgaaaagaaggtgcttgaagtagctgtggagaaggggatgcaacacggtcagaagatcacattcagtggacaagcagatgaagcgcctgatacagtcactggagatatagtcttcgtcattcagcagaaagagcatccaaagttcaagagaaagggagaagatctctttgtggagcacaccctctctctaaccgaggccctctgtggcttccagttcgtcttgacccatttggacacaagacagcttctcatcaaatccaatcatggggaggttgtgaaaccagattcatacagagcgataagtgatgagggaatgccgatataccaaaggccgttcatgaagggcaagctgtacatccacttcacggtagagttcccggaatcgctgagcttggatcagacaaaggccattgaagcggttttgccaaagccaacaaagacaactctgagcgacatggaaattgaggagtgcgaagagacgacattgcatgatgttaacattgaggatgagatgagaaggaaggctcaagctcaaagggaggcttatgatgacgatgatgaagaaggcccaggcggtgctcaacgtgtgcaatgtgcccagcagtgatttcgacatgcggattttagtgatatccaacatttgctttttaatttttcgttgtattatttttgggtcttttatagactttgccaatttggtgcggagaaactcatcctaattcaagtccttgttacaatttctttttgttttgtttccagaataaactttttagtttttcagattttgccccctcccccagcaaattcaatgtacgaaatgaagagaattctgcaaaaatattaatagcgataagttatagaaactgctttatatcacaagttgtatagcgttgctgaagatgttttatagagacaagacaagaaaagactggtacagtactactaatctattggctattattacatccagaatcctctggaacgggccacattgcatctcaacttcgaccgttcaacaccaattcaattcacaaacttatgatgcaacatcgatctttttctgtagataccggtatacatgtgttattgagaaggaaggtggctcgtacctcgattttatgcagagtcgagccacggctagaactttctggagttctctggagttataattgttaccgagatctggatcaatcatcttatcaatggagtttgcgatgcaagagtgttgtacccattcgatcaagtcttcgccttgtctgtctgatgattgtcctgtgatcagttctaacatcaacactccgagctggaatatcacgtttccacattcctcatccgc

SEQ ID NO: 8081 - DNA, 1538 bp, Arabidopsis lyrata
ttgaacagaagcaaagtcttcaaaaccaacaagtagcagccacaacaatctccttattttttttagggttttcgtaagaacagaggaaacatgtttggaagaggaccttcaaggaagagcgataacaccaagttctacgagatccttggtgttcctaagaccgcatcaccggaagatctcaagaaagcttataagaaagctgctatcaaaaaccatcctgataagggtggagatcccgaaaagtttaaagagctagctcaggcttatgaagttcttagtgatcctgagaagcgtgagatctatgatcaatatggggaagatgcactcaaggagggaatgggtggtggaggcggtgggcatgacccatttgatatcttctcttccttctttggtggtggtggaaacccattcggaggtggtagcagccggggaagaaggcagaggcgcggtgaagatgttgttcatcccctgaaggtttccttagaggatgtttatctcggaacaacaaagaagctctcactttctaggaaggttttgtgctcaaagtgtaacggcaagggttcaaagtctggagcttcaatgaaatgtggtggctgtcaaggttcgggaatgaaggtctcgatcaggcaggttggacctggaatgattcagcagatgcagcatgcttgtaatgattgcaagggcacaggagagacaatcaatgatcgggacaggtgtccacaatgcaaagcagagaaggttgtttccgagaagaaggtgcttgaagtaaatgtggagaagggaatgcaacacaatcagaagatcacgttcaatggacaagcagatgaagcgcctgatactgttaccggagatatagtgttcgtcattcagcagaaggagcacccaaagttcaaaagaaagggggatgatctctttgtggagcacaccctctctctaaccgaggccttgtgtggcttccagtttgttttaacccatttggacaaaaggcagcttctcatcaaatccagtcccggagaggtcgtcaaacctgattcatacaaggcgataagtgatgagggaatgccaatataccaaaggccgttcatgaagggtaagctatacatccacttcactgttgagttcccggaatcgctgagcccagatcagacaaaggccattgaagcagttttgccaaaaccgaccaaggcagctataagtgatatggaaatagacgagtgcgaagagacgactctgcatgatgtgaacattgaggatgagatgaaaaggaaggcgcaagcccaaagagaggcttatgatgacgatgaggatgaacacccaggcggtgctcagcgtgtgcaatgtgcccagcagtgatccacatgcgaatcctagtgatctccaacatttgcttcttcttttctctttttcgttgtattatttttgggtctttttatagactttgccaattcagtgggaagaacctcgtcctaattcaaaatccttattaccattttttttggtttgagaaataaacttgtagttcttgagattttgtcctg

SEQ ID NO: 8082 - DNA, 1372 bp, Brassica rapa
aattagtcttcttagaacaacagcagccacacaacaaaactctattgaaagcctctccctcccacttctttcctttagggttttctcaataacgtagacaagatgttcagaagaggaccttcgagtaagagcgacaacaccaagttctacgagatcctcggcgtccccaagaccgcatcacccgaagatctcaaaaaggcttacaagaaagccgccatcaaaaaccatcccgacaagggtggagatcccgagaagttcaaagagctagctcaggcttatgaagttttaagtgatccggagaagcgtgagatctacgatcagtatggagaggatgcactcaaggagggaatgggtggtggaggcggtgggcatgacccctttgatatcttctcgtccttctttggtggtggtggtggtagcccatttggaggtggcagcagccgtggaaggaggcagaggcgtggtgaagacgttgttcaccctctgaaggtttcactagaggatctttatctcggaacaactaagaagctctcactttctaggaatgctttgtgttccaagtgtaacggaaagggttcaaagtctggagcttcatcgacatgtagtggatgtcaaggatctggaatgaaggtttcaatcaggcagcttggaccgggaatgattcagcagatgcagcacccttgtcatgattgcaaaggtacaggagagaccatcaatgaccgtgacaggtgtccacaatgcaaaggggataaggttgtctctgagaagaaggtgcttgaagtagctgttgaaaagggaatgcagcatagtcagaagatcacattcagtggacaagcagatgaagcgccggatacagtcactggagatatagtgttcgtcattcaacagaaagagcacccaaagttcaagagaaagggagatgatctctttgtggagcacaccctctctcttacagaagctctctgtgggttccagtttgtcttgacccatttggacaaaagacagcttctcatcaaatccagtccgggagaggttgtgaagccagattcatacagggcgataaccgatgagggaatgcctatgcaccaaaggccgttcatgaagggcaagctttacatccacttcacggtcgacttccctgactcgttgagccctgaccagacaaaggccattgaagcggttttgccgaagccaaaggcggatctgagcgacatggaaatagacgaatgcgaggagacgacgctgcacgaagtgaacattgaggatgagatgagaaggaaggctcaagctcaaagagaggcttatgatgatgacgatgatgatgaagaaggcccaggtggtgctcagcgtgtgcaatgtgcccagcagtgat

SEQ ID NO: 8083 - DNA, 1527 bp, Brassica rapa
cagccacacaaacaaaactccatcaaaagcctctcctcccaccactttcctttagggttttcttaaacaacgtagacaagatgttcagaagaggacctccgagtaagagcgacaacaccaagttctacgagatcctcggcgtccccaagaccgcttcacctgaagatctcaaaaaggcttacaagaaagccgccatcaaaaaccatcccgacaagggtggagatcccgaaaagttcaaagagctagctcaggcttatgaagttctaagtgatccagagaagcgtgagatctacgatcagtatggtgaggatgcactcaaagagggaatgggtggtggaggcggtgggcatgatccgtttgatatcttctcgtccttctttggtggtggtggtggtagcccattcggtggtggcagcagccgtggaaggaggcagaggcgtggtgaagatgtggttcaccctctgaaggtttcgctagaggatctttatctcggaacaacgaagaagctctcactttctaggaatgctttgtgctctaagtgtaacggaaagggttcaaagtctggagcttcatcgacatgtagtggatgtcaaggatctggaatgaaggtttcaatcaggcagcttggaccgggaatgattcagcagatgcagcacccttgtcatgattgcaaaggtacaggagagaccatcaatgaccgtgacaggtgtccacagtgcaaaggagataaggttgtctctgagaagaaggtgcttgaagtagctgtggaaaagggaatgcagcatagtcagaagatcacattcagtggacaagcagatgaagcgcctgatacagtcactggagatatagtgttcgtcattcagcagaaggagcacccaaagttcaagagaaagggagatgatctctttgtcgagcacaccctctctcttacagaagctctctgtgggttccagtttgtcttgactcatttggacaaaaggcagcttctcatcaaatccagtcccggggaggttgttaagccagattcatacagggcgataaccgatgagggaatgcctatgcaccagaggccgttcatgaagggcaagctttacatccacttcacggtcgacttccctgactcgctgagccctgaccagacaaaggccattgaagcggttttgccgaagccaaaggcggatctgagcgacatggaaatagacgaatgcgaggagacgacgctgcacgaagtgaacattgaggatgagatgagaaggaaggctcaagctcaaagagaggcttatgatgatgacgatgatgatgaagaaggcccaggtggtgctcagcgtgtgcaatgtgcccagcagtgatatcaaacatgcgcacttgtagtgatgatattcagcatttgcgtttttaaaaattatatgtattattttttggtctttgctataagacttttgcccgattatgttggaagaaacttgtcctaattcaaattcttgtcacaatgttggttttgagaaataaacttttctagttctctcc

SEQ ID NO: 8084 - DNA, 1459 bp, Brassica napus
aagatgttcagaagaggacctccgagtaagagcgacaacaccaagttctacgagatcctcggcgtccccaagaccgcatcacccgaagatctcaaaaaggcttacaagaaagccgccatcaaaaaccatcccgacaagggtggagatcccgaaaagttcaaagagctagctcaggcttatgaagttctaagtgatccggagaagcgtgagatctacgatcagtatggtgaggatgcactcaaagagggaatgggtggtggaggcggtgggcatgatccgtttgatatcttctcgtccttctttggtggtggtggtggtagcccattcggtggtggcagcagccgtggaaggaggcagaggcgtggtgaagatgtggttcaccctctgaaggtttcgctagaggatctttatctcggaacaacgaagaagctctcactttctaggaatgctttgtgctctaagtgtaacggaaagggttcaaagtctggagcttcatcgacatgtagtggatgtcaaggatctggaatgaaggtttcaatcaggcagcttggaccgggaatgattcagcagatgcagcacccttgtcatgattgcaaaggtacaggagagaccatcaatgaccgtgacaggtgtccacagtgcaaaggagataaggttgtctctgagaagaaggtgcttgaagtagctgtggaaaagggaatgcagcatagtcagaagatcacattcagtggacaagcagatgaagcgccggatacagtcactggtgatatagtgttcgtcatccaacagaaggagcacccaaagttcaagagaaagggagatgatctctttgtggagcacaccctctctcttactgaagctctctgtggcttccagtttgtcttgacccatttggacaaaaggcagcttctcatcaaatccagtcccggagaggttgtgaagccagattcatacagggcgataaccgatgagggaatgcctatgcaccagaggccgttcatgaagggcaagctttacatccacttcacggtcgacttccctgactcgctgagccctgaccagacaaaggccattgaagcggttttgccgaagccaaaggcggatctgagcgacatggaaatagacgaatgcgaggagacgacgctgcacgatgtgaacattggggatgagatgagaaggaaggctcaagctcaaagagaggcttatgatgatgacgatgatgatgaagaaggcccaggtggtgctcagcgtgtgcaatgtgcccagcagtgatatcaaacatgcgcacttgtagtgatgatattcagcatttgcgtttttaaaaattatatgtattattttttggtctttgctataagacttttgcccgattatgttggaagaaacttgtcctaattcaaattcttgtcacaatgttggttttgagaaataaacttttctagttctctcaaaaaaaaaa

SEQ ID NO: 8085 - DNA, 1569 bp, Brassica napus
tctacgattcatcatggatcgcggtaaaactgcacacctctcgacatcagcacacaaacaaaactccatcaaaagctctcctcccacactttcctttagggtttcttaaacaacgtagacaagatgttcagaagaggacctccgagtaagagcgataacaccaagttctacgagatcctcggcgtccccaagaccgcatcacccgaagatctcaaaaaggcttacaagaaagccgccatcaaaaaccatcccgacaagggtggagatcccgaaaagttcaaagagctagctcaggcttatgaagttctaagtgatccggagaagcgtgagatctacgatcagtatggagaggatgcactcaaagagggaatgggcggtggaggcggtgggcatgatccgtttgatatcttctcgtccttctttggtggcggtggtggtagcccattcggtggtggcagcagccgtggaaggaggcagaggcgtggtgaagatgtggttcaccctctgaaggtttcactagaggatctttatctcggaacaacgaagaagctctcactttctaggaatgctttgtgctctaagtgtaacggaaagggttcaaagtctggagcttcatcgacatgtagtggatgtcaaggatctggaatgaaggtttcaatcaggcagcttggaccgggaatgattcagcagatgcagcacccttgtcatgattgcaaaggtacaggagagaccatcaatgaccgtgacaggtgtccacagtgcaaaggagataaggttgtctctgagaagaaggtgcttgaagtagctgtggaaaagggaatgcagcatagtcagaagatcacattcagtggacaagcagatgaagcgccggatacagtcactggtgatatagtgttcgtcatccaacagaaggagcacccaaagttcaagagaaagggagatgatctctttgtggagcacaccctctctcttactgaagctctctgtggcttccagtttgtcttgacccatttggacaaaaggcagcttctcatcaaatccagtcccggagaggttgtgaagccagattcatacagggcgataaccgatgagggaatgcctatgcaccagaggccgttcatgaagggcaagctttacatccacttcacggtcgacttccctgactcgctgagccctgaccagacaaaggccattgaagcggttttgccgaagccaaaggcggatctgagcgacatggaaatagacgaatgcgaggagacgacgctgcacgatgtgaacattggggatgagatgagaaggaaggctcaagctcaaagagaggcttatgatgatgacgatgatgatgaagaaggcccaggtggtgctcagcgtgtgcaatgtgcccagcagtgatatcaaacatgcgcacttgtagtgatgatattcagcatttgcgtttttaaaaattatatgtattattttttggtctttgctataagacttttgcccgattatgttggaagaaacttgtcctaattcaaattcttgtcacaatgttggttttgagaaataaacttttctagttctctc

SEQ ID NO: 8086 - DNA, 1388 bp, Brassica napus
aagatgttcagaagaggaccttcgagtaagagcgacaacaccaagttctacgagatcctcggcgtccccaagaccgcttcacctgaagatctcaaaaaggcttacaagaaagccgccatcaaaaaccatcccgacaagggtggagatcccgagaagttcaaagagctagctcaggcttatgaagttttaagtgatccggagaagcgtgagatctacgatcagtatggagaggatgcactcaaggagggaatgggcggtggaggcggtgggcatgacccctttgatatcttctcttccttctttggtggcggtggtggtagcccattcggtggtggtagcagccgtggaaggaggcagaggcgtggtgaagacgttgttcaccctctgaaggtttcactagaggatctttatctcggaacaacgaagaagctctcactttctaggaatgctctgtgctctaagtgtaacggaaagggttcaaagtctggagcttcatcgacatgtagtggatgtcaaggatctggaatgaaggtttcgataaggcagcttggacctggaatgattcagcagatgcagcatccttgtcatgattgcaaaggtacaggagagaccatcaatgaccgtgacaggtgcccacagtgcaaaggagataaggttgtatctgagaagaaggtgcttgaagtagctgtggaaaagggaatgcagcatagtcagaagattacattcagtggacaagcagatgaagcgcctgatacagtcactggagatatagtgttcgtcattcagcagaaggagcacccaaagttcaagagaaagggagatgatctctttgtcgagcacaccctctctcttacagaagctctctgtggcttccagtttgtcttgacccatttggacaaaagacagcttctcatcaaatccagtccgggagaggttgcgaagccagattcatacagggcgataaccgatgagggaatgcctatgcaccaaaggccgttcatgaagggcaagctttacatccacttcacggtcgacttccctgactcgttgagccctgaccagacaaaggccattgaagcggttttgccgaagccaaaggcagatctgagcgacatggaaatagacgagtgcgaggagacgacgctgcacgaagtgaacattgaggatgagatgagaaggaaggctcaagctcaaagagaggcttatgatgatgacgatgatgatgaagaaggcccaggcggtgctcagcgtgtgcaatgtgcccagcagtgatatcaaacatgcgcacttgtagtgatgatattcagcatttgcgtttttaaaaattatatgtattattttttggtctttgttataagacttttgcccgattatgttggaagaaactt

SEQ ID NO: 8087 - DNA, 1471 bp, Brassica napus
agcagccacacaacaaaactctattaaaagcctctccctcccacttctttcctttagggttttctcaataacgtagacaagatgttcagaagaggaccttcgagtaagagcgacaacaccaagttctacgagatcctcggcgtccccaagaccgcttcacctgaagatctcaaaaaggcttacaagaaagccgccatcaaaaaccatcccgacaagggtggagatcccgagaagttcaaagagctagctcaggcttatgaagttttaagtgatccggagaagcgtgagatctacgatcagtatggagaggatgcactcaaggagggaatgggcggtggaggcggtgggcatgacccctttgatatcttctcttccttctttggtggcggtggtggtagcccattcggtggtggtagcagccgtggaaggaggcagaggcgtggtgaagacgttgttcaccctctgaaggtttcactagaggatctttatctcggaacaacgaagaagctctcactttctaggaatgctctgtgctctaagtgtaacggaaagggttcaaagtctggagcttcatcgacatgtagtggatgtcaaggatctggaatgaaggtttcgataaggcagcttggacctggaatgattcagcagatgcagcatccttgtcatgattgcaaaggtacaggagagaccatcaatgaccgtgacaggtgcccacagtgcaaaggagataaggttgtatctgagaagaaggtgcttgaagtagctgtggaaaagggaatgcagcatagtcagaagattacattcagtggacaagcagatgaagcgcctgatacagtcactggagatatagtgttcgtcattcagcagaaggagcacccaaagttcaagagaaagggagatgatctctttgtcgagcacaccctctctcttacagaagctctctgtggcttccagtttgtcttgacccatttggacaaaagacagcttctcatcaaatccagtccgggagaggttgcgaagccagattcatacagggcgataaccgatgagggaatgcctatgcaccaaaggccgttcatgaagggcaagctttacatccacttcacggtcgacttccctgactcgttgagccctgaccagacaaaggccattgaagcggttttgccgaagccaaaggcagatctgagcgacatggaaatagacgagtgcgaggagacgacgctgcacgaagtgaacattgaggatgagatgagaaggaaggctcaagctcaaagagaggcttatgatgatgacgatgatgatgaagaaggcccaggcggtgctcagcgtgtgcaatgtgcccagcagtgatatcaaacatgcgcacttgtagtgatgatattcagcatttgcgtttttaaaaattatatgtattattttttggtctttgttataagacttttgcccgattatgttggaagaaacttgtcct

SEQ ID NO: 8088 - DNA, 1547 bp, Brassica oleracea
gaagcaaagtcttcgaagagcagccacaacaacaaactccatctcctctctctctctctctctctctctctctcgcatctctcctcttttgtttttagggttttcttaaaaacggagaaaagatgttcagaagaggaccttcgagcaagagcgacaacaccaagttctacgagatcctcggcgtccccaagaccgcctcacctgaagatctcaaaaaggcttacaagaaagccgccatcaaaaaccatcccgacaagggtggagatccagagaagttcaaggagctagctcaggcttatgaggttctcagcgatccggagaagcgtgagatctatgatcagtacggtgaggatgcgctcaaggaaggaatgggtggtggaggcggtggtcatgacccctttgacatcttctcctccttctttggtggtggtggtggacaccctttcggaggtggcagcagccgtggaaggaggcagaggcgtggtgaagatgttgttcaccctctgaaggtttctctagaggatctttatctcggaacaacgaagaagctctcgctttcaaggaaggctttgtgctcaaagtgtaacggaaagggttcgaagtctggagcttcgatgacatgcggtggatgccagggatcggggatgaaggtctccatcaggcagattggacctgggatgattcagcagatgcagcatccttgtcatgactgcaagggcactggagagaccatcaacgatcgggataggtgtccacagtgcaaaggagagaaggtcgtctccgagaagaaggtgcttgaagtagctgtggagaaggggatgcaacacagccagaagattacattcagaggacaagcagatgaagcgcctgatacagtcactggagatatagtcttcgtcattcagcagaaggagcactcaaccttcaagagaaagggagatgatctcttcgtggagcacaccctctctctaacggaagccctctgtgggttccagtttgtcttgacccacttggacacaaggcagcttctcatcaaatcgaatcccggggaggttgtgaagccagattcgtacagggcgataagtgacgaggggatgcctatacaccaaaggcccttcatgaagggtaagctttacatccacttcactgtggagttcccggactcgctgaacccggaccagacaaaggccattgaagcggttttgcctaagcgtgcaaatgcgactctgagcgacatggagatagacgagtgcgaggagacgacgctgcacgatgtgaacattgaggatgagatgaggaggaaggctcaagctcaaagagaggcttatgatgatgacgacgatgatgaggaaggcccaggcggtgctcagcgtgtgcaatgcgcccagcagtgatgtgacttgcgctttttagtgatatctaaatactggttacgattttttagtaaagacttttgccgattctgtggcaagaaactcctcttaattcaaatgctggttacatttttgtttgttttgtttttctgaataaacttctctagttcttgg

SEQ ID NO: 8089 - DNA, 1616 bp, Brassica rapa
gacctttaagcaaagtcttcgaagagcagccacaacaacaaactccatctccttctctctctctcgctcgcatctctcctcttttgtttttagggttttcttaaaaacggagaaaagatgttcagaagaggaccttcgagcaagagcgacaacaccaagttctacgagatcctcggcgtccccaagaccgcctcacctgaagatctcaaaaaggcttacaagaaagccgccatcaaaaaccatcccgacaagggtggagatccagaaaagttcaaggagctagctcaggcttatgaggttcttagcgatccggagaagcgtgagatctatgatcagtacggtgaggacgcgctcaaggaaggaatgggtggtggaggcggtggtcatgacccctttgacatcttctcctccttctttggtggtggcggtggacaccctttcggaggtggcagcagccgtggaaggaggcagaggcgtggtgaagatgttgttcaccctctgaaggtttctctagaggatctttatctcggaacaacgaagaagctctcactttcaaggaaggctttgtgctcaaagtgtaacggaaagggttcgaagtctggagcttcgatgacttgcggtggatgccagggatctggaatgaaggtctccatcaggcagatcgggcctgggatgattcagcagatgcagcatccttgtcatgactgcaagggcactggagagaccatcaatgatagggataggtgtccacagtgcaaaggagagaaggttgtctcggagaagaaggtgcttgaagtagctgtggagaaggggatgcagcacagccagaagattacattcaggggacaagcagatgaagcgcctgatacagtcactggagatatagtgttcgtcatccagcagaaggagcactcaaccttcaagagaaagggagatgatctctttgtggagcacaccctctctctaacagaagccctctgtgggttccagttcgtcttgacacacttggacacaaggcagcttctcatcaaatccagtcccggggaggttgtgaagccagattcgtacagggcgataagtgacgagggaatgccgattcaccaaaggcccttcatgaagggcaagctgtacatccacttcactgtagagttcccggacagtctgagcccggaccagacaaaggccattgaagcggttttgccaaggcctgcaaatgcgactctgagcgacatggagatagacgagtgcgaggagacgacgctgcacgatgtgaacattgaggatgagatgaggaggaaggctcaagctcaaagagaggcttatgatgatgacgacgatgatgaggaaggcccaggcggtgctcagcgtgtgcaatgcgcccagcagtgatgtgacttgcgcggtttagtgatatctggttacgattttttagtaagacttttgccgattctgtggcaagaaactcgtcctaattcaaatgctggttacatttttgtttgttttgttttgtttttctgaataaacttctctagttcttggatcttgttactagttcgggttgtacgaaactatagtttggatgtgaacttagtaatagagaatgcgtttgtttaata

SEQ ID NO: 8090 - DNA, 1631 bp, Brassica napus
atcaacgcagagtacgcggggaagcaaagtcttcgaagagcagccacaacaacaaactcccatctccttctctctctctcgcatctctcctcttttgtttttagggttttcttaaaaacggagaaaagatgttcagaagaggaccttcgagcaagagcgacaacaccaagttctacgagatcctcggcgtccccaagaccgcctcacctgaagatctcaaaaaggcttacaagaaagccgccatcaaaaaccatcccgacaagggtggagatccagaaaagttcaaggagctagctcaggcttatgaggttctcagcgatccggagaagcgtgagatctatgatcagtacggtgaggatgcgctcaaggaaggaatgggtggtggaggcggtggtcatgacccctttgacatcttctcctccttctttggtggtggcggtggacaccctttcggaggtggcagcagccgtggaaggaggcagaggcgtggtgaagatgttgttcaccctctgaaggtttctctagaggatctttatctcggaacaacgaagaagctctcgctttcaaggaaggctttgtgctccaagtgtaacggaaagggttcgaagtctggagcttcgatgacttgcggtggatgccagggatctggaatgaaggtctccatcaggcagatcgggcctgggatgattcagcagatgcagcatccttgtcatgactgcaagggcactggagagactatcaacgatagggataggtgcccacagtgcaaaggagagaaggttgtctcggagaagaaggtgcttgaagtagctgtggagaaggggatgcaacacagccagaagattacattcaggggacaagcagatgaagcgcctgatacagtcactggagatatagtgttcgtcatccagcagaaggagcactcaaccttcaagagaaagggagatgatctcttcgtggagcacaccctctctctaacagaagccctctgtgggttccagttcgtcttgacacacttggacacaaggcagcttctcatcaaatcgaatcccggggaggttgtgaagccagattcgtacagggcgataagtgacgagggaatgccgattcaccaaaggcccttcatgaagggcaagctgtacatccacttcactgtagagttcccggacagtctgagcctggaccagacaaaggccattgaagcggtcttgccaaggcctgcaaatgcgactctgagtgacatggagatagacgagtgcgaggagacgacgctgcacgatgtgaacattgaggatgagatgaggaggaaggctcaagctcaaagagaggcttatgatgatgacgacgatgatgaggaaggcccaggcggtgctcagcgtgtgcaatgcgcccagcagtgatgtgacttgcgctttttagtgatatctaaatgctggttacgattttttagtaagacttttgccgattcggtggcaaggaactcctcttaattcaaatgctggttacatttttgtttgttttgtttttttttttctgaataaacttctctagttcttggatcttgttactagttcgggttgtacgaaactatagtttggatgtgaacttagtaatagagaatgcgtttgttt

SEQ ID NO: 8091 - DNA, 1585 bp, Brassica napus
gttttcttaaaacggagaaaagatgttcagaagaggaccttcgagcaagagcgacaacaccaagttctacgagatcctcggcgtccccaagaccgcctcacctgaagatctcaaaaaggcttacaagaaagccgccatcaaaaaccatcccgacaagggtggagatccagaaaagttcaaggagctagctcaggcttatgaggttctcagcgatccggagaagcgtgagatctatgatcagtacggtgaggatgcgctcaaggaaggaatgggtggtggaggcggtggtcatgacccctttgacatcttctcctccttctttggtggtggcggtggacaccctttcggaggtggcagcagccgtggaaggaggcagaggcgtggtgaagatgttgttcaccctctgaaggtttctctagaggatctttatctcggaacaacgaagaagctctcgctttcaaggaaggctttgtgctccaagtgtaacggaaagggttcgaagtctggagcttcgatgacttgcggtggatgccagggatctggaatgaaggtctccatcaggcagatcgggcctgggatgattcagcagatgcagcatccttgtcatgactgcaagggcactggagagactatcaacgatagggataggtgcccacagtgcaaaggagagaaggttgtctcggagaagaaggtgcttgaagtagctgtggagaaggggatgcaacacagccagaagattacattcaggggacaagcagatgaagcgcctgatacagtcactggagatatagtgttcgtcatccagcagaaggagcactcaaccttcaagagaaagggagatgatctcttcgtggagcacaccctctctctaacagaagccctctgtgggttccagttcgtcttgacacacttggacacaaggcagcttctcatcaaatcgaatcccggggaggttgtgaagccagattcgtacagggcgataagtgacgagggaatgccgattcaccaaaggcccttcatgaagggcaagctgtacatccacttcactgtagagttcccggacagtctgagcctggaccagacaaaggccattgaagcggtcttgccaaggcctgcaaatgcgactctgagtgacatggagatagacgagtgcgaggagacgacgctgcacgatgtgaacattgaggatgagatgaggaggaaggctcaagctcaaagagaggcttatgatgatgacgacgatgatgaggaaggcccaggcggtgctcagcgtgtgcaatgcgcccagcagtgatgtgacttgcgctttttagtgatatctaaatgctggttacgattttttagtaagacttttgccgattcggtggcaaggaactcctcttaattcaaatgctggttacatttttgtttgttttgttttttttcttgaataaacttctctagttcttggatcttgttactagttcgggttgtacgaaactatagtttggatgtgaacttagtaatagagaatgcgtttgttttatagacacaagtgaagactcgtacacaatgctactactctactacagggatgatggatcag

SEQ ID NO: 8092 - DNA, 1689 bp, Brassica napus
gaagcaaagtcttcgaagagcagccacaacaacaaactccatctcctctctctctctctctctctctcgcatctctcctcttttgtttttagggttttcttaaaaacggagaaaagatgttcagaagaggaccttcgagcaagagcgacaacaccaagttctacgagatcctcggcgtccccaagaccgcctcacctgaagatctcaaaaaggcttacaagaaagccgccatcaaaaaccatcccgacaagggtggagatccagagaagttcaaggagctagctcaggcttatgaggttctcagcgatccggagaagcgtgagatctatgatcagtacggtgaggatgcgctcaaggaaggaatgggtggtggaggcggtggtcatgacccctttgacatcttctcctccttctttggtggtggtggtggacaccctttcggaggtggcagcagccgtggaaggaggcagaggcgtggtgaagatgttgttcaccctctgaaggtttctctagaggatctttatctcggaacaacgaagaagctctcgctttcaaggaaggctttgtgctcaaagtgtaacggaaagggttcgaagtctggagcttcgatgacatgcggtggatgccagggatcggggatgaaggtctccatcaggcagattggacctgggatgattcagcagatgcagcatccttgtcatgactgcaagggcactggagagaccatcaacgatcgggataggtgtccacagtgcaaaggagagaaggtcgtctccgagaagaaggtgcttgaagtagctgtggagaaggggatgcaacacagccagaagattacattcagaggacaagcagatgaagcgcctgatacagtcactggagatatagtcttcgtcattcagcagaaggagcactcaaccttcaagagaaagggagatgatctcttcgtggagcacaccctctctctaacggaagccctctgtgggttccagtttgtcttgacccacttggacacaaggcagcttctcatcaaatcgaatcccggggaggttgtgaagccagattcgtacagggcgataagtgacgaggggatgcctatacaccaaaggcccttcatgaagggtaagctttacatccacttcactgtggagttcccggactcgctgaacccggaccagacaaaggccattgaagcggttttgccaaagcgtgcaaatgcgactctgagcgacatggagatagacgagtgcgaggagacgacgctgcacgatgtgaacattgaggatgagatgaggaggaaggctcaagctcaaagagaggcttatgatgatgacgacgatgatgaggaaggcccaggcggtgctcagcgtgtgcaatgcgcccagcagtgatgtgacttgcgctttttagtgatatctaaatactggttacgattttttagtaaaagacttttgccgattctgtggcaagaaactcctcttaattcaaatgctggttacatttttgtttgttttgtttttctgaataaacttctctagttcttggatcttgttactagttcgggttgtacgaaactatagtttggatgtgaacttagtaatagagaatgcgtttgtttaacgaccaccaaccacggtgaactcccggggggggtcgccacacgaatcgccctatactagctgggtctcttca

SEQ ID NO: 8093 - DNA, 1527 bp, Brassica napus
agggttttcttaaaaacggagaaaagatgttcagaagaggaccttcgagcaagagcgacaacaccaagttctacgagatcctcggcgtccccaagaccgcctcacctgaagatctcaaaaaggcttacaagaaagccgccatcaaaaaccatcccgacaagggtggagatccagagaagttcaaggagctagctcaggcttatgaggttctcagcgatccggagaagcgtgagatctatgatcagtacggtgaggatgcgctcaaggaaggaatgggtggtggaggcggtggtcatgacccctttgacatcttctcctccttctttggtggtggcggtggacaccctttcggaggtggcagcagccgtggaaggaggcagaggcgtggtgaagatgttgttcaccctctgaaggtttctctagaggatctttatctcggaacaacgaagaagctctcgctttcaaggaaggctttgtgctcaaagtgtaacggaaagggttcgaagtctggagcttcgatgacatgcggtggatgccagggatcggggatgaaggtctccatcaggcagattggacctgggatgattcagcagatgcagcatccttgtcatgactgcaagggcactggagagaccatcaacgatcgggataggtgtccacagtgcaaaggagagaaggtcgtctccgagaagaaggtgcttgaagtagctgtggagaaggggatgcaacacagccagaagattacattcagaggacaagcagatgaagcgcctgatacagtcactggagatatagtcttcgtcattcagcagaaggagcactcaaccttcaagagaaagggagatgatctcttcgtggagcacaccctctctctaacggaagccctctgtgggttccagtttgtcttgacccacttggacacaaggcagcttctcatcaaatcgaatcccggggaggttgtgaagccagattcgtacagggcgataagtgacgaggggatgcctatacaccaaaggcccttcatgaagggtaagctttacatccacttcactgtggagttcccggactcgctgaacccggaccagacaaaggccattgaagcggttttgccaaagcgtgcaaatgcgactctgagcgacatggagatagacgagtgcgaggagacgacgctgcacgatgtgaacattgaggatgagatgaggaggaaggctcaagctcaaagagaggcttatgatgatgacgacgatgatgaggaaggcccaggcggtgctcagcgtgtgcaatgcgcccagcagtgatgtgacttgcgctttttagtgatatctaaatactggttacgattttttagtaaaagacttttgccgattctgtggcaagaaactcctcttaattcaaatgctggttacatttttgtttgttttgtttttctgaataaacttctctagttcttggatcttgttactagttcgggttgtacgaaactatagtttggatgtgaacttagtaatagagaatgcgtttgtttta

SEQ ID NO: 8094 - DNA, 1526 bp, Brassica oleracea
  misc_feature (1190)..(1190): n is a, c, g, or t
  misc_feature (1504)..(1504): n is a, c, g, or t
ggaacaactcagccacacaaacaactccattaaaagcctcctcccaccactttccttcctcctctcccaattagggttttcttaaagaacagagaaaagatgttcagaagaggaccttcgagtaagagcgacaacaccaagttctacgagatcctcggcgtccccaagaccgcatcacccgaagatctcaaaaaggcttacaagaaagccgccataaaaaaccatcccgacaaaggtggagatcccgaaaagttcaaagagatagctcaggcttatgaagttctaagtgatccggagaagcgtgagatctacaatcagtatggagaggatgcactcaaggagggaatgggcggtggaggcggtgggcatgatccgtttgatatcttctcgtccttctttggtggtggtggtagcccatttggaggtggcagcagccgtggaaggaggcagaggcgtggtgaagacgttgttcaccctcttaaggtttcactagaagacctttatctcggaacaacgaagaagctctcactttctaggaatactttgtgctccaagtgtaacggaaagggttcaaagtctggagcttcatcaacatgtagtggatgtcaaggatctggaatgaaggtttcgatcagacagcttggacctggaatgattcagcagatgcagcatccttgtcatgattgcaaaggtacaggagagaccatcaatgaccgtgacaggtgtccacagtgcaaaggggataaggttgtatctgagaagaaggtgcttgaagtagctgtggaaaagggaatgcagcatagtcagaagatcacattcagtggacaagcagatgaagcgcctgatacagtcactggtgatatagtgttcgtcattcagcagaaggagcacccaaagttcaagagaaagggagatgatctctttgtggagcataccctctctcttacagaagccctctgtgggttccagtttgtcttgacccatttggacaaaaggcagcttctcatcaaatccagtcccggggaggttgtcaagccagattcatacagggcgataaccgatgagggaatgcctatgcaccaaaggccgttcatgaagggcaagctttacatccacttcacggtcgacttccctgactcgctgagccctgaccagacaaaggccattgaagcggttttgccgaaggcaanggcggatctgagcgacatggaaatagacgagtgcgaggagacgaccctgcacgaagtgaacattgaggatgagatgagaaggaaggctcaagctcaaagagaggcttatgatgatgacgatgatgatgatgaagaaggcccaggcggtgctcagcgtgtgcaatgtgcccagcagtgatatcaatcatgcgcacttgtagtgatattcatcatttgcgttttttttttaaatattatgtattatttttgggtctttgctataaagactttttgcccgattatgttggaagaaacttgtcctaattcaatttctngtcgcaatgttggttttgagaa

SEQ ID NO: 8095 - DNA, 1553 bp, Brassica napus
gaacaactcagccacacaaacaactccattaaaagcctcctcccaccactttccttcctcctctcccaattagggttttcttaaagaacagagaaaagatgttcagaagaggaccttcgagtaagagcgacaacaccaagttctacgagatcctcggcgtccccaagaccgcatcacccgaagatctcaaaaaggcttacaagaaagccgccataaaaaaccatcccgacaaaggtggagatcccgaaaagttcaaagagatagctcaggcttatgaagtcttaagtgatccggagaagcgtgagatctacgatcagtatggagaggatgcactcaaggagggaatgggcggtggaggcggtgggcatgatccgtttgatatcttctcgtccttctttggtggtggtggtagcccatttggaggtggcagcagccgtggaaggaggcagaggcgtggtgaagatgtggttcaccctctgaaggtttcactagaagacctttatctcggaacaacgaagaagctctcactttctaggaatactttgtgctccaagtgtaacggaaagggttcaaagtctggagcttcatcaacatgtagtggatgtcaaggatctggaatgaaggtttcgatcagacagcttggacctggaatgattcagcagatgcagcatccttgtcatgattgcaaaggtacaggagagaccatcaatgaccgtgacaggtgtccacagtgcaaaggggataaggttgtatctgagaagaaggtgcttgaagtagctgtggaaaagggaatgcagcatagccagaagatcacattcagtggacaagcagatgaagcgcctgatacagtcactggtgatatcgtgttcgtcattcagcagaaggagcacccaaagttcaagagaaagggagatgatctctttgtggagcataccctctctcttacagaagccctctgtgggttccagtttgtcttgacccatttggacaaaaggcagcttctcatcaaatccagtcccggggaggttgtgaagccagattcatacagggcgataaccgatgagggaatgcctgtgcaccagagaccgttcatgaagggcaagctttacatccacttcacggtcgacttccctgactcgctgagccctgaccagacaaaggccattgaagcggttttgccgaagccaaaggcggatctgagcgacatggaaacagacgagtgcgaggagacgaccctgcacgaagtgaacattgaggatgagatgagaaggaaggctcaagctcaaagagaggcttatgatgatgacgatgatgatgaagaaggcccaggcggtcctcagcgtgtgcaatgtgcccagcagtgatatcaatcatgcgcacttgtagtgatattcatcatttgcgttttttttttaaatattatgtattatttttgggtctttgctataaagactttttgcccgattatgttggaagaaacttgtcctaattcaatttcttgtcgcaatgttggttttgagaaataaacttttctagttctctccaaaaaaaaa

SEQ ID NO: 8096 - DNA, 1499 bp, Brassica napus
aactcagccacacaaacaactccattaaaagcctcctcccaccactttccttcctcctctcccaattagggttttcttaaagaacagagaaaagatgttcagaagaggaccttcgagtaagagcgacaacaccaagttctacgagatcctcggcgtccccaagaccgcatcacccgaagatctcaaaaaggcttacaagaaagccgccataaaaaaccatcccgacaaaggtggagatcccgaaaagttcaaagagatagctcaggcttatgaagtcttaagtgatccggagaagcgtgagatctacgatcagtatggagaggatgcactcaaggagggaatgggcggtggaggcggtgggcatgatccgtttgatatcttctcgtccttctttggtggtggtggtagcccatttggaggtggcagcagccgtggaaggaggcagaggcgtggtgaagatgtggttcaccctctgaaggtttcactagaagacctttatctcggaacaacgaagaagctctcactttctaggaatactttgtgctccaagtgtaacggaaagggttcaaagtctggagcttcatcaacatgtagtggatgtcaaggatctggaatgaaggtttcgatcagacagcttggacctggaatgattcagcagatgcagcatccttgtcatgattgcaaaggtacaggagagaccatcaatgaccgtgacaggtgtccacagtgcaaaggggataaggttgtatctgagaagaaggtgcttgaagtagctgtggaaaagggaatgcagcatagccagaagatcacattcagtggacaagcagatgaagcgcctgatacagtcactggtgatatcgtgttcgtcattcagcagaaggagcacccaaagttcaagagaaagggagatgatctctttgtggagcataccctctctcttacagaagccctctgtgggttccagtttgtcttgacccatttggacaaaaggcagcttctcatcaaatccagtcccggggaggttgtgaagccagattcatacagggcgataaccgatgagggaatgcctgtgcaccagagaccgttcatgaagggcaagctttacatccacttcacggtcgacttccctgactcgctgagccctgaccagacaaaggccattgaagcggttttgccgaagccaaaggcggatctgagcgacatggaaacagacgagtgcgaggagacgaccctgcacgaagtgaacattgaggatgagatgagaaggaaggctcaagctcaaagagaggcttatgatgatgacgatgatgatgaagaaggcccaggcggtcctcagcgtgtgcaatgtgcccagcagtgatatcaatcatgcgcacttgtagtgatattcatcatttgcgtttttttttaaatattatgtattatttttgggtctttgctataaagactttttgcccgattatgttggaagaaacttgtcctaattcaatttcttgtcg

SEQ ID NO: 8097 - DNA, 1576 bp, Arabidopsis thaliana
ttgaacagaagcaaagtcttcaaaaccaaacaagttagcagccacaacattctccttctccttctcctcgtgaagacttttctctctgtttattttttttagggttttcgtaagaacagagcaaaaaacatgtttggaagaggaccttcaaggaagagcgataacacaaagttctacgagatccttggtgttcctaagaccgcagcaccagaagatctcaagaaagcttataagaaagccgctatcaaaaaccatcctgataagggtggtgatcccgaaaagtttaaagagttagcacaggcttatgaagttttaagtgatcctgagaagcgtgagatctatgatcaatatggggaagatgcactcaaggaaggaatgggtggtggaggtggtggacacgatccatttgatatcttctcttccttctttggtagtggtggacacccattcggaagtcatagccggggaaggaggcagaggcgtggtgaagatgttgttcatcccttgaaggtttccttagaggatgtttatctcggaacaacaaagaagctctcactttctaggaaggctttgtgctcaaagtgtaacggcaagggttcaaagtctggagcttcaatgaaatgtggtggctgtcaaggttcgggaatgaagatctcgatcaggcagtttggacctggaatgatgcagcaggtgcagcatgcttgtaatgattgcaaaggcacaggagagaccatcaatgatcgggacaggtgtccacaatgcaaaggagagaaggttgtctctgagaagaaggtgcttgaagtaaatgtggagaagggaatgcaacacaatcagaagatcacattcagtggacaagccgatgaagcgcctgatactgtcaccggagatatagtgtttgtcattcagcagaaggagcacccaaagttcaaaagaaagggtgaggatctctttgtggagcacaccatctctctaaccgaggccttgtgtggcttccagtttgtcttgacccatttggacaaaagacagcttctcatcaaatccaagcccggagaggtcgtcaaacctgattcatacaaggcgataagtgatgagggaatgccaatataccaaaggccgttcatgaagggtaagctatacattcacttcacggttgaattcccggaatcgctgagcccggatcagacaaaggccattgaagcagttttgccaaagccaaccaaggcagctataagcgatatggaaatagacgactgcgaagagacgactctgcatgatgtgaacattgaggatgagatgaaaaggaaggcgcaagctcaaagagaggcttatgatgacgatgaggaagatcacccaggcggtgctcagcgtgtgcaatgtgcccagcagtgatcaacatgcgcatcttagtgatctccaatatttgcttctgtcttttctccttttcattgtattatttttgggtctttttatagactttgccaattcagtgggaagaacctcgtcctaattcaaatccttgttacaccattttttttggtttgagaaataaacttgtagttcttgagattttgtcctg

SEQ ID NO: 8098 - DNA, 1539 bp, Raphanus sativus
  misc_feature (982)..(982): n is a, c, g, or t
  misc_feature (988)..(988): n is a, c, g, or t
  misc_feature (994)..(994): n is a, c, g, or t
  misc_feature (1256)..(1256): n is a, c, g, or t
  misc_feature (1372)..(1372): n is a, c, g, or t
  misc_feature (1386)..(1386): n is a, c, g, or t
  misc_feature (1422)..(1423): n is a, c, g, or t
  misc_feature (1444)..(1444): n is a, c, g, or t
  misc_feature (1446)..(1446): n is a, c, g, or t
gggaccttaagcaaagtcttcgaagagcagccacaacaaactctctctctctctacatctctcctctctgtttttagggttttcttaaaaacggagaaagatgttcagaagaggaccttcgagtaagagcgacaacaccaagttctacgagatcctcggcgttcccaagaccgcctcacctgaagatctcaaaaaggcttacaagaaagccgccatcaaaaaccatcccgacaagggtggagatcccgagaagttcaaggagctagctcaggcttatgaagttctaagcgatccagagaagcgtgagatctacgatcagtatggtgaggacgcgctcaaggaaggaatgggcggtggaggcggtggtcacgacccctttgatatcttctcctccttctttggtggtggtggtggtggacaccctttcggaggtggtagtagccgtggaaggaggcagaggcgtggtgaagatgttgttcaccctctgaaggtttctctagaggatctttatctcggaacaacgaagaagctttcgctttctaggaaggctttgtgctcaaagtgtaacggaaagggttcgaagtctggagcttcgatgacgtgcggtggatgccagggatcgggaatgaaggtgtcgatcaggcagattggacctgggatgattcagcagatgcagcatccttgccatgactgcaagggaactggtgagaccatcaacgatcgtgataggtgtccacagtgcaaaggagagaaggttgtctccgagaagaaggtgcttgaagtagctgttgaaaaggggatgcagcatagtcagaagatcactttcgatggacaagcagatgaagcgcctgatacggtcactggagatatagtgttcgtcatacagcagaaggagcacccaaagttcaagagaaagggagaagatctcttcgtcgagcacaccctctctctaaccgaagccctctgtggcttccagtttgtnttgacncatttngacaaaagacagcttctcatcaaatccagtcccggggaggttgtgaagccagattcatacagggcgataagcgacgagggaatgccaatgtaccaaaggcccttcatgaagggtaagctttacatccacttcaccgtcgagttccctgaatcgctgaccctggaccagacaaaggccatcgaagcggttttgccgaagcccaaggcggctctgagcgacatggagatagacgagtgcgaggagacgacgctgcacgatgtgnacatggaggatgagatgagaaggaaggctcaagcgcaaagagaggcttatgatgacgatgatgatgaagaaggcccgggcggtgctcagcgtgtgcaatgtgctcagcagtgatantatcaacatgcgcnctttgtagtgatattcagcatttgcgtttttttaannattatatgtattatttttggntnctttgctatagacatttacccgattctgttggaagaaacttgtcctaattcaatttctttttactttcagaataaactttttctagttcttga

SEQ ID NO: 8099 - DNA, 1509 bp, Raphanus sativus
  misc_feature (376)..(376): n is a, c, g, or t
  misc_feature (472)..(472): n is a, c, g, or t
  misc_feature (593)..(593): n is a, c, g, or t
  misc_feature (602)..(602): n is a, c, g, or t
  misc_feature (655)..(655): n is a, c, g, or t
  misc_feature (670)..(670): n is a, c, g, or t
ctcttcccttaaccttctctcagtattagggttttctgaagaacgtagagaaaggatgttcagaagaggaccttcgagtaagagcgacaacaccaagttctacgagatccttggcgttcccaagaccgcatcacccgaagatcttaaaaaggcttacaagaaagccgccatcaaaaaccatcccgacaaaggtggagatcccgagaagttcaaagagctagctcaggcttatgaagttctaagcgatccagaaaagcgtgagatctacgatcagtacggagaggatgcactcaaggagggaatgggtggtggtggcggtggacacgatccctttgatatcttctcctccttcttcggtggtggtggtggacacccnttcggtggtggtagcagccgtggaaggaggcagaggcgtggtgaagatgtggttcaccctctgaaggtttcactagaggatctttatctcggaacnacgaagaagctctcactttctaggaaggctttgtgttccaagtgtaacggaaagggttcaaagtctggagcttcaatgacatgcggtggatgtcagggatctggaatgaaggtttcgatcnggcagcttngacctggaatgattcagcagatgcagcatccttgtcacgattgcaaaggcacnggagagaccatcaangatcgggacaggtgtccacagtgcaaaggagagaaggttgtctctgagaagaaggtgcttgaagcagctgttgaaaaggggatgcagcatagtcagaagatcacattcgatggacaagcagatgaagcgcctgatacggtcactggagatatagtgttcgtcattcagcagaaggatcacccaaagtttaagaggaagggagaagatctctttgttgagcacaccctctctcttacagaagccctctgcggcttccagtttgtcttgactcatttagacaaaagacagctcctcatcaaatccggtcccggggaggttgtgaagccagactcatacagggcgataagcgacgagggaatgccaatgtaccaaaggccgttcatgaagggtaagctttacattcacttcacggtcgagttccctgaatcgctgaccccggatcagacaaaggccatcgaagcggttctgccgaagccaaaggcagctctgagcgacatggagatagacgagtgcgaggagacgacgctgcacgatgtgaacatggaggatgagatgagaaggaaggctcaagcgcaaagagaggcttatgatgacgatgatgatgaagaaggcccgggtggtgctcagcgtgtgcaatgtgctcagcagtgatatatattatcaacatgcgcgctttgtagtgatattcagcatttgcgttttaaaaattatactatgtattattttcgggtctttgctattagacttttgcccgattctgttggaagaagcttgtcctaattcattttcttgtcgctttcagaataaacttcttttctagttcttgagatttacgtcca

SEQ ID NO: 8100 - DNA, 1854 bp, Malus domestica
caaaacccttctttcttttccttttttatttcctgataaaaatcaacaattccatcatcaaccaatccaacggtccaaaactcccgacgaccaaaaaccccaaggagagaggaaattctagacccttccgaaacacggacccaatcccaaccgtccactgcctctgtgtctaatagtgacctgatctctctataaatacccaaacgggctgctcgtttcccctagttgcccttgactctttaggtatcgtcctcctcgcatctcgtaataccatacggagagaggaacaagattcgtgatttcgattcgatttggcgattaaggttatttcttccgatcgatttagtcggccaagatgtttgggagggcgccgaagaagagcgataacactcggtactatgagattctgggagtctcgaagagtgcttctcccgacgatttgaagaaggcgtacaagaaggccgccataaaaaaccaccctgacaagggtggagatcctgagaaatttaaagagttggctcaggcttatgaggttttgagtgaccctgagaagcgtgaaatctatgatcagtatggtgaggatgcactcaaggagggaatgggtggcggcggcggtggaggccacgacccgtttgacatcttctcatccttctttgggggaagcccttttggaggtggtggtagtagccgaggacgaagacagagacgtggagaagatgttgtccacgcactgaaggtttcattggaggacctctatcttgggacctcgaagaaactatctttgtcgcgaaatgtgttatgctccaagtgtaatgggaagggatcaaaatctggggcttcattgaagtgttctggctgtcaaggaagtggtatgaaggtctcaatcaggcatcttggcccgtcaatgattcaacagatgcaacatgcttgcaatgagtgtaagggtactggagagaccattagtgacagagaccgctgcactcagtgcaaaggggagaaggttgttcaagagaagaaggttctggaagtccatgtggagaagggtatgcagaatggccagaagatcacattccctggtgaagcagatgaagctccggagacagtcactggtgatatagtgtttgtcattcagcaaaaagaacatcccaagttcaagagaaagggcgaggaccttttcgttgagcacacactgtctcttactgaggctctatgtggcttccagttcgtgctgacccatttagatggcaggcagctgcttatcaaatcaaaccctggcgaagttgtcaagcctgattcgttcaaggcgatcaatgatgagggtatgcccatgtaccagaggccattcatgaagggtaagctgtacatccacttcaatgtggaattcccagagtctctgagccctgagcaggtcaaggcattggaagctgctcttccaggcaagccatcggcatctcagctcactgatatggaggtggatgagtgtgaggagacgactctgcatgatgtgaacatggaggaggagatgaggaggaagcagcagcaggctcagcaagaggcctatgatgaggatgacgatatgcctggtggtgctcagagggtgcagtgcgcccagcagtgatatgattgatatgctagttttcaacttgtactagtttttcgcgtacttgcagaagcgtaacaacagaatgacaaggtggggggatgagaggagggaagggctatggcacggcggtctagaattttggaacacttaattaaatgttatgtgatgatttgaacatcctgttattcttcaactttctttttataaatgaccatcatatcattcttatctaatcaagatattctcttctc

SEQ ID NO: 8101 - DNA, 1853 bp, Malus domestica
caaaacccttctttcttttcctttttatttcctgataaaaatcaacaattccatcatcaaccaatccaacggtccaaaactcccgacgaccaaaaaccccaaggagagaggaaattctagacccttccgaaacacggacccaatcccaaccgtccactgcctctgtgtctaatagtgacctgatctctctataaatacccaaacgggctgctcgtttcccctagttgcccttgactctttaggtatcgtcctcctcgcatctcgtaataccatacggagagaggaacaagattcgtgatttcgattcgatttggcgattaaggttatttcttccgatcgatttagtcggccaagatgtttgggagggcgccgaagaagagcgataacactcggtactatgagattctgggagtctcgaagagtgcttctcccgacgatttgaagaaggcgtacaagaaggccgccataaaaaaccaccctgacaagggtggagatcctgagaaatttaaagagttggctcaggcttatgaggttttgagtgaccctgagaagcgtgaaatctatgatcagtatggtgaggatgcactcaaggagggaatgggtggcggcggcggtggaggccacgacccgtttgacatcttctcatccttctttgggggaagcccttttggaggtggtggtagtagccgaggacgaagacagagacgtggagaagatgttgtccacgcactgaaggtttcattggaggacctctatcttgggacctcgaagaaactatctttgtcgcgaaatgtgttatgctccaagtgtaatgggaagggatcaaaatctggggcttcattgaagtgttctggctgtcaaggaagtggtatgaaggtctcaatcaggcatcttggcccgtcaatgattcaacagatgcaacatgcttgcaatgagtgtaagggtactggagagaccattagtgacagagaccgctgcactcagtgcaaaggggagaaggttgttcaagagaagaaggttctggaagtccatgtggagaagggtatgcagaatggccagaagatcacattccctggtgaagcagatgaagctccggagacagtcactggtgatatagtgtttgtcattcagcaaaaagaacatccgaagttcaagagaaagggcgaggaccttttcgttgagcacacactgtctcttactgaggctctatgtggcttccagttcgtgctgacccatttagatggcaggcagctgcttatcaaatcaaaccctggcgaagttgtcaagcctgattcgttcaaggcgatcaatgatgagggtatgcccatgtaccagaggccattcatgaagggtaagctgtacatccacttcaatgtggaattcccagagtctctgagccctgagcaggtcaaggcattggaagctgctcttccaggcaagccatcggcatctcagctcactgatatggaggtggatgagtgtgaggagacgactctgcatgatgtgaacatggaggaggagatgaggaggaagcagcagcaggctcagcaagaggcctatgatgaggatgacgatatgcctggtggtgctcagagggtgcagtgcgcccagcagtgatatgattgatatgctagttttcaacttgtactagtttttcgcgtacttgcagaagcgtaacaacagaatgacaaggtggggggatgagaggagggaagggctatggcacggcggtctagaattttggaacacttaattaaatgttatgtgatgatttgaacatcctgttattcttcaactttctttttataaatgaccatcatatcattcttatctaatcaagatattctcttctc

SEQ ID NO: 8102 - DNA, 1845 bp, Quercus alba
ccgatcgtggaaccatcatcaaagcaaggtatccaacggtccacgttgcaacagagtccacaaattctagacccttcctaaacattccagtaatacccctcaaaccatctcaaccgtccattctttaattaccgacccaaactcaaatcaaaattaaatttttttgtttacctctctttctctctctctatctctatatatatacagagaaccctccttgatccttattagtttggttcttctagtttcagagtctccagacttttccttttttcacaaaggtttggaatcgaattctctagcttagattgtgtttgtttgatcggaaaataattttattaacgagatgtttgggagagcaccgaagaagagtgataacactcggtactacgagatattgggagtgtcgaagaacgcttcccaggacgatctcaaaaaggcttacaagaaagccgccatcaagaaccatcctgacaagggtggcgatcctgagaagttcaaagagcttgcccaggcgtatgaggtactgagcgaccctgagaaacgtgagatctatgaccaatatggtgaagatgcacttaaggagggaatgggcggtggtggcggtggccatgacccatttgatatcttctcgtctttcttcggtgggagtccatttggaggtggtggtagcagcagaggacgaaggcagcgacgtggagaagatgtggtccacccattgaaggttactttggaggacctttaccttggaacagccaagaagctttcactttctcgaaatgtgatctgttcaaagtgcaatggcaaagggtcaaagtcaggagcttcaatgaagtgtgctggctgtcaaggaactggtatgaaggtctcaattaggcaccttggcccctctatgattcagcaaatgcagcatgcttgcaatgagtgcaagggtactggagagactatcagtgacaaagaccgctgcccacaatgcaaaggggagaaggttgtacaggaaaagaaggttttggaagtcattgtggagaagggcatgcagaatgggcagaagatcacattccccggtgaagcagatgaagcgcctgatactgtcactggggatatagtctttgtccttcaacaaaaggaacatccaaagttcaagagaaagggtgatgacctttttgtggagcacaccttatccctgactgaagctctttgcggcttccagtttgtattgacccacttggatggcagaccgcttcttattaaaacacaccctggggaagttgtcaagcctgactcattcaaggcaataaatgatgaagggatgccaatgtaccagaggccattcatgaaagggaagctgtacattcatttcactgtggaattccctgattctctgagccctgagcaggttacagcactggaagctgttttgccaccaaaatcgtcgacccagctgacagacatggagctggatgagtgtgaggagaccacactacatgatgtcaacattgaagatgagatgagaaggaagcagcatgcccaggctgaggcatacgacgaagatgaagatatgcacggtggcgcacagagggtgcaatgtgcccagcagtgatgatcctttattggttgggggaactagaaatataggtgcacacctagaactgggaagtgtagtggaggtggagattgggaagtaaggaatgtttggttgcgggacatactttgtgttattattaattagtgtgtggtctttgctagtttttccaatgatccggagaccacttttgaagcagtttcattaatatctaaaccttgaaatctcaaacttttcaataatattactctcctcttataaat

SEQ ID NO: 8103 - DNA, 1645 bp, Malus domestica
aggtttgttcttcgtgttctggctttcctcgcaagaaaatagcagattctctgggagcttcctcctcctccccgctatctcatacaaaaggaacaagattcgcgatttcgctttcgatttggggattaggctttcgatcgatttagcctgccaagatgtttgggagggcgccgaagaagagcgataacactcggtactatgagattttgggagtttcgcagagtgcttcttccgacgatttgaagaaggcgtataagaaagccgccataaaaaaccaccctgataagggtggagatcctgagaaatttaaagagttggctcacgcttatgaggttttgagtgaccctgagaagcgtgaaatctacgatcagtatggtgaggatgcactcaaggagggaatggggggtggaggtggtggcggccacgacccattcgacatcttctcatctttctttggtggaagcccatttggaggtggtggtagtagccgaggacgaagacagagacgtggagaagatgttgtccacgcactcaaggtttctttggaggacctctatcttgggacctcgaagaagctatctttatcgcgtaatgtgctttgctccaagtgtaatgggaagggttcgaaatctggggcttcattgaagtgttctggctgtcaaggaactggtatgaaggtctcaattaggcacctgggcccgtctatgattcaacagatgcagcatgcttgcaatgagtgtaagggtactggagagaccattagtgaccgagaccgctgtactcagtgcaagggggagaaggttgttcaagagaagaaggtgttggaagtccatgtggagaaaggcatgcagaatggacagaagatcacattccctggtgaagcagatgaagctcctgagacagtcactggtgatatagtgtttgtcattcagcaaaaagaacatccaaagttcaagagaaagggcgaggaccttttcgtcgagcacactctgcctctaactgaggctctatgtggcttccagtttgtgttgacccatttggatggcaggcagctgcttataaaatcaaaccctggtgaagttgtcaagcctgattcgttcaaggcgatcaatgacgagggtatgcccatgtatcagaggccattcatgaaggggaagctgtacattcacttcaatgtggaattcccagagtctctcaaccctgagcaagtcaaggccttggaagctgctcttccaggcaagccatcagcatctcagctcacggatatggaggtggacgagtgtgaggagacgactctgcatgatgtgaacatggaggaggagatgaggaggaagcagctgcaggctcagcaagaggcctatgatgaggacgatgacatgcctggtggtgctcagagggtgcagtgcgcccagcagtgatgactgatgctagtttttggaaacttgtacaagttttcgggtgcttgctgaagtgttaacggatgacaaggtggggggatgaaaggaggggagggattgactgtgatgatggcatggcggtctagaattttgtgaaacacttattataattaaatgttatgtgatgattttgaacatcctgttattcttcctctatctttttataaatgaccatcattcttactact

SEQ ID NO: 8104 - DNA, 1656 bp, Malus domestica
cgaattccgttgctgtcgttgttcttcgtgttctggctttcctcgcaagaaaatagcagattctctgggagcttcctcctcctccccgctatctcatacaaaaggaacaagattcgcgatttcgctttcgatttggggattaggctttcgatcgatttagcctgccaagatgtttgggagggcgccgaagaagagcgataacactcggtactatgagattttgggagtttcgcagagtgcttcttccgacgatttgaagaaggcgtataagaaagccgccataaaaaaccaccctgataagggtggagatcctgagaaatttaaagagttggctcacgcttatgaggttttgagtgaccctgagaagcgtgaaatctacgatcagtatggtgaggatgcactcaaggagggaatggggggtggaggtggtggcggccacgacccattcgacatcttctcatctttctttggtggaagcccatttggaggtggtggtagtagccgaggacgaagacagagacgtggagaagatgttgtccacgcactcaaggtttctttggaggacctctatcttgggacctcgaagaagctatctttatcgcgtaatgtgctttgctccaagtgtaatgggaagggttcgaaatctggggcttcattgaagtgttctggctgtcaaggaactggtatgaaggtctcaattaggcacctgggcccgtctatgattcaacagatgcagcatgcttgcaatgagtgtaagggtactggagagaccattagtgaccgagaccgctgtactcagtgcaagggggagaaggttgttcaagagaagaaggtgttggaagtccatgtggagaaaggcatgcagaatggacagaagatcacattccctggtgaagcagatgaagctcctgagacagtcactggtgatatagtgtttgtcattcagcaaaaagaacatccaaagttcaagagaaagggcgaggaccttttcgtcgagcacactctgcctctaacggaggctctatgcggcttccagtttgtgttgacccatttggatggcaggcagctgcttataaaatcaaaccctggcgaagttgtcaagcctgattcgttcaaggcgatcaatgacgagggtatgcccatgtatcagaggccattcatgaaggggaagctatacattcacttcaatgtggaattcccagagtctctcaaccctgagcaagtcaaggccctggaagctgctcttccaggcaagccatcagcatctcagctcacggatatggaggtggacgagtgtgaggagacgactctgcatgatgtgaacatggaggaggagatgaggaggaagcagctgcaggctcagcaagaggcctatgatgaggacgatgacatgcctggtggtgctcagagggtgcagtgcgcccagcagtgatgactgatgctagtttttgaaaacttgtacaagttttcgggtgcttgctgaagtgttaacggatgacaaggtggggggatgaaaggaggggagggattgactgtgatgatggcatggcggcctagaattttgtgaaacacttattataattaaatgttatgtgatgattttgaacatcctgttattcttcctctatctttttataaatgaccatcattcttact

SEQ ID NO: 8105 - DNA, 1607 bp, Castanea mollissima
cttgacccatagcttggttcttctagtttcacaaagttttggaatcgaattctctagcttagattgtgtttgtttgatcggaaaaaaatttagcaaagatgtttgggagagcaccgaagaagagtgataacactcggtactacgagatattgggagtgtcgaagaacgcttcccaagacgatctcaaaaaggcttacaagaaagccgccatcaagaaccatcctgacaagggtggcgatcctgagaagttcaaagagcttgcccaggcgtatgaggtactgagtgaccctgagaaacgtgagatctatgaccaatatggtgaagatgcgcttaaggagggaatgggcggtggcggcggtggccatgacccatttgatatcttctcgtctttctttggtgggagtccatttggaggtggtggtagcagcagaggacgaaggcagcgacggggagaagatgtggtccacccattgaaggttactttggaagacctttaccttggaacagctaagaagctttcactttctcgaaatgtgatctgttcaaagtgcaatggcaaagggtcaaagtcaggagcttcaatgaagtgtgctggctgtcaaggaactggtatgaaggtctcaattaggcaccttggcccctctatgattcagcaaatgcagcatgcttgcaacgagtgcaagggtactggagagacaatcagtgataaagaccgctgcccacaatgcaaaggggagaaggttgtacaggaaaagaaggtgttggaagtcattgtggagaagggcatgcagaatgggcagaagattacattccctggtgaagcagatgaagcgcctgacactgtcactggggatatagtctttgtccttcaacaaaaggaacatccaaagttcaagagaaagggtgatgacctttttgtggagcacaccttatcccttactgaagctctttgcggcttccagtttgtattgacccacttggatagcagacagcttcttattaaaacaaaccctggggaagttgtcaagcctgactcattcaaggcaataaatgatgaagggatgccaatgtaccagaggccattcatgaaagggaagctgtacattcatttcgctgtggaattccctgattctctgagccctgagcaggttgctgcactggaagctgttttgccaccaaaatcgtcgacccagctgacagacatggagttggatgagtgtgaggagaccacactacatgatgttaacattgaagacgagatgaggaggaagcagcatgcccaggctgaggcatacgacgaagatgaagatatgcacggtggcgcacagagggtgcaatgtgcacagcagtgatgatccttcatttggttggggcaactagaaatataggtgcacactttggaggtggagattgggaaggaattcttggttgtgggacacactttgtgtgattattaattagtatgtggtctttgctagtttttccgatgatctgctgatttagaccacttttgaagcagtttcattaatatctaaaccttgaaatctcatactttttaataatatgactgtcattttataatccatgttctttcttcgtgtggaata

SEQ ID NO: 8106 - DNA, 1816 bp, Trigonella foenum-graecum
ggaaggatccagaacaaaatcccacgtaagccaaacaactttcacaaccaaatccaacgcttcacacttgacacctttcttttccactcttctagacccttcttctgtgggaccaaaacactcacacacaatcccaaccgtccattacatctcactcttaatccaaccattataacaaacttacatctcatagttatttcttctctttcttcaagttcattcggatctacaacttttattgttcttcttgttcatctcgtttctttgagctagggtttcgatctgtacgagattttcgagtagtacaaggaaggatgtttggaagagcaccgaagaaaagtgatagtacgaggtactatgaaatcttaggtgtatctaaaacagcttctcaggatgatttgaagaaagcttataaaaaagctgctattaagaatcatcctgataagggtggtgatcctgagaagttcaaagagctagcacaagcttatgaggttctgagtgatcctgagaagcgtgagatatatgatacgtatggtgaggatgcacttaaagaaggaatgggtggtggaggtggtggtggccatgatccatttgacatcttctcgtctttctttggtggtggtggtggtggtagtagccgaggacggaggcagagacgtggagaagatgtggttcaccctctcaaggtctctttggaggacctttaccttgggacatctaagaagctttctctctcaaggaatgtcttgtgctcaaagtgcagtggcaaaggttctaaatctggggcttctacgaaatgtgctggttgtcaaggaactggtatgaaggtttctattaggcaccttggtccatcaatgattcagcaaatgcagcatccttgcaacgaatgtagaggtaccggtgaaactatcaatgataaagaccgttgcccacaatgcaaaggagataaggttgtacaggagaagaaagtacttgaagttcacgtggagaaaggaatgcagaacagtcagaagattacattccctggtgaagctgatgaagcaccagacacagttactggggatattgtatttgtgcttcagcagaaagaacatcctaagttcaaaagaaagagtgaggacctttttgtagagcacacactgtctctcactgaggctttgtgtggtttccaatttgtgcttactcacttggatggtcgccaacttcttatcaaatcaaaccccggagaagttgtcaagcctaattcatacaaggctattaacgacgaaggaatgccgatgtaccagaggccatttatgaagggcaagctttacattcactttaccgtggaattccctgactccctaagtcttgatcaggtgaaaggtttggaggctgttcttccagcaaagccttcatcacagttgactgatatggagatcgacgagtgtgaggaaactacacttcatgatgtcaatatggaagaggagacgaggagaaaacaacagcagcaacaacaggaggcatatgatgaggatgatgacatgcctggtggggcacagagggtacaatgtgcccagcagtagaatcagaaagaataatggtgatgataatgataatattactgttttttaaccatagtgtggacagaacctatgtagtgtttggttcaatggtttcgagaatgtgaacactttactgctttctatatttattgtcgatgggataacttccatcctgacatccaaaatactttatatgttttggttttggtatttttgaaacatctacatcttggttattgcgacattttcagtgtgcccctttatgatgatga

SEQ ID NO: 8107 - DNA, 1589 bp, Medicago truncatula
cttctcttctctctcattcattcggatctacaacacaaactgttcctgttcttgttgtttgaactactagggtttgttttgtttcgatctgtacaaggataagatgtttggaagagcaccgaagaaaagtgatagtacgaggtactatgaaatcttaggtgtatctaagacagcttctcaggatgatttgaagaaagcttataaaaaagctgctattaagaatcatcctgataagggtggtgatcccgagaagttcaaagagctagcgcaagcttatgaggttctgagcgatcctgagaagcgtgagatatatgacacgtatggtgaggatgctcttaaggaaggaatgggtggtggaggtggtggtggccatgacccatttgacatcttctcgtctttctttggtggtggaggtggtggtagtagccgaggacggaggcagagacgtggagaagatgtggttcatcctctcaaggtctctttggaggacctttaccttgggacatctaagaagctttctctctcgagaaatgtcttgtgctcaaaatgcagtggcaaaggttctaaatctggggcttccatgaaatgtgctggttgtcaaggaactggtatgaaggtttctattagacaccttggtccatcaatgattcagcaaatgcagcatccttgcaatgaatgtaagggtaccggtgaaactatcaatgataaagaccgctgtccgcagtgcaagggagaaaaggttgtgcaagagaagaaagtacttgaagttcatgtcgagaaaggaatgcagaacagtcagaagattacattccctggtgaagctgatgaagcaccagacacagttactggggatatcgtatttgtgcttcagcagaaagaacatcccaagttcaaaagaaagagtgaagacctttttgtagagcacacactgtctcttaccgaggctttgtgtggtttccaatttgtgcttactcacttggatggtcgccaacttcttatcaaatcaaaccccggagaagttgtcaagcctgattcatacaaggctattaacgacgagggaatgccgatgtaccagaggccatttatgaagggcaagctttacattcacttcaccgtggaattccccgacaccctaagtcttgatcaggtgaaaggtttggaggctgttcttccagctaaaccttcatcacagttgacagacatggagatcgacgagtgtgaggaaactacacttcatgatgtcaatatggaagaggagaataggaggaaacaacagcaacaacaacaggaagcatatgatgaggatgatgatatgcctggtggggcacagagagtacaatgcgcccagcagtagaatcagaaaaaatgatggtgatgaaatgataatgataatgttactgttttttaaccattgtgtggacagaacctatgtagtttggttcaatggtcttgagagtgtgaacactttactgctttctatatttattatcgatgggataacttccattctgacatccaaaatacttatgttttggtatttttgaaacatctatatcttggcttttgagatattatagctcattttccca

SEQ ID NO: 8108 - DNA, 1961 bp, Glycine max
ttagggtgttgttacttcttctctggttgattcggatctagagtcttcagtttctcctcgttgttcttcgctttcctgttttcaatttcgattctttcgttaatttaataagatgtttgggagggcaccgaagaagagcgataatacgaggtactacgaaatcctcggcgtctccaagaacgcttcgcaggatgatctgaagaaggcttacaagaaagccgccattaagaatcaccccgacaagggcggtgatcccgagaagtttaaagagctggcgcaagcttatgaggttctgagtgaccctgagaagcgtgagatatatgatcagtatggtgaagatgcgcttaaggaaggaatgggtggtggcggtggccatgatccatttgatatcttttcatctttctttggcggtgggagtccctttggatcaggtggaagtagtcgaggtaggaggcagaggcgcggagaagacgtggttcaccctctcaaggtctctttggaggacctttatcttggaacttccaagaagctctccctctccagaaatgttatatgctccaagtgcagtggcaagggttctaagtctggtgcttcgatgaagtgtgctggttgtcaaggaactggtatgaaggtttctataagacatcttggcccatccatgattcagcagatgcagcatgcctgcaatgaatgtaagggtactggagaaactatcaatgacagagatcgctgcccacagtgcaagggagagaaggttgtgcaggagaagaaagtccttgaagttattgtagaaaaggggatgcagaatgggcagaagataacattccctggcgaagctgatgaagcgccggacacaattactggggatatcgtctttgtccttcagcagaaggaacatcccaaattcaaaagaaaggctgaagatctttttgtagagcacactttgtcccttaccgaggccttgtgtggcttccaatttgtgctgactcacttggatagccgtcagcttcttattaaatcaaatcccggggaagttgtgaagcctgattcatacaaggctataaatgatgagggaatgcccatgtatcagaggccattcatgaaggggaaactttacattcacttcactgtggagtttccagattctctaaaccctgatcaagttaaggccttggaggctgttctgccaccaaagccttcttcacaattgacagacatggagctggatgaatgtgaggaaactacactccatgatgtcaacatggaggaggagactaggaggaagcagcaacaagctcaggaggcatatgatgaggatgatgacatgcctggtggtgcacagagggtacagtgcgcccagcagtaatgactttgtgtggaagctagattcagaattgatgaaaatgatgataatactgttgatgttccataactgtagtgtgtggcttaaagataagtagtgtttgatgaaatgattgtgagaaagtgaacagtgtatcacttgcgtttttattattgtcgaaggggtaacttccgttctgacatcctaaatactttactatatttcgttgttctttttaatcatctccgttttggttatcacagtttttatcatttccctttcttgtgtgcatcgtttgctagtgaatgaaaacttcgaaaaaacttgttgtaagactaagacttaaaatgggaaatatccgaatatttccccccaaaaatgtattggtcttttattttttgacctaaatgtattgatctttcagggaaaaacaaagagggatataaactgtatagtctgtaggggtatattctcccaagaaatttgatagtttcttttaataatgtaactagctggaagaattccaatacatgtaattattagatttttaagctcatcacctccgaatgagtaaagagtactttttttatgtaattggaaatagtttgaatttgttgca

SEQ ID NO: 8109 - DNA, 1462 bp, Catharanthus roseus
gatgttcgggagggcaccgaaaaagagtgataacactaagtattatgagattttaggggttcccaagaatgctactcctgaagatctcaagaaggcttacaagaaagcggccatcaagaatcatcctgataagggcggtgaccctgaaaagtttaaggagctggctcaggcttatgaggtcttgagtgatccagagaaacgtgagatttatgatcagtatggtgaagatgcactcaaagaaggaatgggtggcggaggtggcatgcatgacccatttgacatcttttcttccttctttggtggaggtgcatttggaggtggaagcagcaggggtagaaggcagaggaggggagaggatgtagttcatccattgaaggtctcattagaagacctttacagcgggacaaccaagaagctgtcattatctaggaatgttatttgctccaaatgtagcggtaagggttcaaagtccggagcttcaagtaagtgttctggttgccaaggtactggtatgaaagtcacgattcgacaacttggccctggcatgatccagcagatgcagcatgcttgcaatgagtgcaaaggaaccggagagacaatcagtgacagggatcgatgtcctcagtgtaaaggtgagaaagttgtttcagagaagaaagtcttggaagtagttgttgaaaagggtatgcaaaatggacagaagatcactttccccggagaggctgatgaagctccggacacgatcacaggggatattgtttttgtcctccagcagaaagagcatcccaagtttaagagaaagcacggtgacctttttgtggagcataccctctccctcactgaggctctgtgtggcttccaattcattttgacacacttggatggaaggcagctactcattaaatcaaaaccaggagaagttatcaagcctgaccaatacaaggcaattgatgatgaaggaatgccgctgtatcagcgaccgttcatgcgtggtaaactgtatattcacttcactgtcgaattcccagattctcttagccctgatcaggtgaaagctttggaggcaatccttccgccaaggccacagtcacagctgacagacatggaactggatgagtgtgaagagacaacattgcatgatgttaatattgaggaggaaatgaggaggaaacaggctcaggctcagcaggaggcatacgacgaggacgaagatatgcacggtggagctcaaagagtacaatgtgctcaacagtgatgagagttctggcagagatggaagatggtttgcttgttctaggaatgatgatgaagaaaagaaattattaattgaaactattttgttttaagatctgtatgctgctggttttggtcaaacttgttctccattagttgagacgtgcttcgatttttatacaattcttatattataatcgatagacctgtgaaattttggaaattaatt

SEQ ID NO: 8110 - DNA, 1801 bp, Arachis hypogaea
ggagagtactgaagtatttcgcgtggtcagtgttaacccgtgcataaatatatacgaggcccaaaaccagggttttcaccttagcttctttttgttgttgcgcgtgtgagatctagaactctctgactacaacgcttcttcttgttcagttgggcggaagtagttagggtttcgaagttttgaccttcttcgataagggaccaggatgtttgggagagcgccgaagaagagcgataacaccaggtactatgagatccttggagtctccaagaacgcttcacaggatgatctcaagaaggcttacaagaaagccgccatcaagaatcaccctgacaaaggcggtgatcccgagaagtttaaagagcttgcccaggcttatgaggttctgagtgatcctgaaaagcgagagatttatgatcagtatggtgaggatgctctcaaagaaggaatgggtggcggtggtggcggccacgacccatttgatatcttccagtctttctttggtgggagtccctttggcggcggtggtagtagcagagggaggaggcagagaaggggagaagatgtggttcaccctctcaaggtctcgcttgaagacctatacctcggaacatctaagaagctctcgctctctcgcaatgtactttgctcaaagtgcaatggcaaagggtccaagtctgggaattctacaaagtgcgctggttgccaaggaactggtatgaaggtttctatcaggcaccttggtccctctatgattcagcaaatgcagcatccttgcaatgaatgtaagggtactggcgaaaccatcagtgacagggaccgttgcccacagtgcaaaggagagaaggttgtgcaggagaagaaggttcttgaggtccatgttgaaaagggtatgcagaacggacagaagattacattccctggtgaagccgatgaagcgccagatactatcactggggatattgtatttgtccttcagcaaaaggagcaccccaagttcaaaaggaaggcagaagacctttttgtagaacacactttgtccctcactgagtcgctatgtggcttccaatttgtgctcacacacttggatggcaggcaactccttattaaatcaaaccctggtgaagttgtcaagcctgactcattcaaagcgattaatgatgagggaatgccaatataccagaggccattcatgaagggcaagctttacatccacttcactgttgaattcccagagtctttgaaccctgatcaggttaaggctctagaagctgttctgccatcgaggccttcttcacagttaacagacatggagcttgatgagtgtgaggagaccacactacatgatgtcaacatggaggaagagtcaaggaggaaggcacaagctcagcaggaggcatatgaagaagatgatgacatgcctggtggtgcacagagggtacagtgcgcccagcagtagagaatgttctgttctgtggcagagagggtagagtcagatatggtgatgatgaaggattctatgatgagtgttgttgaccttagtgtgtggagtagaagcataaaacagtgtttgatcaatgatctgaagtttttaacagtgtacttattgccttatattattattaagggataatttccttttcttaagggatactttctattcttgacaacaacgacttcactgaatattctttatggagtgatttttcattttttccagacagtttttttatgaccttgttttggtgtgtgaattacttgatctgataaattcgagagatttgtacacttagtagatagt

SEQ ID NO: 8111 - DNA, 1416 bp, Ambrosia trifida
aggccgaacatacaccagtcaagtcttcctttcccgatctgcttcttcgcagattggtaattgaatactgaggattaaagaagaaggatagaatgtttggaagagcaccgaaaaagagcgataatacaaagtattacgagatccttggggttccaaagaccgcttcacaggatgatctaaagaaagcgtataggaaagctgctattaagaatcatcctgataaaggtggagatcctgaaaagtttaaagagcttgcccaagcatatgaggtactgagtgacccagagaagcgtgagatatatgatcagtatggtgaggatgccttgaaggaaggaatgggcggtggaggcggtggtcatgacccctttgacatcttccagtctttctttggcggtagtccttttggtggtggtgggggtagcagtcggggacgaaggcaacgaaggggtgaggacgttgttcatcctctcaaagtttctcttgaggatctttataacggaacttccaaaaagctctctctttcacgcaatgtaatttgctccaagtgtaaaggaaagggttcaaagtctggcgcttcaatgaagtgtgctggctgtcaaggttctggaatgaaagtttctatcagacatcttggaccatccatgatccagcaaatgcagcatccttgtaacgaatgtaagggtactggagaaaccatcaacgacaaggatcgatgcacacaatgcaagggtgagaaagttgtgcaggagaagaaggtactggaagtacatgttgagaagggcatgcagaatggacagaagattacattccctggagaggctgatgaagctcctgacacggttacaggtgatattgtgtttgtgttgcaacaaaaggagcaccctaagtttaagcgaaagggtgaggacatatttgttgagcacacattgagcttgacagaggccttatgtgggttccagtttatcctaacccatttggataacagacagcttctcatcaaatctcaacccggagaggttgtcaagccagattccttcaaggcaataaatgacgaaggaatgccaatgtaccagaggccgttcatgaaggggaaactgtacatccacttcactgtagaattcccagaatcgttgtcgcctgagcagtgcaaggcgttggaggcggtgctgccaccaaagccgtcaatgcaaatgtcagacatggaactggatgaatgtgaggagacgactcttcatgatgtcaacatcgaagaggaaatgagaaggaagcaacaagcagctcacgaagcttatgatgaagatgatgacgacatgcatggtggagcccaaagagtacaatgtgcacaacagtaattgaatcacggttaaggtttggtttgtatttgattttgtctgggcatcatcttaagacaataat

SEQ ID NO: 8112 - DNA, 1819 bp, Glycine max
ttagggcggtgttactccttctctcgttgattcggatctagagtcttttttcactcttcagttctcgttgttgttcttcgctttcctgaaactagggttttcaatttcgattcattcgttaataattaaagatgtttgggagggcaccgaagaagagcgataatacgaggtactacgaaatcctcggcgtctcgaagaacgcttcgcaggatgatctgaagaaggcttacaagaaagccgccatcaagaatcaccctgacaagggcggtgatcccgagaagtttaaagagctggcacaagcatatgaggttctgagtgaccctgagaagcgtgagatatatgatcagtatggtgaagatgcgcttaaggaaggaatgggtggtggcggtggccatgatccgtttgatatcttttcatctttctttggaggtgggagtccctttggatcaggtggaagtagtcgaggtaggaggcagaggcgcggagaagatgtggttcaccctctcaaggtctctctggaggacctttatctcgggacttctaagaagctctccctctccagaaatgtcatatgctccaagtgcactggtaagggttctaagtctggtgcttcgatgaagtgtgctggttgtcaaggaactggtatgaaggtttctataagacatcttggcccgtccatgattcagcagatgcagcatgcttgcaatgaatgcaagggtactggagaaaccatcaacgacagagatcgctgcccacagtgcaagggagaaaaggttgtgcaggagaaaaaagtccttgaagttattgtggaaaagggaatgcagaacgggcagaagattacattccctggcgaagctgatgaagcgccagacacaattactggggatattgtctttgtccttcagcagaaggaacatcccaaattcaaaagaaaggctgaagatctttttgtagagcacattttgtcccttactgaagccttatgtggcttccaatttgtgctgactcacttggatggccgtcagcttcttattaaatcaaatcctggggaagttgtcaagcctgattcatacaaggctataaatgatgagggaatgcccatgtatcagaggtcattcatgaaggggaagctttacattcacttcactgtggagttcccagattccctaaaccctgaccaggttaaggccttggaagctgttctgccaccaaagccttcttcacaattgacagacatggagctggatgaatgtgaggaaacaacactccatgatgtcaacatggaggaggagactaggaggaagcaacaacaagctcaggaggcatatgatgaggatgatgacatgcctggtggtgcacagagggtacagtgtgcccagcagtaatgacttgtgtggaagctagaatcagaattgatgaaaatgatgatgatactgttgatgtttccgtaaccgtagtgtgtgtggactaaagataagtagtgtttgatcaaatgattgtgagaaagtgaacagtgtattgcttgctttcttatgattgtcgaagggataatttccgatctgacgtcctaaatagtagtactttactatatttgtttgttctttttaaactctacgatttggtttatctcattccgttgtttgtgtgcatcgcgtttgctactgagtgaaaaacttctcagaaacttgtaaggcaaaaaatgggaaatatccgaatattctccctcaaaaaatgtcttggtttttcagggaaaagccaaggcggatataactgtaacctgtaggggtatattttcccaagaaattagatagcttttaat

SEQ ID NO: 8113 - DNA, 1785 bp, Amsonia hubrichtii
cacaatgaatcccagctgttgaaatatctcgagtttgcttatatataaaagcccataccacacattcttggaagcatctctccttttgtgttctctgggaagaaagccgaagtagaaatcaagaatcgattcttcttcgtgttgttctttgaagaagattgttggttgagtgtgtaaaggattaacgggaagatgtttgggagggcacctaagaagagtgataacacaaggtattatgagattttaggggtgcccaagaatgcttctcctgaagatctcaagaaggcttacaaaaaggcggccatcaagaaccatcctgataagggtggtgatcctgagaagtttaaggagctggctcaggcttatgaggtcttgagtgatccagagaagcgtgagatttatgatcagtatggtgaagatgcactcaaggaaggaatgggtggcggcggtggcatgcatgatccatttgacatcttccaatctttctttggaggaagtccatttggaggaggtagcagtaggggtcgaagacagaggaggggagaggacgttgttcatccattgaaagtttccttagaagacttgttcagtgggacaaccaagaagctctcgctatctaggaatgtaatatgtaccaaatgtagtggcaaggggtcaaagtccggagcttcaacaaagtgttctggctgtcaaggtactggtatgaaagtcacgattagacaactaggtcctggcatgatccaacagatgcagcatccttgcagtgagtgcaaaggaactggagagacaatcagtgacagggaccgctgccctcagtgtaagggtgataaggttgttccagagaaaaaagtcttggaagttgttgttgagaagggaatgcataatggacagaagatcactttccctggagaggctgatgaagctcctgacacagtcactggggatatcgtttttgtcctccaacagaaagaacaccccaagtttaagagaaagagtgatgacctcttcgtggagcatactctttccctcactgaagctctctgtggcttccagttcattttgacacacttggatggcagacagttacttattaaatcaaaacctggagaggttatcaagcctgatcaatacaaggcaattgatgatgaaggaatgccaatgtatcagcgcccattcatgcgaggtaaactgtatattcacttcacagtggagttccccgactcattgagccctgagcaggtgaaggctttggaagaaatccttccaccaaggccagtatcacagctgacagacatggaactagatgagtgtgaagagaccacattgcatgatgttaacattgaggaggagatgaggaggaagcaagctcaggcacagcaggaagcatacgacgaggatgatgacatgcacggtggagctcaaagggtacaatgtgctcaacagtgatataagttttgcgtaaaggaagacaatttacttgttttaggataatcaagaaaagattagccgatgctactttgttatgtgtggtttcggtcttgagtatgcaagtggaaggttctgtactccataacttggatgctacttcaattcttatacaattattctgacttgaaatttttgagttacttaattctatctgttgtcaccttagcaagtgcttacattccgaagatgttagagatgtttaacattttcttcctagtattgggtactttatttattctactatttcctctagtattttgacgagcaaatgagaatcatagttatacttttggaagc

SEQ ID NO: 8114 - DNA, 1713 bp, Cajanus cajan
aagcagtggtatcaacggcaggagttacgggggagggtgttacttcttctctcgttggtttttgggatctggagtcttctcttcgcaatcgttctttgctctctgaaattagggtttgtaatttcgatcttttgggttaaaaatgttcgggagggcaccgaagaagagcgataacacgaggtactatgaaatccttggcgtcgccaagaacgcctcgcaggatgatttgaagaaggcttacaagaaagctgccattaagaaccaccccgacaagggtggtgatcccgagaagtttaaggagctggctcaagcttatgaggttctgagtgaccctgagaagcgtgagatatatgatcagtatggtgaggatgcgcttaaggaaggaatgggtggtggtggtggtggccatgatccgtttgacatcttttcatccttctttggtggtggaagtccatttggatcaggtggtagtagtcgaggcaggaggcagagacgtggagaagatgtggtgcaccctctcaaggtctctttggaggacctttacctcgggacttctaagaagctctccctttccagaaatgtcatatgctccaagtgcagtggcaagggttctaagtctggtgcttcgatgaagtgtgctggttgtcaaggaactggtatgaaggtttctattagacatctcggtccgtccatgattcagcagatgcagcatgcttgcaatgaatgtaagggtactggagaaactatcaatgatagagaccgctgcccacagtgcaagggagagaaggttgtgcaggagaagaaagttcttgaggttcatgtggagaagggaatgcagaacgggcagaagattacattccctggtgaagctgatgaagcgccggacacaattactggggatatagtctttgtgcttcagcagaaagaacaccccaaattcagaagaaagtctgaagacctttttgtggagcacaccttgtccctcactgaggccttatgtggcttccaatttgtgctgactcacttggatggtcgtcaacttcttataaagtcaaatcccggggaagttgtcaagcctgatgcatacaaggctatcaatgatgaggggatgcccatgtaccagagaccatttatgaaggggaagctgtacatccacttcactgtggaattccctgattttctgaatgctgatcaggttaaggccttggaagccgttctgccaccaaagccttcttcgcagttgacagacatggagctggacgagtgtgaggagacaacactacatgatgtgaatatggaggaggagactaggaggaagcagcagcaggcagctcaggaggcgtatgatgaggatgatgagatgcctggtggtgcacagagggtacagtgcgcccagcagtaatcactcgtttctgcggaactagaatcaagggttattgatgatcaagatgatgtgaacaagatatttcttgcatgtcattgttgaaaggatagtttgcgttttgacatccttaattcttttgtttttaatgctctaataaggagaaataactcctttctatcggtccgagtcaacatttataggagtaaaatacatctttcggttttgaatgtatgtccaagttgggaatatgtactcctgataaaggagtacgagtgatttttgattaaagattagtagcgagttgcagtgacatttaaatagtatagtat

SEQ ID NO: 8115 - DNA, 1427 bp, Ambrosia trifida
ggacagaatgtttggaagagcaccgaagaagagcgataatacaaagtattacgagatccttggggttccaaagaccgcttcacaggatgatctaaagaaggcgtataggaaagctgctattaagaatcatcctgataaaggtggagatcctgagaagtttaaagagcttgcccaagcatatgaggtgctgagtgaccctgagaagcgtgagatatatgatcagtatggtgaggatgccttgaaggaaggaatgggcggtggaggcggtggtcatgacccctttgacatcttccagtcgttctttggtggtagtccttttggcggtggtggtggtagtagtaggggacgaaggcaacgaaggggcgaagacgttgttcatcctctcaaagtttctcttgaggatctttataacggaacttccaaaaagctctctctttcacgcaatgtaatttgctccaaatgtaaaggaaagggttcaaagtctggtgcttcaatgaagtgtgctggctgtcaaggttctggaatgaaagtttctattagacatcttggaccatcgatgatacagcaaatgcagcatccttgtaacgaatgcaagggtactggagaaaccatcaacgacaaggatcgatgcacacagtgcaagggtgagaaagttgtgcaggagaagaaggtattggaagtacacgttgagaagggcatgcagaatggacagaagattacattccctggagaggctgatgaagctcctgacacagttacaggtgatattgtgtttgtgttgcaacaaaaggagcaccctaagtttaagcgaaagggtgaggacatattagttgagcacacgttgagcttgacagaggccttatgtgggttccagtttatcctaacccatttggataaccggcagcttctcatcaaatcccaacccggagaggttgtcaagccagattccttcaaggcaataaatgacgaaggaatgccaatgtaccagaggccgttcatgaaggggaaactgtacatccacttcactgtagaattcccagaatcgttgtcgcctgagcagtgcaaggcgttggaggcggtgctgccaccaaagccgtcaatgcaaatgacagacatggaactggatgaatgtgaggagacgacacttcatgacgtcaacatcgaagaggagatgagaaggaagcaacaggcggctcaagaagcttatgacgaagatgatgacgacatgcatggtggagctcagagggtacaatgtgcacaacagtaattgaatcatggttaaggtttggtttgatttgattttgtctgggcatcatcttaagacaataatgtcaactgtaatactttataatgttaaatttgtgtctgttttgtgaacctttaaggagtatggatgattaactactattaagaaacattgtttgaga

SEQ ID NO: 8116 - DNA, 1556 bp, Ambrosia trifida
acctccacatctcattattcaaaccctctctttcacccaaacacaaccaaaccaagtcaagtcttcccttcccttcacgatctacttcttcgccgatttgtaattgaatactgaggattaaagaagaaggacagaatgtttggaagagcaccgaagaagagcgataatacaaagtattacgagatccttggggttccaaagaccgcgtcacaggatgatctaaagaaggcgtataggaaagctgctattaagaatcatcctgataaaggtggagatcctgagaagtttaaagagcttgcccaagcatatgaggtgctgagtgaccctgagaagcgtgagatatatgatcagtatggtgaggatgccttgaaggaaggaatgggcggtggaggcggtggtcatgacccctttgacatcttccagtcgttctttggtggtagtccttttggcggtggtggtggtagtagtaggggacgaaggcaacgaaggggtgaagacgttgttcatcctctcaaagtttctcttgaggatctttataacggaacttccaaaaagctctctctttcacgcaatgtaatttgctccaagtgtaaaggaaagggttcaaagtctggtgcttcaatgaagtgtgctggctgtcaaggttctggaatgaaagtttctatcagacatcttggaccatcgatgatccagcaaatgcagcatccttgtaacgaatgtaagggtactggagaaaccatcaacgacaaggatcgatgcacacagtgcaagggtgagaaagttgtgcaggagaaaaaggtattggaagtacatgttgagaagggcatgcagaatggacagaagattacattccctggagaggctgatgaagctcctgacacagttacaggtgatattgtgtttgtgttgcaacaaaaggagcaccctaagtttaagcgaaagggtgatgacatatttgtagagcacacattgagcttgacagaggccctatgtgggttccagtttatcctaacccatttggataacagacagcttctcatcaaatcccaacctggagaggttgtcaagccagattccttcaaggcaataaatgatgaaggaatgccaatgtaccagaggcccttcatgaaggggaagctgtacatccacttcacagtagaattcccagaatcgttgtcgcctgagcagtgcaaggcgttggaggcggtgctgccgcctaagccgtcaatgcaaatgacagacatggaactggatgaatgcgaggagacgactcttcatgatgtcaacattgaagaggagatgagaaggaagcaacaagcggctcacgaagcttatgacgaagatgatgacgacatgcctggtggagctcagagggtacaatgtgcgcaacagtgattgaatcatgattaaggtttggtttgattttgtctgggcattatcttaagacaataatgtcaaattgtaatactttataatgttaaatttgtgtctgttttgtgaaccttttaagcagtatggatgattaactaaatattaagaaacattgtttgagaagc

SEQ ID NO: 8117 - DNA, 1417 bp, Tripterygium wilfordii
gaattcgaaagcaaccgcgagagcagaattctgatcggcgaagatgttcgggagggctccaaagaagagcgataatactaggtattacgaggtgttgggtgttccgaagaatgctggtcaggatgatttgaagaaggcttataagaaagctgcgatcaagaaccatcctgataaaggaggcgatcctgagaagttcaaagagcttgcccacgcttatgaggtcttgagtgatcctgagaagcgtgagatatatgatcaatatggggaggatgcactcaaggaaggaatgggtggtggcggtggtggccatgatccatttgacatcttttcatcattctttggtggctctccatttggtggtggcagcagcaggggaagaaggcagagacggggcgaggatgtggttcacccactgaaggtttctttggaggacctctatctagggacatccaagaagctctctctttctcggaatgtgatatgttcaaagtgcaatggcaagggttcaaagtctggagcttcaatgacttgtgctggttgccaaggtactggtatgaaagtgtcgataaggcaccttggtccttcaatgattcagcagatgcagcatccctgcaatgaatgcaagggaactggtgaaactattagtgacaaggatcgctgcccacagtgcaagggagagaaggttgttcaggagaagaaggtgctggaggtgatagtggagaagggaatgcagaatgggcagaagattactttccctggtgaagcagatgaagcgcctgatacagtcactggagatattgtctttgtccttcagcaaaaggaacaccctagattcaagagaaaaggcagtgacctcttcgtggagcataccctttccctcactgaggccctttgtggttttcattttgtgttaacccacctggacggcagacagctcctcattaaatcaaatccaggggaagttgttaagcctgactcattcaaggcaatcaatgatgagggcatgcctgtgtatcagaggccatttatgaaggggaagttgtatatccacttcactgtagagttcccagattctgtggcccctgatcaggtgaaggcacttgaggcgattttgccttcaaggccaactagccagttgacggacatggagctagacgagtgcgaggaaactacactacatgacgttaacattgaagaagagatgcggaggaagcagcagcaggctcaacaggaggcatatgatgaggatgaagatatgcctggtggtgctcagagggtccaatgtgcacaacagtgatgaggtacaaaggaggggaaaaaatgatatctgctgtggatggctgtgagaggtggagaggaacccatgataagaattgtactagacttgtgctggtgacgaaattttcaatgaaagact

SEQ ID NO: 8118 - DNA, 3891 bp, Eucalyptus grandis
tctccacagcctcagccacagcagcgcttccttccttcatcgtttctctctctagattcctccgcgccggcaccggcaccggcaccggcacaccgtcgccgtcgaccgatcgccgccgattcgggatcccgttcctccgaccgaccgaccgagcgaaacgagggggggcaagatgttcgggcgggcgccgaagaagagcgacaacacgcggtactacgaggtcctgggagtctcgaagaacgcctcccaggaggacctcaagaaggcgtaccggaaggccgccatcaagaaccacccggacaaggggggcgatcccgagaagttcaaggagcttgcgcaggcatatgaggtcttaagtgatcctgagaagcgtgagatatacgatcaatatggtgaagatgccctcaaggagggaatgggcggtggtggaggtgggcatgacccatttgacattttctcgtccttctttggtggaagtggatttggaggtggaagcagccgaggacgtagacagagaagaggggaggacgtggttcatcccttgaaggcgtctctggaggatctctatcttgggactacaaagaagctatctctctctaggaatgtgatatgtgttaagtgcaatgggaaaggatcgaagtctggtgcgtcgatgacatgtcccggttgccaagggactggtatgaaagtgaccattaggcagctgggtccatccatgatccagcagatgcaacaagcttgcaatgaatgtaaaggcacaggagagaccattaatgagaaggatcgctgcccgcagtgcaaaggagacaaggttgtcccagaaaagaaggtgctggaagttgttgttgagaagggtatgcagaatggacagaagattacattccctggtgaagcagatgaagctccggatacagttacaggagacattgttttcatcctccaacaaaaggagcatcctaaatttaagagaaagggcgacgatctcttcgtggagcacaccctttctctcactgaggctctgtgtggcttccagtttgtattgactcacctggatggcaggcagctccttattaagtcaaaccctggggaagttgtcaagcctgattctttcaaggctattaatgatgagggtatgccgatgtaccaaaggcccttcatgaaggggaagctctacattcacttcactgtggacttcccagagtctctcagccctgagcaggtcgaggctctgcagagtgtgctgccgcagaagccagcgtcgcagctgacggagatggagctggatgagtgtgaggaaacaacattgcatgacgtcaacatcgaagaggagatgcggagaaagcaacaagcgcaggctgaagcatacgatgaggatgatgatatgcccagcggcgctcaacgcgtgcaatgcgcccagcagtaatatggtccggtcgtaaggtctcaaaacaactccgggagggtatacttcgggtgtagtgggtgatgaatgttatgcctagaggttcttatggagtcgatggggaatagtgatgtcaagcggcttctgccccctgcacttggtcctctgtatttggacatctgggtggatgaaggttttactatctttcttaacgtgagtgacaaattcaaatatagctgtgcttttcttgtttcttctcgaggccattcttattctacgaatctccatgtcccaagttttgtttggcagccttttaaaaattgcgccgggtcgataaaacagatcattgttatttcttgattgacttccaaaattgatttacttctagttgtcagttccagggcattgattctcgggatgggcaacgatttttcccagttcaggaatttcttggcgttagtccatgttccattgcactcgccatttcctggccgatttagccgacctctttctgattcaaatttttcaagagagattttgatacccagtccatggtatcctttcgattttctttcgattaattatacatcgatagtggtatggtactatcgattttctttcgatcaattattcgtcgatagttgtagcaactaacttatggatttgaattagctttatgtattatttcggatttttcgattttcttttggtcaattaaacagcgatagttgtagcaattaacttacagattacatactatttcggctgatttttcctaaagccgtcatgggatcaaatgtcaacatatccggaaaatctactaaatcaaattacttacattttgaagttcgcgattcacgttttctttcgcagtgggagttcattggtatcattcataagacgtctaatacatcatcttctcaactaaaaccttctggacacctaccgctggatacagagtacgatggccaactaacctcttccttctaggcaaaagagaaaaaataattacctaactaacgaagtcatgtgcatggcttgtctggcgggtgatacaaagggacaaagggcgagggcaatgagccactccatgattggttggttagatggacagtcgtcctctagaacactccatcatcattacaacctttgaacagagagaaaaaatctgtcccgaagcaagtacacgacaagcgccttccttcctggtgtctgcctctcctgcgtgtgggaatctttctcccttttcttatccgtgcaacgagggatcgatgtctgctcgagtgtccccctccgggaaccacttcactctgccgctggtttgtccccaccggaaaagctctcccttttaatcgccaagatcgctccttttcgtaaaatcaagaaatgggttcgctcttctgcatcctcgcgttcgctctcctcttgcctctcgcttgcgccaccagcatcaagtattgcgataattctggggactatgtcgtgaaggtgagcgatgttaagatatcgcctaacccagtggttccaggcaagccgaccacctttgacatctctgcttctacaggtcaaaatctctccaatggaaaagtggtgatacgagttacatatttcggggttcaagtccatacagagacccacgatctctgcgaagagatatcctgtcctatcacagcaggaaaatttgtgctatcccacacccaaagcttacccatatttactcctccaggcttgtacactctaaggataaccatggaggatgagctgaatcagcagttaacctgcatcagcttcaatttcagtatcagattcggatctctggtcttcaacagttgaaaatcccctatacccatatctttaggcgacttcaaaaggtcggatactgctttcttttctgaacatgattgccccatgccatatttcactgtatttcctggtgtattattcttctgtatctcgaaagtactttgtatctcccttgtaaatgaaaatatgttcgcatctagacgccttataggtgcattgcatgtcataagtcatttcaacttcagctgtctccggatgccagcaaaggcgcctttcgtaatcagagacaggaagatctacatgacactgcaaagagagcataatgaaagatagaggcattcagcagctagcagagaagtcatgcatcaaaagctgtcattctttgaaggcagggtataatggcccgaaagatgtataggcagtgaagatacgttgtcaagcagtttagggggggttttatgttatgctgttcgattgggttgaaattacttcaatttgatcactactttttttccacatgagctagtttggttcggttttaactctcccaaggagaaccaaatcgaactgatgttattctgcgcagcgcttggatgacatctatgagtttgtattgagttaggaagcaccacatgccaaagtaatacagccagttccatcgatggaaccggctttcatggcccgtg

SEQ ID NO: 8119 - DNA, 1483 bp, Euphorbia peplus
tctttatatattctatctccatttcatcattttcgcatctctagatcattaacatgtttggcagatcagcccctaagaagagcgataattccaagtactatgaaattcttggtgtctcccagactgcttcccctgatgatttgaagaaagcctacaagaaagccgccattaaaaaccatcctgacaagggtggcgatcctgaaaagttcaaggagctagctcaggcttatgaagtcttgagtgatcctgagaagcgtgagatttatgatcaatatggagaggatgcgctcaaggaaggaatgggcggaggaggcggtggccataacccgtttgatatatttgaatctttctttggtgggagtccttttggaggtggcagtagcagaggaagaaggcaaagaaggggagaggatgtggttcatccattgaaagtctcattggaggatctctacctcggtactaccaagaagctgtctctttctcgaaatgtcatttgctcaaagtgtagtggaaaggggtcaaagtctggagcttcaatgaagtgtggaggttgccagggtacagggatgaaggtctccataaggcagcttggcccttcaatgattcagcagatgcagcatgcctgcaatgagtgcaagggaactggtgagtcgattaacgacaaagatagatgcacacagtgcaagggagagaaggttgttgctgagaagaaggtgctggaagtagtagttgagaagggaatgcagcatggtcagaaaattacattccctggggaagctgatgaagctcctgatactgttaccggagacattgttttcgtcctccaacagaaggatcatccgaaattcaagagaaagggagaggaccttattgtggagcacaatctgtccctgacagaatctctttgtggcttccactttgtattgacacacttggatggaagacagcttcttatcaaatcaaaccctggagaagttgtgaagcctgattcattcaagggaataaatgatgagggcatgccaatgtaccaaaggccattcatgaagggcaagctctacattcattttaacgtagaattccctgattctttgactccagaccaggtcaaggcactcgaggcgattctacctgctaggccgtcgagtcagttgacagacatggagctggacgagtgtgaggaaactactctgcatgatgttaatatggaggaagagatgagaaggaagcagcagcaagctcagcaagaagcatatgatgaggatgatgacatgcctggtggtgcacagagagttcagtgtgctcagcaatgattcaatggaatgtactagtggtctagtcagtctaccaatctggggttgatacaagttgagtcttaactttgaacagaatattttagtaaaatcaaattgatgatcccgaaaattttctggaaataaccgcatatttgtatggataatgttcatttagtatcttatatagtttt

SEQ ID NO: 8120 - DNA, 1445 bp, Citrus sinensis
aagatgtttggaagagcaccgaagaagagcaataatacgaggtactatgagatcctgggggtgtccaagaacgcttccgctgaggacttgaagaaggcttataaaaaagctgccatcaagaatcatcccgacaagggcggcgatcctgagaagtttaaagagttggctcaggcttatgaggttctgagtgatcctgagaagcgtgagatatatgatcagtacggcgaggatgcactcaaggaaggaatgggtggtggcgctggcgcccatgacccgtttgatatcttttcgtctttctttggcggcagcccattcggaggtggtagcagcaggggacggagacagaggcggggcgaggacgtggttcatcctttgaaggtgtccttggaggatctttatctgggtacctcgaagaagctctcactttcgcggaatgtgatatgctcgaagtgcagtggtaaagggtcaaaatctggcgcttcgatgaagtgttctggttgccaaggtactggtatgaaggtctcgataaggcacctaggaccctctatgattcagcagatgcagcatccttgcaatgaatgcaagggtaccggtgagaccatcaacgataaagatcgctgccctcagtgcaagggagacaaggttgttcaggagaaaaaggtgcttgaggtcattgttgagaagggcatgcaaaatgggcagaagattaccttccctggtgaagcagatgaagcgccagatacagtcactggagacatagtatttgtacttcagcagaaggaacatccaaagttcaagagaaagggagaagatctcttttatgagcatactttgtcgctaactgaggccctctgcggtttccagtttgcactgactcatctggatgggaggcaacttctgattaaatcgaatcctggggaagttgttaagcctgattcatacaaggctatcaatgaggagggtatgcccttgtaccagaggccgttcatgaaggggaaactgtacattcacttcacagtcgaattccctgattctctgaccccagatcaggttaaggccctagaggccatcctcccatcgaggccattgtctgggatgactgacatggagctagatgaatgtgaagagactacattgcatgatgtcaacattgaggaggagatgcggaggaagcaggctcatgctcaagaggcatatgaggaggacgaagatatgcctggtggtgcccagagagtgcagtgtgcccaacagtgatgatggcgaagaacaatcattgaaagtggttttaagttgttgtacgcatactaaaatgaagctaattttcagtactaaggaaagataatttgaatagcatatttgtctgatgctcaaagctgtggacgctttgatgtttacagtgttttttgtttactagatttttttaaagcaatgaaatgccttctttt

SEQ ID NO: 8121 - DNA, 1630 bp, Trigonella foenum-graecum
cctatataaacacataactggtacttcccaaatcatcgcgttgttcacaacttcatattccgttgagatctaagaagaactctccctcacaaagcttcaaaattagggttaggttttcgatttcgattgtgaaatttcaagatgtttgggagagggcctaagaagagtgataattctaagtactatgagattcttggtgtttcgaagagtgcttctcctgatgatttgaagaaagcttataagaaagctgcgattaagaatcatcctgataagggtggtgatcctgaaaagttcaaagagcttgcacaagcttatgaggttttgagtgatcctgaaaagcgtgagatatatgatcaatatggtgaagatgcccttaaggaaggaatgggtggtggcggtggtggtcatgacccatttgatatcttttcgtctttctttggtggaggtggatttccaggtggtggtagtagcagaggaaggaggcagagacgtggtgaagatgttgttcaccccttgaaggtctctctggaggatctttaccttgggacatctaagaagctttcgctttctcggaatgtcttgtgctccaagtgcaatggaaaagggtcaaagtctggtgcttccatgacttgtgctggttgtcaaggtactggtatgaagatttccatgaggcatttgggtgccaacatgattcagcaaatgcaacatccttgcaatgaatgtaagggtactggagaaacaatcagtgacaaagatcgatgcccacaatgcaagggagagaaggttgttcaacagaagaaagtgcttgaagttcatgtggagaagggaatgcagaatgggcagaagattacattccctggtgaagctgatgaagcgccggataccgttactggagatatcgtctttgttcttcaacagaaggaacatcccaaattcaaaagaaagggtgaagatctttttgtagagcacacattgtccctcactgaggctctatgtggtttccaatttgcgctgactcatttggattctcgtcaactcctgattaaatcaaactctggagaagttgtcaagcctgattcatacaaggcaatcaatgatgaaggaatgccaatgtaccagaggcctttcatgaagggcaaactttacattcacttcactgttgagttccctgagtccctgactcttgatcaggtcaaggctttggagacaattcttccagcaaggcctgtatcacaattgacagacatggagctggatgagtgtgaggagacaacacttcatgatgtcaacattgaagaagagggaaggagaaggcagcaagctcagcaggaggcttatgatgatgatgatgatatgcctggtggtggtgctcagagagtacagtgtgctcagcagtaatgagttttgagctgtggtagaacctgtgttgatgatgtctttcatggatgtgttctagccttctggggctaaacatagtgtctgatcaaatgatttttgaaaaacagtgtagcatttatttccgtataaaagatatcttatatggttaattttatttgtttccttgtgtttgcaacattgcagctactcttaagtcactctctctatcaagcaattttttcattttctgtgt

SEQ ID NO: 8122 - DNA, 1766 bp, Mesembryanthemum crystallinum
gctccttctcgtctctctcttctctcatcgacttcctctgttgcttctctcagatcttttgtttttgcactcaactcagagcaaaaggaagaagaagaagaagaagaagaagaagaagaggagagagaaaatgttcgggagagcaccgaagaagagcgacaacaccaagtactatgaggtcctcggcgtccctaagaccgccgctcctgaggatttaaagaaggcttacaagaaagccgctatcaagaatcatcctgataagggtggtgatcctgagaagttcaaagagttggctcatgcttatgaggtcctgagtgatccagaaaagcgtgagatatatgatcaatatggtgaagatgcactcaaggaaggaatgggtggaggtggcggcatgcacgatccattcgatatcttcagttcattctttggcgggagcccatttggtggtggtggtagcagcaggggaagaaggcagaggagaggagaagatgttatccatcctctcaaggtgtctcttgatgacctgtacaacggaatgacaaagaagctttccttgtctcgcaatgcactatgctcaaagtgcaagggcaaaggatcaaagtctggagcttcgatgaattgttctggatgtcaaggtactggtatgaaggtttcaatccggcaccttggcccctcaatgatccagcagatgcaacatccgtgtaatgaatgcaagggtactggagaaactatcaatgacaaggataggtgccctcaatgtaagggtgagaaggttgtgcaagagaagaaggttctggaggttgttgtggagaaaggaatgcaacatggacagaaaattactttccctggagaggctgatgaagcgccggatacggtcacaggagatattgtctttgttgtgcagcagaaagagcaccctaagttcaagcgaaagggtgaagacctcttctatgagcacactttgagccttacagagtccctttgtggcttccggtttgttttgacccacttggatggaaggcagctccttgttaaatcaaacccaggagaagtcatcaagcctgaccaaaccaaggcaattgacgatgagggtatgccgatttaccagaggcctttcatgaagggcaagctatacatccactttactgtggaattcccggacactctgggccctgatcagtggaaagcattggaggctgtcctgccaccgaggccttcattgcaactcactgacatggagctggatgagtgcgaggagaccatattgcacgatgtcaacatcgaagaggatatgaggaggaagcgggctcaggctcaacaagaggcttatgatgaagatgacgagtcctatggtggtggtgctcaaagggtgcaatgtgcacaacagtgattacacaatctaatgattgaagaaggaatccatagacaacaacagtattgcaattgttaagtcttagtggtacgtggcggaaacttatgatgttttttctttctggtatttgtgttttgcttgtaatcctgtggggggagttagagagagcttttccttagtgtttgaatatgtactctcatacatcttaggcaggttatgctaattttgcaaattcttcgaatcatgatttgttcgagaagtcgtcatttaggtgataatcgactcgttattatgttttttagatgatgggagcagaatggagctgtgttcctttgaaagctttgattggcactctttcttctttatataaaatgcatacctgaaattcaaaatt

SEQ ID NO: 8123 - DNA, 1756 bp, Petunia hybrida
gcgggatatacaaatattttacatctgccagtgccagctatttctcggacaactatttcgtgttaatttctcaaaaaataaaagaagtctaattttgaataagagcttctagaaacttctaactcctaaacaaatcgtggccgttcaattcccctacctcacataaaaccacaaaatcccacacataatatctcctttttctcctttactccctcttcttctccctacaactttccaatcgttaaaagagattattgaagatgtttgggagagcaccaaagaagagtgataatacaaagtattatgagatcttaggagtaccaaaaacagcatcacaagaggatcttaaaaaagcttatcgtaaagctgctattaaaaatcatcctgataaaggtggtgatcctgaaaagtttaaagagcttgctcaagcttatgaggttttaagtgacccagaaaagcgtgagatatatgatcagtatggtgaggatgccctcaaggaaggaatgggaggtggaggtggtggacatgacccatttgacatattctcacagttctttggtggtgggagcccctttggtggtggtggaagcagcagaggtagaagacaaagaagaggagaggatgtagtacaccctctcaaggtttctttggaggatctttacaatggtacatcaaagaagctttcactatctcgcaatgtgctctgtgcaaagtgcaagggtaaagggtctaaatcaggtgcttcaatgaagtgttccggttgtcaagggtctgggatgaaagtttctatcagacagcttggtccctccatgatccagcagatgcagcacccttgcaatgagtgcaagggtactggtgagacaatcaatgacaaagataggtgcccacagtgcaagggtgagaaggttgcgcaggagaagaaggtgttggaagtccatgtggagaagggtatgcagaatgggcagaagataactttcccgggcgaggctgatgaagcgccggatactgtcactggagacatagtctttgtcttgcaacagaaggaacatccgaagttcaagcgcaagggagatgatctttttgttgagcacacattgaccttgactgaggctctatgcggtttccagttcatcttgactcacctagacaatagacagcttctcattaagtcccaacctggcgaagtagtcaagcctgatcagtttaaggctatcaatgatgaaggaatgccaatgtaccaaaggcctttcatgaaaggcaagctgtacattcacttcactgttgattttcctgattcattaacaccagagcaaagcaagaatcttgaagctgtgctgccgccaagacccaaactgcaagtgtctgatatggaattggatgagtgtgaggagactactttgcacgatgtgaacattgaggacgagatgcgaagaaagcagcaggcagcccaggaggcatacgacgaagatgatgatatgcatggtggtggtgcacagagagtccaatgtgctcagcagtaatttggtagtattctggtatatgcatcaagggcctgttctctctgggtatgatattagggctgctgataaagaccattgacattgtcaggaaactgggtaggaggtagatttctactagtaaagcatttgggtattttattatgcaaactgacactattaagcagagttatactgcttgacaattgcaagtgtgcttacatgttttggcaatttgtttttattcaatattattcccc

SEQ ID NO: 8124 - DNA, 1464 bp, Prunus persica
gtagcactctttaggttgttattgttcttctgttctggctttcgttccaagaaaatagcagattctctgggagcctcagagtcggtgagattgatttgggttctgggttttcaagaaatcaatcaaatttaatcgaggaagatgttcgggagggcgccgaagaagagcgataacactcggtactatgagattttgggagtgtcgcagaacgcttctcatgacgacttgaagaaggcttacaagaaagccgccatcaagaaccatcctgacaagggtggagatcctgagaaatttaaagagttggctcaggcttatgatgttctgagtgaccctgagaagcgtgaaatctatgatcagtatggtgaggatgcactcaaggaaggaatgggtggcggtggtggcggccacgacccatttgacatcttctcatctttctttggtggtagcccatttggaggtggtggcagtagcagaggccgaagacagagacgcggagaagatgtggtccactcactgaaggtctctttggaggacatctatctcgggacctcaaagaaactatctttatcgcgtaatgtgttatgctccaaatgtaatggtaaggggtcgaaatctggggcttcgttgaagtgtgcgggctgtcaaggaactggtatgaaggtcacaatcaggcaccttggcccctctatgattcaacagatgcagcacgcttgcaatgagtgcaaaggtactggagagaccatcagtgacaaagaccgatgcacgcagtgcaaaggagaaaaggttgttcaagagaagaaggtgttggaagtcattgtggagaagggtatgcaaagtggacagaagatctcattccctggtgaagcagatgaagctcctgagacagtcactggtgatatagtgtttatcattcatcaaaaagaacatccaaagttcaagagaaagggtgaggacctttttgtggagcactctctgtccctcaccgaggctctctgtggcttccagttcgttttgacccatttggatggcaggcagctgcttatcaaatcaaaccctggtgaagttgtcaagcctgattcgtttaaggcgatcaatgatgaagggatgcccctctaccaaaggccattcatgaaggggaagctgtacattcatttcaatgtggacttcccagagtctctgaacccagagcaggtcaaggctttggaagctattcttccatcaaagccaggagcatctcagcttacagatatggaggtggatgagtgtgaggagacaactctgcatgatgtgaacatggaggaggagatgaggaggaagcagcaggctcaggcggaggcttatgacgaggacgatgacatgcctggtggtgctcagagggtgcagtgcgcacagcagtgatgatagtttctagaacctgtagaagttttctgaagtgatgggggctgaagaacaactgatgactga

SEQ ID NO: 8125 - DNA, 1647 bp, Cucumis melo
gaaaaagtgtaaagaaatttgcatttcgtgcccagaaccttcgtatcatttctcaaactttgattccacgaaattggggttgcccagtttcgatcggatttcaattgggttttccatcgatttgaagaataaagatttcaattgtctcaaccggaagcgaagatgtttggaagagctccgaagaagagcgacaacacgcggtactatgagatccttggagtctccaagaacgcgtcgcaggatgatttgaagaaggcttacaaaaaggctgctatcaagaatcatcctgataagggtggtgatccggagaagtttaaagaattggctcaggcttatgaggttcttagcgatcctgagaagcgcgagatctatgatcagtatggtgaggacgcacttaaagaaggaatgggtggtggaggtggtcatgaccccttcgatatcttccaatccttctttggtggaagtccatttggaggtggtagcagtagaggccgacgacagagaaggggagaagatgtggtacatccccttaaggtctcacttgaggatctttaccttggaacttccaagaaactttctctgtcacggaatgtgatctgctcgaaatgcaatggtaaaggatcaaaatcaggcgcttcaatgagctgctctggctgtcaaggaactggaatgaaggtcacaattaggcaccttggtccgtcgatgatccagcagatgcagcacccttgtaatgaatgcaagggcactggagaaacaatcagtgacaaggaccggtgttctcaatgcaagggtgagaaagttgttcaagagaagaaggttctggaagttattgtggagaagggtatgcagaatggacagaaaattacattcccaggagaagcagatgaagctcctgatactgtcactggagatatagtttttgtccttcagcagaaggagcatccaaaattcaagagaaagggtgaagacttattcgtggagcacactttgtcactcactgaagctctctgtggcttccagtttgttctcactcacttggatggcagacagcttctcatcaaaacaaatcctggggaagttgtaaagcctgattcattcaaggccattaacgacgaggggatgccagtgtaccagagaccattcatgaaagggaagctctacatccatttcagtgtggacttccctgattccctaagcccagagcagatcaaagctctggaaactgtcttaccatcaaaaccatcatcccaactgacagacatggagctcgacgagtgtgaggagacatcaatgcatgatgtcaacatcgaagaggagatgcggaggaagcagcaagctgaggcatatgaagaagatgaagatatgcacggtggggcgcagagagtgcagtgtgcccagcagtaatcctcgttgagctgaaattaactgaaatgagtagtcaatatgttaggtttgtttgtttggggattagtggttgatgaactgcgtatcttgttaatgtggccgtttttgatgggtggcatttggaattttttatattccgataggccgttaccaactgatacaatatataaaatcaatctggttctgatctgtgagcactgctattttattatgaagttccaaaatccaagctgatggttgttt

SEQ ID NO: 8126 - DNA, 1664 bp, Arachis hypogaea
gggggggtgtttcgcttcgcttatacctcctctgaaagaaagagatctggagtcttcatgttctcgcgccagttggttacatacaccacgccaaccttattttggggggaaatataattagggtttcgtttcttcgatcgatcaatcgatcggaatcggtttctgttgaattgtgatctgaatttgattgtgttgtgagattgtgaagatgtttgggagggcgccaaagaagagcgataacaccaagtactatgagatcctcggagtatcgaaggaggcttcgcaggacgatttgaagaaggcttacaagaaagccgccatcaagaatcatcctgacaaaggaggtgatcctgagaagtttaaagagctggcacatgcttatgaggtgctgagtgacccggagaagcgtgagatttatgatcaatatggtgaagacgcacttaaggaaggaatgggtggcggtggtggtggccatgatccatttgatatcttccagtctttcttcgggggaagtccatttggctccggtggtggcggcagtagaggccggaggcagagacgtggcgaagatgtggttcaccccctgaaggtctctttggaggacctttaccttgggacttcaaagaagctttctctttcacggaatgtcttgtgttctaaatgcaacgggaaagggtcgaaatctggagcttcaatgacatgtgctggctgtcaaggtactggtatgaaggtttccattaggcaccttggtccctctatgattcagcaaatgcagcatccttgcaatgaatgcaagggtactggagaaacaatcaatgagaaagaccggtgcccacaatgcaagggcgagaaagtcgtccaagagaagaaagtgctcgaggtccatgtggagaagggaatgcagaacgggcagaagattacattccctggtgaagctgatgaagcacccgatacagtcactggagatattgtctttgtccttcaacagaaggaacatcccaagttcaagagaagggatgaagacctctttgttgagcactcgctgtccctgactgaggctttgtgtggctttaagtttgtgctcactcacttggatgggcggcaacttctcatcaagtcaaatcctggtgaagttattaagcctgattcttacaaggcaataaacgatgagggaatgccaatgtaccagaggcccttcatgaaggggaagctttacattcacttctcggtagaatttcctgaatctctgatccctgatcaggtgaaagctttggaagctgttctgccaccaaaacctacttcacagttgactgacatggagctggacgagtgcgaggagaccacactgcacgatgtgaacatggaggaagagatgaggaggaggcaacaggctcagcaggaggcatacgacgaggacgatgatatgcacggtggtcatcagagagtacagtgcgctcagcagtgatgatcttcatacagaacaagtgttgatcttcagtcaattcatatgttatttttagccgtgtgctgcggactaaattagtgtttgattaaatctgatttttggataaaaaacaaacagagtagcatttattgtccaagggtaattccgttcggacatcctaatatcatcaattttgttcaattttactctcttcttccta

SEQ ID NO: 8127 - DNA, 1512 bp, Helianthus annuus
tcttttcacccaaacaacaaccaagtcaagtcttccccctcgcgatctacttcttcgtcgatcgaagaagaaggaatacaggatgtttggaagagcaccgaagaagagcgataacaccaagtattacgagatcctcggggttccgaaaaccgcttctcaggatgatctgaaaaaggcgtatcggaaagctgctattaagaatcatcctgataaaggtggagatcctgagaagtttaaagagcttgcccaagcatatgaggtactgagtgacccagagaagcgtgagatatacgatcagtacggtgaggatgccttgaaggaaggaatgggcggtggaggcggtggtcatgacccctttgacatcttccagtctttctttggtggtggtagtccgtttggtggtggtggtggcggtagcagcaggggacgaagacaacgaaggggagaagacgttgttcatcctctcaaagtctctcttgaggatctctataacggaacttccaagaagctctctctttcacgcaatgtaatctgctctaagtgtaaaggcaagggttcaaagtccggtgcttcaatgaaatgtgctggctgtcaaggttccggaatgaaggtttccatcagacatcttggaccatctatgatccagcaaatgcaacatccttgtaacgaatgcaagggtaccggtgaaactatcaacgacaaggatcgatgcacacagtgcaagggtgagaaagttgtgcaggagaagaaggtactcgaagtacacgtcgagaagggcatgcagaacggacagaagattacgttccccggagaggctgatgaagctcctgacacggttactggtgatattgtgtttgtgttgcaacaaaaggagcaccctaagtttaagcgaaagggtgatgacatatttgtcgagcacacgttgagtttgacagaggccctatgtgggttccagtttatcttaacccatttggataaccgacagcttctcatcaaatctcaacccggagaggttgtcaagccagattcattcaaggcgataaacgatgaaggaatgccgatgtaccagaggccgtttatgaaggggaagctgtacatccacttcacagtggaattcccggagtcattgtcgcctgagcagtgcaaggcgttggaggcggtgctgccaccaaagccttcaatgcagatgacagacatggagctcgacgaatgtgaggagacgactctgcatgacgtcaatatcgaagaggagatgagaaggaagcaacaagcggctcaagaagcttatgatgaagacgatgaagacatgcatggaggagcccagagggtacaatgtgcacaacagtaattgaatcatggttaactggttaaggattggtttgattttgtctgggcattatgttagacaataatgtcaagtgtaatacctataatgttaaatttgtctgttttgagaacctttgtgtatggatgatccactaattttcagaacgttgtttgagaaactcaaaa

SEQ ID NO: 8128 - DNA, 1498 bp, Fraxinus spp
ggtgattttggtagtagttcaagatgtttgggagggcaccgaagaagagtgataacactaagtattatgagattcttggagtgtctaaaacagcgtcaccggatgatttgaagaaggcgtacaagaaagctgccatcaagaatcatccagataagggtggagatcctgagaagtttaaggagcttgctcatgcttacgaggttcttagtgatcctgaaaaacgtgagatatatgaccagtatggtgaagatgcactcaaggagggatgggtgggggcggtggcatgcacgatccattcgacattttctcatccttctttggtggaagtccatttggaggtggtggtggtagcagcagaggaaggaggcagaggagaggagaggatgtagtccatccactgaaggtctcgctcgaggatctgtaccttggtaccacaaagaagctttctttatcacgcaatgcactgtgttcgaagtgtaatggcaaaggatcaaaatctggagcttcaatgaagtgctcagggtgtcaaggaaaagggatgaaggttacaataagacagcttggccccggtatgattcagcaaatgcaacacccatgcaacgaatgtaaaggaactggagagactattagcgataaagatcgatgtctcaatgcaaaggtgaaaaagttgttcaggagaagaaagttctggaagttcatgtagaaaagggtatgcaaaatggtcagaagattacattccccggagaagctgatgaagcgcctgatacaatcactggggacatagttttttgtccttcagcagaaggaacaccctaaattcaagagaaaaggtgtaagacctttttgtggagcatactttgtcgctcactgaagctttatgcggctttcggtttatattgtctcacctcgatggcagacagctcctaattaaatcacaacctggggaagttgtgaagcctgattctttcaaggcaatcaatgatgaaggaatgccattgtatcaaagaccattcatgaagggtaaactgtacattcatttcactgtggatttcccagattctttaagtcccgatcaagtcaaggccttggaggaaattcttcctccaaagcctcagtcacaagtaacggacatggaactggacgagtgtgaggagacgactctacatgatgttaacattgaggaggagatgaggaggaagcaggctcagcatcaagaggcgtatgatgaggatgaggacatgcatggtggagcccagagggtgcaatgtgctcaacagtgataaaacaattttgaagtcctaaatttcattgttatcttgctatgaagagagagatgctgatttcttttatggaacgtgatctagtttttctgttgattttatgtccgttcttgtcaatttgcttgtgattttgtttgccaatgagaaaatataagggaactcagttgtcattgggtaatttctgagccataaattccagttggattaaagggtcagca

SEQ ID NO: 8129 - DNA, 1556 bp, Citrus clementina
accaggttatattccttggcttttgggggctctcctgtagcgttctccgcgagaaaaataattttctgggtctgtttcgtttctgtggattcctgttaagaaactcaaaacaagatgtttggaagagcaccgaagaagagcaataatacgaggtactatgagatcctgggggtgtccaagaacgcttccgctgaggacttgaagaaggcttataaaaaagctgccatcaagaatcatcccgacaagggcggcgatcctgagaagtttaaagagttggctcaggcttacgaggttctgagtgatcctgagaagcgtgagatatatgatcagtacggtgaggatgcactcaaggaaggaatgggtggtggcgctggcgcccatgacccgtttgatatcttttcgtctttctttggcggcagcccattcggaggtggtagcagcaggggacggagacagaggcggggcgaggacgtggttcatcctttgaaggtgtccttggaggatctttatctgggtacctcgaagaagctctcactttcgcggaatgtgatatgctcgaagtgcagtggcaaagggtcaaaatctggcgcttcgatgaagtgttctggttgccaaggtactggtatgaaggtctcgataaggcacctaggaccctctatgattcagcagatgcagcatccttgcaatgaatgcaagggtaccggtgagaccatcaacgataaagatcgctgccctcagtgcaagggagagaaggttgttcaggagaaaaaggtgcttgaggtcattgttgagaagggcatgcaaaatgggcagaagattaccttccctggtgaagcagatgaagcgccagatacagtcactggagacatagtatttgtacttcagcagaaggaacatccaaagttcaagagaaagggagaagatctcttttatgagcatactttgtcgctaactgaggccctctgcggtttccagtttgcactgactcatctggatgggaggcaacttctgattaaatcgaatcctggggaagttgttaagcctgattcatacaaggctatcaatgaggagggtatgcccttgtaccagaggccgttcatgaaggggaaactgtacattcacttcacagtcgaattccctgattctctgaccccagatcaggttaaggccctagaggccatcctcccatcgaggccattgtctgggatgactgacatggagctagatgaatgtgaagagactacattgcatgatgtcaacattgaggaggagatgcggaggaagcaggctcatgctcaagaggcatatgaggaggacgaagatatgcctggtggtgcccagagagtgcagtgtgcccaacagtgatgatggcgaagaacaatcattgaaagtggttttaagttgttgtacgcatactaaaatgaagctaattttcagtactaaggaaagataatttgaatagcatatttgtctgatgctcaaagctgtggacgctttgatgtttacagtgttttttgtttactagatttttttaaagcaatgaaatgccttctttt

SEQ ID NO: 8130 - DNA, 1650 bp, Tabernaemontana elegans
ttgatgtatctcgagtttccttatacttcataaaagcccataccacccgttctaggaagcgtctctccttttgtgctctctgggaagaaacctgaagaagaaagaatagattcttcttgttggttttggaagagctttgaattggggaaagtgtaaaggaagaagggaaaggaaagatgtttggaagggcacctaagaagagtgataacacgaggtactatgagattttaggggtgcccaagaatgcttctcctgaagatctcaagaaggcttacaagaaagcggccatcaagaatcatcctgataagggtggtgatcctgagaagtttaaggagctggctcaggcttatgatgtcttgagtgatccagagaaacgagagatttatgatcaatatggtgaagatgcactcaaggaaggaatgggtggtggtggtggcatgcacgacccgtttgacatcttccagtctttctttgggggaaacccatttggaggtggtggcagtaggggtcgaaggcagaggaggggagaggatgtggttcatccgttgaaggtttctttagaagacctgttcggtgggacaaccaagaaactctcactgtctcgaaatgttatttgttccaaatgtagtggcaagggctcaaagtctggagcttcaatgaagtgttctggttgtcaaggaactggtatgaaagtgactattagacaacttggccctggtatgatccagcagatgcagcacccttgtaatgagtgcaaaggaactggagagacaatcagtgacagggaccgctgtactcagtgtaagggcgagaaggttgttccagagaagaaagtcctggaagtagttgttgaaaagggtatgcataatgggcagaagatcactttccctggagaggctgatgaagcgcctgacactgtcacaggtgatattgtttttgtcctccaacagaaagaacatcccaagtttaagagaaagcatgatgatcttttcgtggagcatactctttcactcactgaggctttgtgtggcttccagttcattttgacacacttggatggcagacagctacttattaaatcaaaacctggagaagttatcaagcctgaccaattcaaggcaattgatgatgaaggaatgccaatgtatcagcgcccattcatgcggggtaaactgtacattcactttaccgtggaattccccgagtccttgagcccggagcaggtgaaggctttggaggaaatccttccaccaaggccacaatcacagctgacagacatggaactggatgagtgtgaagagaccacattgcatgacgttaacattgaggaagagatgaggaggaagcatgctcaggctcagcaggaggcatatgatgaggatgatgacatgcatggtggagctcaaagggtacaatgtgctcaacagtaacaaagattttggtgaaaggaagatgattggttgtgttgggattgtcgagaaaatattattagatgaaccattttattgtaagcatcgtatgctgcttttatggtggctttggtctgagtatgtgagtggcagactcgtgtgctccaggactgggatgctgcttcaatttttatataattggtcctaacttgaaaaattctgcgaggtgattaatcctcta

SEQ ID NO: 8131 - DNA, 1417 bp, Vinca minor
tttttagggaaaaagagtgttaagggaattaattaattaaggaaagatgtttgggagggcacctaagaagagtgataacaccaagtattatgagatattgggggtgcccaaaactgctagtcaagaagatctgaagaaggcttacaagaaagctgctatcaagaatcatcctgataagggtggtgatcctgagaagtttaaggagctagctcatgcttatgaggtcttgagtgatccagagaaacgtgagatttatgatcaatatggtgaagatgcactcaaggaaggaatgggcagtggaggcggaatgcatgatccattcgacatcttccaatccttctttggaggaagcgggtttggaggtggtagcagtaggggtcgaaggcagaggcgtggggaggatgtagttcatgcattgaaggtctccttagaagacctgttcaatgggacgacgaagaagctatcactctctcggaatgttatctgttccaaatgtagtggcaaggggtcgaagtctggagcttcacacaagtgttctggttgccaaggtactggtatgaaagtcaccattagacaacttggccctggtatgattcagcagatgcagcacccttgcaacgactgcaaaggaacgggtgagatgatcagcgacagggatcgctgtcctcaatgtaaaggtgagaagtttgttccagagaaaaaagttttggaagttgtcgtcgaaaagggaatgcataatagccagaagatcactttccctggagaggctgatgaagcgccggacactgtcacgggggatattgtttttgtcctccaacagaaagagcatcccaagtttaagagaaagcacgacgaccttttcgtggagcataccctctccctgaccgaggccttgtgtggcttccagttcattttgacacacttggatggcagacagctacttattaaatctaaacctggagaagtgatcaagcccgaccaatacaaggcaattgatgacgaaggaatgccgatgtatcagcgtcctttcatgcgtggtaaactgtatatccacttcacggtggaattcccagactctttgagccccgaccaggtgaaggctttggaggtaatccttccgacaagggcacagtcacagctggcggacatggaactggatgagtgtgaagagacgacattgcatgatgtgaacatcgaagaggagatgaggaggaagcaagcccaggctcagcaggaggcttacgatgacgacgaagacatgcatggtggagctcaaagagtacaatgtgctcaacagtgatgaaataattttacaaaaatgaagataatttgtttgtgctagggatgatgatgaagaagaatttctgggtttaagcattgtatggggaaaatagcctatttggtccttttcgttttt

SEQ ID NO: 8132 - DNA, 1619 bp, Citrus sinensis
ccaggttatattccttggcttttgggggctctcctgtagcgttctccgcgagaaaaagaattttctgggtctgtttcgtttctgtggattcctgttaagaaactcaaaacaagatgtttggaagagcaccgaagaagagcaataatacgaggtactatgagatcctgggggtgtccaagaacgcttccgctgaggacttgaagaaggcttataaaaaagctgccatcaagaatcatcccgacaagggcggcgatcctgagaagtttaaagagttggctcaggcttatgaggttctgagtgatcctgagaagcgtgagatatatgatcagtacggtgaggatgcactcaaggaaggaatgggtggtggcgctggcgcccatgacccgtttgatatcttttcgtctttctttggcggcagcccattcggaggtggtagcagcaggggacggagacagaggcggggcgaggacgtggttcatcctttgaaggtgtccttggaggatctttatctgggtacctcgaagaagctctcactttcgcggaatgtgatatgctcgaagtgcagtggtaaagggtcaaaatctggcgcttcgatgaagtgttctggttgccaaggtactggtatgaaggtctcgataaggcacctaggaccctctatgattcagcagatgcagcatccttgcaatgaatgcaagggtaccggtgagaccatcaacgataaagatcgctgccctcagtgcaagggagagaaggttgttcaggagaaaaaggtgcttgaggtcattgttgagaagggcatgcaaaatgggcagaagattaccttccctggtgaagcagatgaagcgccggatacagtcactggagacatagtatttgtacttcagcagaaggaacatccaaagttcaagagaaagggagaagatctcttttatgagcatactttgtcgctaactgaggccctctgcggtttccagtttgcactgactcatctggatgggaggcaacttctgattaaatcgaatcctggggaagttgttaagcctgattcatacaaggctatcaatgaggagggtatgcccttgtaccagaggccgttcatgaaggggaaactgtacattcacttcacagtcgaattccctgattctctgaccccagatcaggttaaggccctagaggccatcctcccatcgaggccattgtctgggatgactgacatggagctagatgaatgtgaagagactacattgcatgatgtcaacattgaggaggagatgcggaggaagcaggctcatgctcaagaggcatatgaggaggacgaagatatgcctggtggtgcccagagagtgcagtgtgcccaacagtgatgatggcgaagaacaatcattgaaagtggtttaagttggtggtttaagttgttgtacgcttactaaaatgaagctaattttcagtactatttactaaggaaagataatttgaatagcatatgtgtctgatgctcaaagctgtggacgctttgatgtttacagtgttttttgtttactagatttttttaaagcaatgaaatgccttcttttaaactgcacaatttatggtagagctttatatatgacgatttaatt

SEQ ID NO: 8133 - DNA, 1492 bp, Cucumis sativus
atgttcgggagagctccgaagaagagcgacagcacgcggtactatgagatccttggagtctccaagaacgcgtcgcaggatgatttgaagaaggcttacaaaaaggctgctatcaagaatcatcctgacaagggtggtgatccggagaagtttaaagaattggctcaggcttatgaggttcttagcgatcctgagaagcgcgagatctacgatcagtatggtgaggacgcacttaaggaaggaatgggtggtggaggtggtcatgaccccttcgatattttccaatccttctttggtggaagtccctttggaggtggtagcagtagaggccgacgacagagaaggggagaagatgtggtacatccccttaaggtctcacttgaggatctttaccttggaacttccaagaaactttctctgtcgcgtaatgtaatctgctcgaaatgcaatggtaaaggatcaaagtcaggtgcttcaatgagctgctctggctgccaaggaactggaatgaaggtcacaattaggcacctaggtccatcgatgatccagcagatgcagcacccttgcaatgaatgcaagggcactggagaaacaatcagtgacaaggaccggtgttctcaatgcaagggtgagaaagttgttcaagagaagaaggttctggaagttattgtggagaagggtatgcagaatggacagaaaattacattcccaggagaagcagatgaagctcctgatactgtcactggagatatagtttttgtccttcagcagaaggagcatccaaaattcaagagaaagggtgaagacttattcgtggagcacactttgtcactcactgaagctctctgtggcttccagtttgctctcactcacctggatggcagacagcttctcatcaaaacaaatcctggagaagttgtaaagcctgattcgttcaaggccattaacgacgagggaatgccagtgtaccagagaccattcatgaaagggaagctctacatccatttcagtgtggacttccctgattccctaagcccagagcagatcaaagctctggaagctgtcttaccatcaaaaccgtcatcccaactgaccgacatggagcttgacgagtgcgaggagacatcaatgcatgatgtcaacattgaagaggagatgcggcggaagcaacaagctgaggcatatgaggaagatgaagacatgcacggtggggcgcagagagtgcagtgtgcccagcagtgatcctcaatgagctggaattaaccagaagtgagtatagtcaatatgttgttaggtttgtttgtttggggattagtggttgatgaactgcgaatcttgttaatgtggccgtttttgatgggtggcatttggaattattcatattccgatgggccgttacctactgatacaatatataaaatcaatctcgttctgatctgtgagcactgctattttattatgaagttctaaaatccagctgacggttgtctcg

SEQ ID NO: 8134 - DNA, 1534 bp, Capsicum annuum
gacaaagccaacaaacctctcttcttctcgccgctcaccgctcgccgcactttatcatcgttcagttttgactaaactaagcgatcaaagatgtttgggagggcaccgaagaagagcgacaacactaagtactatgagatcttaggtgttcctaagactgctgcaccggaagatctcaagaaagcttaccgtaaagctgctattaagaatcatcctgataagggaggtgatcctgaaaagtttaaagagcttgcacaagcttatgaggttttgagtgatcccgagaagcgtgagatatatgatcagtatggtgaagatgctctcaaggaaggaatgggcggtggaggtggtggacacgacccatttgatatcttctcatctttctttggtggcagcccatttggcggaggtggtggaagcagcagaggaagaagacaaagaagaggagaggatgttgtccaccctctcaaggtttctctggaggatctgtacaatggaacctcaaagaaactgtcactatctcgcaatgttttgtgcccaaagtgcaaagggaaaggatctaaatcaggtgcttcaatgaaatgttctggctgtcaaggatctgggatgaaagtcactatcagacaacttggcccatccatgatccagcagatgcagcacccttgcaatgagtgtaagggtactggtgagatgatcaatgataaagatagatgtgggcagtgtaaaggtgagaaggtcgtacaggagaagaaggtgttggaagttgttgtggagaagggtatgcagaacggacaaaagataacatttccgggcgaggctgatgaagcacctgatacagtcactggggacatagtttttgtcttgcaacagaaggagcatcccaagtttaagcgcaagggtgatgatctctttgtagagcacaccttgagcttgaccgaggccctatgcggtttccagtttatcttgactcatctggacaacagacagctgatcatcaagtcccaacccggagaagttgtcaagcctgatcaatttaaggccataaatgatgaaggaatgcctatgtacggaaggccatttatgagaggaaaattatacattcactttactgtagaattccccgacacattatcccccgatcagtgcaagaacctcgaagcagtgctgccagcaaaacccaaaacacaaatgactgacatggaattggatgagtgcgaggagaccaccttacatgatgtcaacatcgaagaggagatgcgtaggaagcagcaacaggcacaagaggcatacgatgaagatgatgaagacatgcatggtggtgcgcagagagtccaatgtgcacaacagtaatttggtagcgattcaaacgttggtttcaagtatctgtatgttaggataatgacgacgttgtctgaaatattgcttttgtagtaagatatactatagcttattaacttatgatttggaattttgcatttgcctaactgatgctgcttagcaaattttaatgttccacattttgcccgggctgctg

SEQ ID NO: 8135 - DNA, 1624 bp, Solanum phureja
aagaccaaagaagtctttatccttgagtcttctatatattccctaatttccaccaacaaatctggaccgttcaattttctacctctcaataaaaccacagatctcatactcaaagcaaaccctctctctctctttcctccatactcaaacaacgccaacaaactcttcttctcgccgcgctttatcatcgttcaattttgactaaattaagcgatagaagatgtttgggagggcaccgaagaagagcgacaacacgaagtactatgagatcttaggtgtccctaagactgctgcaccggaagatctcaagaaagcttaccgtaaagctgctattaagaaccatcctgataagggaggtgatcctgaaaagtttaaagagcttgcacaagcttatgaggttctgagtgatcccgagaagcgtgagatatatgatcagtatggagaagatgctctcaaggaaggaatgggcggtggaggtggtggacacgacccatttgacattttctcatctttctttggtggcagcccatttggtggaggtggtggaagcagcagaggaagaagacaaagaagaggagaggatgttgtacaccctctcaaagtttctctggaggatctgtacaatggaacatcaaagaagctgtcactatctcgcaatgtattgtgctcgaagtgcaaggggaaaggatctaaatcaggtgcttcaatgaagtgttctggctgtcaagggtctgggatgaaagtcactattagacaacttggcccatccatgatccagcagatgcagcacccttgcaacgagtgtaagggtactggtgagatgatcaatgataaagataggtgtgggcagtgtaaaggtgagaaggttgtgcaggagaagaaggtgttggaagttgttgtcgagaagggtatgcagaacggacagaagataacattcccgggcgaagctgatgaagcacctgataccgtcactggggacatagtttttgtcttgcaacagaaggaacatcccaagtttaagcgaaagggagatgatctctttgtagagcacaccttgagcttaaccgaggccctatgtggtttccagttcatcttgactcacctagataataggcagctgatcatcaaaccccaacccggagaagttgtcaagcctgatcaatttaaagccataaatgatgaaggaatgcctatgtaccaaagaccatttatgagaggaaaactatacattcactttactgtagaattccccgacacattatcccccgagcaatgcaagaaccttgaagcagtattgccaccaaaaccgaaaacacaaatgactgatatggaattggacgagtgcgaggagaccaccttacatgatgttaacatcgaagaggagatgcggaggaagcagcaacaggcccaagaggcatatgacgaagatgatgaagacatgcatggaggtgcacagagagttcaatgtgcacaacagtaatttggtaacacggaagttgcactaaagaattaacgtcacgattcaactcttgttttcacgtatttgtatgacaagataatgacattgtctgaagaaatatttcctctgccgtaagatatattatagtttactagcttataattt

SEQ ID NO: 8136 - DNA, 1561 bp, Glycine max
gtgaatcagaatcacctggcttggcctagcgcttattctctcgcattccgtggagatctagtgcttctgctgcaagacctcgctgaaaattagggtttcgattcggaggtagacgaagatgttcggaagggctccgaagaaaagcgacagcaccaggtactacgaaatcctcggcgtttccaagaacgcttcgccggatgacttaaagaaggcttacaagaaagccgccattaagaaccatcctgacaaaggcggggatcccgagaagtttaaagagcttgctcaagcctatgaggttctgagtgaccctgagaagcgcgagatttatgatacatatggagaagatgctcttaaggaaggaatgggtggtggtggcggtggccatgatccatttgatatcttcagttcattctttggtggaagtccgtttgggtcaggtggtagcagtagaggacggaggcagaggcggggagaagatgtggttcatcccctgaaggtctctctggaggatctttacctcggaacttcaaagaaactctctctttcacgaaacgtgttgtgctcaaaatgcaatgggaagggctcaaagtctggggcttcaatgacctgtgctggttgccagggtactggcatgaaggtgtctattaggcaccttggtccttctatgattcagcaaatgcagcatccttgcaatgagtgtaagggtactggagagacaatcaatgacagagacaggtgccaacagtgcaagggagagaaggttgttcaggagaagaaagtacttgaagttgttgtggagaagggaatgcagaatggacagaagattacattccctggtgaagctgatgaagcgcctgatacagtcacaggggatattgtctttgtcctacaacagaaggaacacccaaagttcaaacgaaaggcagatgacctttttgtagaacacacattgtctcttactgaggctctatgtggcttccagtttgtgctgactcacctggatagcaggcagcttctgatcaaatcaaaccctggggaggttgttaagcctgagtcattcaaggcaataaatgatgagggaatgccaaactaccagaggcacttcctgaagggaaagctttacattcatttctcagtggaatttcctgataccctgagtcttgatcaggtgaaggctttggaggctgttctgccatcaaagccaacatcacagttgtcagacatggagctggatgagtgtgaggagaccacactccatgatgtgaacatggaggaagagacaaggaggaggcaacaagctcagcaggaggcatatgatgaggatgaggatatgcatggtggtgctcagagagtgcagtgcgctcagcagtaatgagccacaggagcgctagagtagacatgtgatgatctcgatcatcttattttttagccgtttgtgcgggtctaaacatatttagtgtttgatatctcagacgattttagcaaccaaacactgtagcattattgtccaagaaattatttcacaagacatcctaatacaattttttttccttctgatggc

SEQ ID NO: 8137 - DNA, 1573 bp, Lactuca sativa
cggggattcacctcctcatatatcacaccttctaccccaaaattccaaacccctctttctctctttcgccgtacacacccgactcaagtcttcacgatttcgatctcttttccgatctgcttattggcagatttgtaattagatatcgaaggtcgaagaaacaggatgtttggaagacagccgaagaagagcgataatacgaagtactatgagatcctgggtgttcccaaaagtgcttcccaggatgatctcaagaaggcttatcggaaagccgccattaagaatcaccctgacaagggtggagatcctgaaaagtttaaagagcttgctcaagcatatgaggtattgagtgaccccgagaagcgtgagatatatgaccagtatggtgaggatgccttgaaagaaggaatgggtggcggaggcggtggtcatgacccatttgacatcttccaatccttctttggtggtggtaatccctttggtggtgctggtggtagcagcagggggcgaagacagcgtaggggtgaagatgtcattcaccctcttaaagtttcccttgaggatctctacaatggaacatccaaaaaactctctctttcacgtaatgtactctgctccaagtgtaagggaaagggttcaaaatcaggtgcttcaatgaagtgtgcaggctgtcaaggttcaggaatgaaagtctcaatcagacatcttggcccatctatgatccaacaaatgcagcatccttgtaacgagtgcaagggcactggtgaaaccattaatgataaagatcgctgcccacagtgcaagggtgagaaagttgttcaagaaaagaaggttctagaagtccacgtcgagaagggcatgcagaattcccagaagattaccttccctggtgaagcagatgaagctcctgacacggttacaggtgatattgtgtttgtgttgcaacaaaaggagcaccctaaatttaagcgaaagggtgatgacttgtttgttgagcacacattgagtttaaccgaggctctgtgtgggttccagttcatattaactcatttggatagcagacagcttctcatcaaatcggaacctggggaggttgttaagcctgatcaattcaaggcgataaatgacgagggtatgccaatgtatcagaggccattcatgaaggggaagctgtacatccactttactgtggagttcccggaatctttgtcacctgagcagtgtaaggcgttggagggggtgctgccacctaagccttccatgcagatgacagatatggagttggatgaatgtgaggagacaactctgcatgatgtcaacattgaagaggagatgagaaggaaacagcagcaacaagctcaagaagcttatgatgaagatgatgagatgcctggtggtgcacagagggtgcaatgtgcacagcaatgatttgagttttgaggcatatggagtacggtggtttggttatctattatgattatgatgataggttttggcaagacaataatgtcaggctgtgattttctttctttatactgtctgtctgtctgtttgtattgagactttttgagat

SEQ ID NO: 8138 - DNA, 1688 bp, Euonymus alatus
ggaagcgcatctccaccctccattgtcgaatccctaccctcacatattggcatttataaaagccaaggaacaagaaaggattcccactgtctcagattgtccgttgtcgtgtccagattccagagcattcgaaagcaaaaagcaagaacagaatttctgatcggcgaaaatgttcggcagggctccgaagaagagcgataacaccaggtattacgaggtattgggcgttccgaagaacgccggtcaggatgatttgaagaaggcctacaagaaagccgcgatcaagaaccatcctgataaaggaggcgatcctgaaaagttcaaagagcttgcccacgcttatgaggttctgagtgatcctgagaagcgtgagatatatgatcagtatggggaggacgcactcaaggaaggaatggggggtggtggtggtggccatgacccatttgacatcttttcatctttctttggtgggtctccatttggtggcggcagtagcaggggacgaaggcagagacggggtgaggatgtggttcatccactgaaggtttctttggaggacctctacctagggacatcaaagaagctctctctttctcggaatgtgatatgttcaaagtgcaatggcaagggttcaaagtctggagcttcaatgacgtgtgctggttgccaaggtactggcatgaaagtgtcaataaggcaccttggtccttcaatgattcagcagatgcagcatccctgcaatgaatgcaagggaactggtgaaactattagtgacaaggatcgctgcccacagtgcaagggagagaaggttgttcaggagaagaaggtgctggaagtgattgtggagaagggcatgcagaatgcacagaagattactttccccggtgaagcagatgaagctccagatacggtcactggagatattgtctttgtccttcagcaaaaggaacaccctcgtttcaagagaaagggcgatgacctttttgtggagcacacactttcccttactgaggccctctgcggttttcagtttgtcttaacccacttggacggcagacagctcctcattaaatcaaatccgggggaagttgttaagcctgattctttcaaggcaatcaatgatgagggtatgcccgtgtatcagaggccatttatgaaggggaagctgtatatccacttcactgtggacttccctgattctgttgcccctgatcaggcgaaggcacttgaggctattctgccttcaaggccaacaagccagttgactgatatggagctagacgagtgtgaggaaactactctacatgatgttaacattgaagaagagatgcggaggaagcagcatgctgctcaacaggaggcgtatgatgaggatgaagagatgcctggtggggctcagagggtccaatgtgcccaacagtgatcaaatacagattacaaagaaggaaaaaaaaaaggaagaatgttgatttcttttgtgatgttttgtaattgagtgtactggtactagaactagaactagaacttgaacttgcgctgatgatggaattttgaatgtgggcttagaatatttatgatcacttttcttcaacctgatcatgtgatggaacttgtcgatccaggcatattcattcttccttcatcttggtcaagtagaggtctagaagctaatgtagactggataatta

SEQ ID NO: 8139 - DNA, 1509 bp, Flaveria ramosissima
ctcgaccgtccgatttaccccactcaataatattacacctctcgcccccaaattccaaaccctctctttcgcccaacacaactcaaaaagtcttccgatagcgatctacttcttcgcagatctgtaattgagtattgaagatcgaagaaggagaacaggatgtttggaagagcaccgaagaagagcgataacacgaagtattatgagatccttggggtcccgaagaacgcttcacaggatgatctgaagaaggcgtataggaaagcagctattaagaaccatcctgacaaaggtggagatcctgagaagtttaaagagctcgcccaagcatatgaggttctcagtgacccagaaaagcgtgagatatatgatcaatatggtgaggatgccttgaaggaaggaatgggtggtggaggtggtggtcatgacccctttgacatctttcaatccttctttggtggtagtccttttggtggcggtggcggtagcagtaggggacgaaggcaacgaaggggagaagatgttgttcatcctctcaaagtttctcttgaggatctctataatggaacttccaaaaaactctctctttcacgcaatgtaatctgctccaagtgtaagggcaagggttcaaagtcaggtgcttcaatgaaatgtgctggttgtcaaggttctggaatgaaagtttctatcagacatcttggcccatctatgatccaacaaatgcagcatccttgtaatgaatgcaagggaactggagaaaccatcaatgataaggatcgatgcacacagtgcaagggtgagaaagttgttcaggagaagaaggtactggaagtgcatgtggagaagggtatgcagaatggacagaagattacattccctggagaggctgatgaagctcctgacaccgttaccggagacattgtgtttgtgttgcaacaaaaggagcaccctaagtttaagcgaaagggtgatgacctatttgtggaacacacattgagtttaaccgaggccctatgtgggttccagtttatcttaacccatttggataacagacagctcctcatcaaatctcaaccaggggaggttgtcaagcctgatcaattcaaggcaataaatgatgaaggaatgccaatgtaccagaggccatttatgaggggtaagctgtacctccacttcaccgtagaattcccagattcattgtcagcagatcagtgcaaggcattggaggcggtgctgccaacgaagccttcaatgcagatgacagacatggaactggatgaatgcgaagagacaactcttcatgatgtcaacatcgaagaggagatgagaaggaagcaacaagcagctcaagaagcttatgatgaagatgaagacatgcacggtggagcacagagggttcaatgtgcccaacagtaacggagtcacggtcgaggtttgctcatatgatagacaataatgtcagttgtgtttttgcttctccttttattttaatatatgatactattaatg

SEQ ID NO: 8140 - DNA, 1606 bp, Prunus persica
ccaaaacttgctcttctctttctctcgccgtttctcttgctcttctctgctcccttcacacgacctcttcaattaatcggatcttgctatccgtacaacacaagatcgattaagttatttaagagagaatgtttgggagagctccaaagaaaagcgataacacgaagtactatgagatccttggagtgtcgaagaccgcttcgcaagatgatctaaagaaggcttacagaaaagccgccatcaaaaaccatcctgataagggcggtgatcctgaaaagtttaaagagttggcccaagcatacgaggttctgagtgacccagagaaacgagagatctatgaccaatatggcgaggacgcgctcaaagaaggaatgggtggcggaggtggtggtcacgacccatttgatattttccaatccttctttggtggaagcccttttggtgggggtggaagcagcagaggccgaaggcagagaaggggagaggatgtgatccatcccctcaaggtttctttggaagatctctacaatgggacatccaagaagctttctctctctcgcaacataatctgctccaagtgcaggggtaaagggtcaaagtcaggtgcttctttgaaatgtcctgggtgccaaggttctggaatgaaagtctctattagacacctcggcccctccatgatccagcaaatgcagcatccttgcaatgagtgcaagggtactggggagaccattaatgacaaggatcgctgcacacaatgtaagggtgagaaggttgttcaggaaaagaaagtcttggaagtcattgtggagaagggtatgcaaaatggtcagaggatcacattccctggcgaagctgatgaagcgccagacaccatcacgggggatattgtttttgtcctacaacaaaaagagcacccaaaatttaagcgaaagggtgatgacctgttctttgagcataccttatccctcgtggaagcactctgtggcttccactttgtattgacacatttagatggaagacagctcctcatcaaatcccaacctggtgaagttgttaagccagatcaattcaaggctataaatgatgagggtatgccaatgtaccagagaccattcatgaaaggtaaattgtatattcatttcacagtggagttccccgactcactaaacccagaacagtgcaagggcctggaggctgtgctacctcccaggtcttctgcacagcttaccgacatggagctggatgagtgcgaggagactacactgcatgatgtgaacatagaggaggaaatgcgtcgaaagcaagcacaggcccaagaggcttatgatgaggatgacgatatgcatggtggtgcccagagggttcaatgcgcgcagcaatgattagataggcttatgagattatttgagaaaataaaagttctcaacattgtggtctgttgtagtttattagtgtttatttctggtttggtttgtgaatccgtgactttcggggatttggaagttaagcaatagctatattaagaacatgcttattctacgtaatgtggatggttacttatatatacataattataattgttgtttgttcctattgctggtaagaa

SEQ ID NO: 8141 - DNA, 1433 bp, Vinca minor
atatttagggaattaataattaaggaaagatgtttgggagggcaccaaagaaaagtgataacagcaagtactatgaaattttaggggtccccaagactgcttctcctgaagatctcaagaaggcttacaagaaagctgccatcaagaatcatcctgataagggcggtgatcctgaaaagtttaaggagctagctcatgcttatgaggtcttgagtgatccagagaagcgtgagatttatgatcaatatggtgaagatgcactcaaggaaggaatgggaagtggaggcggaatgcacgatccattcgacatcttccaatcattctttggaggaagtggatttggaggtggtagcagtaggggtcgaaggcagatgcgcggggaggatgtagttcatccattgaaggtctccttagaagacctgttcaatgggacgactaagaagctgtcgctgtctcggaatgttatctgttccaaatgtagtggcacggggtcaaagtccggagcttcacacaagtgttctggttgccaaggtactggcatgaaggtcaccattaggcaacttggcccaggtatgatccagcagatgcagcacccttgcaacgagtgtaaaggaactggagagacaattagcgacaaggatcgctgtcctcagtgtaaaggagagaaggtcctttcagagaagaaagttttggaagttgttgttgacaagggaatgctaaacagccagaagataactttccctggagaggccgatgaagcgccggacactgttacaggggatatcgtttttgtgctccaacagaaagagcatcccaagtttaagagaaagcatgctgacctcttcgtggagcataccctctccctgactgaggccttgtgtggcttccagttcattttgacacacttggatggcagacagctacttattaaatcaaaacctggagaagtgatcaagcccgaccaatacaaggcaattgacgatgaaggaatgccgatgtatcagcgccccttcatgcgtggtaaactgtatattcacttcacggtggaattcccggactctttgagccccgaccaggtgaaggctttggagggaattcttccagcaagggcacagtcacagctgacggacatggaactcgatgagtgtgaggagacgacgctgcatgatgtgaatatagaagaggagatgaggaggaaacaagctcaggctcagcaggaggcttacgatgacgatgaagacatgcatggtggagctcaaagagtacagtgtgctcaacagtgatggaagaagtatttggaaaaaattaagaagaaattattagatgaagtatttatgtttttttaagcattttgtatgctggttttgtggttttggtggagtatgcaaaggattcagtttgtatacacagttgactccaactgcccagtgaaa

SEQ ID NO: 8142 - DNA, 1975 bp, Gossypium hirsutum
aaaaaacagaggtagagaattctagagccttctttattttctctaaatctcagtcatccattgaacaatctctcttataaattatatcccaaacccaaatcctttccctcaagcaatttgagtgattctttctttttcttgtggtctccagagcttctctgttacatcgtttattttctctcaagaactgaagaaaaaatccgaatagattaaaacttaagaaagatcaaaagatgtttggaagagcacctaagaagagtaataacaccaggtactatgagattctgggtgtttcgaataacgcttcccaggatgatttgaagaaagcttataaaaaagccgccattaaaaaccatccagacaaaggcggtgatcctgaaaaatttaaagagttggcgcaagcttatgaggtattgagcgatcctgagaaacgtgagatatatgatcagtatggtgaggatgcactcaaggaaggaatgggtggtggtgccggtgctcatgacccgtttgacatcttctcctccttctttggtggtagcccgtttggaggtggtagcagtcgaggtagaagacagagaaggggagaggacgtagttcatcctctgaaggtgtcactagaggacctttaccttgggacttcaaagaaactttctctctctcggaatgtgatatgctcgaagtgcaatggcaagggttcaaaatctggagcttcaatgacgtgccctggttgccagggttctgggatgaaggtttcaatcaggcagcttggcccctccatgattcagcaaatgcaacatccttgcaatgagtgtaagggtactggcgagacgatcaacgacaaggaccgctgccctcagtgcaagggtgaaaaggttgttcaagagaagaaagttttggaagtcattgtagagaagggtatgcagaatggacaaaagataacattccctggcgaagctgatgaagcgcctgagactgttactggggatatagtctttgtccttcagcagaaggaccatccgaagttcaagaggaagggagaagacctgtttttggaacatactttgtctcttactgaggcattgtgtggctttcaattcgttattacccatcttgatggtcgacaacttctaatcaagtcgaaccctggggaggttgtgaagcctgattcttgcaaggcaatcaatgatgaggggatgccattataccagaggccattcatgaagggcaaattgtacattcagttcactgttgaattccctgattcccttagccctgatcaggttaaggcacttgaggccatcctgcctccaaaaccaacctctcagttgagtgatatggagctagacgagtgtgaggagaccacgctatatgatgtgaacattgaagaggagatgaggaggaagcagcagcaggcagcgcaggaagcttatgaggaagatgaagatatgcatggcggtgcccagagggtgcagtgtgcccagcaatgatgatgaagcaaaaaagaaaaaagaagttgatatatggtttcaaaagtattctcgaggatatagaaagctggtttctctagtaatgtagagtggcaaagcatatcttgctcaggtggtggatgagcgtgttattattgttagcctgagaagaaccgagtactaagtattttttttatgtctctcttcgcaaaaggtccacatcctgtagtgtttcttgctggtaattggaaagtagttaataagggagataaagttccagcgaagacaatttgctttctttcatacttctcttatcaagaaaggttagaaggtagacaatctgctacaattggatatttacctgaataaaaagaaaaactaattgtctgaaaacagaaaggcttgtggaggcctcaactcacgaaggaaatatatttcacggaaagtatcaattgaagtaaaacagggccaacactgaacctcagtttgtgcaggaaaaagtttgtaat

SEQ ID NO: 8143 - DNA, 2256 bp, Vigna unguiculata
ttttcacaatctgaaccacaaaagtcattttattcataatttgcagtagaattaagaagcatatttatgatttgatttacattcacagagacatatgtgtgatggtctttgtcttgaccacaacatcataattaacacaaagcattgaagtgaaagagcaaagaagagtgattcatgacaatgcaagaaaacacaaagcagattctcttattatttaagcagtaataagataaaaggggatgttgcatgttctaggcatggttgttgttgtcctccactggagggtactttccataaggtggcttcttcttgaagggtggctttttgtatattggcttgtggaaaggttttggcttgtaaatgggatgcttataaattggacgcttgtaaatgggatgtttcttgattggtttgtaataagtagcaaaaccttgaggaatgaggattagggcagcaagaagtaacaccagaaaggttgaaaaggaagccatgtttcttctctagtttgttccgatctagagttttcccttctcgttgttcttcgcttcctcaaactagggtttcaatttcgatccattagaacaagatgtttgggagggcaccaaagaagagcgataacacacggtactacgaaatcctcggcgtctccaaaaacgcttcacaggatgatttgaagaaagcttacaagaaagcagccatcaagaatcaccccgacaagggcggtgatcccgagaagtttaaagaattggctcaagcttatgaggttctgagtgaccctgagaagcgtgagatatatgatcagtatggtgaagatgcgcttaaggaaggaatgggtggtggcggtggccatgatccatttgatatcttttcatctttctttggcggtgggagtccttttggatcaggtggtagtagtcgtggtaggagacagaggcgcggagaagatgtggttcaccctctcaaggtctctctggaggacctttacctagggacttcaaagaagctgtccctctccagaaatgtcatatgctccaagtgcagtggcaagggttctaagtctggggcttcgatgaagtgtgctggttgtcaaggaactggtatgaaggtttctataaggcaccttggtccatccatgattcaacaaatgcagcatgcttgcaatgaatgtaagggtactggagaaactatcaatgatagagatcgctgcccacaatgcaagggagagaaggttgtgcaggagaagaaagttcttgaagtgattgttgaaaagggaatgcagaacgggcagaagattacattccctggtgaagctgatgaagcgccggacacaattactggggatatcgtctttgtgcttcagcagaaggagcatcctaaattcagaagaaaggccgaagacctttttgttgagcacaccttgtcccttactgaggctttgtgtggtttccaatttgtcctaactcacttggatgggcgtcagcttcttattaaatcaaatcccggggaagttgtgaaacctgattcatacaaggctattaatgacgaggggatgcccatgtaccagaggccattcatgaaggggaagctttatcttcacttcactgtggaattcccagattttctaaatcctgatcaggttaaggctttggaagccgttctgcccccaaagcagccttcacagttaacagacatggagctggacgaatgtgaggagaccacacttcatgatgtcaatatggatgaggagtctaggaggaggcaacaacaagctgctcaggaagcatatgaggaggatgatgatatgcctggtggtgcacagagggtacagtgcgcccaacagtagtgacttgtgcggaaggaatgtagaatctgaattgatgaaaaatgaatgatgatgaaactgatgatgatgatactgttttgatgttccgtaactgtagcgtggactatggactaaagatgagtagcatgttagtagctgttgattgtgaggaagtgaaacagtaatatgtggaaaggataattttcgttttgcatcctaaatacttcgctttattgtttattttaagtatttctgtttcagttattcaattttattatcatttcttgtatgtgactgttttaagaaacttggctaagacctttctataagatgcaagagacccagaatggggataaccttattattctcacacagatagaatgaagttcctatgtatgagtttttgccaggattaggaagagtttttcaattgt

SEQ ID NO: 8144 - DNA, 2027 bp, Vitis vinifera
agcatctagaaagaaaatctcaacccttggacgaaagatcatccaacggcctacgttccttctttccctaccaataaaatctggaaatataaagagagttctagactcaccccaatcgcaaacgatcacagccgttcgctccctctatatatatgatacaaaccccactcccaaaagttgacgtccttagagtttctgaagacgccgttctcttaagatccaattacgatttctgggggttgggtttggattggaaatctcagagaagttaaggttcccaggtacagattgaagaaaaatgtttggaagagcgccgaagaaaagcgataataccaggtactatgagacactgggagtgtcaaagaacgcttctcaggatgatctcaagaaggcgtatcgtaaagccgccatcaagaatcatcctgacaagggaggtgatccagagaagttcaaagaacttgctcaggcttatgaggttctgagtgaccctgagaaacgtgaaatctatgatcagtatggtgaagatgccctcaaggaaggaatgggtggcagtggtggtggccatgatccatttgacattttccaatctttctttggtgggagtccatttggtggtggtggtagcagcaggggaagaaggcaaaggaggggagaagatgtcgtccaccccttgaaggtttctttagaggacctttatattgggacgtcaaagaaactctccctctcaagaaatgtaatatgctcgaagtgcaatggaaaagggtcaaaatctggagcatcaataaagtgtaatggttgtcaagggtctgggatgaaggtttcaattagacaacttggcccctctatgattcagcagatgcagcatccttgcaatgaatgcaaaggtactggagaaactatcaatgataaagaccgctgcccacagtgtaaaggtgagaaggttgttcaggagaagaaggtgctggaagtcattgtggaaaagggcatgcaaaatggacagaaagttacatttcctggagaagctgatgaagcgcctgacacagtcactggggatatagtttttgtcctccagcaaaaggaacatccaaaattcaagagaaagggggatgacctttttgtggagcacaccttgtccctcactgaggctctctgtggtttccagtttatattgacgcacttggatggaaggcagctgcttattaaatcaaatcctggggaagttgtcaagcctgatcagttcaaggcaatcaatgacgagggaatgccaatataccagaggccattcatgagggggaagctatacatccagttcaacgtggagttcccggacacactaagcccagagcagtgcaaggcattggaagctgtgctgccagcaagggcgactacacagctgacagatatggagctggacgagtgtgaggagaccacactgcatgatgtcaacatagaggaggagatgaggaggaagcaggcacaggctcaggaagcatacgaggaggatgaagagatgcctggtggcgctcaaagggtgcaatgtgcccagcagtgatgaattctaataccagaaatttccttttcacaagtattaatacaatccgcgaatgtgttgtcaactacaaacctggataactgtcactacattcattatggtggatgatgaaattcccattcctcactttggcctctttcctcaattacttcagcactcgcttaccacctgccacctggatcaagaggtggcattatatagtcttacccagcatgataaaaatgattttatggggcttaagtcgtcttctcaccctgttattcttctctctatgcatatgctctaaaaatggaaatgtgggttttgacatttgtcattatgggagttggaagcagcagcaggatgcgtctcacgacatcttatgaaaagaaacaaaaaaataaaaaaaaaaagccaatgaaaagtttctctaaatctgttggggccctcacttgacgcttttcattaatggcattatattttttgcaacaccacc

SEQ ID NO: 8145 - DNA, 1833 bp, Vitis vinifera
gacgtccttagagtttctgaagacgccgttctcttaagatccaattacgatttctgggggttgggtttggattggaaatctcagagaagttaaggttcccaggtacagattgaagaaaaatgtttggaagagcgccgaagaaaagcgataataccaggtactatgagacactgggagtgtcaaagaacgcttctcaggatgatctcaagaaggcgtatcgtaaagccgccatcaagaatcatcctgacaagggaggtgatccagagaagttcaaagaacttgctcaggcttatgaggttctgagtgaccctgagaaacgtgaaatctatgatcagtatggtgaagatgccctcaaggaaggaatgggtggcagtggtggtggccatgatccatttgacattttccaatctttctttggtgggagtccatttggtggtggtggtagcagcaggggaagaaggcaaaggaggggagaagatgtcgtccaccccttgaaggtttctttagaggacctttatattgggacgtcaaagaaactctccctctcaagaaatgtaatatgctcgaagtgcaatggaaaagggtcaaaatctggagcatcaataaagtgtaatggttgtcaagggtctgggatgaaggtttcaattagacaacttggcccctctatgattcagcagatgcagcatccttgcaatgaatgcaaaggtactggagaaactatcaatgataaagaccgctgcccacagtgtaaaggtgagaaggttgttcaggagaagaaggtgctggaagtcattgtggaaaagggcatgcaaaatggacagaaagttacatttcctggagaagctgatgaagcgcctgacacagtcactggggatatagtttttgtcctccagcaaaaggaacatccaaaattcaagagaaagggggatgacctttttgtggagcacaccttgtccctcactgaggctctctgtggtttccagtttatattgacgcacttggatggaaggcagctgcttattaaatcaaatcctggggaagttgtcaagcctgatcagttcaaggcaatcaatgacgagggaatgccaatataccagaggccattcatgagggggaagctatacatccagttcaacgtggagttcccggacacactaagcccagagcagtgcaaggcattggaagctgtgctgccagcaagggcgactacacagctgacagatatggagctggacgagtgtgaggagaccacactgcatgatgtcaacatagaggaggagatgaggaggaagcaggcacaggctcaggaagcatacgaggaggatgaagagatgcctggtggcgctcaaagggtgcaatgtgcccagcagtgatgaattctaataccagaaatttccttttcacaagtattaatacaatccgcgaatgtgttgtcaactacaaacctggataactgtcactacattcattatggtggatgatgaaattcccattcctcactttggcctctttcctcaattacttcagcactcgcttaccaccagccacctgccacctggatcaagaggtggcattatatagtcttacccagcatgataaaaatgattttatggggcttaagtcgtcttctcaccctgttattcttctctctatgcatatgctctaaaaatggaaatgtgggttttgacatttgtcattatgggagttggaagcagcagcaggatgcgtctcacgacatcttatgaaagaaacaaaaaaataaaaaaaaaaagccaatgaaaagtttctctaaatctgttggggccctcacttgacgcttttcattaatggcat

SEQ ID NO: 8146 - DNA, 1761 bp, Euonymus alatus
gtcgcagaacgcgttgctttgttttgtggaataatttcagatcggtcgttccgcgtccggagaattcgaaagcaaacgcctgagcaaagttcctgatcggcgaacatgttcgggagggctccaaagaagagcgataatactaggtattacgaggtattgggggttccgaagaacgctggtcaggatgatttgaagaaggcctacaagaaagctgcgatcaagaaccatcctgataaaggaggcgatcctgagaagttcaaagaacttgcccacgcatacgaggtcttgagtgatcccgagaagcgtgagatatatgatcaatatggggaggatgcactcaaggaaggaatggggggtggtggtggcggccatgatccatttgatatcttttcatctttctttggtggctctccatttggtggcggcagcagcaggggaagaaggcagagacggggtgaggatgtggttcacccaatgaaggtttctctggaggacctctacctagggacctccaagaagctatctctttctcggaatgtgatatgttcaaaatgcaatggcaagggttcaaagtctggagcttcaatgacatgtgctggttgccaaggtactggtatgaaagtgtcaataaggcaccttggaccatcaatgattcagcagatgcagcatccatgcaatgaatgcaagggaactggtgaaactattagcgacaaggatcgctgcccacagtgcaagggagagaaggttgttcaggagaagaaggtgctggaggtgattgtggagaagggcatgcagaatgggcagaagataacttttcctggtgaagcagatgaagcacctgatacagtcactggagatattgtctttgtccttcagcaaaaggaacaccctagattcaagaggaaaggcgatgacctctttgtggagcatactctttccctcactgaggccctttgtggttttcagtttgtgttaacccacttggacggcagacagctcctcattaaatcaaatccaggggaagttgtcaagcctgattcgttcaaggcaatcaatgatgagggtatgcctgtgtataggaggccatttatgaaggggaagttgtatatccacttcactgtggacttccctgattctgtggcccctgatcaggtgaaggcacttgaggcaattctgccttcaaggcgaacaagccagttgacggacatggagctagatgagtgtgaggaaactacactacatgatgttaacatcgaagaagagatgcggaggaagcagcaggctcaacaggaggcatatgatgaggatgaagagatgcctggtggggctcagcgggtccaatgtgcacaacagtgatcaaacacaaaggatgacaaaaaatgtaagaagaattggtgaatgttctggtgtttggtaaattgggtgtactgctgtggatggccgagactgagaggttgagctagactatgataagtattgtactagacttgtgctgatgacgaaattttcaattaaagactccgaatttctataactaattttctttcaacctgatgatgtgatggagatatgtgcctatgctcttatatatttaaatgcttggtgttttacagtttacctggatgcagagttcgaatactctcgtctgtgattatggtgttttgtgataacttgacggaggacagaacggtttcctaagtagactgcggcagttctgtagaaattacgtcaacccacttgcgaaactatgtacggcttgag

SEQ ID NO: 8147 - DNA, 1665 bp, Lippia dulcis
gaaacccatggccgaatcctacgtccacgattgcatcgtcgctcgatctccaccgtcgaatgttctcctataaacacctctctccccgcttggtctttagccttcaaccctttctcgctctggaaatactaaaacatcccgcacacgccgaatcatcatcgattttgtgggggtaattggtgtatcgattgaaatcttcacgatgttcgggagggctccgaagaaaagtgataattcgaggtactatgagatcctcggtgtgccgaagacggcgtcgcccgatgatttgaagaaggcgtataagaaggcagctattaagaatcatccggacaagggcggggatcctgaaaagttcaaagagcttgctcatgcatatgaggttttgagtgatccggagaaacgtgaaatctatgatcaatatggtgaggatgcacttaaggaaggaatgggtggtggcggtggtatgcacgacccgtttgacatcttctcatctttctttggtgggagtccatttggaggtggtggtagcagtaggggacgaagacaaagacgtggagaggatgtagtgcatccactgaaggtctctcttgaggatctttaccttgggaccaccaagaagctctctctatcacgcaatgtcctttgttcaaagtgtaatggtaaaggttcaaaatctggagcctcaatgaagtgttcaggttgtcaaggaagcggtatgaaggtgacaatcaggcaactgggacctggcatgattcagcaaatgcagcatccatgcaatgaatgcaaaggaacgggagaaactattactgacaaagacagatgctctcagtgcaaaggtgagaaggttgttcaggaaaagaaagtcttggaagtccatgttgaaaagggcatgcagaatggacagaagatcacattccctggagaggctgatgaggcgcctgatactatcacgggagacatagtatttgtgctccaacagaaggagcatcctaaattcaaaagaaaaggtgatgatctatttgtcgagcactcgctgaccctcactgaggcattatgtggattccagtttatattgtctcatttggatggaaggcctctccttatcaaatcccacccaggagaagttgtgaagcctaattcttacaaggcaatcaacgacgaaggaatgcccatgtaccagaggccattcatgaagggtagactctatattcatttcaatgttgaattcccagattctctagatgtggatcaagttgctgctctggagaagatccttcctccaaagccacaatccaagttgacagacatggagattgacgagtgtgaggagacgacccttcatgatgtggacatcgagagcgaaatgaggaggaaagccgcgcagcaacaggaagcttatgaagaggatgacgacgatatgcacggtggtggggcccaaagggttcaatgtgctcagcagtgatgagctgaaaacataagattttctggaaccttattgttaaggtctttctattcataatgcattattatttgaaatgtagcaactattaatgtgtttggaagcagttttgtgttgacttggttgtatgtgtctttggctttatggtgtaatgaatgtcgagtgtgtactgaaataattcggtttactcgttgagctccgacagg

SEQ ID NO: 8148 - DNA, 1668 bp, Glycine max
gaagaattagtgaattagaatccaccttggcctagccagctagcgcttcttctctcgcattccgtggagatctagtgctgccaaacctcgctgaaaattagggtttcgtttcggaggtagacgaagatgttcggaagggcaccgaagaaaagcgacagcaccaggtactacgaaatcctcggcgtttcgaagaacgcttcgccggatgatttaaagaaggcttacaagaaagccgccattaagaaccaccctgacaaaggcggtgatcctgagaagttcaaagagcttgctcaagcctatgaggttctgagtgaccctgagaagcgtgaaatttatgacacatatggagaagatgctcttaaggaaggaatgggtggtggtggcggtggccatgatccatttgatatcttcagttcattctttggtggaagtccgtttgggtcaggtggtagcagtagaggacggaggcagagacggggagaagatgtggttcatcccctgaaggtctctctggaggatctttacctcggaacatctaagaaactctctctttcacgaaacgtgctgtgttcaaaatgcaatgggaagggctcaaagtctggggcttcaatgacctgtgctggttgccagggtactggcatgaaggtgtctattaggcaccttggtccttctatgattcagcagatgcagcatccttgcaatgagtgtaagggtactggagagacaatcaatgacagagacaggtgccaacagtgcaaaggagagaaagttgttcaggagaagaaagtacttgaagttgttgtggagaagggaatgcagaatggacagaagattacattccctggtgaagctgatgaagcacctgatacagtcactggggatattgtctttgtcctacaacagaaggaacacccaaagttcaaacgaaaggccgatgacctttttgtagaacacacattgtctcttactgaggcactgtgtggcttccagtttgtgctggctcacttggatggccggcagcttcttatcaaatctaaccctggggaggttgttaagcctgattcatacaaggcaataaatgatgagggaatgccaaactaccagaggcacttcctgaagggaaagctttacattcatttctcagtggaatttcctgataccctgagtcttgatcaggtgaaggctttggagactactctgccactaaagcctacatcgcagttgacagacatggagctggatgagtgtgaggagaccacactccatgatgtgaacatggaggaagagataaggaggaggcaacaagctcagcaggaggcatatgaggaggatgaggatatgcatggtggtgctcagagagtgcagtgcgctcagcagtaatcagagcctgtgatgtcatttgatgatctcgattatgctattttttagccgcttgtgcgggactaaacataactagtgtttgatcaaaacgattttgacaagcaaacactgtagaatttattgtccaagaaattatttcgcaaaagacatcttaagtaccattttttttcttcttcttatggctctgcttgcattggtattttttctttctttcattttttcacttttgttttacaaaagaatatatttttatctgttgattcaaaatatagtttaattttcataagc

SEQ ID NO: 8149 - DNA, 1493 bp, Flaveria ramosissima
ccaacaacacaactcaaagtcttccgatagcgatctacttcttcgcagatttgtaattgagtattgaagatcgaagaaggagaacaggatgtttggaagagcaccgaagaagagcgataacacgaagtattatgagatccttggggtcccgcagaacgcttcacaggatgatctgaagaaggcgtataggaaagctgccattaagaaccatcctgacaaaggtggagatcctgagaagtttaaagaactagcacaagcatatgaggttctcagtgacccagagaagcgtgagatatatgatcagtatggtgaggatgccttaaaggaaggaatgggcggtggaggtggtggtcatgacccctttgacatcttccaatccttctttggcggtagtcctttcggtggcggtggtggtagcagcaggggacgaaggcaacgaaggggagaagatgttgttcatcctctcaaagtttctcttgaggatctctataatggaacttccaagaaactctctctttcacgcaatgtaatctgctccaagtgtaagggcaagggctcaaagtcaggtgcttcaatgaaatgtgctggatgtcaaggttctggaatgaaggtttctatcagacatcttggcccatctatgatccagcaaatgcagcatccttgtaacgaatgcaagggtactggggaaaccatcaatgacaaggatagatgcacacagtgcaagggtgaaaaggtcgtgcaggagaagaaggtactggaagtgcatgtggagaagggtatgcagaatggacagaagattacattccctggagaggcagatgaagctcctgacactgttactggagacattgtgtttgtgttgcaacaaaaggagctccccaagtttaagcgaaagggtgatgacctgtttgttgaacacacattgagcttgaccgaggccctatgtgggttccagtttatcttaacccatttggataatagacaacttctcatcaaatctcaacccggagaggttgttaagcctgatcaattcaaggcaattaatgatgaaggtatgccaatgtaccaaagaccgtttatgagggggaagctgtacctccacttcaccgtagaattcccagattcattgtcaccagatcagtgcaaagcgttggaggcggtgctgccacctaagccttcgatgcagatgacagacatggaactggatgaatgtgaagagacaactcttcatgatgtcaacatcgaagaggagatgagacggaagcaacaagcagctcaagaagcttatgatgaagatgaagacatgcacggtggagcacagagggttcaatgtgcgcaacagtaacttgaggcaaggtcgaggtttgctcatctgatagacaataatgtcagttgtgtttttgcttctcttttttaattaaatatacgatattattaatgcttcaaagatagtgtggatgatttttaccctatttagaaagactggtttggtc

SEQ ID NO: 8150 - DNA, 1448 bp, Flaveria ramosissima
tctctttcgcccaacaacgcaactcaaagtcttccgatagcgatctacttcttcgcagatttgtaattgagtattgaagatcgaagaaggagaacaggatgtttggaagagcaccgaagaagagcgataacacgaagtattatgagatccttggggtcccgcagaacgcttcacaggatgatctgaagaaggcgtataggaaagctgccattaagaaccatcctgacaaaggtggagatcctgagaagtttaaagagcttgcacaagcatatgaggttctcagtgacccagagaagcgtgaaatatatgatcagtatggtgaggatgccttaaaggaaggaatgggcggtggaggtggtggtcatgacccctttgacatcttccaatccttctttggtggtagtcctttcggtggcggtggtggtagcagcaggggacgaaggcaacgaaggggagaagatgttgttcatcctctcaaagtttctcttgaggatctctataatggaacttccaagaaactctctctttcacgcaatgtaatctgctccaagtgtaagggcaagggctcaaagtcaggtgcttcaatgaaatgtgctggatgtcaaggttctggaatgaaggtttctatcagacatcttggcccatctatgatccagcaaatgcagcatccttgtaacgaatgcaagggtactggggaaaccatcaatgacaaggacagatgcacacagtgcaagggtgaaaaggtcgtgcaggagaagaaggtactggaagtgcatgtggagaagggtatgcagaatggacagaagattacattccctggagaggcagatgaagctcctgacactgttactggagacattgtgtttgtgttgcaacaaaaggagcaccccaactttaagcgaaagggtgatgacctgtttgttgaacacacattgagcttgaccgaggccctatgtgggttccagtttatcttaacccatttggataatagacaacttctcatcaaatctcaacccggagaggttgttaagcctgatcaattcaaggcaataaatgatgaaggtatgccaatgtaccaaagaccgtttatgagggggaagctgtacctccacttcaccgtagaattcccagattcattgtcaccagatcagtgcaaggcgttggaggcagtgctgccacctaagccttcgatgcagatgacagacatggaactggatgaatgtgaagagacaactcttcatgatgtcaacatcgaagaggagatgagacggaagcaacaagccgctcaagaagcttatgatgaagatgaagacatgcacggtggagcacagagggttcaatgtgcgcaacagtaacttgagtcacagtcaaggtttgctcatctgatagacaataatgtcagttgtgtttttgcttctcttttttaattaaatatacgatactattaa

SEQ ID NO: 8151 - DNA, 1441 bp, Flaveria ramosissima
gattgtaatgaatatgaagatcgaagaaggagagcaggatgtttggaagagcaccgaagaagagcgataacacgaagtattatgagatccttggggtcccgaagaacgcttcacaggatgatctgaagaaggcgtataggaaagctgctattaagaaccatcctgacaaaggtggtgatcctgagaagtttaaagagctggcccaagcatatgaggtactaagcgacccagagaagcgtgagatatatgatcagtacggtgaggatgccttgaaggaaggaatgggtggtggaggtggtggtcatgacccctttgacattttccaatccttctttggtggtagtcctttcggtggaggcggtggtggtagcagcaggggacgaaggcaacggagaggtgaagatgttgttcatcccctcaaggtttctcttgaggatctctataatggaacttccaagaagctctctctttcacgcaatgtaatctgctccaagtgtaagggcaagggttcaaagtcaggtgcttcaatgaaatgtgctggctgtcaaggttctggaatgaaagtctctatcagacatcttggcccatctatgatccagcaaatgcagcatccttgtaatgaatgcaagggtaccggagaaaccatcaatgataaggatcgatgcacccaatgcaagggtgagaaagttgtgcaggagaagaaggtactggaagtccatgtggagaagggcatgcagaatggacagaagattacattccctggagaagctgatgaagctcctgacaccgttaccggagacattgtgtttgtgttgcaacaaaaggagcaccctaagtttaaacgaaagggtgatgacctatttgtggaacacacattgagcttaaccgaggccctatgtgggttccagtttatcttaacccatttggataacagacagctcctcatcaaatctcaaccaggggaggttgtcaagcctgatcaattcaaggcaataaatgacgaaggaatgccaatgtaccagaggccgtttatgagggggaagctatacctccacttcaccgtagaattcccagattcattgtcaccagagcagtgcaaggcgttggaggcggtgctgccaccgaagccttcaatgcagatgacagacatggaactggatgaatgcgaggagacaactcttcatgatgtcaacatcgaagaggagatgaggaggaagcaacaagcagctcaagaagcttatgatgaagatgaagatatgcacggtggggcacagagagttcaatgtgcacaacagtaattgaatcgttgttaaggtttggtctgatctggtcatttatcatcttaggttttggcaagacaataacgtcaactgtaattttacttcatactgctatgtatgtccatctgttttgagaacctttgaggtgtgtggattattga

SEQ ID NO: 8152 - DNA, 1702 bp, Linum usitatissimum
tagtttccttcttatttgtggctctctgaaccccggcctcggagaagctaccaataaactcccgactgcctttgattgtgcgttactttgtttctgacaatcgggcgtcaccaagacctaaaacaagatgtttgggagagctccgaagaaaagcgacaacactaagtactatgagatccttggggtttcccagagcgcatcacaggatgatctgaagaaggcttatcgcaaagcagctataaagaatcatcctgataagggcggtgaccccgagaagttcaaggagttggcacaagcttatgaagttctgagtgacccagagaaaagggacatatatgatcagtatggagaggatgccctcaaggaaggaatgggaggaggcggtggcggccacgatccctttgacatcttccagtctttctttggcggtggcggcggtaatccttttggtgctggtgggagcagtaggggccgaaggcagaggaggggtgaagatgttgtccatcctctcaaggtttcattggaggatctctacaatggcacatctaagaagctgtctctttctcgcaatgcactctgttccaaatgcaagggcaagggatccaaatcaggccagtcaatgaagtgttctggttgccagggttcagggatgaaggtttccattaggcaactcggaccttccatgattcagcaaatgcaacatgcttgcaacgagtgcaaaggtaccggtgagaagatcaatgacaaagatcgatgcccgcaatgcaagggtgaaaaggtcatgcaggagaagaaagtcctggaggttgtcgttgagaagggaatgcaaaatggacagaggatcaccttccctggtgaagctgatgaagctcccgacacggtcacaggagacattgttttcgtgctacaacagaaggaacatcccaagttcaagcgaaagggcgatgatctgtttgttgagcacaccctttctctcacagaggctctatgtggcttccagtttgcattgactcatttggatggacgacagctcctaataaaatcccaacctggggaagtagtcaagcctgatcaattcaaggcaataaacgacgaagggatgccaatgtaccagcgtcccttcatgagaggaaagatgtacatccatttcggtgttgatttcccagactcactttctcctgaccagagcaaagctctggagggtgtccttcctgcaaggtcatcgggtcagctctcggacatggagttggacgagtgcgaggagacaacactgcatgatgtgaacatcgaagatgaaatgaggcggaagcaacaggcagcccaggaggcctacgatgaagacgatgaagatatgcatggaggagcgcagagggtgcaatgtgctcagcaataaggtctgaatcgcaataaaggggtgccagagataaaggaaactaccccagtcttgggagctgaggttgtttatgtcgttgggagttggaacaggactgcgggtgcgttgattgtttgagagattatctctcagaacagtaatggcttttataattgacgttttgtagtgtatctacgttgttgttttgtttgctccctgaagacctctattgaagacttggacaaaactactgcttaaattttgaaggattatatttgtagctttaagctttctttcttgtgactagccttatggtgatctattacattt

SEQ ID NO: 8153 - DNA, 1503 bp, Ambrosia trifida
accaaaccaaaccaagtcaagtcttcccttcacgatctacttcttcgccgattgaagattatagaagaagaagaaggagagaatgtttggaagagcaccgaaaaagagcgataatacaaagtattatgagatccttggagttccaaagacagcttcacaggatgatctaaagaaggcttataggaaagctgctattaagaatcatcctgataaaggtggagatcctgagaagtttaaagagcttgcccaagcatatgaggtactgagtgaccccgagaagcgtgagatatatgatcagtatggtgaggatgccttgaaggaaggaatgggcggtggaggcggtggtcatgacccctttgacatcttccagtctttctttggtggtagtcctttcggtggtggtggtggcggtagtagtaggggtcgaaggcaacaaggggtgaggacgttgttcatcctctcaaagtttctcttgaggatctttataacggaacttccaaaagctctctctttcacgcaatgtaaattgctccaagtgtaaaggaaagggttcaaagtctggcgcttcaatgaagtgtgctggctgtcaaggttctggaatgaaagtttctatcagacatcttggaccatccatgatccagcaaatgcagcatccttgtaacgaatgtaagggtactggagaaaccatcaacgacaaggatcgatgcacacaatgcaagggtgagaaagttgtgcaggagaagaaggtactggaagtacacgttgagaagggcatgcagaatggacagaagattacattccctggagaggctgatgaagctcctgacacggttacaggtgatattgtgtttgtgttgcaacaaaaggagcaccctaagtttaagcgaaagggtgaggacatatttgttgagcacacattgagcttgacagaggccttatgtgggttccagtttatcctaacccatttggataacagacagcttctcatcaaatctcaacccggagaggttgtcaagccagattccttcaaggcaataaatgacgaaggaatgccaatgtaccagaggccgttcatgaaggggaaactgtacacccacttcactgtagaattcccagaatcgttgtcgcctgagcagtgcaaggcgttggaggcggtgctgccaccaaagccgtcaatgcaaatgacagacatggaactggatgaatgtgaggagacgactcttcatgatgtcaacatcgaagaggagatgagaaggaagcaacaggcggctcaagaagcttatgacgaagatgatgacgacatgcatggtggagctcagagggtacaatgtgcacaacagtaattgaatcatggttaaggtttggtttgatttgattttgtctgggcatcatcttaagacaataatgtcaactgtaatactttataatgttaaatttgtgtctgttttgtgaacctttaaggaatatggatgattaactactattaagatacattgattgaga

SEQ ID NO: 8154 - DNA, 1634 bp, Citrullus lanatus
aagaagggaaaggtataaagaaattagcattttcttgtccagaaccttcgtttcatttctcaaactttggttccacgaaattgggttgccgagtttcgatcgggtttcaatcggtttgaagaataaggatttcaatcatcaaagcgggggtgttcggaagagctccaaagaagagcgacaacacgcggtactacgagatccttggagtctccaagaacgcgtcgcaggatgatttgaagaaggcttacaagaaggccgctatcaagaatcatcctgacaagggtggtgatccggagaagtttaaagaattggctcaggcttatgaggttcttagcgaccctgagaagcgagagatctatgatcagtatggcgaggacgcacttaaagaaggaatgggtggtggaggtggtcatgaccccttcgatatcttccagtccttctttggaggaagtccatttggtggtggtagcagcagaggccgacgccagagaaggggagaagatgtggtacatccccttaaggtctcccttgaggatctttaccttggaacttccaagaaactttctctgtcgcggaatgttatctgctcaaaatgcaatggtaagggatcaaaatcaggtgcttcaatgaactgctctggctgccaaggaactggaatgaaggtcacaattaggcaccttggtccgtcgatgatccaacaaatgcagcacccttgcaatgaatgcaagggcactggagaaacaatcagtgacaaggaccggtgttcacaatgcaagggtgagaaagttgttcaagagaagaaggttctggaagttattgtggagaagggtatgcagaatggacagaaaattacattcccaggagaagcagatgaagctcctgatactgtcactggagatatagtttttgttcttcagcagaaggagcatccgaaattcaagagaaagggagaggacttgtttgttgagcacactttgtctctcacagaagctctctgtggcttccagtttgctctcactcacttggatggcagacagcttctcatcaaaacaaatcccggagaagttgtaaagcctgattcattcaaggcgattgacgaagaggggatgccggtataccagagaccattcatgaaagggaagctctacatccatttcagtgtggacttccctgattccttaagcccagagcagatcaaagctctggaagccgtcttaccatcaaaaccatcatcccaactgactgacatggagcttgacgagtgtgaggagacgacaatgcatgatgttaacatcgaagaggagatgcggcggaagcagcagcaagcacaagctgaggcgtatgaggaagatgaagacatgcacggtggtgcgcagagggtgcagtgtgcccagcagtaatccctccttgagctgaaattaacctgaaatgactatacgtaggtatgtttggggatatgaatgggttgatgaactccacatcatgttaatggcagtttttgatggtagcatttggaatttctcatattctgaaagccattactactgatacaacataaaaatcaatctgtttctgatcttatgtgccaactgctattttaatataaagtttttaaatccaagctgattgttgtc

SEQ ID NO: 8155 - DNA, 1522 bp, Brassica napus
tctccttctcctctccaccgctaaaagcctcgcgatttgccttctctacctactagggttttcttaacaaggagggagaaaagatgttcagaagaggaccttcgagtaagagcgacaacaccaagttctacgagatccttggcgttcccaagaccgcttcgccagaagatctcaagaaggcttacaagaaagccgccatcaaaaaccatcccgacaagggtggagatcctgagaagttcaaggagctaggtgaggcttatggagttcttagtgatccagagaagcgtgagatctacgatcaatatggagaggatggactcaaggagggaatgagtgatagacacgacccgtttgatatcttctcgtccttctttggtcgtaatgaaaggaggcagaggcgtggtgaagatgttgttcaccctctgagggtttccctggaggatctttatctcggaacaacgaagaagctctcgctttctaggaatgctctctgctcaaagtgtaacggaaagggttcaaagtctggagcttcgttgaaatgtggtgggtgtcaaggaaagggaatgaaggtctcgatcaggcagattggacctggaatgattcagcagatgcagcatgtttgtcaagactgcaagggtacaggacagaccaccaatgatcgtgacaggtgtccacaatgcaaaggagataaagttatccccgagaagaaggtgcttgatgtagctgttgaaaagggaatgcaaaacagtcagaagatcacattccgcggacaagctgatgaagcgcctgatacggtcactggagatatagtgtttgtcattcagcagaaggagcaccctaagttcaagagaaagggagatgatctctttgtggagcacactctctctctaaccgaggctctctgtggcttccagttcgtcttgacgcacttggacgcaagacagcttctcatcaaatccagccctggggaggttgtgaagccagattcatacaaggcgataagcgacgagggaatgccgattcaccagaggccgttcatgaagggcaagctttacatccacttcactgtcgagttcccggagtcgcttagccgagatcagacaaaggcctttgaagctgtcttaccaaagccggcaaagtcagctatgagcgacatggagatagacgagtgcgaagagacgacgctacatgaggtgaacattgaagctgagatgaaaaggaaggctcaagctaaaagagaggcttatgatgatgatgatgatgaagaaggcccaggcggtggtcatggtgttcaatgtgctcagcagtgatccgacatgcgcattttagtgctatccaacttttgtcgttttttttttaattttctttatatgatttttggatcttcttataggctttgcgcaaattccttttatttttttgaataaacttttctagtttttgagattttgtcctctccaccaacaattcaatgtgctatatcaagatattttcaacaaaataatttctagctatattttca

SEQ ID NO: 8156 - DNA, 1575 bp, Solanum lycopersicum
gcaaagaccaaagatgtctttatggcggagactggtatatattccccaattcccaccaacaaatcctgaccgttcaattctcaacctcacaataaaaccacagatctcatactcaaagcaaaccctctctcccttttcctccatactcgaacaagccaacaaactcttcttctcgccgcgctttatcatcgttcaattttgactaaattaagcgatcgaagatgtttgggagggcaccgaaaaagagcgacaacacgaagtactatgaaatcttaggtgttcctaaaactgctgcacaagaagatctcaagaaagcttaccgtaaagctgctattaagaatcatcctgataagggaggtgatcctgaaaagtttaaagagcttgcacaagcttatgaggttctgagtgatcccgagaagcgtgagatatatgatcagtatggagaagatgctctcaaggaaggaatgggcggtggaggtggtggacacgacccatttgacattttctcatctttctttggtggcagcccatttggtggaggtggtggaagcagcagaggaagaagacaaagaagaggagaggatgttgtccaccctctcaaagtttctctggaggatctgtacaatggaacatcaaagaagctttcactatctcgcaatgtattgtgcccgaagtgcaaggggaaaggatctaaatcaggtgcttcaatgaagtgttctggctgtcaagggtctggaatgaaagtcactattagacaacttggcccatccatgatccagcagatgcagcacccttgcaacgagtgtaagggtactggtgagatgatcaatgataaagataggtgtgggcagtgtaaaggtgagaaggttgtgcaggagaagaaggtgttggaagttgttgtcgagaagggtatgcagaatggacagaagataacattcccgggcgaggctgatgaagcacctgataccgtcactggggacatagtttttgtcttgcaacagaaggaacatcccaagtttaagcggaagggagatgatctctttgtagagcacaccttgagcttaaccgaggccctgtgtggtttccagttcatcttgactcacctagataccaggcagctgatcatcaagtcccaacccggagaagttgtcaaacctgatcaatttaaggccataaatgatgaaggaatgccgatgtaccaaaggccatttatgagaggaaaactatacattcacttcaccgtagaattccccgacacgttatccctcgagcaatgcaagaaccttgaagcagtattgccaccaaaacccaaaacccaaatgactgatatggaattggacgagtgcgaggagaccacgttacatgatgttaacatcgaagaggagatgcgtaggaagcagcaacaggcccaagaggcatacgacgaagacgatgaagacatgcatggtggtgcacagagagttcaatgtgcacaacagtaatttggtaacacggaattaacgtcacgattcaactcttgttttcacgtatttgtaatgacattactagcttataaatttcgagttttgaatttgc

SEQ ID NO: 8157 - DNA, 1498 bp, Tripterygium wilfordii
ctagaaaggaagctcactatttcgtattattcgttgcgtgtccagagaattcgaaagcaaaaaagcgaaagcagaatttctgatcggcgaagatgttcgggagggctccaaagaagagcgataacactaggtattacgaggtcttgggtgttccgaagaacgctagtcaggatgatttgaagaaggcctataggaaagctgcgatcaagaaccatcctgataaaggaggcgatcctgaaaagttcaaagagcttgcccacgcttatgaggtcctgagtgatcctgagaagcgtgagatatatgatcagtatggggaggacgcactcaaggaaggaagtggggggtggtggcggccatgatccatttgacatcttttcatcgttctttggtgggtctccatttggtggcggcagcagcaggggacgaaggcagagacggggtgaggatgtggttcatccattgaaggtctctttggaggacctctacctagggacgtcaaagaagaactctctttctcggaatgtgatatgttcaaagtgcaatggcaaaggttcaaagtccggagcttcaatgacttgtgctggttgccaaggtactggtatgaaagtgtcaataaggcaccttggtccttcaatgattcagcagatgcagcatccctgcaatgaatgcaagggaactggtgaaactattaacgacaaggatcgctgcccacagtgcaagggagagaaggttgttcaggagaagaaggtgctggaagtgattgtggagaagggcatgcagaatgggcagaagattactttccctggtgaagcagatgaagcgcctgatacagttactggagatattgtctttgtccttcagcaaaaggaacaccctagattcaagagaaagggcgatgacctctttgtggagcatacgctttctcttactgaggccctttgtggttttcggtttgtgttaacccacttggacggcagacagctcctcattaaatcaaatccaggagaagttgttaagcctgattctttcaaggcaatcaatgatgagggaatgcccgtgtatcagaggccatttatgaaggggaagttgtatatccacttcactgtagacttccctgattctttggcccctgatcaggtgaaaaagcttgaggagatcctgccttcaaggccaacaagccagttgacggacatggagctagacgagtgtgaggaaactactctgcatgatgttaacattgaagaagagatgcggaggaagcagcatgctcaacaggaggcttatgaggatgacgatgagatgcctggtggggctcagagggtccaatgtgcacaacagtgatcaaatacaaagaagaaagagaaagaaatggaagaattggtgaatgttaattccgcttgtggtactttataattgtgagctgctgtggatggctgagaatttgagggaaaatatgataagaattgtactagacttgcgtcgatgatgaaattttgaa

SEQ ID NO: 8158 - DNA, 1603 bp, Carica papaya
gggtgctctgctctttcgttctctgcggccaatcctcggaacctaaacactgcgaataaaaagagaaaaaagaggtaaagatgtttgggagagctccaaagaaaagcgacaacacaaagtactacgagattcttggagtctcaaaaaatgcttcgcaggatgatctgaagaaggcttacaggaaagccgcaatcaagaaccatcccgacaagggtggtgaccctgagaagtttaaagaattggcccaagcttatgaggttctaagcgacccggagaaacgtgagatttatgatcaatatggtgaagatgctctcaaggaaggaatgggtgcaggtggaggtggccatgacccatttgatattttccaatccttttttggtggcaatccatttggtggtggtggaagcagcagagggcgaagacagaggcggggagaggatgttgtgcatccactaaaggtttctttggaagatctgtataatggaacgtccaaaaaactctctctttcacgtaatataatctgctccaagtgcaaaggaaaaggttccaaatcaggtgcatcaatgaaatgccctagctgccaaggttctgggatgaagatttcaattagacagcttggccctggtatgatccagcagatgcagcatccttgcaatgagtgtaagggtactggtgagactattaatgataaggatcgctgcccacaatgcaagggtgataaggttgtacaggagaaaaaagtattggaagtcattgttgagaagggaatgcaaaatggacaaaagattacattccctggagaagctgatgaagcgcctgacaccattactggggacattgtatttgtcctacaacagaaagaacatccaaaatttaagagaaagggtgatgacctctttgtggagcatactctgtccctcacagaggcgctttgtggtttccaatatgtgttgacccatttggatggcaggcaacttctaattaaatctcaacctggggaagttgtaaagcctgatcaatttaaggccattaatgacgagggaatgccaatatatcagaggtcattcatgaagggtaaattgtacattcacttcagtgttgacttcccagactcgctaagccctgagcaatgcaaatctttggaagctgtgctaccgccgagaacctcagttgagctgacggacatggagctcgatgaatgtgaggagactactttgcatgatgttaacattgaggaggagatgcgcaggaagcaggctcaggctcaagaagcatacgaggaagatgatgatatgcatggaggtgcgcagagagtgcaatgtgctcagcaataatcaatgactggagactgagggaaaggatttgacatcatgggctttacaagatcacagaacagattcttctaattggtatcttctactgttataataggggattacagttctagcttttccttgtttatgggattttcgttgtgcttgcttacattttaatgtgtatttcaggtttagcacctgaattagttccatatctcttgcgtgaataatttaacaattctctgtgatgctgcgatcaattatatgattgataattcttgcatcta

SEQ ID NO: 8159 - DNA, 1689 bp, Solanum lycopersicum
gcaaagaccaaagatgtctttatggcggagactggtatatattccccaattcccaccaacaaatcctgaccgttcaattctcaacctcacaataaaaccacagatctcatactcaaagcaaaccctctctcccttttcctccatactcgaacaagccaacaaactcttcttctcgccgcgctttatcatcgttcaattttgactaaattaagcgatcgaagatgtttgggagggcaccgaaaaagagcgacaacacgaagtactatgaaatcttaggtgttcctaaaactgctgcacaagaagatctcaagaaagcttaccgtaaagctgctattaagaatcatcctgataagggaggtgatcctgaaaagtttaaagagcttgcacaagcttatgaggttctgagtgatcccgagaagcgtgagatatatgatcagtatggagaagatgctctcaaggaaggaatgggcggtggaggtggtggacacgacccatttgatattttctcatctttctttggtggcagcccatttggtggaggtggtggaagcagcagaggaagaagacaaagaagaggagaggatgttgtccaccctctcaaagtttctctggaggatctgtacaatggaacatcaaagaagctttcactatctcgcaatgtattgtgcccgaagtgcaaggggaaaggatctaaatcaggtgcttcaatgaagtgttctggctgtcaagggtctggaatgaaagtcactattagacaacttggcccatccatgatccagcagatgcagcacccttgcaacgagtgtaagggtactggtgagatgatcaatgataaagataggtgtgggcagtgtaaaggtgagaaggttgtgcaggagaagaaggtgttggaagttgttgtcgagaagggtatgcagaatggacagaagatcacattcccgggcgaggctgatgaagcacctgataccgtcactggggacatagtttttgtcttgcaacagaaggaacatcccaagtttaagcggaagggagatgatctctttgtagagcacaccttgagcttaaccgaggccctgtgtggtttccagttcatcttgactcacctagataccaggcagctgatcatcaagtcccaacccggagaagttgtcaaacctgatcaatttaaggccataaatgatgaaggaatgccgatgtaccaaaggccatttatgagaggaaaactatacattcacttcaccgtagaattccccgacacattatccctcgagcaatgcaagaaccttgaagcagtattgccaccaaaacccaaaacccaaatgactgatatggaattggacgagtgcgaggagaccacgttacatgatgttaacatcgaagaggagatgcgtaggaagcagcaacaggcccaagaggcatacgacgaagacgatgaagacatgcatggtggtgcacagagagttcaatgtgcacaacagtaatttggtaacacggaattaacgtcacgattcaactcttgttttcacgtatttgtaatgacattactagcttataaatttcgagttttgaatttgctaatctatactgttaacgttacaaacatattattgaaatattttgtcgaagaattgatataaagaggaaataaattggtgtgctttgtcttgtgagaagatgtaatataacatg

SEQ ID NO: 8160 - DNA, 1506 bp, Medicago truncatula
agcatcacgtagttcacaacttcacaattccgttgagatctaacaaaaaagaattcacaaagcttgaaaattagggttaggttttcgacttcgattgtgaaatttgtgagatttgaagatgtttggaagagcccctaagaaaagtgataacactaaatactatgaaattcttggtgtttcgaagaatgcttctcctgatgatttgaagaaagcgtataaaaaagctgcgattaagaatcatcctgataagggtggtgatcctgaaaagttcaaagagcttgcacaagcttatgaggttttgagtgatcctgagaagcgtgaggtatatgatcagtatggtgaagatgctcttaaggaaggaatgggtggcggtggcggtggccatgacccatttgatatattctcatccttctttggtggaggtggatttcctggtggtggtagtagcagaggaaggaggcagagacgtggtgaggatgtcgtccaccccttgaaggtatctttggaggatctttaccttgggacatctaagaagctttctctttcacgaaatgtcttgtgctccaagtgcaatgggaaaggttcaaaatctggtgcttcaatgacctgtgctggttgtcaaggttctggtatgaagatttctatgaggcatttgggtgctaatatgattcagcaaatgcaacatccttgcaatgaatgcaagggtactggagagaccatcagtgacaaagatcgatgcccacagtgcaagggagagaaggtcgttcaacagaagaaagtacttgaagttcatgttgagaagggaatgcaaaatggccagaagatcacattccctggtgaagctgatgaagcgccggatacagttactggggatatcgtctttgtacttcaacagaaggaacaccccaagttcaagagaaagggtgaagatctttttgtagagcacacattgtccctcaccgaggctttgtgtggtttccaattcgcgctgactcatttggattctcgccaactattgattaaatcaaaccctggagaagttgtcaagcctgattcatacaaggcaatcaatgatgaaggaatgccaatgtaccagaggcctttcatgaagggcaagctttacattcacttcactgtggagttccccgagtctctgactcttgatcaggttaaggctttggagacaattctcccagcaaggcctgtatcacagttgacagacatggagctggatgagtgtgaggagacaacacttcatgatgtcaacattgaagaagagacgagaagaaggcagcaagctcagcaagaggcatatgatgaggatgatgaaatgcctggtggtgctcaaagagtacaatgtgctcagcagtaatgagtttggagatatccttcatggatgtgttttagctttggtgggctaaacatagtggtgtcttatcaaatgatttttgaaaaacagtgtagcatttatttccgtataaagatatcctatatggttaattttat

SEQ ID NO: 8161 - DNA, 1566 bp, Lactuca sativa
actatatacctcctaccctcaaattcaatctcctctctcaacacgaacatagccgagtcaagtcttcccgtatcgatctacttcttcgttgatttgtaattgagtattgaagatcgcagaagaagaacaatatgttcggtagagcgcctaagaagagcgataataccaagtattacgagatcctcggggtcccgaagaatgcttcccaggatgatctcaagaaggcttatcgtaaagccgccattaagaatcatcctgataagggaggagatcctgagaagtttaaagagcttgcccaagcatatgaggtattgagtgatccagagaagcgtgagatatatgatcagtatggtgaggacgccttgaaagaaggaatgggtggtggaggcggtggtcatgatccctttgacatcttccagtccttctttggtggtggtaatccctttggaggtgctggtggtagcagcaggggaagaaggcaacgtaggggcgaagatgtcattcaccctcttaaagtatcccttgaggatctctacaatggaacttccaagaaattatctctttcacgtaatgtactctgctccaagtgtaagggaaagggttcaaagtcaggtgcttcaatgaagtgtgcaggttgtcaaggatccggaatgaaagtttccatcagacatcttggcccatctatgatccaacaaatgcaacatccatgtaacgagtgtaagggcactggtgaaaccattaatgataaagatcgctgcacacagtgcaagggtgagaaagttgttcaagagaagaaggttctagaagtccatgtggaaaaggggatgcagaattcccaaaagatcaccttccctggtgaagcagatgaagctcctgacactgttactggtgatattgtgtttgtgttgcaacaaaaagagcatcctaagttcaagcgaaagggtgatgacttgtttgttgagcacacattgagtttaacagaggctctttgtggattccagtttatattaactcatttggatagcagacagcttctcatcaaatcagaacctggagaggttgttaagcctgatcaattcaaggcaataaatgatgagggaatgccgatgtatcagaggccattcatgaaggggaaactgtacatccactttactgttgagttcccggaatcattgtcacctgagcagtgtaaggcgttggagggggtgctgccacctaagccatccatgcagatgacagatatggagttggatgaatgtgaagagacaactctgcatgatgtcaacattgaagaggagatgagaaggaaacagcagcaacaagctcaagaagcttatgatgaagatgatgagatgccaggtggtgcacagagggtacaatgtgcacagcaataagtgttgaaacatggtgatcgtttatagggggtcctgggatgataataatatttggtgtaattgtttttttgttatgttatagtgataaatccggtctatctattttggtaagtgtttaagatgtatggatgatttacttgttctgaacaatgattttgccaagctttttcag

SEQ ID NO: 8162 - DNA, 1810 bp, Aristolochia fimbriata
cgacgctggtccgtgctcgcgttctccgaaattctccccgtagggctttgttggagctcggttgatcgatctgaatccgagcgtttttgggacgagtcggtcgttcaccgactgagattctggggttttgatctcgagaactcgttcgtcctgtaaagggttcgatctcgagaactcggggttcgatctactttttttgacctgcggatacagcatcatcgggttgaaaccgcgggtacaagatgttcggacgggcgcccaagaagagtgatagcactagatactatgagattcttggggtgtcgaagaatgcatcgcaggatgatttgaagaaggcgtacaggaaggcggccatcaagaatcatcctgataagggaggggatcctgagaagttcaaagagctggctcaggcgtatgaggtgttgagtgatcctgagaaacgtgaaatatatgatcagtatggagaagatgctctcaaggaaggaatgggtggcggtggtggtggtcacgacccatttgatatattccagtccttcttcggcggcaacccgtttggaggaggtggaagcagccgcggaagaagacagagaaggggagaggatgtgatgcatcctctgaaagtgtcccttgaagagctatacaatggaacatcgaagaaactctcactttctcgcaatgtcatctgttctaagtgcaaagggaaggggtcaaaatctggtgcttccatgaaatgttctggctgtcaagggtctggcatgaaagtgtctattcggcacttggggccatctatgatacagcagatgcagcatccatgcaatgagtgtaaagggactggggagactatcaatgataaagaccgatgcccacaatgtaagggtgagaaggtcgttcaagaaaagaaagtacttgaggttcatgttgagaaaggaatgcagaatggtcaaaagatcacttttcctggagaagcagatgaagcgcccgatactgttactggtgatattgtcttcatccttcaacagaaagagcatcctaagttcaagaggaagggtgacgatctgtttgtagagcatactctttcccttacagaggccctatgtggttttcagtttgttttgactcatttggacggtagacaattgctgatcaagtcccaacctggcgaagttgttaaacccgatcaattcaaggctatcaatgacgaagggatgccaatgtaccagagacccttcatgaaagggaagctttacatccatttcacagtggagttcccagatacgttgtctccagatcagtgcaaggctcttgagagcgttttgcctccaagggccgggacccagctgacagacatggagctggatgaatgtgaggaaacaaccctgcatgatgtgaatatcgaagaggagatgcgcaggaaacaggcgcatgctcaggaggcttatgacgaagacgatgaccctcatggtggcccccagagggtgcaatgtgctcagcagtagatgcggtgcgggtgggatggatgttattgatatttcaacttggtcgaaagggagacctatcataatgtaggggtagggaactttaccagcagcgtgccaggggcgttctatttgtgtatgcgtaagagtttttatcttttggaaatctatatgattcatttttgttgaacaatgatagaaaagaagacgtttctttgactcgatgttatttgatggtggtatttgtttaagcaattgggataagatttgtctgcgaaattattagggcatcggcgaagaaagaaaacggtgctggacgagtaaattttttctaa

SEQ ID NO: 8163 - DNA, 1958 bp, Vitis vinifera
gaggacggatggaaaagtgcagactattctagaggcttctttcctaacactggtataaaagaatcgatctggaccgtccaaatttttcaataaataaaagacttggtagaccaacgcaaccctcttttgccgtcaagcgtgctctgctctctccgccaagcagatcctctgcaattcctatctccctactcaatctaggttttcttttcaggatcggttcgttttaggggtagatttttcggtggggttgcttggaatcagataaaatgtttggtagggctcccaagaaaagcgataacactaagtactatgatgttcttggagtttccaagaacgcttcgcaggaagatctgaagaaggcgtataggaaggcggcgatcaagaaccaccctgacaagggtggtgacccggagaagtttaaagagttggcacaagcttatgaggtattgagcgacccggagaagcgggagatatatgatcaatacggagaagatgctctgaaagaaggaatgggtggtggcggtggcggccatgacccctttgacatattccaatccttctttggtggcaacccatttggtggtggtggaagcagcagaggccggaggcaaagaaggggggaggatgtcatccacccccttaaggtttctctggaagatctctacaatgggacatccaagaaactgtccctttctcgcaatgtaatctgctcaaagtgcaaggggaaagggtccaagtcaggtgcatcaatgaagtgttctgggtgtcaaggatctgggatgaaagtttctattagacaccttggcccctctatgatccagcaaatgcaacatccttgcaatgagtgtaaaggtacaggtgagaccattaatgacaaggatcgatgcccacagtgtaagggtgagaaggttgtacaagagaagaaagtgttggaagtcattgtagagaaggggatgcaaaatggacagaggataacattccctggagaagctgatgaagcgcctgacacagtcacaggcgacatagttttcgtcctacaacagaaagagcatcctaagttcaagcgtaagggtgatgacttgtttgttgagcacaccttatccctgaccgaggcactctgtggatttcaatttatactgactcatttggatggtagacagcttctcattaaatcccatccaggagaagtggtcaagcctgaccaattcaaggctataaatgacgaaggaatgcccatttaccagaagccattcatgaaggggaaattgtacattcactttgcagtggatttccctgactccctgaacacggatcagtgcaaagctcttgaagcagtgctgcctccgaggacttcaacacagttgactgatatggagattgatgagtgtgaggagactaccttgcatgatgtcaacattgaggaggagatgcggaggaagcaggccgcccaggaggcatatgaagaggatgaggatattcatggtggtgctcagagggtgcagtgtgcccagcaataaatggtgaacaaacctgggggttgaagggggagggggcatgtctaagggtgcaatgggcctcactattaatgctgggtaagcctgaattggggaagagaattttgttgactagcaacaagacaatagacaatggctttcaattgtaggtgttgaagtctggatttggatgcatttgttttgtgtgagcgcgaatacactatttttaagccttttaaagcaatttgagaaacctattattatgttgattttgttgtttattcgtttaggttttttacacatccaaatctcactagtctaatatggttgttttggccattgaatgcatagccatgtccatgagcgtgtgagaagccacgtgtaaataattcgaaacatgtgtgcgttctatgttgtgttcaagtttcttatttatcattgggttatttaattaattaattaaaa

SEQ ID NO: 8164 - DNA, 1753 bp, Vitis vinifera
gaggacggatggaaaagtgcagactattctagaggcttctttcctaacactggtataaaagaatcgatctggaccgtccaaatttttcaataaataaaagacttggtagaccaacgcaaccctcttttgccgtcaagcgtgctctgctctctccgccaagcagatcctctgcaattcctatctccctactcaatctaggttttcttttcaggatcgaggggtagatttttcggtggggttgcttggaatcagataaaatgtttggtagggctcccaagaaaagcgataacactaagtactatgatgttcttggagtttccaagaacgcttcgcaggaagatctgaagaaggcgtataggaaggcggcgatcaagaaccaccctgacaagggtggtgacccggagaagtttaaagagttggcacaagcttatgaggtattgagcgacccggagaagcgggagatatatgatcaatacggagaagatgctctgaaagaaggaatgggtggtggcggtggcggccatgacccctttgacatattccaatccttctttggtggcaacccatttggtggtggtggaagcagcagaggccggaggcaaagaaggggggaggatgtcatccacccccttaaggtttctctggaagatctctacaatgggacatccaagaaactgtccctttctcgcaatgtaatctgctcaaagtgcaaggggaaagggtccaagtcaggtgcatcaatgaagtgttctgggtgtcaaggatctgggatgaaagtttctattagacaccttggcccctctatgatccagcaaatgcaacatccttgcaatgagtgtaaaggtacaggtgagactattaatgacaaggatcgatgcccacagtgtaagggtgagaaggttgtacaagagaagaaagtgttggaagtcattgtagagaaggggatgcaaaatggacagaggataacattccctggagaagctgatgaagcgcctgacacagtcacaggcgacatagttttcgtcctacaacagaaagagcatcctaagttcaagcgtaagggtgatgacttgtttgttgagcacaccttatccctgaccgaggcactctgtggatttcaatttatactgactcatttggatggtagacagcttctcattaaatcccatccaggagaagtggtcaagcctgaccaattcaaggctataaatgacgaaggaatgcccatttaccagaagccattcatgaaggggaaattgtacattcactttgcagtggatttccctgactccctgaacacggatcagtgcaaagctcttgaagcagtgctgcctccgaggacttcaacacagttgactgatatggagattgatgagtgtgaggagactaccttgcatgatgtcaacattgaggaggagatgcggaggaagcaggccgcccaggaggcatatgaagaggatgaggatattcatggtggtgctcagagggtgcagtgtgcccagcaataaatggtgaacaaacctgggggttgaagggggagggggcatgtctaagggtgcaatgggcctcactattaatgctgggtaagcctgaattggggaagagaattttgttgactagcaacaagacaatagacaatggctttcaattgtaggtgttgaagtctggatttggatgcatttgttttgtgtgagcgcgaatacactatttttaagccttttaaagcaatttgagaaacctattattatgttga

SEQ ID NO: 8165 - DNA, 1820 bp, Phaseolus coccineus
ttattggtctggggagggtgttgcttcatctttcgtttgttccgatctagagttttcccttctcgttgttcttcgcttcctcaaactagggtttccaatttcgatccattagagcaagatgtttgggagagcacccaagaagagcgataacacgcggtactacgaaatcctcggcgtctccaagaacgcttcacaggatgatttgaagaaggcttacaagaaagccgccattaagaatcacccggacaagggcggtgatcccgagaagttcaaagagttggctcaagcttatgaggttctgagtgaccctgagaagcgtgaggtatatgatcagtacggtgaagatgcccttaaggaaggaatgggcggtggcggtggccatgatccgtttgatattttttcatctttctttggcggtgggagtccgtttggatcaggtggtagtagtcgaggtaggagacagagacgcggagaagatgtggttcaccctctcaaggtctctctggaggacctttaccttgggacttcaaagaagctgtcgctctccagaaatgtcatatgctccaagtgcactggcaagggttcgaagtctggggcttcgatgaagtgtgctggttgtcaaggaactggtatgaaggtttctataagacaccttggtccatccatgattcagcaaatgcagcatgcttgcaatgaatgtaagggtactggagaaactatcaatgatagagatcgctgcccactgtgcaagggagagaaggttgtgcaggagaagaaagttcttgaagttattgtggaaaagggaatgcagaatggccagaagattacattccctggtgaagctgatgaagcgccggacacaattactggggatatcgtctttgtgcttcagcagaaggagcatcctaaattcagaagaaaggctgaagacctttttgtcgagcacaccttgtcccttactgaggccttgtgtggtttccaatttgtcctgactcacttggatagccgccaacttcttatcaaatctaatcctggggaagttgtcaaaccagattcatacaaggctattaatgatgagggaatgcccatgtaccagaggccattcatgaaggggaagctttatcttcacttcactgtggaatttccagattttctaaatccagaacaggttaaggctttggaggccgttctgccaccaaagcagccttcacagttaacagacatggagctggacgagtgtgaggagaccacacttcatgatgtcaacatggaggatgaaactaggaggaggcagcaacaagctgctcaggaggcatatgaggaggatgatgatatgcctggtggtgcacagagggtacagtgcgcccagcagtgatgacttgtgtggaaggaatgtagaatcagaattatataaaatgaatgatgatgatgatactgttgatgatccgtaactgtagcgtggactatggactaaagacgagtagcgttgtagtagtgtttgattgtgagaaagtgaagaacattaatactgtggaaaggataatttctgttctggcatcctaaatacttctgtttattggtttattttaagcatatttgtttcggttatttaattttattaccatctcatgtttgcgtgtggttgctaatgaattaccgtttcatggttaggcaagacctttttttataaggctaagaagcaataggcgtgttaatgactatgaagagtttttctttctttttcgagtgtttgaagattacagtttattttcgtagttatagaattgtatattttttaattttataatataaagttgatt

SEQ ID NO: 8166 - DNA, 1587 bp, Antirrhinum majus
  misc_feature (34)..(34): n is a, c, g, or t
cttcgcggcggctcccttgtgcaaaacctagaantacgaactagttagttagttagtactaaggaagtagtactagttagtactagtttgggttgaagaagaagaagaagatgtttggtcgggcaccgaagaaaagtgacaacagcaggtactatgaggtcctcggtgtccctaaaacggcggcacctgacgatctcaagaaggcctacaagaaagccgctatcaagaatcaccccgacaaaggcggcgaccctgagaagttcaaagagttagctcatgcttatgaggttctcagtgatcctgaaaaacgtgagatctacgatcagtatggtgaggatgctctcaaggaaggaatgggtggcggcggtgctggaatgcacgacccctttgacatcttctcatccttttttggtgggagtcccttcggaggtggtggcagtaggggacgaagacaaagacggggagaggatgtggttcacccgttgaaggtgtctcttgaagatctttatctcgggagcaccaagaaactctctttgtcgcgaaatgttctttgttccaagtgtagtggtaaaggatcaaaatctggagcatccactaaatgttctgggtgtcgtggatctggtatgaaggtcaccattaggcaacttggcccgggcatgattcagcaaatgcagcacccttgcaacgagtgtaagggaacaggtgaaactattagtgacagagatcgatgcccacagtgcaaaggggagaaggttgttcaggaaaagaaagtcttggaagtccatgttgagaaaggcatgcaaaatggacagaaaatcacattccctggagaagctgatgaggcgcccgatactgtaactggagatatagtatttgtgctccaacagaaggagcatcctaagttcaagagaaagaatggtgacgacctttttgtggagcactccctctcacttaccgaggcattatgtggttttcagtttatattgcctcatcttgatggcaggcaactcctcatcaagtcggagcctggagaagttgtgaagcctgattcttacaaggcggtgaatgatgaaggaatgccgatgtatcagaggcctttcatgaagggtaaactatatattcatttcaatgttgatttccctgattcgttgagtctggatcaagttcaggccttgggaaaaattcttcctgcaaaggcccagccacaattgacggacatggagctggatgagtgtgaggagacaacgctgcatgatgtaaacattgaggatgagcttaggaggaaggctcagcatcaagaagcatatgaagaagatgatgaagatatgcatggcggagctcaaagggtgcaatgcgctcaacagtgatgagtagatgtggaatgtgctagcacatgaaggggccccaagtcgggacaatcagcagggttcaagggcttggagcaatgtctgctttggccttatctttatcctttataatcttgaaacactaatcctctatttttaatctgcttgtaatcataagttaaaattttgtggtcgctgccaacttgcgtgcaatctatggaatatttgcatttgaaaaaaa

SEQ ID NO: 8167 - DNA, 2000 bp, Quercus alba
atggggagaaatcatagtacacctcaataatcaatctccaccgtccatttctctcacttaaaaatcagatccaaaactcattcctacctctctttctctctgtctctctcgccgtctcgctttgcttctgtggctctctcatcatccttttcttgcaattcaagatcgataagaagagaaaatgtttgggagagcaccgaagaaaagtgacaacacgaagtattatgagattctgggagtctcaaagaacgcttcacaggatgatctaaagaaagcttatagaaaagccgccatcaaaaaccatcctgacaaaggtggtgacccagaaaagtttaaagagttggcccaagcttatgaggttctcagtgacccagagaaacgtgagatctatgatcagtatggtgaggatgctctcaaggaaggaatgggtggtggaggtggtggacatgacccatttgacatattccagtcattctttggtggaagcccatttggtggtggtggtggaagcagcagaggccgaaggcaaaggaggggagaggatgtgatccatcctctcaaggtttctctggaagacctctacaatgggacatctaagaagctatccctctctcgtaatgtgatctgctccaagtgcaagggtaaaggctctaaatcaggtgcttcaatgaagtgctctggttgtcaagggtctggaatcaaaatttcaattagacaccttggcccctccatgatccagcaaatgcagcatgcttgcaatgagtgcaagggtactggggagactatcaatgacaaggaccgctgcccacagtgtaagggagagaaggttgttcaggagaagaaagttttggaagtaattgtagagaagggtatgcaaaatggacagaggattacattccctggagaagctgatgaagcgcctgacactaccacaggggacatagtttttgttctacaacagaaagagcaccctaaatttaagcgaaagggtgaagatttatttgtcgaacacacgttgtcccttaccgaggcactctgtggcttccaatttatattgacacatttggatggcaggccgctcctcattaaatctgaaccaggagaagttgttaagcctgaccaatacaaggcaataaatgatgagggaatgccggtgtaccagagggcgttcatgaagggtaaattgtacattcacttcacagttgaatttccagacgccctcaacccagagcagtgcaagtcactggaggctgtgctacctccaaggacgtcagtgcagctgacagacatggagctggatgaatgtgaggagactacactgcatgatgtgaacatagaggatgaaatgcgtcgcaagcaagcacaggcccaagaagcatatgaggaggatgatgatatgcctggtggtgctcagagggtccaatgtgctcaacaatgatgaactaatgagctgatcaacaacaaatagggagagatggagtccacgatttggggaagccaaattactttgagaaaataaatctcaacattatcgtcttgttatagggagtgtgttagattttggtttgggttttgttttttcctttgtttctaaacttatactgtgtggaagatttagtatttaaattcaagtatacatttgagaattatgcctgtttcttgggatgtatatctatatttggatggggttatcgttccatctagatgtgtttcagataggccataagatatttgaccgcttattgcttctagttttgcagttcttttaagccagctagatagaggagccaagtgcaaggagtgagaactgtgatagcattgagatttgttctagagatgtagcgatggtagatctaaaatgatcccagtttcttattcttgtcaatccgtggaagattacaatcaattgaaacagaaaagattctggttttttagtttgatggaccacaatttgacaacaaaattgaacatgtctgttgtacgtacgcagttatattgca

SEQ ID NO: 8168 - DNA, 1522 bp, Fagopyrum esculentum
taaacggtgcaaagaaattcgattctctgctaatctatccctcaagtatccgatctgtgttgaagaagaactttaagatcgaagatgtttggaagagcgccaaagaaaagcgataacactaagtattatgaaattctcggggtttccaaggacgcttcccctgatgatttgaagaaggcgtataagaaagctgccattaagaatcatcccgataaaggcggtgatcctgagaagttcaaagaattggctcaggcttatgaagttctaagtgatccggagaagcgtgagatatatgaccaatacggagaggatgcacttaaggaaggaatgggcggtggaggaggcggccataatccattcgacatatttgaatcgttcttcggtggaaatccatttggaggtggtggtggcagtagcagaggaagaagacaaagaaggggagaagatgtcattcatcctctcaaggtctctctggaagatctttacagcggaacatcgaaaaaactttctctatcacgaaacgttatatgctcaaagtgcaatggtaaaggttcaaaatccggtgcttcaatgacatgcggtggatgtcaaggttctggtatgaaggtctcaatcagacaacttggaccttctatgatccagcaaatgcagcatccttgcaatgaatgtaagggtactggcgaaaccattaacgacaaagatcgttgcccggattgcaagggcgagaaggttgttcaagaaaagaaggtccttgaagtgattgttgagaagggcatgcaacatggacagaagatcacttttcccggagaggcagatgaagctcctgacacaatcacaggagatatagtctttgtattgcaacagaaggatcattccaaattcaagagaaagggtgatgatctcttctatgagcacactttatctctaactgaggctctttgtggcttcaagtttgtcttgacccacttggatggtcgtcagcttctaatcaaatcaaatccaggagaagtcatcaagcctgatcaattcaaggcaattgatgatgagggtatgccaatgtaccagagaccattcatgaagggcaagctgtatgtccacttcacagtagactttcccgactccttgagccctgagcaggttaaagcgctagagactgtattgccaccgagatcaggtagtgagcttaccgacatggagctggacgagtgcgaggagactacactgcatgatgtcaacattgaggaggagatgaggaggaagcaagcccaagctcaggaagcttacgatgaggatgatgagccacatggtgctcagagggtgcagtgtgcacaacagtaacttactgtgggaggattgattggacttaaaaactacaaatgtaatatgatggttactgcattttgagacttgatctttgtatgagtaattttttcttataatgtgcttcgaaaagctgaagaaggatgtttggtagaattgtgtgtttggtttgaatgcagactataaattttttgatactttt

SEQ ID NO: 8169 - DNA, 1505 bp, Flaveria ramosissima
gtacatggggatctttcaactcaacaaactcaagtctccgataggatctacttcttcgcagatttgtaattgagtattgaagatcgaagaaggagagcaggatgtttggaagagcaccgaagaagagtgataacacgaagtattatgagatccttggggtcccgaagaacgcttcacaggatgatctgaagaaggcgtataggaaagccgctattaagaatcatcctgacaaaggtggagatccggagaagtttaaagagctggcccaagcatatgaggtactaagtgacccagagaagcgtgagatatatgatcagtatggtgaagatgccttaaaggaaggaatgggtggtggaggtggtggtcatgacccctttgacattttccaatccttctttggtggtagtcctttcggtggaggcggtggtggtagcagcaggggacgaaggcagcgaaggggtgaagatgttgttcatccccttaaagtctctcttgaggatctttataatggaacttctaagaaactctctctttcacgcaatgtaatctgctccaagtgtaagggcaagggttcaaagtcaggcgcttcaatgaaatgtgctggctgtcaaggttctggaatgaaagtttctatcagacatcttggcccatctatgatccagcaaatgcagcatccttgtaacgaatgcaagggtaccggagaaaccatcaatgataaggatcgatgcacccaatgcaagggtgagaaagttgtgcaggagaagaaagtactggaagtgcatgtggagaagggtatgcagaatggacagaagattacattccctggagaggctgatgaagctcctgacactgttaccggagacattgtgtttgtgttgcaacaaaaggagcaccctaagtttaagcgaaagggtgatgacctttttgtggaacacacattgagcctaaccgaggccctatgtgggttccagtttatcttaacccatttggataaccggcagctcctcatcaaatctcaacctggggaggttgtcaagcctgatcaattcaaggcaataaatgatgaaggaatgccaatgtaccagaggccatttatgagggggaagctatacctccacttcaccgtagaattcccagatacattctcaccagagcagtgcaaggcgttggaggcggtgctgccaccgaagccttcgatgcagatgacagacatggaactggatgaatgcgaagagacgactcttcatgatgtcaacatcgaagaggagatgagaaggaagcaacaagcagctcaagaagcttacgatgaagatgaagatatgcacggtggagcgcagagggttcaatgtgcacaacagtaattgaatcattgttaaggtttggtctgatctggtcatttatcatcttaggttttggcaagacaataacgtcaactgtaattttacattatactgttttgtttgtccgtctgtttggagacctttaggtgtgtggattattgactc

SEQ ID NO: 8170 - DNA, 1375 bp, Flaveria ramosissima
aataatctctcacctctcacccccaaattacaaaccctctcttcacccaacacaatcgacatcttctttcttcaccgatttataatggatatgaagatccgattagaacaggatgtttggtagagcaccgaagaagagcgataacaccaagtattatgagatccttggggtccccaaaaacgcctcacaggatgatctcaagaaggcttatcggaaagccgccattaagaatcatcctgacaagggtggagatcctgagaagtttaaagagcttgcccaagcatatgaggtactgagtgacccagagaagcgtgagatatatgatcagtatggtgaggatgccttgaaggaaggaatgggcggtggaggcggtggccatgacccctttgacatctttcagtctttctttggtggtagtccttttggtggtggtggcggtggtagcagcaggggacgaaggcaacgaaggggagaagacgttgttcatcctctcaaagtgtcccttgaggatctttataacggaacttccaaaaaactctcactttcacgtaacataatctgctccaagtgtaaaggcaagggttcaaaatcaggtgcttcaatgaaatgtgctggctgccaaggttcaggagtgaaagtttccatcagacatcttggtccgtctatgatccaacaaatgcaacatgcttgtaacgagtgtaagggtactggagaaaccatcaatgataaggatcgctgtacacagtgcaagggtgagaaagttgtgcaggagaagaaggttttggaagtacatgtggagaagggcatgcaaaatgggcagaagatcacatttcctggggaggctgatgaagctcccgacactgttactggtgatattgtattcgtgctgcaacaaaaagagcaccctaagtttaagcgaaagggtgatgacttatttgttgagcacacattgagcctgacagaggccctatgtgggttccagtttatcttgacccatttggataacaggcagcttctcattaaatctcagcctggagaggttgtgaagcctgatcaattcaaggcaattaatgacgaaggaatgccaatgtaccagaggccatttatgagggggaagctgtacatccacttcactgttgacttccctgattcattatccccagaacagtgcaaggcgttggaggcggtgctgccacctaagccttcgatggagatgacagacatggagcttgacgagtgtgaggaaacgactcttcatgatgtgaacatcgaagaagagatgagaaggaagcaacaacaagcacaggaggcttatgatgaagatgaagacatgcatggtggagctcagagggtacaatgtgcacaacagtaattt

SEQ ID NO: 8171 - DNA, 1264 bp, Flaveria ramosissima
ttggaagagcaccgaagaagagcgataacacgaagtattatgagatccttggggtcccgaagaacgcttctcaggatgatctgaagaaggcgtataggaaagccgctattaagaatcatcctgacaaaggtggagatccggagaagtttaaagaactagcccaagcatatgaggtactaagtgacccagagaagcgtgagatatatgatcagtatggtgaggatgccttgaaggaaggaatgggtggtggaggtggtggtcatgacccctttgacattttccaatccttctttggtggtagtcctttcggtggaggcggtggtggtagcagcaggggacgaaggcaacgaaggggtgaagacgttgttcatcccctcaaagtctctcttgaggatctttataatggaacttccaagaaactctctctttcacgcaatgtaatctgctccaagtgtaagggcaagggttcaaagtcaggcgcttcaatgaaatgtgctggctgtcaaggttctggaatgaaagtctctatcagacatcttggcccatctatgatccagcaaatgcagcatccttgtaatgaatgcaagggtaccggagaaaccatcaatgataaggatcgatgcgcccaatgcaagggtgagaaagtcgtgcaggagaagaaggtactggaagtgcatgtggagaagggtatgcagaatggacagaagattacattccctggagaggctgatgaagctcctgacactgttactggagacattgtgtttgtgttgcaacaaaaggagcaccctaagtttaagcgaaagggtgatgacctttttgtggaacacacattgagcctaaccgaggccctatgtgggttccagtttatcttaacccatctggataaccgacagctcctcatcaaatctcaacctggggaggttgtcaagccagatcaattcaaggcaataaatgatgaaggaatgccaatgtaccagaggccatttatgagggggaagctatatctccatttcaccgtagaattcccagattcattatcaccggagcagtgcaaggcgttggaggcggtgctgccaccaaagccttcgatgcagatgacagacatggaactggatgaatgcgaagagacgactcttcatgatgtcaacattgaagaggagatgagaaggaagcaacaagcagctcaagaagcttatgatgaagatgaagatatgcatggtggagcgcagagggttcaatgtgcacaacagtaatagaatca

SEQ ID NO: 8172 - DNA, 1668 bp, Humulus lupulus
tttcgctctcgccgtctcgcgttgatactctttctctcgctctctatctttgctctccttacacgaaggaaagggaataataatcgactttgcattctccttagggtttggaatagaattataagagaggatgtttgggagaggaccaaagaaaagtgataacaccaagtactatgaggtcttgggcgtttctaagaacgcttcgcaagatgatctgaaaaaggcttatcgtaaagctgctattaagaatcatcctgacaagggtggtgatccagagaagtttaaggagttggctcaagcatacgaggttttgagtgacccagagaagcgtgagatctacgatcagtatggtgaggatgccctcaaggagggaatgggtggtggaggtggtggccacgacccatttgatatattccaatcattctttggtggcagcccatttggtggtggtggtgggagtagcagaggccgaagacagagaaggggagaggatgtaattcatcctcttaaggtttcattggaagacctttataatggcacatcaaagaaactttccctttctcgcaatgtactttgctctaagtgcaagggtaagggctcaaagtctggtgcttcaatgaagtgtcctgtctgtcaaggttctggaatgaagatttccattagacagcttggtccttctatgattcaacaaatgcaacatccttgcaatgagtgcaaaggtactggtgagaccataaatgataaggatcgctgcacacaatgcaaaggcgataaggttgtccaagagaagaaagtcttggaagttaatgtggaaaagggtatgcaaaatggacaaaggattacattccctggggaagctgatgaagctcctgatactgttactggagatattgtatttatcttacaacagaaagagcaccccaagtataaacgaaagggcgacgacatattttatgagcataccctgagccttacagaggcactatgcggctttcaatttattttaacacatttagatggcaggcaactccttattaaatctcaacctggagaagttgtcaagcctgagcaatttaaggccataaatgacgagggaatgccaatgtaccagaggcccttcatgaagggcaaattatatattcacttcactgtcgaatttccagactctttaagcccagagcaatgcaaggcccttgagactgtgttgcccccaagggcaggagttcagcttacggacatggagatagacgagtgcgaggagaccacaatgcacgatgtaaacattgaggaggagatgcgccgcaagcaagctcaggcgcaagaagcttatgacgaggatgatgacatgcacggtggtggtggtgctcaaagggtgcaatgtgctcagcaatgatgagagggatgtagcgtgagtgatgcttaacaaattatttgtgagaaataaacagttgtttctcctttccttataggttttctctttcttttcttttgcccctttttagaattttaattatgcttcgggaggttttaccctttactgtttgcaaaaaccttattgtgctggagtctagaaatagtctctctcagacctctattaagatatatgcttggtttgttcatctgctcctagaagagacgtgaattattatattagtgaatggacctgtt

SEQ ID NO: 8173 - DNA, 1681 bp, Humulus lupulus
tttcgctctcgccgtctcgcgttgatactctttctctcgctctctatctttgctctccttactcgaaggaaagggaataataatcgactttgcatactccttagggtttggaatagaattataagagaggatgtttgggagaggaccaaagaaaagtgataacaccaagtactatgaggtcttgggcgtttctaagaacgcttcgcaagatgatctgaagaaggcttatcgtaaagctgctattaagaatcaccctgacaagggtggtgatccagagaagtttaaggagttggctcaagcatacgaggttttgagtgacccggagaagcgtgagatctacgatcagtatggtgaggatgccctcaaggagggaatgggtggtggaggtggtggccatgacccatttgatatattccaatccttctttggtggcagcccatttggtggtggtggtgggagtagcagaggccgaagacagagaaggggagaggatgtaattcatcctcttaaggtttcattggaagacctttataatggaacatcaaagaaactttccctttctcgcaatgtactttgctctaagtgcaagggtaagggctcaaagtctggtgcttcaatgaagtgtcctgtctgtcaaggttctggaatgaagatttccattagacagcttggtccttctatgattcaacaaatgcagcatccttgcaatgagtgcaaaggtactggtgagaccataaatgataaggatcgctgcacacaatgcaaaggcgataaggttgtccaagagaagaaagtcttggaagttaatgtggaaaagggtatgcaaaatggacaaaggattacattccctggggaagctgatgaagctcctgatactgttactggagatattgtatttatcttacaacagaaagagcaccccaagtataaacgaaagggcgatgacatattttatgagcataccctgagccttacagaggcactatgcggctttcaatttattttaacacatttagatggcaggcaactccttattaaatcccaacctggagaagttgtcaagcctgagcaattcaaggccataaatgacgagggaatgccaatgtaccagaggcccttcatgaagggcaaattatatattcacttcaccgtggaatttccagactctttaagcccagagcaatgcaaggcccttgagactgtgttgcctccaagggcaggagttcagcttacggacatggagatagatgagtgcgaggagaccacaatgcacgatgtaaacattgaggaggagatgcgccgcaagcaagctcaggctcaagaagcatatgatgaggatgatgacatgcacggtggtggtggtgctcaaagggtgcaatgtgctcagcaatgatgagagggatgtagcgtgagtgatgcttaacaaattatttgtgagaaataaacagttgttaacattgtttctcctttccttataggttttctctttcttttcttttgcctctttttagaattttaattatgcgtcgggaggttttaccctctgtttgcaaaaaccttattgtgctggagtctagaaatagtctctctcagacctctattaagatatatgcttggtttgttcatctgctcctagaagagacatgaatgtgttattatattagtgaatggacctgttgca

SEQ ID NO: 8174 - DNA, 1483 bp, Helianthus annuus
acaccaccagtcaaatcttcctcttccgatcttcttcctcagtttgtaactgaataattctgagaatcgaagaagaaggtaaggatgtttggaagagcaccgaagaagagcgataacaccaagtattatgagatccttggggtccctaaaaacgcctcacaggatgatctcaagaaggcttatcgtaaagccgccattaagaatcaccccgacaaaggtggagatcctgaaaagttcaaagagcttgctcaagcatatgaggtgctgagtgatccagagaagcgtgagatatatgatgaatatggtgaggatgctttgaaggaaggaatgggaggtggaggtggtggtcatgacccctttgacatctttcaatctttttttggtggtggtggaggtggtagcagcaggggaagacgtcaacgaaggggagaagacgtcgttcatcctctcaaagtttctcttgaggatctctataatggaacttccaaaaagctctctctttcacgtaatgttatctgctccaagtgtaagggtaagggttcaaaatctggtgcttcaatgaaatgtgctggctgtcaaggttcaggaatgaaagtttctatcagacatctcggcccatcaatgatccagcaaatgcaacatccttgtaacgagtgcaagggtaccggagaaaccatcaacgataaggatcgctgtacacagtgcaagggtgagaaagttgttcaggagaagaaggtgcttgaagtacatgtggaaaagggcatgcaaaatgggcagaagatcacattccctggagaggctgatgaagctcctgacacagtcacaggtgatattgtgtttgtgctgcaacaaaaagagcaccccaagtttaagcgaaagggtgatgacatatttgttgagcacacattgagcttgacagaggctctgtgcgggttccagtttgttttgacccatttggataacagacagcttctcatcaaatctcaacctggagaggttgtgaagcctgaccaattcaaggcgataaatgatgaaggaatgccaatgtaccagaggccattcatgagggggaagctttacatccactttactgtggacttccctgattcattatctccggaacagtgcaaggcgttagagggggtgctgccacctaagccttcgcagcagttgacagacatggagctggatgaatgtgaggaaacaacgttgcatgatgtcaacattgaagaagagatgagaaggaagcagcaacaacaagctcaagaagcatatgatgaagatgaagaagacatgcatggtggagctcagagggtacaatgtgcacagcagtagttgactcatcaatatggtctggtctggtactctggtctagcgtctgatatcaactgtgattttgtttcttttttaactttatatataaaaactgcaaaatgtgttgtatgaatgatttaaaaattaaaatattattacttgttttgag

SEQ ID NO: 8175 - DNA, 1568 bp, Vigna unguiculata
  misc_feature (721)..(721): n is a, c, g, or t
tccttggagatctagtgcagccacaacacgcggatctcggtgaaaattagggttagggattcggaggtagaagaacaagatgtttgggagagcgcccaagaaaagcgacagcactaggtactatgaaatccttggcgtcgccaagaacgcgtcgcaggaggatttgaaaaaggcttataagaaagccgccataaaaaatcaccctgacaaaggcggtgatcccgagaagttcaaggagcttgctcaagcctatgaggttctgagtgaccctgagaaacgtgagatttacgatacttacggtgaagatgctcttaaggagggaatgggtggcggcggcggtggccacgatccgtttgatatcttcagttcgttctttggtggaaatccgtttgctgggggtggtagcggtagaggaaggaggcagagacggggagaagatgtggttcaccctctgaaggtctctctggaggatctttatcttggaacgtctaagaaactctctctttcacgaaacgtgttgtgttcaaaatgcaatgggaagggatcgaagtctggggcttcaatgacttgtgctggttgccagggtactggtatgaagttgtcgatcaggcaccttggtccttctatgattcagcaaatgcaacatccttgcaatgagtgtaagggcaccggagagaccatcagtgacagagaccgatgcactcaatgcaagggagagaangttgttcaggagaagaaagtacttgaagtagttgtggagaaagggatgcagaatggacagaagattacattccctggggaagctgatgaagcacctgatacaatcactggggatattgtatttgtcctgcaacagaaggaacatccaaagttcaaaagaaaggctgaagacctttttgtcgaacatactttgtctctcactgaggctctatgtggtttccagtttgtgttggctcacttggatggtcgacaactccttatcaaatcaaaccctggggaggttgtcaagcctgattcatacaaagctataaacgatgagggaatgccaatgtaccagaggccgttcatgaaggggagactatacattcatttcactgtggaatttcctgattctctgagccttgatcaggtgaaggccatagaggctgttttgccagcaaagacttcatcacaaaagttgacagacatggagctggatgagtgtgaagagactacacttcatgatgtgaacatggaggaagaatcaaggaggaggcaacaaagttcgcaggaggcgtacgaggaggatgaggacatccatggtggtgctcagagagtacaatgcgctcagcagtaatgaatggaccataggggcagatcggaggagtagtgttgatgatcttgatatcatttttaaacataatttgtgtttgatcaatcgattttgacaaccaaacaccttaccatttattcttcgacaaattattttacagaagccatctaaatacaatatattttttttctactctgcctactactgtctcttccattcttttcatttatcgctatgcaagaaactcttttcttta

SEQ ID NO: 8176 - DNA, 2367 bp, Theobroma cacao
tattatgacattcacaattattaaaataaattcacaattatttaaaaaattttacagacccgttatggagggtaggttctcatagtttatttaattataaacaaaataataatgtagaaatatataaatcaggtttcttagaaaggagtacttgaaaatgactcaaaggaataagcttccctttgggattctttgccaagaaactcccccaccgccacccacagtttgtttttcattcaacaacaaatgaaacatatcaacggcccaggttgggcctcaatcgatgagaattggagagaattctagatccttccgtaattcatttccaatgccaataaaagcacatacctttcggccacctctcaaagtatttcaacctttagatctggaccgtccattttctctcctataactcaatctctaaccgcacgctcttcctctttctctttttctctctcgctctctgtttctctcgccgtctcgcgtccgctcttgtggctctctgcaaccttctcatatctattcaggatctataaaaagagaagaaagatgtttgggagagcaccgaagaaaagcgataataccaaatactatgagatattgggagtatccaaaaacgcctctcaagatgatttgaagaaggcttacagaaaagctgctatcaagaaccatcctgataagggtggtgaccctgagaagtttaaagagttggctcaagcttatgaggtgctgagtgacccggagaagcgtgagatttatgatcagtatggcgaggacgcccttaaagaaggaatgggtggaggtggtggtggccatgacccatttgacatcttccaatccttctttggtggcaatccttttggtggtggtggaagcagcagaggccgaagacaaagaaggggagaggatgtgatccatcccctcaaggtttctttagaagatctctacaacggaacatccaaaaagctttctctttcacgcaacataatttgcttcaagtgcaagggtaagggatctaagtctggtgcatcaatgaaatgttctggttgtcaagggtctgggatgaaagtctccatcagacaccttggtccttccatgatccaacagatgcagcatccttgcaatgagtgtaagggtactggtgagaccatcaatgacaaggatcgctgcccacagtgcaagggtgagaaggttgtgcaggagaagaaagtcttggaagttattgttgaaaagggtatgcaaaacggacagaggattactttcccaggagaagctgatgaagcacctgacacagtcactggagacattgtatttgtcctacaacagaaagaacatcccaaatttaaaagaaagggtgatgacttgtttgtagagcatacattgacacttactgaggcactatgtggctttcagtttattctgactcacttggatggcagacaactcctcattaaatcacaacctggggaagtggttaagcctgatcaattcaaggctataaatgatgaaggaatgccaatgtatcaaaggccattcatgaggggtaaactttacattcacttcaccgttgatttccccgattccttgatccctgaccagtgcaaggcattagaggctgtgctacctccaaggacctcagtccagctgactgacatggagctggatgagtgcgaggaaaccactctgcatgatgttaacattgaggaagagatgcgtaggaaacaggcacaggctcaagaggcttatgaggaagatgaggacatgcatggtggtgcccagagggtacaatgcgctcagcaatgatagaactgatgtcagtaacagtggtttggctgaggaaatggacggaatggtttaacaaaattatttgagaacaagattctcaacattgttggcttttgttagtccttttttagagtgcaagtcttatttaatggaatacttgttatgctttcaaaactgataatgtatggaaagaattagctttggaactttacctacttgtttttgtacacaacctattgccgattgtggagtgagatccttttttgttttttttttttgtcatttttccttttaaatttagaaactaagttttaggctgtgaaaaattttaatatgtcaagtggacctaggaaatagggtttaaattataaaatgtattttaaagagtgggtttttaggtattttctaatatattgttagtgggtttttaagtatttataatctcataatttttcaaaagaattaaacttttataaattggcaattcatattaacgagttgtaaacatgtactttaagtgtaagggtgtaataaattagttaatatgaacatgataagattaattaaatgtaagactagata

SEQ ID NO: 8177 - DNA, 3644 bp, Zingiber officinale
gcggcctcttcctcctcttcctccgtgggcgcgattaggccttgccgcagtgggtattgtacagattggaggacgactaggccactgagtttgtgttttttttcgcttcttcacgatttttgtttgatcggttaagatttcgtcggcaagatgtttgggagggggccgaacaagagcgataataccaggtactacgaggtccttggggttccgaagacagcttcgcaagaggatctcaagaaggcttatcggaaggctgctatcaagaaccatcctgataagggaggcgatcccgagaagttcaaggagttggctcaggcttatgaggttctaagtgaccctgagaagcgtgaaatctatgatcagtatggcgaagatgccctgaaggagggaatgggcggtggcggcggccacaatccatttgatatcttcgaatcattttttggagggagtccttttggaggaggtggtagcagccgtggacgaaggcaaaggaggggagatgatgttatccatcctcttaaggtgtcattggaagatctgtacaatggaacttctaagaagctgtctctttctcgtaatgtcatctgtcaaaaatgcagcgggaagggttctaagtctggtgcttcggctaagtgctctggctgtcaaggttctggcatgaaggtaacaattcggcagttggggcctggcatgatacaacaaatgcaacacccttgcaatgaatgtaaggggactggggagacgatcaatgagaaggaccgatgtccaaaatgtaaaggtgagaaggttgtgcaggaaaagaaagtattggaggttgtggtcgagaagggtatgcagaatggccaaaagataaccttccctggagaggcagatgaagcacccgatacagtgactggagacattgtgtttgtccttcaacaaaaggaacacccaaaattcaagagaaagggtgacgatctcttttatgagcacacactatccctcactgaagctctctgcggcttccaatttattttgacccatttggataacagacaattgcttatcaagtcgaatcccggtgaagttgtaaagcctgatcaattcaaagcaataaacgatgagggcatgcctatgtaccagaggcccttcatgaaagggaagctgtacatccatttcagtgtcgacttccctgattcattgacaccagatcagtgcaaagctctcgaggcagtgctaccgccgaagcctggtgcacagatgactgacatggagcttgatgagtgcgaagaaacaacattacatgatgtcaatatcgaggaagaaatgcggaggaagcaagctcaggcacaggaagcctacgaggaagatgacgacggccctggaggtggtgcccagagagtgcagtgtgcacagcaataagcagaatacatacgaatacctctaaaatctactgttactttttgttcctgcttctgttaaattgcggtagcgattttagcaatgtaatgtactgagcagaatcttgactatctttgggtttgttaatgcttggattggctttacctgaagcgagcgattcaggattacaaggtgaaataagagttctgaagcgagcgattgaggattacaaggcgtctcatgaatagttgagttgatgctcatccatctcccatggagtttcatggattcactgatgaagacacatcctacgaatacccatcgtcgtcgaggaatacggcgttcacgaattggtcaatcgattccatcaaattaggtttcgacgactcccccaactcgccgctctccggtcagtttgactgcgatggttggagtcatcttccggtggatgctcaggcgccggcctattccagacagaaaatgaggcgcgctctgcaacaaatcgaaaccgatctcatgctgcctgacccagaagaaccagcgaccagcacgagtctcgaatcgagcgagaagcagcaagatcaggccgcgaagcagtttcgtgtgcggccgaggactggcggcgcaccgccggagttgcgccatccggagaaacgactgagagaatcgaagagtccgtcgggcgacgatctgcgacagcttctgatcaggtgcgctgaatctctgtcggagaacgacatggaggagttcgaatcgctggtcagagaagctcgaggcgtggtttcgatcgccggagagccgatccaacgcctgggcgcgtacatgctcgaaggcctggttgctcggcgtgagaattctgggacgaatatctatcgcgccatgaggtgcgacgaaccagagaacaaggagctgctctcgttcatacgcatcttgtacgacatctgcccctacttcaagttcggatacatggcggcgaacggcgccatcgccgacgctatcagaaacgaagacagagtccacatcatcgacttccagatccgtcagggcacccaatggatcacgctgatacaggcgctggcagcgaggccgggaggtccgccgcgcattcggatcaccgggatcgatgactcggtgtcggagtatgccaggggagagagcttgcagttggtcgggaagatgttgatggagctgtcgaagaagttcagcattccgctggagtttaaaggcctgccggtgtacggccccgatgtgactcgggagatgctggacatccggccgggggaagcggtggcggtgaacttcactctgcagctgcaccacacgccggacgagagcgtcgacgagaacaacccgcgcgaccggctgctgcggctggtgagggcactgtccccgaaagtgatgaccctggtggagcaggagtcgaacaccaacacgacgccgttcgcgacgcggttcgcggagacgctggactactactccgccatgttcgagtcgattgacgcggcggtggcgagggacagcaaggagaggatcggcgtggagcagcactgcctggccaaggacatcgtcaacgtgatcgcctgcgaggggaaagaaagggtggagaggcacgagctgctggggaagtggcggtcaaggctgagcatggcagggttccggccttacccgctgagcgcgtacgtgaactcggtgatcaggatgctgctgggttgctactccgataagtacacgctggtggagaaggatggtgctctgttgctgggctggaagaacaggaacctcatctccgcatctgcttggcactgatccaatcatcatgcatcatcgtaaaatccattctgtacctcgttgcaaatctaaatcgataaagtatgtttgttgatacgggacgggagacgaccggtccttcagccggtaggatatagggagtttgatgtcctacttttgaattaggaagttagtatggctggtcagttaatagccaattaagtttaaaggatttctgacccacctcacaagcgattgatcataggtctggtggagagaatgatcaaacttcttaatctgcacaagcctctttacacatgcccgggtaaccctattacttgttattcctatgggtttccacatgaaaatatgtcagtgtattcgttcggtaatagaatcggacgggtttaagtggccccataacccgggcctgaggtgcttacacgcccgaccatacaaagttagccgagcttaagacacttagcttcatatta

SEQ ID NO: 8178 - DNA, 1761 bp, Euphorbia peplus
tggcctgtctcgcgtctgtctctgtggctctctctgaagctgaatctttcaatccttgatctttgattgattgattaggtcaaaagagagaactagagatgttcggaagagcaccgaagaaaagtgataacacaaagtactatgagattctcggagtctcaaagagcgcttcgcaggatgatctaaagaaggcttacagaaaagctgccatcaagaaccatcctgataagggtggcgatccagaaaagttcaaggagttggcccaagcttatgaagttttaagtgacccagaaaaacgtgagatatatgatcagtatggtgaggatgctctcaaggaaggaatgggtggtggtggtggtggtcatgacccgttcgacatattccaatccttctttggtggcagtccatttggcggtggtggtagcagcagaggacgtagacagaggaggggtgaggatgtgacacatcctcttaaagtttccttggaagacctctacaatggcacctccaagaagctatctttatcacgaaatgtaatctgctcaaagtgcaaaggtaaagggtccaagtcaggtgcatctatgaaatgttcaggttgccaaggttctggaatgaaagtgtccattagacagcttggtccctccatgatccaacaaatgcagcatgcttgcaatgagtgtaagggtactggggagaccattaatgataaggatcggtgccctcaatgcaagggtgagaaggttgtccaggagaagaaagttttggaagtcattgttgagaagggtatgcaaaatggacaaaagattacattccctggagaagctgatgaagctcctgatactattacaggggatatagtttttatcctacagcaaagggagcatcctaagtttaaacgaaggggagatgacctaattgttgagcacaccttgtctcttacagaggctctctgtggtttccagtttatattgacccatttagatggaaggcagctcctcataaagtctcagcctggtgaagttgtgaagcctgatcaattcaaggctataaatgatgaggggatgccaatctaccagaggccatttatgagggggaagttgtacattcattttaatgttgaattcccagattctcttcccccagaacagtccaaagccttggaggctgtgcttccgtctagaactgcagttcaattgtcagatatggagctggatgaatgtgaggagaccactttgcatgatgtcaactttgaggaggagatgcggcgaaagcaacaacagagtgcagaggcatatgatgaagatgaagatatgcatggtggcgcccagagagtgcaatgcgcacagcagtaaggtaacaaatacagaggaatcaatgcccagattgatccggtaagatagttgtttgagaataagattctcaaaagcatacactggtatatcttgtaaaagagcttagaggcgccgggtccggcatgaaaactcaatttaatgtttgcagaatgtaaggacgagtgtttgaactatgtagggattatcatgaacaaacaactatgccatctttctttaataatttttcgcgtgtaatcttttatgtaatttggattgatagcttgccatatagtaattttttcccgtgctaatttggctgtaataggttttcaattaataatcctttgtcttaacttgggagtctggtgatttgggctttggatgaggcccgatctattatagattcgatcttgagaatttttctcttcaa

SEQ ID NO: 8179 - DNA, 1725 bp, Orobanche aegyptiaca
ccgtagacaaattctctatatattaaccctactccctcccgtgtttttcgagtccctttctctctcttgttttctacgcggccctgttctctctttctttaaattgtggaaaacctattcgcaaaattctcgatcttccgtgcgaatcagctcgatcggtcttgatttagcgactttttgtaagcaatttgaagatgtttgggagggctccgaagaaaagtgataattcaaagtactatgagatcctcggagtgcctaaaacggcgacgcccgatgatttgaagaaggcgtacaagaaagccgctataaagaatcaccccgataagggtggtgaccctgaaaagttcaaggagcttgctcatgcttatgagatcttaagcgatcccgagaaacgtgaaatttacgaccagtatggcgaggatgcactcaagcaagatatgggtggtggcggtggcatgcacgatccatttgacatcttctcgtctttctttggtgggagtccttttggaggtggtggtagcagtaggggacgaaggcaaagacggggtgaggatgttgtacatccattaaaggtgtctcttgaggatgtttatcttgggaccacaaagaaactctccttatcccgcaatgtactctgttcaaagtgcaatggcaagggatcaaaatctggtgcttcgttgaagtgtccgggttgtcaaggagctggtatgaaggtttctattaggcagcttggccccgggatgatccagcaaatgcagcacccctgtaatgaatgcaaaggaactggggaaactatcagtgacaaggataggtgcacgcattgcaaaggtgagaaggttgctcaggaaaagaaggttctggaagtccatgttgaaaagggcatgcaaaatgggcagaagataacattcccgggggaggctgatgaggcgcctgatactgtcactggggatatagtgtttgtgctgcagcagaaggagcatcctaaatttaagaggaagggtgatgatcttttcgtggagcatactctgtcacttgctgaggctttgtgtggtttccagtttattttgtctcatctagacagcaggcagttactcatcaaatcccaacccggagaagttgtgaagcctaattcatacaaggctatcaatgatgaggggatgccaatgtatcaaagaccattcatgaagggcagactgtatatccacttcaatgttgagttcccggactcccttggcgtggatcaagtagaggccttgtccaaaatctttccggcaaaggcccaatcccagttgacagatatggagatcgacgagtgcgaggagacaacactccatgatgtcaacattgaagatgagatgaggaggaaagctcaacagcaccaggaagcatatgacgaggacgatgaggacatgcatggtggggcccagagggtccagtgtgcccaacagtgatgggtttgatttaatttggaccgtcttgcctttccttgatctttttatttgaatactgcgaaaaaagtggttatgttggggaatactgtagtagttattttcaaatgcaattttgtgctgaatacagaatgcatggtgtgatcttttttataatgtgggacaaaaatgaagcattgtttgagctcggttataccggttagtatttgattaacaatattaaatgtggctgaagtgcttatgtaaaaatgtgtgcaccctctccttgactaaaaaa

SEQ ID NO: 8180 - DNA, 1578 bp, Lactuca sativa
actatatacctcccaccctcaaattccaatcccctctctcaacacaaacatagccgagtcaagtcttcccgtatcgatctacttcttcgttgatttgtaattgaatattgaagatcgcagaagaacaggatgttcggaagagcaccgaagaagagcgataatacgaagtattacgagatcctcggggtcccgaagaatgcttcccaggatgatctcaagaaggcttatcgtaaagccgccattaagaatcatcctgataagggaggagatcccgaaaagtttaaagagcttgcccaagcatatgaggtattgagtgacccagagaagcgtgagatatacgatcagtatggtgaggatgccttgaaggaaggaatgggtggtggaggtggtggtcatgatccctttgacatcttccaatctttctttggtggtggtaatccctttggaggtggtggtggtggcagcagcaggggtcgtaggcaaagaaggggcgaagatgtcattcacccccttaaagtttcccttgaagacctctacaatggaacttccaagaaactatctctttcacgtaatgtaatctgctccaagtgtaagggaaagggttcaaagtcaggtgcttcaatgaagtgtgcaggctgtcaaggttcaggaatgaaagtctccatcagacatcttggcccatctatgatccaacaaatgcagcatccttgtaacgagtgcaaggggactggtgaaaccatcaatgataaagatcgctgtacacagtgcaaaggtgagaaagttgttcaagagaagaaggttctagaagtccatgtggagaagggcatgcagaattcccagaagattaccttccctggtgaagcagatgaagctcctgacacggttacaggtgatattgtgtttgtgttgcaacaaaaggagcaccctaaatttaagcgaaagggtgatgacttgtttgttgagcacacattgagtttaaccgaggctctgtgtgggttccagttcatattaactcatttggatagcagacagcttctcatcaaatcggaacctggggaggtcgttaagcctgatcaattcaaggcgataaatgatgagggtatgccaatgtatcagaggccattcatgaaggggaagctgtacatccactttactgttgagttcccggaatctttgtcacctgagcagtgtaaggcgttggagggggtgctgccacctaagccttccatgcagatgacagatatggagttggatgaatgtgaagagacaactctgcatgatgtcaacattgaagaggagatgagaaggaaacagcagcaacaagctcaagaagcttatgatgaagatgaagatatgcatggtggtgcacagagggtacaatgtgcacagcaatgaagatgtgcattgaaagatggtgctcgtttatagggggttctgggaagataataatgtatctggtgtaatttttatttttttgttatgttatagtgataaatccggtctatctattttgttaagtgtttaagatgtatggatgatttactcgttttgaacaatgattttgcgaagctttttcag

SEQ ID NO: 8181 - DNA, 1542 bp, Ambrosia trifida
cacaagtctcttataagtcttcctcttccgatctacttcttctcagtttgtaactgactactgagaatcaaagaagaaggtcaggatgtttggaagagcaccgaaaaagagcgataacacaaagtattatgagatccttggtgtccctaaaaacgcatcacaggatgatctcaagaaggcttataggaaagctgctattaagaatcatcctgacaagggtggagatcctgagaagtttaaagagctcgcccaagcatacgaggtactgagtgatcccgagaagcgtgagatatatgacgagtatggtgaggatgccttgaaggaaggaatgggaggcggcggtggcggtcatgacccctttgacatcttttcatctttctttggtggtggtggaggtggtagcagcaggggacgaagacaacgaaggggagaagatgtcgttcatcctctcaaagtttctcttgaggatctctataatggaacttctaaaaagctctctctttcacgtaatgttatctgctccaagtgtaagggcaagggttcaaagtccggtgcttcaatgaaatgtgctggatgtcaaggttcaggaatgaaagtttccatcagacatcttggcccatctatgatacagcaaatgcagcatccttgtaatgagtgcaagggtactggggaaaccatcaacgataaggatcgctgcacgcaatgcaagggtgagaaagttgttcaggagaagaaagtgcttgaagtacatgtggagaagggcatgcaaaatgggcagaagataacatttcctggagaggctgatgaagcccctgacaccgttacaggtgatatagtgtttgtgttgcaacaaaaagagcaccctaagtttaagcgaaagggtgatgacatattttttgagcacacgttgagcttgacagaggctctgtgcgggttccagtttgtcctgacccatctggataacagacagcttctcataaaatctcaacctggagaggttgtgaagcctgatcaatttaaggcaataaatgatgaaggaatgccaatgtaccagaggccatttatgaggggcaagctgtacatccacttcactgtggacttccctgattcattatcccctgaacagtgcaaagcgttagaggcagtgctaccacctaagccgtcgcagcagatgacagacatggagctggacgaatgtgaggagacaacattgcacgatgtcaacatcgaagaagagatgagaaggaagcaacaacaagcagctcaagaagcttatgatgaagatgaagacatgcatggtggagcccagagggtacaatgtgcacagcagtagtggattcatcaatttggtctggtttggtactccggtctagtgtctgatatcagctgtgattgtttctttttttacttaaaatatgaaactgcaaaatgtgttgtatgaatgatttaaaattaaagtgttattacttgttttatgttctgctgttaatgaactgcttaaggccccttctttcttctatattacatggtttctctaaaaga

SEQ ID NO: 8182 - DNA, 1452 bp, Ambrosia trifida
gacatagaagcagacggagtattctagaggcttctttataacatcatcgaacacaatatagaccgtctacccctctcctttacaaatcacaagtcaagtcttcccaatcacaatcacaatcacaatcacgatcttattcttcaccgatttgtaatttgatattaaaaccaaagatccagtcaggatgtttggaagagcaccaaagaagagcgataacacaaagtattatgagatccttggagtccctaaaaacgcatcacaggatgatctaaagaaggcttatagaaaagctgctattaagaatcatcctgacaagggtggtgatcctgagaagtttaaagagcttgcccaagcatatgaggtactgagtgacccagagaagcgtgagatatatgacgagtatggtgaggatgccttgaaggaaggaatgggcggtggcggtggcggtcatgacccctttgacatcttttcatctttctttggtggtagtccttttggtggtggtggcggtggtagcagcaggggacgaaggcaacgacgcggagaagatgttgttcatcctctcaaagtatctcttgaggatctgtataatggaacttccaggaaactctctctttcacgtaatgtaatctgctctaagtgtaaaggcaagggttcgaagtccggtgcttcaatgaaatgcgctggctgccaaggttctggaatgaaagtatctatcaggcatcttggaccgtctatgatccagcaaatgcaacatccatgtaatgagtgcaagggtaccggagaaaccatcaatgataaggatcgttgttcgcagtgcaagggtgagaaagttgttcaggagaagaaggttctggaagtacatgtggagaagggcatgcaaaacgggcagaagattacgtttcctggagaggctgatgaagctcctgacacagttacaggtgatattgtgtttgtgttgcaacaaaaggagcaccctaagtttaagcgtaagggtgatgacctatttgttgagcaaacattgagcttgacagaggcgctttgcgggttccagtttgtcttgacccatttggataacagacagcttctcatcaaatctcagcctggagaggtggtgaagcctgatcaatttaaggcgataaatgatgaaggaatgccaatgtaccagaggccatttatgagggggaagctgtacatccacttcactgtggacttccctgattcgttgtcccctgaacagtgcaaggcgttagaagcagtgctaccacctaagtcttcacagcagatgacagacatggaactggacgaatgcgaggaaacaactttgcatgatgtcaacattgaagaagagatgagaaggaagcaacaacaagctcaagaagcttatgatgaagacgaagacatgccgggtggtgctcagagggtacaatgtgcccaacaataattcaatca

SEQ ID NO: 8183 - DNA, 1481 bp, Chelidonium majus
gggatttcttatttaatttgaattaaagatgtttggccgaggagcacccaagaaaagtgataacaccaagtactatgagatccttggggtttcaaagactgcttctccggaggatctgaagaaagcttacagaaaggctgccattaagaatcatcctgacaagggaggagatccagagaagttcaaggagttggcacaagcttatgaggttctgagtgaccctgagaaacgtgagatatatgaccagtatggtgaagatgcactcaaggaaggaatgggtggaggaggcggtggccacgacccctttgacatcttccaatccttctttggtggtggcagcccatttggaggtggtggtggcagcagcagaggcaggaggcagaggaggggtgaagatgtgatgcattccctaaaggtgtctctggaagatctttacagtggcacatcaaagaagctatctctctctcgcaatgttctctgctccaagtgtaatggcaaagggtcaaagtctggtgcctcaatgaagtgttctggttgtcaagggtctggtatgaaggtttcaatcaggcaccttggtccctctatgatccaacagatgcagcacccatgcaacgagtgtaaaggtactggagagaccattagtgacaaagaccgttgcacagtttgcaaaggtgagaaggtcgtacaagagaagaaggtgctggaagttcatgttgagaagggaatgcagaatggacagaagattaccttccctggagaagccgatgaagcacccgacactgtcacaggagatattgtgtttgtgttgtctcagaaggatcaccccaaattcaaaagaaagggtgatgatctgtttgttgagcacacattgtcccttactgaagctctttgtggctttcagtttgtgctgacccacttggatggtagacagctcctcatcaagactaaccctggtgaagttgttaagcctgatcagttcaaggctgttaatgacgagggaatgcctatttaccagaggccattcatgaggggtaagctctacattcacttcactgtggagttccctgaatcgctgacaatcgagcagtgcaaggctttagaagccgttcttccagcaaggacttcaagccaattgacagacatggagctggacgagtgtgaagagacaactttgcatgatgtgaacattgaggaagagatgaggaggaaacaagcgcaggctcagcaagaggcctatgacgaagatgaagacatgcctggtggtgcccagagagtgcaatgtgcacagcaataagtagagagagaggagagtttttttaaatgaagagaaaagaaagaaacaaaataacaatttgagccaacattatctagtagtaattatcaccgtttaagacattagtgagtgagcgagtgaacagaggggtagtggatggttggtatttatagaattgattatttggtgctgatgtgggataggatgg

SEQ ID NO: 8184 - DNA, 1503 bp, Flaveria ramosissima
ctctctttcgcccaacacaactcaaaaagtcttccgatagcgatctacttcttcgcagatctgtaattgagtattgaagatcgaagaaggagagcaggatgtttggaagagcaccgaagaagagcgataacacgaagtattatgagatccttggggtcccgaagaacgcttcacaggatgatctgaagaaggcgtataggaaagccgctattaagaatcatcctgacaaaggtggagatccggagaagttcaaagagctggcccaagcatatgaggtactaagtgacccagagaagcgtgagatatatgatcagtacggtgaggatgccttgaaggaaggaatgggtggtggaggtggtggtcatgacccctttgacattttccaatccttctttggtggtagtcctttcggtggaggcggtggtggtagcagcaggggacgaaggcaacgaaggggtgaagacgttgttcatcccctcaaagtctctcttgaggatctttataatggaacttccaagaagctctctctttcacgcaatgtaatctgctctaagtgtaagggcaagggctcaaagtcaggcgcttcaatgaaatgtgctggctgtcaaggttctggaatgaaagtctctatcagacatcttggcccatctatgatccagcaaatgcagcatccttgtaatgaatgcaagggtaccggagaaaccatcaatgataaggatcgatgcacacaatgcaagggtgagaaagtcgtgcaggagaagaaggtactggaagtgcatgtggagaagggtatgcagaatggacagaagattacattccctggagaggctgatgaagctcctgacactgttaccggagacattgtgtttgtgttgcaacaaaaggagcaccctaagtttaagcgaaagggtgatgacctttttgtggaacacacattgagcttaactgaggctctatgtgggttccagtttatcttaacccatttggataacagacagctcctcatcaaatctcaacctggggaggttgtcaagcctgatcaattcaaggcaatcaatgatgaaggaatgccaatgtaccagaggccatttatgagggggaagctatatctccacttcaccgtagatttcccagattcattgtcaccagagcagtgcaaggcgttggaggcggtgctgccaccgaagcctttaatgcagatgacagacatggaactggatgaatgcgaagagacgactcttcatgatgtcaacattgaagaggagatgagaaggaagcaacaagcagctcaagaagcttatgatgaagatgaagatatgcacggtggggcgcagagggttcaatgtgcacaacagtaattgaatcattgttaaggtttggtctgatctggtcatttatcatcttaggttttggcaagacaataacgtcaactgtaattttactttatactgttatgtttgtccatctgttttgagaacctttgaggtgtgtggattattgact

SEQ ID NO: 8185 - DNA, 1593 bp, Papaver somniferum
  misc_feature (241)..(241): n is a, c, g, or t
  misc_feature (274)..(274): n is a, c, g, or t
  misc_feature (553)..(553): n is a, c, g, or t
  misc_feature (1204)..(1204): n is a, c, g, or t
cgctaaggaaaaaaaaatctatttaatagaatagattgagagaaacaccctccttcgtgtgaaattctagggcttcctttctgaagaagaattagggtttcactcacaatcataaaatcgatcgattattctgaacattcagcgtgtttgaaattcttgattaaagatgtttggaagagcgcccaagaaaagtgataacacaaagtactatgaggtacttggagtaccaaagactgcttcncctgaagatttgaagaaggcttacagaaaggcngccattaagaatcatcctgataagggtggagatccagaaaagttcaaggagttggcccaggcttatgaggttttgagtgatccagagaaacgtgaaatttatgatcagtatggtgaggatgcgctcaaggaaggaatgggaggaggtggtggtggccacgacccctttgacatcttctcatctttctttggaggaggaagcccatttggaggtggtggcagcagcagaggaaggaggcagaggaggggagaagatgttatgcattctcttaaggtgtcnctggaggatctttacagtggaacatcaaagaaactgtccctctctcgcaatgtcatctgctccaagtgcactggaaagggttcgaaatctggtgcttcaatgaaatgttctggttgccaaggttctggcatgaaagtttctatcaggcacctaggtccctctatgatccagcagatgcaacatccttgtaatgagtgtaagggtactggagagaccatcagcgataaggatcgctgccctcaatgcaaaggtgagaaggttgcccaggagaagaaggtgttggaagtgcatgttgagaagggaatgcagaatggacagaagattaccttccctggagaggccgatgaagcgccagaaactgtcactggggatatagtttttgtcttggctcagaaagatcatcccaagtttaagcgaaagggtgatgatttgtttgtggagcacacattgtccctgactgaagccctctgtggatttcagtttgcactgacccatcttgatggtaggcagctcctcatcaagaccaaccctggggaagtagttaagcctgattcattcaaggcagtaaatgatgaagggatgcccatgtatcagagaccattcatgaggggtaaattatatatccacttcactgttgattttccagactcnttgacagctgagcagtgcaaagccttggaaggagtgctccctccgagaacatcatcgcaattgacggacatggaagttgatgagtgcgaggagaccactcttcatgatgtgaacattgaggaagaaatgaggaggaaacaagctcaagctcaggaggcatatgatgaagatgatgacatgcatgctggcggtgctcaaagggttcagtgtgcccagcagtaagcccagtgaagaagaaataacaattgaaaacagcattctagtagtatccaatatgtatgttggaaactatgatttgtaactatgcaaacttgtctggagtgtttttggcacctttttgtcttccaacagtttttcctttacttttttaatatgaaatcagagttttg

SEQ ID NO: 8186 - DNA, 1579 bp, Helianthus annuus
aaaacaaagagagagacccactcgcttactatacctaattgcgtgaccactgcgtcattatctgcaatacaccagtcaagtcgtccttttccgatctgcttcttcgcagatttgtaattgaatattgaaggtcgaagaagaaggaaaacaggatgtttggaagagcaccgaagaagagcgataacaccaagtattatgagatcctcggggttccgaaaaccgcatctcaggatgatctgaaaaaggcgtatcggaaagccgctattaagaatcatcctgataaaggtggagatcctgagaagtttaaagagcttgctcaagcatatgaggtactgagtgacccagagaagcgtgagatatatgatcagtatggtgaggacgcattgaaggaaggaatgggcggtggaggcggtggtcatgacccctttgacatcttccagtctttctttggtggtagtcctttcggtggaggcggtggtggtagcagcaggggacgaaggcaacgaaggggagaagatgttgttcatcctctcaaagtttctctcgaggatctttataacggaacttccaagaaactatccctttcacgcaatgtaatctgctccaagtgtaaagggaagggttcaaagtccggtgcttcaatgaaatgtgctggctgtcaaggttccggaatgaaggtttccatcagacatcttggaccatctatgatccagcaaatgcagcatccttgtaatgaatgcaagggtaccggtgaaaccatcaacgacaaggatcgatgcacacagtgcaagggtgagaaagttgtccaggagaagaaggtacttgaagtacacgtcgagaagggcatgcagaatgggcaaaagattacattccccggagaggctgatgaagcacctgatacggttaccggtgatattgtgttcgtgttgcaacaaaaggagcaccctaagtttaagcgaaagggtgatgacatatttgtcgagcacacgttgagtttgacagaggccctgtgtgggttccagtttatcttaactcatttggataaccgacagcttcttatcaagtctcaacccggagaggttgtcaagccagattcattcaaggcaataaacgatgaaggaatgccgatgtaccagaggccgtttatgagggggaagctgtacatccacttcacggtggaattcccagagtcattgtcgccggagaagtgcaaggcattggaggcggtgctgccaccgaagccttcgatgcagatgacagacatgcagctggacgaatgtgaggagacgactcttcacgatgtcaacatagaagaggagatgagaaggaagcagcaacaagcggctcaggaagcttatgatgaagatgaagacatgcatggtggagcccaaagagtacaatgtgcacaacagtaactccaataatggtctaggtttggttatctgatagacaataatgtcagttgtgattttgtttctttcttttttgttttaaaatatgatgataccattaagtgtttaaagatagtgtgaatgatttgaaagactggttggtttggtcgctattacttataaagttc

SEQ ID NO: 8187 - DNA, 1547 bp, Taraxacum officinale
acggtccggaattccgggatctcctctcgaccacacaaccaagccaagtcttccctcctcccttaggatctacttcttcgtagttttgtaattgagtattgaagatcgaagaacaggatgtttggaagagcacccaagaagagcgataatacgaagtactatgagatccttggggtcccgaagaatgcttcccaggatgatctcaagaaggcttatcgtaaagccgccattaaaaatcaccctgataagggaggagatcctgagaagtttaaagagcttgcccaagcctatgaggtattgagtgacccagagaagcgtgagatatatgaccagtatggtgaggatgccttgaaagaaggaatgggaggtggaggcggtggtcacgacccctttgacatcttccaatccttctttggaggcggcaatcctttcggtggtgctagtggcagcagcaggggacgaagacaacgcaggggcgaagacgtcattcaccctcttaaagtctcccttgaagacctctacaatggcacttccaaaaaactctctctttcacgtaatgtcctctgctccaagtgcaagggtaagggttcaaagtcaggtgcatcaatgaagtgtgcgggatgtcaaggttcaggaatgaaggtctcaatcagacatctgggcccatcaatgatccaacaaatgcaacatccttgtaacgagtgcaaggggaccggtgaaaccatcaacgacaaagaccgttgcccacagtgcaaaggagagaaagttgttcaagagaagaaggttctagaagtccacgtggagaagggcatgcagaattcccaaaagatcactttccctggtgaagcagatgaagctcctgacacagtaaccggtgacattgtgtttgtgttgcaacaaaaagagcatccgaagttcaaacgaaagggagatgacttgtttgttgaacacacattgagtctgacagaggctctgtgtgggttccagttcaccttaactcatttagacagcagacagcttctcatcaaatcccaacctggagaggttgttaagcctgatgcgtttaaggcgataaatgacgaagggatgccgatgtatcagaggccattcatgagggggaagctgtacatccacttcacagtggagtttccggagtctttgtcaccagagcagtgtaaggcgttggagggggtgctgccacctaagccagccatgcagatgacagacatggagttggatgaatgtgaagagacaactctgcatgatgtcaacattgaggaagaaatgagaaggaaacagcagcaggcagctcaagaagcttatgatgaagatgatgatatgcatggtggtgcacagagggtacaatgtgcacagcaatgattttggattgaaacatagtcttgggaagataataacgacaggtgtaattttggttttgaaatagtgataattccagtctatctattttgttaagtgatactttattccttgtgaacattgatttgaaaagtgtcttaagtcttgaatattatgctattcattttatc

SEQ ID NO: 8188 - DNA, 1854 bp, Triphysaria pusilla
gaacccggccgttgatttcagattctacggctgatagttcacacccgatttaaataaggaaaccaaatagaattctagatccttcactcctaacctaacacccctgaccaacaaacggccaagatcgcatcatcgctcgatctgcgccgtagaaaagccacctatattaacccgccgtcaacccgccgagtcgctctctgcaaattgtgagaaagctaatcacgaaatattcaatctcttgaatagatctgttcgatcgaaacttgatttgtgattttcctgaagtaaattcaaaatgtttggaaggcccccgaagaaaagtgataattccaaatactatgaagtcctcggagtccctaaaacggcgtcgctgacgatctgaagaaggcgtacaaaaaagctgcaattaaaaaccatcccgataagggcggcgaccctgagaagttcaaggagcttgctcactcatatgaggttttgagtgatcctgagaaacgtgaaatatatgaccagtatggtgaggatgcactcaaggaagggatgggtggtggtggtgggggtggcatgaatgatccatttgacatcttctcatcattctttggtgggagcccgttcggcggtggtggtagcagtaggggacgagggcagaggcgaggagaggatgtagtgcattcattgaaggtgtctcttgaggatctttaccttggaaccactaagaagctttcgctatctcgtaatgtactctgctcgaagtgtaatggtaagggatcaaagtctggagcttcgtccacatgctcgggctgtcaaggatctggaatgaaggtctcaattaggcagcttggccctggtatgattcagcaagtgcagcacccctgcaatgtgtgcaaagggacaggagaaactattagtgataaggatcggtgcatacaatgcaaaagcgataaggttgctcagcaaaagaaggttctggaagtccatgttgaaaaggggatgcagaattcgcagaagatcacgttccctggagaggctgacgaggcgcctgatactgtcactggggacatagtctttgttcttcagcagaaggagcatcccaagtttaagagaaagggtgatgatcttttcattgagcactcgctttcactcactgagtcactctgtggcttccagtttcttttgactcatttagatggcaggcagttactcatcaaatcaccagccggggaagttgtgaagcctaattcttacaaggcgatcaatgatgagggcatgccaatgtatgggaggccattcatgaaaggtaaactgtacattcatttcaacgttgagttcccagattctctagccgttgaacaagttgaggccttggagaaaatcctgccgccaaagaaccaaacacaattgacggatatggaaatcgatgagtgtgaggagaccacccttcatgatgtcaacattgaggatgaaatgaggaggaaagctcaagctcaccaggaagcgtatgatgaagatgatgaagatatgcatggtggggcccagagggttcaatgcgcccagcagtgatgagtttgatgtgaattttctggtggcttttgaaaatgtttccttatgttaatctttataattggttacttggaaaactttgctcttccaaaacgataaaatgtagtagcgtgatgattacgtgagcacattcattttagtttgtgagagtggtgttcgtaatattttatgaaggttgtaagatttttggagtagcattacaacaaaacttgactgaattatcatgcttgtaagatgtttgtaggagcaactttgtgttaattaatactaccttggtccaaaaaaaaaaaaaaaaag

SEQ ID NO: 8189 - DNA, 1658 bp, Phaseolus coccineus
  misc_feature (31)..(31): n is a, c, g, or t
  misc_feature (58)..(58): n is a, c, g, or t
  misc_feature (67)..(67): n is a, c, g, or t
  misc_feature (143)..(143): n is a, c, g, or t
  misc_feature (161)..(161): n is a, c, g, or t
  misc_feature (170)..(170): n is a, c, g, or t
  misc_feature (179)..(179): n is a, c, g, or t
  misc_feature (245)..(245): n is a, c, g, or t
  misc_feature (1217)..(1217): n is a, c, g, or t
  misc_feature (1275)..(1275): n is a, c, g, or t
gaataacatttggctcagagagcgtatctcnccttcctcgtattcattggagatccantgcagaaantcgttgaaaattagggttacggattcctaggttgaagaacacaatgtttgggagagcgcccaagaaaagcgacagnaccaggtactatgaaatncttggcgtngctaagaangcgtcgccggaggatttgaaaaaggcttataagaaagccgccataaaaaatcaccccgacaaaggnggtgatcccgagaagttcaaagagcttgctcaagcctatgaggttctgagtgacgctgagaaacgtgagatttacgatacttacggtgaagatgctcttaaggagggaatgagtggtggcggtggtgggcatgacccgtttgatatcttcagttcgttctttggtggaaatccgtttggtggaggtggtagcagtagaggaaggaggcagagacggggagaagatgtggttcaccctctaaaggtctctttggaggacctttaccttggaacttctaagaaactctctctttcacgaaatgtgttgtgctcaaaatgcaatgggaagggctcaaagtccggggcttcaatgacttgtgctggttgccagggttctggtatgaagttgtccattaggcatcttggtccttctatgattcagcaaatgcaacatccttgcaatgagtgcaagggcactggagagactatcagtgacagagaccgatgcactcagtgcaagggagaaaagtttgttcaggacaagaaagtacttgaagttgttgtggagaagggaatgcaaaatgcgcagaagattacattccctggtgaagctgatgaagcacctgatacaatcactggggatattgtatttgtcctgcaacagaaggaacatccaaagttcaaaagaaagattgaagacctttttgttgagcatactttgtctctcactgaggctctatgtggcttccagtttgtgctgactcacttggatggtcgacaactccttatcaaatcaaaccctggggaggttgtcaagcctgattcttacaaggctattaacgatgagggaatgcctatgtaccagaggcccttcatgaaggggaagctttacattcattttaccgtggaatttcctgattctctgagccctgatcaggtgacggccatagaggctgttttgccagcgaaaacttcaccacaaaagttgacaganatggagctagacgagtgtgaggagactacacttcatggtgtgaacatggaggaagagntaaggaggaggcaacaaattccgcaggaggcatacgaggaggatgacgacatgcatggcggtgctcagagagtacagtgcgctcagcagtaatggatgagccacaggagcatagcaggagtaggacctgtggtgtgatgatgatattgattatgatttttttagccgtatatttacgggactaaacataattagtgtttgctcaatcgattttgacaaccaaacactttacatttattcttcaacaaattattttacagaagaagacaactaaatacaacttttttcttcttgtactcactctgcctgcatcgctatctctttcattcttttcatatatggctatgctaggaattgttgttgttgtgttgcaaaaaaaaaaaa

SEQ ID NO: 8190 - DNA, 2081 bp, Ricinus communis
ctagatccttcgaatcacataatataaaaataaaattaaaaagaaaaggaaaaattctctttcttatagagaagcctaccgatcatctacccttcctatgactcttaaatctcaaccgtccaatctctccattatatacaacgatctgacaccagccacaaccctctttctctctctcgccgtctcgcttctttgtttctgtggctctcctgtgacctaatctaacaaccctgataaaaagaagcaaggatgtttggaagagcaccaaagaaaagcgacaacacaaagtactatgagattctgggagtctctaagaacgcatcacaagatgatctaaagaaagcttatagaaaagcagccatcaagaaccatcctgataagggtggcgatcctgaaaagtttaaagagttggcacaagcttatgaggttttaagtgatccagaaaagcgtgagatatatgatcagtatggcgaggatgccctcaaggaaggaatgggtggtggtggtggtggcggccatgatccattcgatattttccaatctttctttggtggcagtccattcggtggtggcggcagcagcagaggccgaaggcagaggaggggtgaggatgtgattcatcctctcaaggtttctttggaagatctctacaatggcacctccaaaaaactctctctttctcgcaatgttatctgctcgaagtgcaaaggtaaagggtctaaatccggtgcatcaatgaaatgttctggttgccaaggttctggaatgaaggtttcaataagacatcttggaccctctatgatccagcaaatgcagcatccctgcaatgagtgcaagggtactggtgagaccattaatgacaaggaccgctgccctcaatgcaagggtgaaaaggttgttcaagagaagaaagtgctggaagttattgttgagaagggtatgcaaaatgggcagaagattacatttcctggagaagctgatgaagctcctgatactatcactggggacattgtttttgtcctacagcaaaaggagcaccctaagttcaagcgaaagggagatgacctagttgttgagcacacactttctctcacagaggcactctgtggcttccagtttatattgacccatttagatggaaggcagctcctcataaaatcccaacctggggaagtagtgaaaccagatcaattcaaggccattaatgatgaaggaatgccaatgtatcaaaggccattcatgagggggaaattgtacattcatttctctgttgatttcccagactctctgcccccagatcagtgcaaagccttggagactgtgcttccctcaaggacttcagtccagctgtctgacatggagctggatgaatgtgaagagaccactttacatgatgtgaactttgaagaggagatgaggcggaaacagcagcaggcccaggaagcatatgatgaggacgaagatatgcatggtggtgcccaaagggtgcaatgcgctcaacaataaataaatcaactaataggagggagtaacgatggtgttgatcaatgagattttatctgaaccagagctgagattgattaatgtgggtttgacagatagtgtgagaataagatgatattctctaacattcattgccttctgctataggattctgtcttgagatttcacttgtgtccgcagaatgataatgtatggaagatgtagtatgctctagaaaagatattttatgcagaccaagaattattctgttctttttcatatgctgtgatgtagttttcttttggcatgcgtccatggatataattagatgttttattattctagtttggaatgccttcttttcttcttggactgcagctgcggtattgcagaggagtgcttgtactgcacatggctgctttgatccatgggattgaactaggtgcatgaaaagagcttgtgagggttgatggttaggcctgcagagcctcactggggatgacaatggtagggtttggatggggaagaaaataggcccactgggggatgatagtggtagggtctggattgggaaggatattttcttggggatacttaca

SEQ ID NO: 8191 - DNA, 1321 bp, Castanea mollissima
gccgtctcgctttgcttctgtggctctctctcatccttttccttgcaattcaagatcgataagaagagaaaatgtttgggagagcaccgaagaaaagtgacaacacgaagtattatgaggttctgggagtgtcaaagaacgcttcacaggatgatctaaagaaagcttatagaaaagccgccatcaaaaaccatcctgacaaaggtggtgacccagaaaagtttaaagagttggcccaagcttatgaggttcttagtgacccagagaaacgtgagatctatgatcagtatggtgaggatgctctcaaggaaggaatgggtggtggaggtggtggacatgatccatttgacatattccagtcgttctttggtggaagcccatttggtggtggtggaagcagcagaggccgaaggcaaaggaggggagaggatgtgatccatcccctcaaggtttctctggaagacctttacaatgggacatctaagaagctatccctctctcgtaatgtgatctgctccaagtgcaagggtaaaggctctaaatcaggtgcttcaatgaaatgctctggttgtcaagggtctggaatcaaaatttcaattagacatctcggcccctccatgatccagcaaatgcagcatgcttgcaatgagtgtaagggtactggggaaactatcaatgacaaggaccgctgcccacagtgtaagggagagaaggttgttcaggagaagaaagttttggaagtaattgtagagaagggtatgcaaaatggacagaggattacattccctggagaagctgatgaagcgcctgacactaccacaggggacatagtttttgttctacaacagaaagagcaccctaaatttaagcgaaagggtgaagatttatttgtcgaacacacgttgtcccttacagaggcactctgtggcttccaatttatattgacacatttggatggcaggcagctcctcattaaatctgaaccaggagaagttgttaagcctgaccaatacaaggcaataaatgatgagggaatgccgatgtaccagagggctttcatgaagggtaaattgtacattcacttcacaattgaatttccagacaccctcaacccagagcagagcaagtcactggaggctgtgctgcctccgaggacgtcagtgcagctgacagacatggagctggatgaatgtgaggagactacactgcatgatgtgaacatagaggacgaaatgcgtcgcaagcaagcacaggcccaagaagcatacgatgaggatgatgatatgcctggtggtggtcagagggtccaatgtgctcaaca

SEQ ID NO: 8192 - DNA, 1449 bp, Cirsium arvense
ccgagtcaagtcttccttcccctttcgatctacttcgcagatttgtaatttaatatcgaagatcgaagaagaagaagaggatgtttggaagagcaccgaagaagagcgataacactaagtactatgagatccttggagtcccgaagaatgcgtcacaggacgatctaaagaaggcttataggaaagctgccattaagaatcatccggataaaggtggagatcctgagaagtttaaagagctggcccaagcatatgaggtactgagcgatccagagaagcgtgagatatacgatcagtatggtgaggatgccttgaaggaaggaatgggtggtggaggaggtggccatgacccctttgacatcttccaatcctttttcggtggcaatccatttggaggtggtggcggtagcagcaggggccgaaggcaacgaaggggagaagatgtcattcaccctctaaaagtgtctctcgaggatctatataatggaacttctaaaaaactgtcgctttcacggaatgtaatatgctccaagtgtaagggcaagggatcaaagtcaggtgcttccatgaaatgtgctggctgtcaaggttctgggatgaaagtttctatcaggcatcttgggccatctatgatccagcaaatgcaacatccttgtaatgaatgcaagggtactggggaaaccatcaatgataaggatcgctgcccacaatgcaagggtgagaaagtggtgcaagagaagaaggttcttgaagtccatgtagagaagggcatgcagaatgggcagaagatcacattccctggagaggctgatgaagctcctgacacagttactggggatatcgtatttgtcttgcaacaaaaggagcaccctaagtttaagcgaaagggtgacgacatatttgttgaacacacattgagcttaactgaggcactctgtgggttccagtttattttaacccatttggatagtagacagcttctgatcaaatctcaacctggagaagttgttaagcctgatcaattcaaggccataaacgatgaaggaatgccaatgtatcagaggccatttatgagggggaagttgtacatccactttactgtggaattccccgactcattgtcaccggagcagtgcaaggcactggagggtgtactgccagctaggccttcaatgcagatgacagacatggagctggacgagtgcgaagagacaactctgcatgatgtcaatattgaagaggagatgcgaaggaagcagcaagcagcccaagaagcctacgatgaagatgaagatatgcacggtggagcacaaagggttcaatgtgcacaacaatgattgaagaaagcatgggttgctcgtctataggtggggtcttggcaagacaataatatgatatatcagctgtaattttgttccttatactatctacttctactactagtactat

SEQ ID NO: 8193 - DNA, 1643 bp, Citrus sinensis
atcaaaaaccaaaccaaaccacacacagctaactctctcatcaacaaatcctcaccgtccattctgtctgttataactcgagatccaacgtttcttcttcctctctctttctgttcgctcgctcgccgtctcgcgtctactctgaagatctgaaattttttagtacaagatgttcggaagagcgccaaagaaaagcgataacacaaagtactatgagattctcggagtctcgaaaaacgcttcgcaagatgatctgaagaaggcttataggaaagccgccatcaaaaaccatcctgacaagggcggtgatcctgagaagtttaaagagttggcacaagcgtatgaggttctgagtgacccagagaagcgtgaaatatatgatcaatacggcgaggatgcgcttaaagagggaatgggtggtggtggtggtgcccatgacccattcgacatattccaatccttcttcggtggcagcccatttggtggtgggagcagcagaggaagaaggcaaaggaggggagaggacgtaatccatcccctcaaggtttcgttggaggatctgtacaatgggacatctaagaagctctcgctctcccgcaatgtaatctgcaccaagtgcaaagggaaggggtctaagtcaggtgcatcaatgaaatgttctggctgccagggatctggaatgaaagtttcaataagacaccttggcccctctatgattcaacaaatgcagcatccttgcaatgagtgcaagggtactggagaaacaatcaatgacaaggatcgctgcccacaatgtaagggtgagaaggtcattcaggagaaaaaagtcttggaggttattgttgagaaggggatgcaaaatggacagaagattacgttccctggagaagctgatgaagcgcccgacactgtcacaggtgacattgtatttgttctacaacagaaagagcacccgaaatttaagcgaaagggtgatgacctatttgttgagcacaccctgtcactgacagaagctctctgtggctttcaatttgtaataactcatttggatggccggcaactcctcatcaaatcccagcctggggaagtagtcaagccggaccaattcaaggccataaatgatgaaggaatgcctatgtatcagaggccatttatgaggggcaaactgtacattcatttcactgttgacttccctgagtcactgagcccagaccagtgcaagatgctggagaccgtactacctccaaggacctcagtccagctcaccgatatggaactggatgagtgtgaagaaacaaccctgcatgatgtgaacattgaggaggaaatgcgaaggaagcaacaagcagctcaggaggcatacgatgaagatgacgatatgcaaggtggtgcccagagagtgcagtgtgctcagcagtgatgatgtagaagaaaaggggtggcctgatttagtattttcattgtttgggagaaaaagattctcaacatatttattttctgttataggctttagaggttctagttttggtttgtctgtctttattcttatgtttttctgataactgactatgtaatggaattctagcgtttgcaccttcagactcaatgctcataattaatatttttagtgtttacaatatttc

SEQ ID NO: 8194 - DNA, 1624 bp, Phalaenopsis aphrodite
cgatcaacgagagagaaatactagggttagggtttcggttccgaagcgggtgattgcggtcggcaagaagttgattgcttcctctggttttagttggactcacagagagaaggaagatgttcggaagggccccgaagaagagcgacaacacgaggtattatgagattctcggcgtgtcgaaaagcgcatctcaggatgatctcaagaaggcgtatcggaaggccgctatcaaaaatcaccccgataagggaggggatccggagaagtttaaggagcttgcacaagcctatgaagttttgagcgatcctgagaagagggatatatacgatcagtatggcgaagatgcactcaaggaaggaatgggtgggggcggtgctggccatgatccatttgacatcttccagtctttctttggcggaaatccttttggaggtggcgggagcagtcgtggtcgcaggcagcggaggggagaggatgttgtccacccacttaaagtcacattggaagatctgtacaatggtacttcgaagaaactctctctttcccggaatgttctttgctcgaaatgcaaagggaagggatcgaaatcgggcgcttcaatgaagtgttctggctgtcagggtacaggtatgaaggtctcgattcgccagttgggtccatctatgatacaacaaatgcagcatccttgcaatgagtgcaaaggaactggggagaccatcaatgataaagatcgctgcccacagtgcaagggagagaaggttacccaggaaaagaaggttcttgatgttctagttgagaagggtatgcagaatgggcagaaaatcaccttccccggtgaggctgatgaggcgcctgattgtatcactggcgacatcgtatttgtcctgcaacaaaaggaccactctaagttcaaaagaaagggcgacgatctctttgtggagcacacactctccctaaccgaagctctttgtggcttccagttcatattaacccatctcgatggccggcagcttctcatcaaatcaaaccccggcgaagtcgtcaagcctgaccaattcaaggccatcaacgacgagggcatgccgatgtaccagaggccgttcatgaggggcaagatttacatccatttcaccgtcgagttccctgattctctgagtccggatcagtgcaaggctctcgaggcaatccttccctcacgggctcgtactcagctgacggacatggagctcgacgagtgcgaggagacaaccttgcacgacgtgaacatcgaggaggagatgaggaggaagcagcagagccaagctcaggaggcctacgatgaggacgaagacatgccaggcggtgctcagagagtgcagtgtgctcagcagtaagttatatacttatatcataccagtaaaagcgttatcagctgtgttgaatcttatcaaacgtatggttctctgttatcttattacaagcctgatactagcataaaactggattgtttgcatgccttaggtgactggttatatgaaatcttttgctcatcaagaaaatatttgaattttattcagcctgaaataatgctgtttaatttgagatttatttaatattattgcatagaaatgcttggattttaaaa

SEQ ID NO: 8195 - DNA, 1667 bp, Phalaenopsis aphrodite
gttgcttgcagccgcagcagccccttcgtttccttaaccgcgatcaacgagagagaaatactagggttagggtttcggttccgaagcgggtgattgcggtctgcaagaagttgattgcttcctctggttttagttggactcacagagagaaggaagatgttcggaagggccccgaagaagagcgacaacacgaggtattatgagattctcggcgtgtcgaaaagcgcgtctcaggatgatctcaagaaggcgtatcggaaggccgctatcaaaaatcaccccgataagggaggggatccggagaagtttaaggagcttgcacaagcctatgaagttttgagcgatcctgagaagagggatatatacgatcagtatggcgaagatgcactcaaggaaggaatgggtgggggcggtgctggccatgatccatttgacatcttccagtctttctttggtggaaatccttttggaggtggcgggagcagtcgtggtcgcaggcagcggaggggagaggatgttgtccacccactcaaagtcacattggaagatctgtacaatggtacttcgaagaaactttctctttcccggaatgttctttgctcgaaatgcaaagggaagggatcgaaatcgggcgcttcaatgaagtgttctggttgtcagggtacaggtatgaaggtctcgattcgccagttgggtccctctatgatacaacaaatgcagcatccttgcaatgagtgcaaaggaactggggagaccatcaatgataaagatcgctgcccacagtgcaagggagagaaggttacccaggaaaagaaggttcttgatgttctagttgagaagggtatgcagaatgggcagaaaatcaccttccccggtgaggctgatgaggcgcctgattgtatcactggcgacatcgtatttgtcctgcaacaaaaggaccactctaagttcaaaagaaagggcgacgatctctttgtggagcacacactctccctgaccgaagctctttgtggcttccagttcatattaacccatctcgatggccggcagcttctcatcaaatcaaaccccggcgaagtcgtcaagcctgaccaattcaaggccatcaatgacgagggcatgccgatgtaccagaggccgttcatgaggggcaagatttacatccatttcacagtcgagttccctgattctctgagtccagatcagtgcaaggctctcgaggcaatccttccctcacgggctcgaactcagctgacggacatggagctcgacgagtgcgaggagacaaccttgcacgacgtgaacatcgaggaggagatgaggaggaagcagcagagccaagctcaggaggcctacgatgaggacgaagacatgccgggcggtgctcagagagtgcagtgtgctcagcagtaaggtatatacttatattataccagtaaaagcgttatcagctgtgttgaatcttatcaaacgtatggttctctgttatcttattacaagactgatactagcataaaactggattgtttgcatgccttaggtggctggttatatgaaatcttttgctcatcaagaaaatatttgaattttattcagcctgaaataattctgtttaatttgagatttatttaatattattgcatggaaatgcttggattttaaaaaaa

SEQ ID NO: 8196 - DNA, 1644 bp, Citrus sinensis
aatcctcaccgtccattctctctgttataagtcgagatccaacgtttcttcttcctctctctttctgttcgctcgctcgccgtctcgcgtctactctgaagatctgaaattttttagtacaagaagatgttcggaagagcgccaaagaaaagcgataacacaaagtactatgagattctcggagtctcgaaaaacgcttcgcaagatgatctgaagaaggcttataggaaagccgccatcaaaaaccatcctgacaagggcggtgatcctgagaagtttaaagagttggcacaagcgtatgaggttctgagtgacccagagaagcgtgaaatatatgatcaatacggcgaggatgcgcttaaagagggaatgggtggtggtggtggtgcccatgacccattcgacatattccaatccttcttcggtggcagcccatttggtggtgggagcagcagaggaagaaggcaaaggaggggagaggacgtaatccatcccctcaaggtttctttggaggatctgtacaatgggacatctaagaagctctcgctctcccgcaatgtaatctgcaccaagtgcaaagggaaggggtctaagtcaggtgcatcaatgaaatgttctggctgccagggatctggaatgaaagtttcaataagacaccttggcccctctatgattcaacaaatgcagcatccttgcaatgagtgcaagggtactggagaaacaatcaatgacaaggatcgctgcccacaatgtaagggtgagaaggtcattcaggagaaaaaagtcttggaggttattgttgagaaggggatgcaaaatggacagaagattacgttccctggagaagctgatgaagcgcccgacactgtcacaggtgacattgtatttgttctacaacagaaagagcacccgaaatttaagcgaaagggtgatgacctatttgttgagcacaccctgtcactgacagaagctctctgtggctttcaatttgtaataactcatttggatggccggcaactcctcatcaaatcccagcctggggaagtagtcaagccggaccaattcaaggccataaatgatgaaggaatgcctatgtatcagaggccatttatgaggggcaaactgtacattcatttcactgttgacttccctgagtcactgagcccagaccagtgcaagatgctggagaccgtactacctccaaggacctcagtccagctcaccgatatggaactggatgagtgtgaagaaacaaccctgcatgatgtgaacattgaggaggaaatgcgaaggaagcaacaagcagctcaggaggcatacgatgaagatgacgatatgcaaggtggtgcccagagagtgcagtgtgctcagcagtgatgatgtagaagaaaaggggtggcctgatttagtattttcattgtttgggagaaaaagattctcaacatatttattttctgttataggctttagaggttctagttttggtttgtctgtctttattcttatgtttttctgataactgactatgtaatggaattctagcgtttgcaccttcagactcaatgctcataattaatatttttagtgtttacaatatttcagggtggtgttaatcagaagtccatatgcgaatgctaaaattat

SEQ ID NO: 8197 - DNA, 1649 bp, Saccharum officinarum
cccctcccctcccctccgctcctggtgctgcccaccccacacccccgcaggagcggcggcggcggcggcaaaggcaaaggcaagatgttcgggcgcgcgccgaagaagagcgacaacaccaagtactacgagatcctcggggtgcccaagtcggcgtcccaggacgacctcaagaaggcctaccgcaaggccgctatcaagaaccaccccgacaagggcggtgaccccgagaagttcaaggagctcgcacaagcctatgaggttctgagcgacccagagaagcgtgagatttatgatcagtatggtgaagatgcccttaaggaaggaatgggcggtggaggagcccatgttgatccatttgacatcttctcatcattctttggaccctcttttggaggaggtggtggaagcagcaggggaagaaggcaaaggaggggagaagatgtagtccacccacttaaagtttctctggaagatctttacaatggcacctcaaagaagctctctctttcgcgcaatgtcctctgctccaagtgcaagggcaagggctcgaagtctggtgcttcaatgaggtgccctggttgccagggctcaggcatgaaagtcactatccgccagctggggccttccatgatacagcagatgcagcagccttgcaacgagtgcaaggggactggagagagcatcaacgagaaggatcgctgcccagggtgcaagggtgagaaggttgttcaagagaagaaggttcttgaggttcatgttgagaaggggatgcaacacaaccagaagatcaccttccctggtgaagctgatgaagcgcctgataccgtcactggagacattgtatttgtcctccagcagaaggatcactccaagttcaaaagaaagggtgaagatctcttttatgagcacaccttgtctctgactgaagctctctgtgggttccaatttgttcttacacatctggacaacaggcagcttctcatcaaatcaaaccctggtgaagttgttaaacctgaccaattcaaggctataaacgatgaggggatgccaatttaccagaggcctttcatgaaggggaagctctacattcatttcacggtggagttccctgactcactggcaccagagcagtgcaaggcgctcgaggcagtacttccaccgaggtcttcatccaagctgacggacatggagatagatgaatgcgaggagacaactatgcatgacgtgaacaacatcgaggaagagatgcgcaggaagcaagctcacgctgcccaggaggcgtacgaggaggatgacgagatgccgggcggagcccaaagagtgcagtgcgcgcaacagtaagcagactatccatcaaggcaatttggccttcaagtgcgagagtggtctctggttttgctgtcgctgaggtgcgagataggaagctgattcgacccctgcaagcagggaatgtatcctttttgctgcaactgaaaaaatgctacccaggcatagctggctacctttttaacttttgtttgtgagatttgctagagtgatggtttcatcaatatataggtggacttaatgtttgtggaatgctaccgtataacgcacatatgggtgcaatgtctgttgcatcgctgtctgaatgacatcgccgttgc

SEQ ID NO: 8198 - DNA, 1343 bp, Ambrosia trifida
attgaggattaaagaagaaggagataatgtttggaagagcaccgaagaagagcgataatacaaagtattacgagatccttggggttccaaaaacagcttcacaggatgatctaaagaaggcgtataggaaagctgctattaagaatcatcctgataaaggtggagatcctgagaagtttaaagagctggcccaagcatatgaggtactgagtgacccagagaagcgcgagatatacgatcagtatggtgaggatgccttgaaggaaggaatgggcggtggaggcggtggtggtcatgatccctttgacatcttccagtctttctttggtggtggtagtcctttggtggtggtggtggcagcagcaggggacgaaggcaacgaaggggagaggatgttgttcatcccctcaaagtttctctcgaggatctttacaatggaacttccaagaaactatctctttcacgcaacgtaatctgctccaagtgtaaaggcaagggttcaaagtccggtgcttcaatgaaatgtgctggctgtcaaggttctggaatgaaagtttctatcagacatcttggaccatccatgatccagcaaatgcagcatccttgtaacgaatgcaagggtactggagaaaccattaacgacaaggatcgatgcacacagtgcaagggtgagaaagttgtgcaggagaagaaggtactggaagtacatgtggagaagggcatgcagaatggacagaagattacattccctggagaggctgatgaggctcccgacacagttaccggtgatattgtgtttgtgttgcaacaaaaggagcaccctaagtttaagcgtaagggtgatgacatatttgttgagcatacattgagcttgacagaggccctatgtgggttccagtttatcctaactcatttggatagcagacagcttctcatcaaatctcaacccggagaggttgtcaagcctgattcattcaaggcaataaacgatgaaggaatgccaatgtaccagaggccgttcatgagggggaagctttacatccacttcagcgtagaattccccgaatcattgtcgcctgagcagtgcaaggcgttggaggcggtgctgccacccaagccttcaatgcagatgacagacatggaactggacgaatgtgaagagacgactcttcatgatgtcaacatcgaagaggagatgagaaggaagcagcaacaagcagctcaggaagcttatgatgaagacgaagacatgcatggtggagcccaaagagtacaatgtgcacaacagtaagtcagatcatggtctagatttggtcatctgattgacaataatgtcagttgtg

SEQ ID NO: 8199 - DNA, 1574 bp, Arnica chamissonis
caccttcttcccccaaattccaaacccttctctttcgccgaacgcacacgagtcaagtcttccgtttccgatctacttcttcgcagtttgtagctgaatattgagaatcgaagaagaagggcaggatgtttggaagagcaccgaagaagagcgataacaccaagtattatgaaatcctcggggtcccaaaaaacgcttcccaggatgatctcaaaaaggcttatcggaaagccgccattaagaatcatcctgacaagggtggagatcctgagaagttcaaagagcttgcccaagcatatgaggtactaagtgatccagagaagcgtgagatatatgatgagtatggtgaggatgccttgaaggaaggaatgggaggtggaggtggtggtggtggtcacgatccctttgacatctttcaatctttctttggcggtggtggtggtggtagcagcaggggacggaggcagcgaaggggagaagatgttgttcatcctctcaaagtttctcttgaggatctctataatggaacttccaaaaaactctctctttcacgtaatgtaatctgctccaagtgtaagggcaagggttcaaagtcgggtgcttcaatgaaatgtaatggctgtcaaggttcaggaatgaaagtttctatcagacatcttggcccatctatgatacagcaaatgcagcatccttgtaacgagtgcaagggtactggagaaaccatcaacgataaggatcgctgtgcacagtgcaagggtgagaaagttgtgcaggagaagaaggttctggaagtacatgtggagaagggcatgcaaaatggacagaagattacattccctggagaggctgatgaagctcctgacacggtcaccggtgatattgtgtttgtgctgcaacaaaaagagcaccctaagtttaagcgaaagggtgatgacatatttgttgagcacacattgagcttgacagaggccctgtgtgggttccagtttatcttgacccatttggataacagacagcttctcatcaaatctcaacctggagaggttgtgaagcctgatcaattcaaggcaataaatgatgaaggaatgccaatgtaccagaggccattcatgagggggaagctgtacatccacttcacagtggaattccctgattcgatatccccagaacagtgcaaggcgttggaggcggtgcttccacccaagccttcaatggagatgacagacatggagctggacgaatgtgaagagacgactcttcatgatgtgaacatcgaagaagagatgagaaggaagcaacaagcagctcatgaagcttatgatgaagatgaagacatgccaggtggagctcagagggtacaatgtgcacaacaataattggatcataatggtctggtcctggtcatttgagaagactataatatgagcttgtgattttctccgttttttaacattaaatataaaactgcaaaatgtgttatgatgtatgaacgacttaaaatagtattattcgtgtcgtgtcctgcttttgatctaatgggttattgtatagaggtcatgagtcatcgagtctta

SEQ ID NO: 8200 - DNA, 1557 bp, Cirsium arvense
ctctctctctcgccgaacacagacgagtcaagtcttcccctttcgatctacttcgcagatttgtaatttagttattgaaagatcgaagaagaaagaacaggatgtttggaagagcaccgaagaagagcgataacaccaagtactatgagatccttggggtcccgaagaatgcttcacaggacgatctaaagaaggcttataggaaagctgctattaagaatcatcctgacaagggtggagatcctgagaagtttaaagagctggcccaagcatatgaggtactgagtgacccagagaagcgtgagatatatgatcagtatggtgaggatgccttgaaggaaggaatgggtggtggaggtggtggccatgacccctttgacatcttccaatccttctttggtggcaatccttttggaggtggtggtggtagcagcaggggccgaagacaacgaaggggagaagatgtcattcatcctctcaaagtttctcttgaggacctctataacggaacctctaaaaaactatccctttcacgtaatgtaatttgctccaagtgtaagggcaagggttcaaaatcaggtgcttcgatgaaatgtgcaggctgtcaaggttcgggaatgaaagtttccatcagacatcttggtccatctatgatccagcaaatgcaacatccttgtaatgaatgcaagggtaccggagaaaccatcaatgataaggatcgatgcccacagtgcaagggtgagaaagtggtgcaggagaagaaggtgcttgaagtccatgtagagaaggggatgcagaatgggcagaagatcacattccctggagaggctgatgaagctcctgacacagttactggtgatattgtatttgtgttgcaacaaaaagagcaccctaagtttaagcgaaagggtgatgacatatttgttgaacacacattgagcttaactgaagcactctgtgggttccagtttatcttaacccatttggatagcagacagcttcttatcaaatcccaacctggagaggttgttaagcctgatcaattcaaggccattaatgatgaaggaatgccaatgtaccagaggccattcatgagggggaagttgtacatccacttcacagtggaattccctgattcattgaccccagagcagtgcaaggctctggagggtgtgctaccagcaaggccttcaatgcagatgacagatatggagctggatgaatgtgaggagacaactctgcatgatgtcaacattgaagaggagatgcgaaggaaacagcaagcagctcaagaagcttacgatgaagatgaagatatgcatggtggtgcacagagggtacaatgtgcacagcaatgattaaatgaagtatggtttgctcgtctataggtgggtcttggcaagacaataatatcagctgtaattttctttcgtttatactattatgtgaaactgccgcctctgtttttggaactttccctataagttgtatgggtgatatatttacttgtttgaaactggttttagagcaattattaggtctttgatgcttgctttg

SEQ ID NO: 8201 - DNA, 2188 bp, Linum usitatissimum
tccaagcctttttgccattccagactcttctctgtctttatttccccatagccacaagcaaagctttcattcaatccaactatcttttagggtttcgaattgagcagaggaaagatgttcggcagagcgcctaagaagagcgacaacaccaagtattatgagatactgggtgtgcccaagaccgcgtcgccggaggatctgaagaaggcgtaccgcaaggccgcgatcaagaatcatcccgacaagggaggcgatcccgagaagttcaaagagctggctcaggcgtatgaggtgttgagtgatccggagaagcgagagatttacgaccagtatggagaggatgcgctaaaggaaggaatgggcggtggcggaggcggccataacccgttcgatatttttgaatccttcttcggtggtggtgcctttggaggtggtagtagcaggggaaggaggcagagaaggggagaagacgtagttcatccattgaaggtttccttggaagatctttacttgggtacaaccaagaagctctcactgtccaggaacgtgatctgctccaagtgcagtggcaaaggatcaaagtctggagcttcgatgaagtgcgcaggctgccaaggcagtggaatgaaggtttcaataaggcaactcggccctgggatgattcaacagatgcagcatccatgtaatgaatgcaaaggtactggcgaatccataagcgacaaggatcgctgctcacagtgcaaaggtgagaaggttgtgccggagaagaaggtccttgaagttcatgtggagaagggtatgcagaatggacagaagattacattccctggtgaagctgatgaagcgcctgaaacaatcactggagatattgtgttcgtccttcagcaaaaggagaaccctaggtttaagagaaagggtgacgatttatttgtggaacactcactggctcttaccgaggctctgtgtggcttccgctttgctcttactcacttggatggcaggcagctcctgatcaagtctcttcctggggaagttgtcaagcctgattcattcaaggcaataaacgatgagggaatgccgatgtaccagaagccattcctgaagggcaagctgtacatccacttcaccgtcgacttccctgattccctctcccccgaccaagtcaaggcacttgaagccatcctgcccgcgaaatcatcgagccgcttgacagacatggagatcgacgagtgcgaggagacccccatgcacgatgtcaacatcgaagaggagatgaggaggaagcagcagcagtctcgtcatgaggcttatgacgaggaggacgaggacatgccaggtggcgcccagagagtgcagtgcgcccagcagtagaacaaacaccaataatcatccgaaatcacctcataaacccttaaaagggatctcataagaatgcttgctgtcttgtgttatcttttcctttctgtagactttgaaattatctgaacttatattatgtgtaacaaatagaatttcgagttttaataacaaacgcttttcatgcgagttcatatggtacatcaacctccttctggaggtatctgaatatcaaagggataaaagttctgggttcatctctacttctgatgcagaatctagccacagctaaaagctttctgagctctttagagtcataactattgccgagatctggatcgatcattctgtggaaggagctgctagagcggcattcttgaatccatttgactaaatcgatgcttcctttctcggctgattgtcctgttacgagctccagcatcagcagtcctaactggaaaacgatgttgcctggccgcgactcggtagcaccatcttgtgaacctgaacttaggagctttgcagcagagttatccgcaacagtagcccctaggcagacatcggagagcttggcattgaagttatggtcgagcatgatagtgctagagcttatggatacatggtacactggtgggttactgaaaagcagcagatattctagtgcagcggtaacaccaatggcaacctccaaccttgtcttccagttcaagggagtcctcagaggatcatcaagatgctccttcaagcttccattctctatgtcaccaaacactaccaacctccggcgtccagagcagaaccctttaacagcaagcaaatggcggtgatgcag

SEQ ID NO: 8202 - DNA, 1759 bp, Mimulus guttatus
ctctatacaaagcccctttccttcaccagcattctttccgtacttctctgtttgtcaaaatcgccatcaaataggtgcgatttgggcatatagttctggatctgtgttctaatcggatcaattccgatctgagattagggattattggaagcaattcaagatgtttggtagggcgccgccgagtaaaagtgacaacaccaagtactacgaggttctcggtgtccctaaaacggcgtcgccggatgatttgaagaaggcgtaccggaaagctgctattaagaatcatcccgacaaaggcggtgatcctgagaagttcaaggagcttgctcatgcttatgaggttttgagcgatcccgaaaaacgtgaaatctacgatcagtatggtgaagatgcactcaaggaaggaatgggtggtggtggtggtggcggcatgcacgacccgttcgacatcttctcatccttctttggcgggagcccatttggaggtggtggcagtagtagggggcgaaggcaaagaaggggagaggatgtagtgcatgcactgaaagtgtctctcgaggatttgtacctcggtacctccaagaagctctcgctatcacgcaatgtactttgcaagaagtgtaacggtaaagggtcgaaatccggagcatcattgaagtgcacaggctgtcaaggaagcggcatgaaggtctcgattaggcagctggggcgtggtatgattcagcaaatgcagcagccttgcggtgattgtagaggaacaggtgagactatcaatgataaagatcgatgccctcaatgcaaaggcgacaaggttgttcaggaaaagaaagtcttggatgtccatgttgacaagggcatgcagaacggccagaagattacattccccggagaagctgacgaggcgcctgatacggtcactggagacatagtatttgtggttcagcagaaggaacatcctaaatacaagagaaagggcgacgaccttttcatagaacacacacttccactcggtgaagctttatgtggcttccagtttgcactttcccatttagatggacgacagcttcttatcaaatcacagcctggagaagttgtaaagcctgattcgtacaaggcgataaacgacgaaggaatgccgatatatcagaggccgttcatgaagggtaagctctatatccattttaatgtggagtttccagattctttgagtacagaacaagtggaggcattggagaagattcttccaccaaagccacaatcgaagcttacggatatggaggtggacgagtgtgaagagacgacactgcacgatgtcaacatcgaggatgagatgagaaggaagcaggcgcaccgccagcaggaagcttatgatgatgacgacgaagatatgcacggtggggcccagagggtccaatgcgctcagcagtgatcaactctatatatagaatctttatatataagaacgctgcggtgtgcctgaatttttcagacgtcttttttttttcaattgcgttgtcgtgacatttataatgttgtttgaaacaaattaattcatttcaagatctatgttgtttgcggacatgaattttattacgagactgtttgaaatcttttgaattttcggtttctcttatctctgagtcactgctccggctagtgaataaataggttgatgatgacaattttgaatttacatgtttggcatggttagtattttggatgatttttttctatgaatttccaattttacccttgattt

SEQ ID NO: 8203 - DNA, 1780 bp, Gossypium hirsutum
cgtatcaacgcagagtacatgggagtttcacaatagatctgacgtccattattcccctatataagtaggtctcttaccacacctattctttccctttaagcccttctgtgtttctctccatctcgccgtctcgcgtgcgccctgtggctctcttcaaccctcgcatatctcttcaagatctgatctgatctgacaaaaaaatgttcgggagagcaccaaagaaaagcgataatactaaatactatgagatattgggagtgcccaaaaccgcttcccaagatgatttgaagaaggcttatagaaaagctgcaattaagaatcatcctgataaaggcggtgatcctgaaaagtttaaagagttggctcaagcttatgaggtgctgagtgacccagagaagcgtgagatatatgatcagtatggtgaggacgcccttaaagaaggaatgggtggaggtggtggtgcccatgatccatttgatatcttccaatccttctttggtggcaatccttttggtggtggtggtagcagccgaggccgaagacaaagaaggggagaggatgtaattcatcccctaaaggtttctttggaagatctctataatgggacttccaaaaagctttctctttcacgcaacataatttgctccaagtgcaaggggaaagggtctaaatcaggtgcatcaatgaaatgttctggttgtcaaggttcaggaatgaaagtctccatcagacaccttggtccttccatgatccaacagatgcagcacccttgcaatgattgtaagggtactggtgagaccatcaacgataaggaccgttgcccccaatgcaaaggcgagaaggttgttcaggagaagaaagtcttggaggttaatgttgaaaagggtatgcagaacggacagaagattactttccctggagaagcagatgaagcacccgacacagttactggggatattgtatttgtcctccaacagaaagatcatccaaaatttaaacgaaagggtgatgacttatttgtagaacatacgttgacacttactgaggcactttgcggcttccagtttatactgacccacctagatggtaggcaacttctcattaagacccatcctggtgaagtggttaagcctgatcaatgcaaggccataaatgatgaagggatgcctatgtatcaaaggccattcatgaggggtaaactatacattcactttaccgtcgattttcctgactccttggcccccgagcagtgcaaggcactcgaggctgtgctacctccgaggacctcagtccagctgacagacatggagctggatgagtgtgaggaaacaactctatatgatgtcaacatcgaggaagagatgcgtaggaagcaggcgcaagcagctcaagaggcttatgaggaagatgatgacatgcacggtggtgcccaaagagtgcaatgcgctcagcaatgatcggtggcagacggtaaggaatggaatgtatgattgtttaacaaaaattatttgaaaataccattctggatatggttgtttgcttagaccatttcttctagagtgctatctgctttggtaactggtaaagtgtatggaaagatttagcgttggaacttgacctatttgtttatggtatacaacctattgcttcttgtgagcttagtttttttagttttgattttatatttgaatttgagaaatcatttagggatattttatgatttgaaggtgttcattgttccgatttgattcgggtcattataagatgtttggttatattc

SEQ ID NO: 8204 - DNA, 1642 bp, Citrus clementina
atcaaaaaccaaaccaaaccacacacagctaactctctcatcaacaaatcctcaccgtccattctgtctgttataactcgagatccaacgtttcttcttcctctctctttctgttcgctcgctcgccgtctcgcgtctactctgaagatctgaaattttttagtacaagatgttcggaagagcgccaaagaaaagcgataacacaaagtactatgagattctcggagtctcaaaaaacgcttcgcaagatgatctgaagaaggcttataggaaagccgccatcaaaaaccatcctgacaagggcggtgatcctgagaagtttaaagagttggcacaagcgtatgaggttctgagtgacccagagaagcgtgaaatatatgatcaatacggcgaggatgcgcttaaagagggaatgggtggtggtggtggtgcccatgacccattcgacatattccaatccttcttcggtggcagcccatttggtggtgggagcagcagaggaagaaggcaaaggaggggagaggatgtaatccatcccctcaaggtttctttggaggatctctacaatgggacatctaagaagctctcgctctcccgcaatgtaatctgcaccaagtgcaaagggaaggggtctaagtcaggtgcatcaatgaaatgttctggctgccagggatctggaatgaaagtttcaataagacaccttggcccctctatgattcaacaaatgcagcatccttgcaatgagtgcaagggtactggagaaacaatcaatgacaaggatcgctgcccacaatgtaagggtgagaaggtcattcaggagaaaaaagtcttggaggttattgttgagaaggggatgcaaaatggacagaagattacgttccctggagaagctgatgaagcgcccgacactgtcacaggtgacattgtatttgttctacaacagaaagagcacctgaaatttaagcgaaagggtgatgacctatttgttgagcacaccctgtcactgacagaagctctctgtggctttcaatttgtaataactcatttggatggccggcaactcctcatcaaatcccagcctggggaagtagtcaagccggaccaattcaaggccataaatgatgaaggaatgcctatgtatcagaggccatttatgaggggcaaactgtacattcatttcactgttgacttccctgagtcactgagcccagaccagtgcaagatgctggagaccgtactacctccaaggacctcagtccagctcaccgatatggaactggatgagtgtgaagaaacaaccctgcatgatgtgaacattgaggaggaaatgcgaaggaagcaacaagcagctcaggaggcatacgatgaagatgacgatatgcaaggtggtgcccagagagtgcagtgtgctcagcagtgatgatgtagaagaaaaggggtggcctgatttagtattttcattgtttgggagaaaaagattctcaacatatttattttctgttataggctttagaggttctagttttggtttgtctgtctttattcttatgtttttctgataactgactatgtaatggaattctagcgttgcaccttcagactcaatgctcataattaatatttttagtgtttacaatatttc

SEQ ID NO: 8205 - DNA, 1616 bp, Tabernaemontana elegans
tccctctcttcgctcgctgccccgctctccaacttctaagtcaacatcgaacctctatacctagctggtctagggttttctccgatttagctaggattgtgaaagcggcagatcgaagatgtttgggaggggacctaaaaagagcgacaacaccaagtactatgagattttgggggtgtcgaagaatgcttcgcaagatgatctgaagaaggcgtatcgtaaagctgccattaaaaaccatcctgataagggaggagatcctgaaaagtttaaagagcttgctcaggcttatgaggtactaagcgaccctgagaagcgtgatatttatgatcagtatggtgaggatgcactaaaggaaggaatgggcggtggaggtggtgtccatgacccatttgacatcttccagtccttcttcggtggtagcccctttggaggtggcggaagcagtagaggccggaggcagagaaggggtgaagatgtcattcatccactcaaggtttctctggaggatctctataatggaacctccaagaagctctcgctctcgcgtaatgtgttatgccaaaagtgcaagggtaaagggtcaaaatctggcgcatcaatgaaatgttctggatgtcaagggtctggaatgaaggtttctattagacatcttggcccgtctatgatccagcagatgcaacacccatgcaatgagtgcaaaggtactggtgaaaccataaatgataaggatcgctgcccgcagtgcaaaggtgaaaaggttgtgcaggagaagaaggtcttagaagtgattgtggagaagggcatgcaaaatggacagaagattactttccctggcgaggctgatgaagcacctgatactgttactggagacatagtttttgtcttacaacagaaagagcatcctaagttcaagcgcaagggtgatgacctcttcgtcgagcatacattgtctctgaccgaggccctctgtggcttccagtttatcttgactcacctagataacaggcagcttcttattaaatcccaaccgggagaagtaatcaagcctgatcaatttaaggcaataaatgatgaaggaatggtgatataccagaggccattcatgagaggcaaattgtatattcatttccatgtggaattcccagattccctgactcctgaccagtgcaaggcacttgaagctgtgttgcctccaagaccaacaaaacaaattactgaaatggagttggatgagtgtgaggagactacacttcatgatgttaacattgaggaggagatgcgaaggaagaaccagcaggcccaggaagcatacgaggaggatgaagatatgcatggtggtgctcagagagtgcagtgcgctcaacaatgagttggtggtcatagatggaaggtaggagccacatctaggaggtgaggactcagcattattgaagcttaataggtttgttgaagcaaggacgccttctgcaatgttgtcctctagatatatagatttgtagttcaatgattttggaatatccgtttctctttgaaaactgattgtaccgaaagatttacagtttgaccattttgagagtacacaaagtatgatatgcaatttatgtgcttgtttt

SEQ ID NO: 8206 - DNA, 1792 bp, Citrullus lanatus
tgatactcttcaatccctctctctacctcgccgtctcgagcgaccctttttcgtttctctgctctcaggtcaccgatctctctacccgatctttcatttcaagatcgcccttttcgctctcctaagggtttgttgagatccgatcggtgaggcaaaaatgtttggaaggccgaagaagagcgataacaccaaatactatgagattctcggagtctcgaagaatgcgtcgcaagacgatctaaagaaggcttatagaaaggccgctatcaagaaccatcctgataagggtggtgaccccgaaaaattcaaggagttggcacaagcctatgaggtgctgagtgatccagagaaacgtgagatatatgaccaatatggcgaggatgccctcaaggaaggaatggggggtggcggtggccatgatccatttgacatattccagtctttctttggtggaagcccgtttggtggtggtggaagcagcagaggccgaaggcaaagaaggggagaagatgttatccatcccctcaaggtctccttggaagatctctacaatggtacttcgaagaagctctctctttcacgcaacgtaatctgctcaaagtgcaagggtaagggttctaaatctggtgcttcaatgaaatgcccgggctgtcaaggatctggtatgaaagtttccatcagacaccttggcccctctatgatacaacaaatgcagcatccttgcaatgaatgcaaaggaactggtgaaaccatcaatgataaagatcgttgctcacagtgcaagggtgaaaaggttgttcaggagaagaaagttttggaagtaattgtggagaagggcatgcaaaatggacaaaagattacattccctggtgaagcagatgaagcgcccgacactgttactggcgatatcgtttttgtcctacaacaaaaagaacacccgaagttcaagagaaagggtgatgacctcttcgtggagcataccttgtcgcttgtcgagtctctttgtggtttccaatttattctgacacatttggatggccggcagctactcatcaagacgcttcccggtgtagtagtgaagcctgatcaattcaaggccataaacgatgagggtatgccaatgtaccagaggccattcatgaagggtaaactctacattcacttcagtgtggagttcccggactccttgaaccccgaacagtgcaaggcgctggagggtgtgctgccccccaggacttctgtgcagctctcggatatggagttggatgaatgtgaagagaccactctccacgatgtcaacatcgaagaggagatgcgcaggaagcaagtacaagaggcatacgatgaagatgacgatatgcacggcggagcacagagggtgcagtgtgctcaacaatgattttgaaatgggggaagctactatgcataacatttgatggtgtttcgagatgaaaattttcagatgaccccaaatggaggaaatggatgtagcagcaacaccaccaggcagcagtcatgtccaaattttctcaataaatagatgaattttattttaattcagtcggtaggattacgaagtttctggatttatgtctttgttttcttatgtgcttttgctttttttttttttttttttttttttttttctccgtagcttaccaagaattcaaagattatgtattggagttgcagataaaataggattggattggattggattgggaaaacagaaagatctttggttcttttctgtgaactgtggttcgaagcaaaaacaccaagatttttcctt

SEQ ID NO: 8207 - DNA, 1659 bp, Euphorbia esula
ggcacgaggcttgcgtctgtttctgtggctctctctaagctgaatctctcaatcgctgatctttgattgattgattgattaggtcatctgagagaagaagagatgtttggaagagcaccgaagaaaagcgataactcaaagtattatgagattctcggagtctcaaagagcgcttcgcaggatgatctaaagaaggcttatagaaaagctgccatcaagaaccatcctgacaagggtggtgatccagaaaagttcaaggagttggcccaggcttatgaagttttaagtgacccagaaaagcgtgatatatatgatcagtatggtgaggatgcccttaaggaaggaatgggcggtggtggcggtggccatgatccatttgacatattccaatccttctttggtggcagtccatttggtggcggtggtagtagcagaggccggaggcagaggaggggtgaggatgtgactcatcctctcaaagtttccttggaagatctctacaatggcacctccaagaagctatctttatcccgaaatgtaatctgctcaaagtgcaaaggtaaaggctccaagtcaggtgcatcaatgaaatgttcaggttgccaaggatctggaatgaaggtttccattagacaccttggtccctctatgatccagcaaatgcagcatccttgcaatgaatgtaagggtactggggagaccattaatgacaaggatcggtgcccccagtgcaagggcgaaaaggttattcaagagaagaaagtcttggaagtccatgttgagaagggtatgcaaaatggacagaagatcacattccccggagaagctgatgaagctcctgatactgttacaggagatatagtttttatccttcagcaaagggagcatcctaagtttaaaagaaggggagatgatctagttgtggagcacaccttgtctctaactgaggctctctgtggtttccagttcatattgacccatttagatggaaggcaactcctcataaagtcccagcctggggaagttgtgaagcctgatcaattcaaggctataaatgatgaggggatgccaatgtaccagaggccatttatgaggggtaagttgtacattcacttcaatgttgaattcccggattctcttccaccggatcaatccaaagccctagaggctgtgcttccatcgagaacttccgtacaattgtcggacatggaggtggatgaatgcgaagaaaccactttgcatgatgtcaattttgaggaagagatgaggagaaagcaacagcagagtgcagaggcttatgatgaagatgaagatatgccaggtggcgcccagagagtgcaatgcgcccagcagtaagccgaggaagcaaaacctgagtgagtaattagtgccaatattaagatagttgttatgtgagaataatagggattctcaatcatttgttggcattggtttaaaggattttagagactgctggttcgacttctggaatattatctcgggagcattcgctcgggaacaaaccagaaaaactgtccttttttaattttctttattggtaaatttctgctgatgttcctctgagctttttatataacggcaaggaattaggtcaaaacacttcacaacatttgaagtaataaggtattgtttttttcc

SEQ ID NO: 8208 - DNA, 1980 bp, Cucumis melo
ccaatccctctctctacctcgccgtctcgaaccgttccttttgggttctctgctctcaggtcaccgatctctctacccgatctttcacttcaagatcgacctttttgttcttctaagggtttgttgagatccgatcgtctaggcaaagatgtttggaaggccgaagaagagcgataataccaaatattacgagattcttggagtctcaaagaatgcgtcgcaagacgatctaaagaaggcttatagaaaggccgctatcaagaaccatcctgataaaggtggcgaccccgaaaaattcaaggagttagcacaagcctacgaggtgctgagtgatccagagaaacgtgagatatatgaccaatatggcgaggatgccctcaaggaaggaatgggaggtggcggtggccacgatccatttgacatattccagtctttctttggtggaagcccgtttggtggtggtggaagcagcagaggccgaaggcagagaaggggagaggatgttatccatcccctcaaggtctcgctggaagatctctacaacggtacctcaaagaagctctctctttcacgtaatgtaatttgctcaaagtgcaagggtaagggttctaaatctggtgcttcaatgaagtgtcctggctgtcaaggttctggtatgaaagtttccatcagacaccttggcccctctatgattcagcaaatgcagcatccttgtaatgaatgcaaaggaaccggtgagaccatcaatgataaagatcgctgctcacaatgcaagggtgaaaaggttgttcaggagaagaaagttttggaagttatcgtggagaagggtatgcaaaatgcacaaaagattacattccctggtgaagcagatgaagcgcctgacactgttactggggatattgtctttgtcctacaacaaaaagagcaccccaggtttaagagaaagggtgatgacctcttcgtggagcataccttgtctctcgtcgagtctctttgtggtttccaatttattctgactcatttggatggccgacagctactcatcaaatcacttcccggcgaagtagtgaagcctgaccaattcaaggccataaacgatgagggcatgcctatgtaccagaggccattcatgaagggcaaactttacattcacttcagtgtcgagttcccagactccttgaaccccgaacaatgcaaggcgctggagggcgttcttcctcccaggacctcggtgcagctctcagatatggagttggatgaatgtgaagagaccactcttcacgatgtcaacattgaagaggagatgcgcaggaagcaagtacaagaggcatacgatgaagatgaggatatgcacggcggagcacagagagtgcagtgtgctcaacaatgatctcgattaaactttgggggaggagtggggctaccgccgtaacacattgattgatggtttcgacattatgaaaattttcagagaacaacaaatggaggaaatggatctctaccaacagcagcacaccaccaggcaggagcagtcatatcatatctcatatccaaattttctcaataaatagatgaattttattttctaattcagtcagtaggattacgaagtaagctttctggattttttatgttttggttttttttttttttattatgtgctatttttcttctagctttaccaagaattcaaaagattatgtattggagttgcagatataaataggatttgattgggaaacagaaagatctttggttcttttctgtgaactgtggtttcaagtgaaaacatcccaagatttattcttcttacttctccaaccttaccctttgcttttggttcatcactacatttttagacatgagaccagttagtgctatccatgatatatatatatatgtacacacatattatgtgtatggactaatgttttgcttgtagcatgggttaaattaccgtaccattcaaagtttagactt

SEQ ID NO: 8209 - DNA, 1520 bp, Arnica chamissonis
agtcttcccgttgcgatctacttcttcgccgatttgtaattgaaaattaaagatcgaagaagaacaggatgtttggaagagcaccgaagaagagcgataatacgaagtactatgaaatcctcggcgtccctaagaatgcttcacatgatgatctaaagaaggcttaccggaaagccgccatgcagaatcatcctgacaagggcggagatcctgagaagtttaaagagcttgcccaagcatatgaggtgctgagtgacccagagaagcgtgagatatacgatcagtatggcgaggatgctttgaaggaaggaatgggtggtggaggtggtggtcatgacccttttgacatcttccagtctttctttggtggtagtccttttggtggtggcggtggtggtagcagcaggggacgaaggcaacgaaggggagaagatgttgttcatcctcttaaagtttctctcgaggatctttataatggaacttctaagaaactatcactttcacgtaatgtaatctgctccaagtgtaaggggaagggttcgaagtcaggtgcttcaatgaaatgttctggctgtcaaggttctggaatgaaagtttctatccgacatcttggaccatctatgatccagcaaatgcagcatccttgtaatgaatgtaagggtactggagaaaccatcaacgataaggatcgatgcacacagtgcaagggtgagaaagttgtgcaggagaagaaggtactggaagtacatgtcgaaaagggcatgttgaatgggcagaagattacattccctggagaggctgatgaagcccccgacactgtcaccggtgacattgtgtttgtgttacaacaaaaggagcaccctaagtttaagcgaaagggtgatgacatatttgttgagcacacgttgagcttgacagagtccctatgtgggttccagtttatcttaacccatctggacaacaggcagcttctcatcaaatctgaacctggggtggttgtcaagcctgatcaattcaaggcgataaatgatgagggaatgccaatgtaccagaggccgtttatgagggggaagctatacatccacttcacagtggaattcccagattcgttgtcaccagagcagtgcaaggcgttggaggcggtgctgccaccgaagccttcgatgcagatgacagacatggaactggatgaatgtgaggagacaactcttcatgatgtgaacatcgaagaggagatgagaaggaagcaacaagcagctcaagaagcttatgatgaagacgaagacatgcatggtggtggagcacagagggtacaatgtgcacaacagtaatgggatcatggttaaggtatgggttcattttttacggtattggcaagacaataatgtaaactgtattattcttactttatattgttgaatttgtctgtttcgagaacctttaagatgattgtctcatttccagaacttgttcgagaagcttgtttggattgtagttgttatacacattcccttcaaaaa

SEQ ID NO: 8210 - DNA, 2100 bp, Setaria italica
aaaagcgagaacttctcgccaccaaacaaacaccagaaacgtgcagtcagtaaagcagagggccggcccggacccattccggcccatcctagcccaccagccccacgaatacgcgtccgctacaccgttgacgtactcgcggtcgtctacatagctcacgcgcatcggccgtgggaaaccctctctcttcccagtccgctcgtccaccagccttgaccgcctcctccgctcccctccgctcctgctcctccccatcccccactcccccgcaggagcggcggcggcggcggtagtcggtggctaggtgtatacctcacctcggcgagcggcaccggcggcgacaaaggcaagatgttcgggcgcgcgccgaagaagagcgacaacaccaagtactacgagatcctcggggtgcccaagtccgcctcccaggatgacctcaagaaggcctaccgcaaggccgccatcaagaaccatcccgacaagggcggcgaccccgagaagttcaaggagcttgcacaagcttatgaggttttaagtgacccagagaagcgtgagatttatgatcagtacggtgaagatgccctcaaggaaggaatgggtggaggaggaggccatgtcgatccatttgacatcttctcatcattctttggaccctcttttggaggaggtggtggcagcagcagaggcagacggcaaaggaggggagaagatgtagtgcatccacttaaagtttctctggaagatctttacaatggtacctcaaagaagctctccctctcgcgcaatgttatctgctcgaagtgcaagggcaagggctccaagtctggtgcttcaatgaggtgcccaggttgccagggttcaggtatgaaagtcaccatccgccagctggggccttccatgatacagcagatgcagacggcttgcaatgagtgcaaggggactggagagagcatcaatgagaaggatcgctgcccagggtgcaagggtgagaaggttgttcaggagaagaaggttctggaagttcatgttgagaaggggatgcaacacggccagaagatcaccttccccggtgaagctgatgaagcgcctgatactaccactggagacattgtattcgtcctccagcagaaggatcactccaagttcaagagaaagggtgatgaccttttttatgagcacacattgtctctgactgaggctctctgtgggttccaattcgttcttacacatctggacaacaggcagcttctcatcaagtcaaaccctggtgaagttgttaagcctgaccaattcaaggcgataaacgatgaggggatgccaatgtaccagaggcctttcatgaagggcaagctctacattcacttcactgtggagttccctgactcgctggcgccagagcagtgcaaggctcttgaggcggttcttccaccaaagcctacgtccaagctgacagacatggagatagatgagtgcgaggagaccactatgcacgacgtgaacaacatcgaggaagagatgcgcaggaagcaagctcatgctgcccaggaggcgtacgaggaggacgatgatatgcctggaggtgctcaaagagtgcagtgtgcgcaacagtaaggagcctgcagggtttgcgcgaacttttggacccaatgttatctctctggttttggttttgtcgtcggagttatgaaacagggaagcagctgctgattctgattcgacccctgtaagagggggaatgtatccctttttgctgtaactgaaaaaatgctacccaggcgtaggtggctacttgtaactgttttgtgagactttgtagggtgctttctatataggcaacttaatgtttgctgatggtacagtatgaagcacattagagtgcaatgactcgattacctgacggcatcgccgttctgcatcgaaatattttattcggctggatgctgttgatcgtgtgacaaatttacaaccatgcaatggcctcatcgatgcagattattataaggtgcctctgttacacaagatactggcaatgccaggtcgacggcaggctgattacaagcattgagtttgcggcgcaagagcgagcaagcattggctagc

SEQ ID NO: 8211 - DNA, 1583 bp, Zingiber officinale
  misc_feature (117)..(117): n is a, c, g, or t
  misc_feature (437)..(437): n is a, c, g, or t
  misc_feature (530)..(530): n is a, c, g, or t
  misc_feature (1385)..(1385): n is a, c, g, or t
gcaccattaccaattcctcgtcgatcgaggctgcgattcgtcagagtagtgacgggatcccgtgattccaccttccatctgtgtgctatcgatcgatcgtgtgaagttccgctgcanagatgtttgggagggtgccgaagaagagcgacaacacccggtactacgaggtcttgggggtgccgaagagcgcatctcaggatgatatgaagaaggcctaccggaaggccgccatcaagaaccaccccgacaaaggcggcgaccccgaaaagttcaaggaattggcccaggcttatgaagttttgagtgatcctgagaaacgggagatctatgatcaatatggtgaagatgccctgaaggagggaatgggtggtggaggcggcggacatgatccgtttgatatattccagtccttctttggcggtagcccctttggaggnggaggaagtagcagaggacgaaggcagaggaaaggggaggatgtgattcatcctctcaaggtatccttggaagatctctacaatggaatttcnaagaaattatcactctcacggaatgttatctgccggaagtgcaatggcaaaggttcgaaatctggtgcttccatgacatgctctgggtgccgcggctcaggtatgaaggtcagtatacgtcaactggggccgggcatgattcagcaaatgcagcatgtatgcaatgattgcaaaggaactggtgagaagatcaatgagaaggatcgctgcccgaactgcaaaggtgagaaagttgctcctgagaagaaagtgctggatgtgatagttgagaagggaatgcaaaatggacagaaaatttccttccctggcgaggctgatgaagcgcctgatactgtcaccggagacattgtgtttgttctccagcaaaaggaacatcccaaattcaagcgtaagggtgaagatctcttttatgagcattcgttgtcactcaccgaggctctttgtggctttcagtttgttttgaatcaccttgacggcaggcagctacttatcaaatcaaatcctggggaagtcatcaagcctgatcaatacaaggcgataaacgatgaaggcatgcccatctaccagaggcccttcatgaaggggaagctctacatccactttgcagtcgacttccctgattcactggcacgggatcaatgcaaagctctcgaggcagtcctccctccaaggtctgcgtctcagttgacagacatggagctagacgaatgcgaggagactacattgcacgatgttaatatcgaggaggagatgcggaggaagcaaacccaagcgcaagaggcctacgaagaggatgaagatgatttccatggtggcgctcagagagtgcagtgtgcgcagcaataagctggatanaacatctatcgttcggtttgtgtaacgagttatggcaaactcaattcttagttgcatttagtgcttataatttcgcagcttcattttacagcaaattgatggattaagcaatcttgatacttatgaattatattgcatgttcttgtcatatgtatgcctttgtggatcttatttatctttatatgcatcataattgtt

SEQ ID NO: 8212 - DNA, 1562 bp, Solanum phureja
ccacgaattccacccatcaagccccttctctttttttcctcttcatttccctaacactgtcaagaacctctcttctcctcttttcgccgcaactttcaatcgatcaatttttattgacgtagttgaaccgatcgaaagatgtttggaagagcaccgaagaagagtgataatacaaagtattatgagatcttaggagttcctaaggctgcttctcaggaagatctcaaaaaggcttatcgtaaagccgccatcaaaaatcatcctgataagggaggcgatcctgaaaagtttaaagagcttgctcaagcttatgaggtcttgagtgacccagagaagcgtgagatatatgatcagtatggagaggatgctctaaaggaaggaatgggtggtggaggtggtggacatgacccatttgatatatttcaatcattctttggtggtggtggaagcccctttggtggtggtggaagcagcagagctcgcagacaaagaagaggagaggatgttatccaccctctcaaggtttctttggaggatctttacaatgggacatcaaagaagctttcactatctcgcaatgtgttgtgctcaaagtgcaagggtaaagggtccaagtcaggtgcttcaatgaagtgttctggctgtcaagggtctggaatgaaagtttctatcagacagctcggtccatccatgatccagcagatgcagcacccttgcaatgagtgtaagggtactggtgagacaatcagtgacaaagataggtgccctcagtgtaagggtgagaaggttgtgcaggagaagaaggtgttggaagttcacgtggagaagggtatgcagaatgggcagaaagtaacattcccaggcgaggcagatgaagcgccagaaaccatcactggagacattgtttttgttttgcaacaaaaagaacatcctaagttcaagcgaaagggagatgatctttttgttgagcacacattgaccttgactgaggccctatgtggtttccagtttgtcttgactcacctagacaacagacagctgctcattaagtcccaacctggcgaagttgtcaagcctgatcagtttaaggctatcaatgatgaaggaatgccaatgtaccaaaggcctttcatgagaggtaaaatgtacattcacttcactgttgatttccccgagtcattaacaccagagcagtgcaagaaccttgaggctgtgctgcctccaagacccaaattgcaagtgtctgatatggaattagacgagtgcgaggagactactttgcatgatgtgaacattgaggacgagatgcgaaggaagcagcaagctgcccaagaggcatacgacgaagatgatgatatgcctggtggtgcacagagagtccaatgtgcacagcagtaatttggtatttgctatcttgtgatattgggtagattacttaccagtaaaggatatggatattttttcttatgcagaccgacactaagtgtgcttacatgtttacgcaatttgttttgatttgttatctcatgcaataatcctttttaattccaagtccaatttga

SEQ ID NO: 8213 - DNA, 1597 bp, Artemisia annua
cttcccttattcgatctacttcttcttcttcaccgatttgtaacttaataattgaagatcgaagaataagaattagaataagaaaagagcaagatgtttgggagagcacctaagaagagtgataacacgaaatactacgaggttttgggggtcccacaaagcgcttcagcagatgagttgaagaaagcttatcgtaaagctgctattaagaatcatcctgataaaggtggagatcctgagaagttcaaagagcttgctcaagcatacgaggtactgagcgacccagagaagcgtgagatttatgatcaatatggtgaggatgctttgaaggaaggaatgggcggtggaggtggcggtcatgatccatttgacatcttccaatccttctttggcggtggcggtagtcctttcggtggtggtagtagcaggggacgaagacaacgtaggggagaagatgttgtccatcctctcaaagtgtctcttgaggatctttacaatggaacctccaagaagctttctctttcacgtagcgtactctgctccaagtgtaaaggaaagggatcaaagtcgggtgcttcaatgaaatgtgctggctgccaaggttctggaatgaaagtgtcaatcaggcatcttggcccatctatgattcagcagatgcaacatccttgtaacgagtgcaagggtaccggagaaaccatcaatgacaaggatcgctgcacacagtgcaagggtgagaaagtggtgcaggagaagaaggttcttgaggtccatgtcgagaagggcatgcagaatgggcagaaaattacattccctggcgaggctgatgaagctccggacacggttaccggagatatcgtctttgtcttgcaacaaaaggagcaccccaagttcaagcgaaagggtgatgacattttcgttgagcacacactgagcttaacagaggcgctttgcggattccagtttatcttgacccatttggataacaggcagcttctcatcaaatctcaacctggggaggttgtcaagcctgatcaattcaaggcaataaatgatgagggtatgccgatgtaccagagaccatttatgaggggtaagttgtacatacacttcactgtggagttcccggaatccttgtccccagagcagtgcaaggctttggaagcagtgctaccaccccggccttcaatgcagatgacagacatggagttggatgaatgtgaggagacaactctgcatgacgtcaacattgaagaggagatgagaaggaaacagcaacaagctcaacaagaagcctacgatgaagacgatgacatgcacggtggtggtgcacagagggtacaatgtgcacagcaataagtgtgggctatgaggtcaaggttttctcatctataggtcttggcaagacaataatgtcagttgtaattttcgttttctattatatactgttaacgagtctatctgttttggatcctgttaagctgtatggataatttgcttatttgaaaaactggtttgagaagcgtcttcggacgctgatattcattatatgcttgtttgtgtgtatggtaagtgaaagtcggtaggaaatgaactttga

SEQ ID NO: 8214 - DNA, 1776 bp, Brachypodium distachyon
ctctctctctcactcactccgtccggccgtccactttgaccgcctcctccgctcctgcccccacccaccgcaggcgaggcgagctcaggcgggcggcgcgcgaggagtgagctaaacccccaccgccggccaacatgttcggccgcgcccccaagaagagcgacaacaccaagtactacgagatcctcggggtgcccaagaacgcctcccaggacgacctcaagaaggcctaccgcaaggccgccatcaagaaccaccccgacaagggcggagaccccgagaagttcaaggagcttgcacaagcttatgaggttttgagtgaccctgagaagcgtgagatctatgatcagtatggtgaagatgctctcaaggaaggaatgggtggaggaggtggtggagttgatccatttgacatcttttcatcattctttggtccctcttttggaggcggtggtggcagcagcaggggcagaaggcaaaggaggggagaggatgttatccatccacttaaagcttctctagaagatctttacaatggcacctcaaagaagctttctctttctcgtaatgtcctctgctccaagtgcaagggcaagggctccaaatctggtgcttccatgaggtgcccaggttgccagggttcaggcatgaaagtgactatccgccaactggggccttccatgatacagcaggtgcagcatgcttgcaacgagtgcaaggggactggagagagtatcaacgagaaggatcgctgccaaggctgcaagggtgagaaggttgttcaggagaagaaggttctggaggttcatgttgagaaggggatgcaacacaaccagaagatcaccttccctggtgaagctgatgaggcgcctgatactgttactggagacatcgtattcgtcgtccagcagaaggagcacccaaagttcaagcgaaagggcgatgatctcttttatgagcacaccttatctctcactgaagctctttgtgggttccagcttgttcttacccatctggacaacaggcagctgctcattaagtctaaccctggtgaaattgttaagcctgattcattcaaggcaataagcgatgaggggatgccgatgtaccagaggcccttcatgaagggcaaactctacattcacttcacagtggagttccctgactcgctggcaccggagcaatgcaaggctctggaggctgtgcttccaccaaagcctgtgtccaagctgactgacatggagctagatgaatgcgaggagacaacactgcatgatgtcaacaacatggaggaagagatgcgcaggaaagcccaagctgctgctcaggaggcgtacgacgaggatgatgatatgcctggaggtggtgcacagagagtgcagtgcgcacaacagtaagcagagtacattaggagcttgtctcattgctgtgcaagtcgtggcagcaagattttttggacccaagatgcctgttctctggttttgctgctgtgatccacaaagctgattttagcccgtatatgccgggactgtatcccttgcctttgcaaacccccctaccccccaaaaaatgctacttatccaggatagttggccacttctgctgtaatgtgatactcgtacggtagtagagtacttcttataatggtaatcttgtgtgaaaactatacatcgcgtgccgtctgaacgaatatgttgtcctgtttttgcttgattgcggctttgcatgttgttgctggcatcttcatgaacattattatccacccacttgtcgctc

SEQ ID NO: 8215 - DNA, 1883 bp, Sorghum bicolor
cccattctgctagcccaccaccgtgaatacgcgtccgctgcggcgttgacgtacttacccgactacattaaccaacgcgtatcggcggtggcaaaccctctcgcttcccactccgctcggccaccagctttgaccgcctcctcccctcccctccgctcctgctcctccccaccccactcccccgcaggagcggcggcggcggcggcggcgaggttgtatcccgcatcggcgagcggcaccggcggcaaaggcaagatgttcgggcgcgcgccgaagaagagcgacaacaccaagtactacgagatcctcggggtgcccaagtcggcgtcccaggacgacctcaagaaggcctaccgcaaggccgctatcaagaaccaccccgacaagggcggtgaccccgagaagttcaaggagctcgcacaagcctatgaggttctgagcgacccagagaaacgtgagatttatgatcagtatggtgaagatgcccttaaggaaggaatgggtggtggaggagcccatgttgatccatttgacatcttctcatcattttttggaccctcttttggaggaggtggtggaagcagcaggggaagaaggcaaaggaggggagaagatgtagtccacccacttaaagtttctctggaagatctttacaatggcacctcaaagaagctctctctttcgcgcaatgtcatctgctctaagtgcaagggcaagggctcgaagtctggtgcatcaatgaggtgccctggttgccagggctcaggcatgaaagtcacaatccgccagctggggccttccatgatacagcagatgcagcagccttgcaacgagtgcaaggggactggagagagcatcaacgagaaggaccgctgcccagggtgcaagggtgagaaggttgttcaagagaagaaggttcttgaggttcatgttgagaaggggatgcaacacaaccagaagatcaccttccctggtgaagctgatgaagcgcctgatactgtcactggagacattgtattcgtcctccagcagaaggatcactccaagttcaaaagaaagggtgaagatctcttttatgagcacaccttgtctctgactgaagctctctgtgggttccaatttgttcttacacatctggacaacaggcagcttctcatcaaatcaaaccctggtgaagttgttaaacctgaccaattcaaggcgataaacgacgaggggatgccaatttaccagaggcctttcatgaaggggaagctctacattcatttcacagtggagttccctgactcactggcaccagagcagtgcaaggctctcgaggcagtacttccaccaaggtcttcatccaagctgacggacatggagatagatgaatgcgaggagacaactatgcatgacgtgaacaacatcgaggaagagatgcgcaggaagcaagctcatgctgcccaggaggcatacgaggaggacgacgagatgcccggcggagcccaaagagtgcagtgcgcgcaacagtaagcaggcgtatcatcatggcaattggcagggttgcgcttcaagtgctagagtggtctctggttttgctgtcgctgagatgcgaaataggaagctgattctacccctgcaagcagggaatgtatcctttttgctgcaactgaaaaaaaaaaaaattgctacctacgcatggctggctacctttcttttaacttttgtttgtgagatttgctagagtgatggtttcatcaatatataggtggacttaaatgtttgtggaatgctactgtataacgcacatatgggtgcactgtctgttgcatcgccgtctgaatgacatcgccgtttgcacatcggcacattttttttaaatataacgcataatcgcttgc

SEQ ID NO: 8216 - DNA, 2286 bp, Sorghum bicolor
tgcagtagagcaaagcaaagcccggggccctgagccctgatccactcgggcccattctgctagcccaccaccgtgaatacgcgtccgctgcggcgttgacgtacttgtggtcgtctacagacccgactacattaaccaacgcgtatcggcggtggcaaaccctctcgcttcccactccgctcggccaccagctttgaccgcctcctcccctcccctccgctcctgctcctccccaccccactcccccgcaggagcggcggcggcggcggcggcgaggttgtatcccgcatcggcgagcggcaccggcggcaaaggcaagatgttcgggcgcgcgccgaagaagagcgacaacaccaagtactacgagatcctcggggtgcccaagtcggcgtcccaggacgacctcaagaaggcctaccgcaaggccgctatcaagaaccaccccgacaagggcggtgaccccgagaagttcaaggagctcgcacaagcctatgaggttctgagcgacccagagaaacgtgagatttatgatcagtatggtgaagatgcccttaaggaaggaatgggtggtggaggagcccatgttgatccatttgacatcttctcatcattttttggaccctcttttggaggaggtggtggaagcagcaggggaagaaggcaaaggaggggagaagatgtagtccacccacttaaagtttctctggaagatctttacaatggcacctcaaagaagctctctctttcgcgcaatgtcatctgctctaagtgcaagggcaagggctcgaagtctggtgcatcaatgaggtgccctggttgccagggctcaggcatgaaagtcacaatccgccagctggggccttccatgatacagcagatgcagcagccttgcaacgagtgcaaggggactggagagagcatcaacgagaaggaccgctgcccagggtgcaagggtgagaaggttgttcaagagaagaaggttcttgaggttcatgttgagaaggggatgcaacacaaccagaagatcaccttccctggtgaagctgatgaagcgcctgatactgtcactggagacattgtattcgtcctccagcagaaggatcactccaagttcaaaagaaagggtgaagatctcttttatgagcacaccttgtctctgactgaagctctctgtgggttccaatttgttcttacacatctggacaacaggcagcttctcatcaaatcaaaccctggtgaagttgttaaacctgaccaattcaaggcgataaacgacgaggggatgccaatttaccagaggcctttcatgaaggggaagctctacattcatttcacagtggagttccctgactcactggcaccagagcagtgcaaggctctcgaggcagtacttccaccaaggtcttcatccaagctgacggacatggagatagatgaatgcgaggagacaactatgcatgacgtgaacaacatcgaggaagagatgcgcaggaagcaagctcatgctgcccaggaggcatacgaggaggacgacgagatgcccggcggagcccaaagagtgcagtgcgcgcaacagtaagcaggcgtatcatcatggcaattggcagggttgcgcttcaagtgctagagtggtctctggttttgctgtcgctgagatgcgaaataggaagctgattctacccctgcaagcagggaatgtatcctttttgctgcaactgaaaaaaaaaaaaattgctacctacgcatggctggctacctttcttttaacttttgtttgtgagatttgctagagtgatggtttcatcaatatataggtggacttaaatgtttgtggaatgctactgtataacgcacatatgggtgcactgtctgttgcatcgccgtctgaatgacatcgccgtttgcacatcggcacattttttttaaatataacgcataatcgcttgctaatcagcaacgctggaatggtctgattaatgatgcctggcaatacatacatatacatatcataatgtactgttgactgtcaagaaacaatagtcgttgcggatgaattgaggaaggaaatggtgtgagcaggcaggctagcgtggttggatggtgacatggaatttcatgccgagtttgcagtagttgccgacgctgcacacgtagtagcgcatgcctttgtagtcgagcgggacgacggccggcgggacgcggaagttgctgtaggggtcgtcggctgtgcagtcctcgtactccctcctcgacacctgcacaacgtcgtagaaccctatcgggaac

SEQ ID NO: 8217 - DNA, 1522 bp, Musa acuminata
gggggcctcgagccatccatcgacaagggttctcggagtcgaggtcggcagcgttgaggtggtcttgaatcgggagtaggcaagacctgagggcccgatttctcattcagtttggggaagatcgattagggttcggtcggcaagatgttcgggagggcgccgaagaagagcgacaacaccaagtactacgagatcctcggggtaccgaagaacgcgtcgcaggaggacctcaagaaggcctaccgtaaggccgccatcaagaaccaccccgataagggtggcgatccagagaagttcaaggagttggcccaagcttatgaggttctgagcgatcctgagaaacgtgagatttatgatcagtatggtgaagatgccctcaaggagggaatgggtgggtggaggtggccacaacccattcgatatcttcgagtcgttcttcggtggaaatcccttcggaggaggcggaagcagtcgcggacgaaggcagaggagggggggaggatgtgatccatcctctgaaggtgtctttggaggacctctacaacgggacctcgaagaaactatccctttcgcggaatgtcatctgccaaaagtgcaagggggaagggttcaaagtctggtgcttcaatgaagtgctccggctggtcaaggctcgggtatgaaggtcacaattcgtcagttagggcctgggatgatccaacaaatgcagcacccttgcaacgagtgcaaggggactggggagaccatcaatgataaggatcgctgcccacaatgtaaaggtgagaaggttgttcccgagaagaaagtgctggaggttatagtggagaaaggaatgcagaatggccagaagattaccttccccggagaggcagatgaagcacctgagacagttactggagacattgtgtttgtacttcaacagaaggatcacccaaagttcaagagaaagggagatgatctcttctacgagcacgcattatcgctcactgaagctctctgtggcttccgattcgtgttgacccatttggataacagacagctactgattaagtccaaccccggtgaagttgtgaagcccgatcaattcaaggcaatcaatgacgagggcatgccgatgtaccagaggcccttcatgagggggaagctctacatccacttcaccgtggacttcccagattcaatgacaccagaacagtgcaaagctctcgaggctgttcttcccccaaagcctgcatcgcagatgaccgacatggagctggatgagtgcgaggagacgacattgcatgatgttaacatcgaggaagagatgcgcaggaagcaggctcaggcacaggaggcttacgaggaggatgacgatatgcatggtggtgcccagagagtgcaatgtgctcagcagtgaacaaaaatctttttggaatcagctgagttcgtgatgagctccgtactctttcagttgtctgcgtactgattactgtgtcgatcattgtcgttgtggtaaccttgtggctgaacactataccta

SEQ ID NO: 8218 - DNA, 1666 bp, Aquilegia formosa
gcatacctatcgaatccagcaaaaagaaaaaaaaaaagaaagaataacttctaaaaaaactatctttcttcttcttcttcttgttctttgattagatcgatttctttcgattgaaatctagggttaattgaattcgagcgaagatgtttggaagaccaccaaagaagagtgataatacaaaatactatgaaattcttggtgttgcgaagaatgcttcaccagaagatttgaagaaggcttataagaaagctgctattaagaatcatcctgataagggaggagatcctgaaaagtttaaggaattagctcaggcttatgaagttttgagtgaccctgagaaacgtgatttgtatgatcaatatggtgaggatgcactcaaggatccaggaatgggtggtggaggtggccatgatccattcgacatcttcagctctttctttggtggaagtccctttggaggtggtagcagcagagggcgtaggcagaggaggggagaggatgttgtccatcccctcaaggtttcattggaggacctttatagtggaacttcaaagaagctttcactctcgcgaaatgttctgtgctccaagtgcagtggaaaaggatctaaatctggtgcctcaatgaagtgtcctggatgccaaggttctggtatgaaggtttcaatcaggcaacttggtcctggtatgattcaacagatgcagcatccttgcaatgagtgtaaaggcactggagaatctatcaatgagaaggaccgatgcccttcttgcaagggggaaaaggttgtgacagagaaaaaggttttggaagtacatgttgaaaagggcatgcagaatgggcagaagataacattccctggagaagcagatgaagctcctgacaccatcaccggtgatatagtgtttgttctccagcagaaggatcatcccaagttcaagcgaaagggtgatgacctctttgttgagcacaccttgtctctcactgaggcgctgtgtggtttccagttcataattacccacttggatggaaggcaacttctcatcaaatcccaacctggagaagtagtaaagcctgatcaattcaaggcagtgaatgatgagggaatgccaatgtaccagaggccgttcatgaggggcaagctttatatccatttcactgttgattttcctgattctctgactccagaacagtgcaaggcacttgaagctgtgttaccaccaaaaaccgcaacacagatgacagacatggaactagatgaatgtgaggaaacgactttgcatgatgtgaacattgaggaggagatgaggaggaaacaggcagctcagcatgaagcctacgatgaggatgatgaaatgcctggtggtgctcaaagggtgcagtgtgctcaacagtagagggctattctcatgactctaaaatctttgattgtctgaatgataatcctattaacccttctaggccctataggtagaaaaccttatattattgaacaatgcctgtatgagtggctgtgttgattgtgagaatttcagtattgtgatgaaaccagtttttgtaagttaaaacttttctttgttatatctagtgcttctttttacgtctgagagactctctcagtgtgctaaattttgcttgactagagttatttttatattatctttgtgtg

SEQ ID NO: 8219 - DNA, 1520 bp, Euphorbia peplus
gtttctgtggctctctctaagctgaatctctcaatcgctgatctttgattgattgattgattaggtcatctgagagaagaagagatgtttggaagagcaccgaagaaaagcgataactcaaagtattatgagattctcggagtctcaaagagcgcttcgcaggatgatctaaagaaggcttatagaaaagctgccatcaagaaccatcctgacaagggtggtgatccagaaaagttcaaggagttggcccaggcttatgaagttttaagtgacccagaaaagcgtgatatatatgatcagtatggtgaggatgcccttaaggaaggaatgggcggtggtggcggtggccatgatccatttgacatattccaatccttctttggtggcagtccatttggtggcggtggtagtagcagaggccggaggcagaggaggggtgaggatgtgactcatcctctcaaagtttccttggaagatctctacaatggcacctccaagaagctatctttatcccgaaatgtaatctgctcaaagtgcaaaggtaaaggctccaagtcaggtgcatcaatgaaatgttcaggttgccaaggatctggaatgaaggtttccattagacaccttggtccctctatgatccagcaaatgcagcatccttgcaatgaatgtaagggtactggggagaccattaatgacaaggatcggggcccccagtgcaagggcgaaaaggttattcaagagaagaaagtcttggaagtccatgttgagaagggtatgcaaaatggacagaagatcacattccccggagaagctgatgaagctcctgatactgttacaggagatatagtttttatccttcagcaaagggagcatcctaagtttaaaagaaggggagatgatctagttgtggagcacaccttgtctctaactgaggctctctgtggtttccagttcatattgacccatttagatggaaggcaactcctcataaagtcccagcctggggaagttgtgaagcctgatcaattcaaggctataaatgatgaggggatgccaatgtaccagaggccatttatgaggggtaagttgtacattcacttcaatgttgaattcccggattctcttccaccggatcaatccaaagccctagaggctgtgcttccatcgagaacttccgtacaattgtcggacatggaggtggatgaatgcgaagaaaccactttgcatgatgtcaattttgaggaagagatgaggagaaagcaacagcagagtgcagaggcttatgatgaagatgaagatatgccaggtggcgcccagagagtgcaatgcgcccagcagtaagccgaggaagcaaaacctgagtgagtaattagtgccaatattaagatagttgttatgtgagaataatagggattctcaatcatttgttggcattggtttaaaggattttagagactgctggttcgacttctggaatattatctcgggagcattcgctcgggaacaaaccagaaaaactgtcc

SEQ ID NO: 8220 - DNA, 1434 bp, Brassica napus
ctccgtctccttctcctctccaccgttaaaagcctcgcgatttgccttctctcccctattagggttttcttaacaaggagggtgaaaagatgttcagaagaggaccttcgagtaagagcgacaacaccaagttctacgagatccttggcgttcccaagtccgcttcgccagaagatctcaagaaggcttacaagagagccgctatcaaaaaccatcccgacaagggtggagatcctgagaagttcaaggagctaggtgaggcttatggagttcttagtgatccagagaagcgtgagatctacgatcaatatggagaggagggactcaaggatggaattgatcgacacgacccttttgatatcttctcgtccttctttggtcgtaatgaaaggaggcagaggcgtggtgaagatgttgttcaccctctgagggtatccctggaggatctttatctcggaacaacaaagaagctctcactttctaggaatgctctgtgctcaaagtgtagcggaaagggttcaaagtctggagcttcgctgaaatgtggtgggtgtcaaggaaagggaatgaaggtctcgatcaggcagattggacctggaatgattcagcagatgcagcatgtttgtcaagactgcaagggtacaggagagaccatcaatgatcgtgacaggtgtccacaatgcaaaggagataaagtaatccccgagaagaaggtgcttgatgtagctgttgaaaagggaatgcaaaacagtcagaagatcacattccgcggacaagctgatgaagcgcctgatacggtcactggagatatagtgtttgtcattcagcagaaggagcaccctaagttcaagagaaagggaaatgatctctttgtggagcacaccctctctctaactgaggctctctgtggcttccagttcgtcttgacgcacttggacgcaagacagcttctcatcaaatccagccctggggaggttgtgcagccagattcatacaaggcgataagcgacgagggaatgccgatgcaccagaggccgttcatgaagggcaagctttacatccacttcacggtcgagttcccggagtcgcttagcggagatcagacaaaggcctttgaagctgtcttaccaaagccggcagagtttgctctgagcgacatggagatagccgagtgcgaagagacgacgctgcacgaggtgaacattgaagctgagatgaaaaggaaggctcaagctaaaagagaggcttatgatgacgatgatgaagaagaaggcccaggcggtggtcacggtgttcaatgtgctcagcagtgatccaacatgcgcattttagtgatatccaacttttgcgtttttttttgttaaaattttctttacatgattttttggatcttcttatagactttgcctaaatcctgttacaaattttattata

SEQ ID NO: 8221 - DNA, 1782 bp, Brassica napus
gtgttctacccttccttcgcttctgcaaggtcttgctagtgtctgccagttccgtctttattaaccatcaatcttcgctcgtgttcctgtgatgctttggttaaagcatcgtgcatccttcgctcctgctcgtcccggacaaagcgaagctgctgcatacattcttttagacctgcatcagtgtgagcggacctctcgtcgctcacgtgtttctcattcacgcttcttctagctgagccttcttcaaacaaactccgtctccttctcctctccaccgttaaaagcctcgcgatttgccttctctcccctattagggttttcttaacaaggagggtgaaaagatgttcagaagaggaccttcgagtaagagcgacaacaccaagttctacgagatccttggcgttcccaagtccgcttcgccagaagatctcaagaaggcttacaagagagccgctatcaaaaaccatcccgacaagggtggagatcctgagaagttcaaggagctaggtgaggcttatggagttcttagtgatccagagaagcgtgagatctacgatcaatatggagaggagggactcaaggatggaattgatcgacacgacccttttgatatcttctcgtccttctttggtcgtaatgaaaggaggcagaggcgtggtgaagatgttgttcaccctctgagggtatccctggaggatctttatctcggaacaacaaagaagctctcactttctaggaatgctctgtgctcaaagtgtagcggaaagggttcaaagtctggagcttcgctgaaatgtggtgggtgtcaaggaaagggaatgaaggtctcgatcaggcagattggacctggaatgattcagcagatgcagcatgtttgtcaagactgcaagggtacaggagagaccatcaatgatcgtgacaggtgtccacaatgcaaaggagataaagtaatccccgagaagaaggtgcttgatgtagctgttgaaaagggaatgcaaaacagtcagaagatcacattccgcggacaagctgatgaagcgcctgatacggtcactggagatatagtgtttgtcattcagcagaaggagcaccctaagttcaagagaaagggaaatgatctctttgtggagcacaccctctctctaactgaggctctctgtggcttccagttcgtcttgacgcacttggacgcaagacagcttctcatcaaatccagccctggggaggttgtgcagccagattcatacaaggcgataagcgacgagggaatgccgatgcaccagaggccgttcatgaagggcaagctttacatccacttcacggtcgagttcccggagtcgcttagcggagatcagacaaaggcctttgaagctgtcttaccaaagccggcagagtcagctctgagcgacatggagatagacaagtgcgaagagacgacgctgcacgaggtgaacattgaagctgagatgaaaaggaaggctcaagctaaaagagaggcttatgatgacgatgatgaagaagaaggcccaggcggtggtcacggtgttcaatgtgctcagcagtgatccaacatgcgcattttagtgatatccaacttttgcgttttttttgttaaaattttctttacatgatttttggatcttcttatagacattcctaaatcctgttacaaattttattatatttttggaataaacttttctagtttttgagattttgtcctctccaccaacaattcaatgtgctatatcaagacattttcaacaaaataattttcaatgc

SEQ ID NO: 8222 - DNA, 1693 bp, Coffea canephora
gtcgctgtttctagccttcgttgcccttttctcttcagctctctgaaaaagtcgaaaatcgtcgtaaatcacaagcgaagatgtttgggagggcgcctaagaaaagtgataatacgcggtactatgagatattaggggtgtcaaagaatgcttctcctgaagatcttaagaaagcttacaagaaagccgccatcaagaaccatcctgataagggcggcgaccctgagaagtttaaggagctagctcatgcttatgaggtcttgagtgacccagaaaaaagggagatttatgatcagtatggtgaagatgcgctcaaggagggaatgggtggtggcggaggcatgcatgatccatttgacatcttccaaactttctttaatggagatccatttaatagaggtagcagtaggggacgaagacagaggaggggtgaggatgtagttcatccattgaaggtgtcgttggaagatctgtacagtggtacaaccaagaagctctctctgtcccggaatgttatttgtacaaagtgtagtggaaaaggatcaaaatctggagcttcaacaaagtgttccggttgtcaaggtactggtatgaaggtgacaattagacagcttggtcctggaatgatccagcaaatgcaacatccttgcaatgaatgcaaaggaactggagagactatcaatgacaaggaccgctgtccactatgtaaaggtgaaaaagttgtcccagagaagaaagtattggaagttcatgtggagaagggcatgcaaaatggccagaagattactttccctggagaggcagatgaagcgcctgacactgccactggggacatagtgtttgttgtccagcagaaagagcatccaaagctcaagagaaaacatgatgatatttttgtcgagcatactttgtctctcactgaggcactctgcggcttccagttcatcttgacgcacctggatggaaggcaacttcttataaaatcaaagccaggagaagttattaagcctgatcaattcaaggcaatcgatgatgaagggatgccaatgtaccagaggccatttatgcggggtaaaatgtatattcatttcactgtagagttcccagactctctgagccccgaccaggtgaaggctttggaaggaatccttcctccaaagccacaatcacagttgactgacatggagcttgatgagtgtgaggagacaacattgcatgatgtcaacattgaggaggagatgaggaggaagcaagctgctcagcaagaggcttacgaggaagatgatgacatgcatggtggtggagctcagagagtgcaatgtgctcagcagtgatcccttgaagatttttaggacgagatgattttgtactttctcaaatgccatgagcttataagagttgctgttcatgtatttgctttggcagattaatctagttttgtctgcagttgttgatcttgaaggagagaatttacttggcacaatttgctcctctcgctttcttttttttcccctttttcttggggagaaataattgggcttttggcagaaaagatcagtagtagtagttcccctggtctagaaaagtactatgtttttgcacacactgattttacaaaatctgtctactgacgaaagaatctgaactgttattggtgcaagatttcctttactaaatgtgttgatctaacctt

SEQ ID NO: 8223 - DNA, 1655 bp, Coffea canephora
ggaaccctctcggctctctctctccctcgctctcgatcgtcgtggctcgctaggccgctaattttactccgtccgccagctcccaagtcaacactcgaccgtcaatccctctagggtttccgtccgagtagatcgaagaacaagatgtttgggagggcgccgaaaaggagcgataacacaaagtactatgaggtattgggggtttccaagaacgcctcccaagatgatctcaagaaggcttatcgtaaagctgccatcaagaatcaccctgataagggaggagatccggaaaagtttaaagagctagctcaagcctacgaggtacttagtgacccagagaagcgtgagatctatgatcagtatggtgaggatgcattgaaggaaggaatgggtggtggaggtggtgtccatgatccatttgacatcttccagtcattctttggtggtagcccttttggtggaggtggaagcagcagaggcagaaggcaaagaaggggagaggatgtcattcatcctcttaaagtttctttggaggacctgtacaatggaacctctaagaagttgtccctctcacgaaacgtgttgtgcccaaagtgcaagggcaaaggttctaaatcaggtgcttcaatgaaatgttcgggctgtcaggggtctgggatgaaagtttctattagacagcttggtccgtcgatgatacagcagatgcagcatccttgtaatgagtgtaaaggtactggtgaaactattaacgacaaggatcgctgcccacagtgcaagggtgagaaggttgtgcaggaaaagaaggttttggaagttgtcgtagagaagggtatgcaaaatgggcaaaaaattacattccctggtgaagctgatgaagcaccggacacagttactggggatattgtctttgtcctgcaacagaaagagcatccaaaattcaagcgcaagcatgatgacctgttctatgagcacactctctccctgactgaggctctttgcggcttccaatttattttgactcacctggatggcaggcaacttcttattaaatcccagcccggagaagtggtcaagcctgatcaattcaaggcaataaatgatgaggggatggtggtgtaccagaggccatttatgagaggtaaattgtatattcactttaatgtggaattcccggactatctggaccctgagcagtgcaagtctctggaggctgtgttgccaccaaagaccacaaaacaaattactgacatggagttggatgagtgtgaggagaccacactacatgacgtaaacattgaggatgagatgcgtaggaaacaacaagcgcaagaagcatacgaggaagatgaagatatgcatggtggtgctcagagagtgcagtgtgcccagcagtgagttgggaggaaagtggtagaaaaaggagccaaatccaggagatgagcgagaaatcagtattttattaaagctttaataggtttgttgaggcaatgacattttgtacaatgtttgtcctcaattttattagaattagatttgctagttaactatttgtaacttttgcatttctttgcaaactgatactgtatccaatgttcacagtggaccattgtgattcaaaacgcgagtttgatatgcggtttacatgcatttgtttt

SEQ ID NO: 8224 - DNA, 1663 bp, Cannabis sativa
ttcgaagttaatgtgaattgtcaatactgccctcatcaccgctttccaacacaataaatcccagccgttcacttcctctctttataatcgcagatctaccccaatttcttattcctctttctctctagccgtctcgccttgttgctctttctctcgctttctctctctttctcttcgctctccttacacaaaggaagaagggaataatcgagtttgcatactccttagggtttggaatagaatttataagaggatgtttgggagagcaccgaagaaaagtgataataccaagtactatgaggtgttgggcgtttctaagaacgcttcgcaagatgatctgaagaaggcttatcgtaaagctgccattaagaatcaccccgacaagggtggtgatccagaaaagtttaaggagttggctcaagcgtacgaggttttgagtgacccagagaagcgtgagatctatgatcagtatggtgaggatgcccttaaggagggaatgggtggtggaggcggtggccacgatccatttgatatattccaatccttctttggtggcagcccatttggtggtggtggtgggagtagcagaggccgaagacagagaaggggagaagatgtaattcatcctcttaaggtttctttggaagacctatacaatggcacatcaaagaagctatccctttcccgcaatgtactttgctctaagtgcaagggcaagggctcaaagtccggtgcttcaatgaaatgccctgtctgtcaaggctctggaatgaagatttccattagacagcttggtccatctatgattcaacagatgcaacacccttgcaatgactgtaaaggtactggcgagaccattaacgacaaggatcgatgcacgcaatgtaagggtgagaaggttgtccaggagaagaaagtcttggaagttaatgtggataagggtatgcaaaatggacaaagaattactttccctggagaagctgacgaagctcctgatactgttactggagatattgtatttatcttacaacagaaagagcaccccaagtataaaagaaagggagatgacatattttatgagcatacccttagccttacagaggcactatgcggctttcaatttattttaacacatttagatggcaggcagctccttattaagtctcaacctggagaagttgtcaagcctgaccaattcaaggctataaatgacgagggcatgccaatgtaccagaggcccttcatgaagggcaaattgtacattcacttcaccgttgaattcccagactctttgagcccagaacaatgcaaggccctggagactgtgctgccaccaagggcaggagctcagcttaccgacatggagatagatgagtgtgaggagaccacaatgcacgatgtgaacattgaggaggagatgcgccgcaagcaagctcagtctcaagaagcttacgatgaagatgatgacatgcacggtggtggtgctcaaagggtgcaatgtgctcagcaatgatgagagcgaggtagtagtgtgagcggtgttttaacaaattatttgagagaaataaacagttaacattgtttctcctttccttataggttttgtttcttactttattctctcttttttttttcttttttcttttttagtatttaaattctt

SEQ ID NO: 8225 - DNA, 1477 bp, Cicer arietinum
gattggccgcccgggcaggtactatgaaatccttggtgtttcaaagaacgcttctcaggatgatttgaagaaagcttacaagaaagctgctatcaagaatcatcctgataagggtggtgatcctgagaagttcaaagagctagcacaagcttatgaggttttgagtgatcctgagaagcgtgagatatatgatacatatggcgaggatgctcttaaggaaggaatgggtggtggaggtggtggacatgatccatttgacattttctcgtctttctttggtgggaatcattttggaggaggtggtggtagccgaggacgaaggcagagacggggtgaagacgtggttcatcctcttaaggtctctttggaggacctttaccttgggacatctaagaagccttctctatcgagaaatgtcttgtgctcaaagtgcagtggcaaaggttctaagtctggggcttccatgaagtgtgctggctgtcaaggaactggtgtgaaggtttctattaggcaccttggtccgtcaatgattcagcaaatgcagcatccttgcaatgaatgtaagggtactggtgaaactatcaatgataaagatcgctgcccacagtgcaagggagggaaggttgtacaagagaagaaagtacttgaggtccatgtggagaagggaatgcagaattcacagaagattacattccctggtgaagctgatgaagcaccagacacagttactggagatattgtatttgtgcttcagcagaaagaacatcccaagttcaaaagaaagagtgaagacctttttgtcgagcacactctgtcccttactgaggctttatgtggtttccagtttgcgctgactcacttggatggccgccaactccttatcaaatcaaaccctggggaagttgtcaagcctgattcatttaaggctattaacgatgagggaatgcccatgtaccagaggccattcatgaagggcaagctttacatccactttacagtggagttccctgagactcttagtcttgaccaggtgaagggtttggaagctgttttgccagctaaaccttcatcgcagttgacagatatggagctggacgagtgtgaggaaactacacttcatgatgtcaatatggaagaggagacgaggaggaagcagcatcagcaacagcaagaggcatatgatgaggacgatgatatgcctggtggggcacagagggtacagtgtgcccagcagtaatgacttctgtagcagaagacagaagtagtatcagaaatgatgatgattatgataatgatactgttttttaaccgtagtgtggaccaaaaacgtaagtagtgtttgatctatgtttttgagagtgtgaacactttactgctttcaatttattgtcgatgggataacttccattttgacatcctaaatgcatgatataatttggtatttttaaatcacatggccatgtttggattaaggtga

SEQ ID NO: 8226 - DNA, 1716 bp, Hordeum vulgare
gcccgactttgaccgcctcctcgtctccgctccgctcccacgcccgccccgcgggagagaggcgaccggcggcgcgcgaggaggggcctaccccaccgtctcaccaccccgccggcgaagatgttcggccgcgcccccaagaagagcgacaacaccaagtactacgaggtcctcggggtgcccaaggacgccgcccaggacgacctcaagaaggcctaccgcaaggctgccatcaagaaccaccccgacaagggcggtgaccccgagaagttcaaggagctggcacaagcctatgaggttttgagtgaccctgagaagcgtgagatctatgataagtatggcgaagatgctctcaaggaaggaatgggtggaggaggaggtggtggagttgatccatttgacatattctcatcatttttcgggccctcttttggaggtggtggtggtggcagcagcaggggcagaaggcaaaggaggggagaggatgttgtccatccacttaaagcttctctagaagatctttacaatggtacctcaaagaagctctctctttcccgtagtgtcctctgctccaagtgcaagggcaagggctccaagtctggtgcttccatgaggtgcccaggttgccagggttcaggcatgaaggtgactattcgtcagctggggccttccatgatacagcaggtgcagcatgcctgcaatgattgcaagggcaccggggagagtattaacgacaaagatcgctgcccaggctgcaagggtgagaaggttcttcaggagaagaaagttttggaggttcatgttgagaaggggatgcaacacaaccagaagatcaccttccctggggaagctgatgaggcgcctgacactgttactggagacattgtatttgtcgtccagcagaaggaacacccgaagttcaagcggaagggtgatgatctcttctatgagcacaccatatctctcactgaagctctttgtgggttccaactcgttttgacccatctggacaacaggcagctgctcattaaatcaaaccctggtgaagttgtcaagcctgattcattcaaggcaatcagcgacgagggaatgccgatgtaccagaggcctttcatgaagggcaagctctacatccatttcacagtggagttccccgactctctggcaccggatcagtgcaaggctctcgaggccgttcttccaccaaagcctgcatccaagctgactgacatggagcttgacgaatgcgaggagacgacgatgcatgatgtcaacatggaggaggagatgcgtcggaaagcccatgctgctgctcaggaggcgtacgacgaggacgacgacgagatgccgggaggcggtgcccagagagtgcagtgcgcgcaacagtaagccaagggcatgattgctaggtttgggaggcaagcttttttgggatccaagatgaagatgcctgcccgcttctggggttttgttggtggtgttatcgatgaaggtgatttttgcccctatggcgccgggactgtatccaaccatgtgttttcgaaaaatgctatctggctacttctgatgtagtgtgatactcagtataaaagcaatctgttcgtgagaactaacgcacgctgtctgtctgaatacgtttgtctacttattagaaccgtcggcaattttgcaaagtatgtttgtggtttttaaacataaacaggtgttctggctgtc

SEQ ID NO: 8227 - DNA, 1731 bp, Oryza sativa
agcactggcgcatcgacctaaccaaaccctctttctctcctcccactccgctagctccggccaccaactttgacccgtcctcctcctccgcatcccccatcccctcctccccggcggcggcggcggcgcggaggcggcggcacgggagcggctagtggtttcgtcggcggaggcggaggcggggccaagatgttcgggcgcgcgccgaagaagagcgacaacaccaagtactacgagatcctgggggtccccaagaccgcctcccaggacgacctcaagaaggcgtaccgcaaggccgccatcaagaaccaccccgacaagggcggcgaccccgagaagttcaaggagcttgcacaagcttatgaggtattgagtgacccggagaaacgtgaaatctatgaccaatatggtgaagatgccctcaaggaaggaatgggtggaggcggatcccatgttgatccatttgacatcttttcatcattctttggaccttcttttggtggtggtggcagcagcaggggcagaaggcaaaggaggggagaggatgtgatccatccgcttaaggtttctctagaagatctttacaatggtacttcaaagaagctctctctttcccgcaatgtcctctgcgccaagtgcaagggcaagggttccaagtctggtgcttccatgaggtgcccaggttgccaggggtctggcatgaaaatcaccatccgccagctggggccttccatgatacagcagatgcagcagccttgcaatgagtgtaaggggactggagagagcattaatgagaaggatcgctgcccaggctgcaagggcgagaaggttattcaggagaagaaggttctggaggttcacgttgagaaggggatgcaacacaatcagaagatcactttccctggtgaagctgatgaggcgcctgataccgttacgggagacattgtattcgtcctccagcagaaggaccactccaagttcaaaaggaagggcgatgatctcttttatgagcacaccttatctctgactgaagcactttgtggtttccaatttgtcctgacacatctggacaacagacagctgctcattaagtcaaaccccggtgaagttgttaagcctgaccaattcaaggcaataaacgatgagggaatgccaatgtaccagaggcctttcatgaaggggaagctctacattcatttcacggtggagttccctgattccctggcgcctgaacaatgcaaggctctcgaggctgtgcttccaccgaagcctgcatcccagctgacagaaatggagatagatgaatgcgaggagaccacgatgcacgatgtcaacaacattgaggaagagatgcgcaggaaagcccaagctgctcaggaggcgtatgatgaggacgatgagatgcctggaggtgcccagagagttcagtgcgcgcaacagtaagcagagtatgtcatctaggaaactcgtcattggttcacaaatcaacgtcgtcgcaaaggtttgccgtaaatttttggacccaaagatgattgtgctctgtttcccgttgcggcgaacatgaagatagtgaagctgattttacaccccttaagccgggactgtatcccttttgtttgcgacttaaaaaatgctactcgtatctagtaatagctggctacgttttactatgctgtgagactcgtagagttttacctcctaaaaagaaactcggtatgttgtgaatgctac

SEQ ID NO: 8228 - DNA, 1851 bp, Zea mays
cccgactacatcaaccaacgcgtatcggcggtggcaaaccctctagcttcccactccgctcggccaccagctttgaccgcctcccctcccctccgctcctgttcctccataccccacccccccgcaggagcggcgcggcggcggcggcggcaaaggcaaaggcaagatgttcgggcgcgcgccgaagaagagcgacaacaccaagtactacgagatcctcggggtgcccaagtcggcgtcccaggacgacctcaagaaggcctaccgcaaggccgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggtggtggtggatcccatgctgatccatttgacattttctcatcattctttggaccctcttttggaggaggtggtggaagcagcaggggaagaaggcaaaggaggggagaagatgtagtccactcacttaaagtttctctggaagatctttacaatggaatctcaaagaagctctctctttcgcgcaatgtcatctgctccaagtgcaagggcaagggctcgaagtctggtgcttcaatgaggtgccctgggtgccagggctcaggtatgaaagtcaccattcgtcagctggggccttccatgatacagcagatgcagcagccttgcaacgagtgcaaggggactggggagagcatcaacgagaaggaccgctgcccagggtgcaagggtgagaaggtcgttcaggagaagaaggttcttgaggttcatgttgagaagggaatgcaacacagccagaagatcaccttccctggtgaagctgatgaagcgcctgataccgtcactggagacattgtattcgtcctccagcagaaggaccactccaagttcaaaagaaagggtgaagatctcttttatgagcacaccctgtctctgaccgaagctctatgtgggttccaatttgttcttacacatctggacaacaggcagcttctgatcaaatcaaaccccggcgaagttgttaaacctgaccaattcaaggcgataaacgacgaggggatgcctatttaccagaggcccttcatgaaggggaagctctacattcatttcacggtggagttccccgactcgctggcaccagagcagtgcaaggctctcgagtcggtacttccgccaaagccttcgtccaagctgacagacatggagatcgatgaatgcgaggagacaaccatgcatgatgtgaacaacatcgaggaagagatgcgcaggaagcaggctcatgctgctcaggaggcgtacgaggaggacgacgagatgcctggcggagcccaaagagtgcagtgcgctcaacagtaagcagactaccataatgggattcaaggcactttggttgctcttcaattatgcgagtgcgcctgtggactgtatggttctatggttttgctgtcgctgagctacgaagtaggaagctgatgcgcccctggctctgcaagcgggggaatgtatccttttttgctgcaactgaaaaatgctacccaggcaatagctggctaccttataacttttgcttgtgagatttgctagagtgacgattttaatttataggtggacttaatgtttgtgtaaggctaggcataacatcatgtctcaatggacgttgccgttgcacattggtgcattttattttaatgtaacgcatgtgcttgtgctgtcgaacaatcttggaatggtctgatcgatgatcggcgtctgttttatataccatccgcagaaggcagcca

SEQ ID NO: 8229 - DNA, 1307 bp, Ambrosia trifida
gattaaagaagaagaagaaggacaaaatgtttggaagagcaccgaaaaagagcgataatacaaagtattacgagatccttggggttccaaagaccgcttcacaggatgatctaaagaaggcttataggaaggctgctattaagaatcatcctgataaaggtggagatcctgagaagtttaaagagcttgcccaagcatatgaggtactgagtgacccagagaagcgcgagatatatgatcagtatggtgaggatgcgttgaaggaaggaatgggcggtggaggcggtggtcatgacccctttgacatcttccagtctttctttggtggcggtagtccttttggtggtggtggtggtagcagcaggggacgaaggcaacgaaggggagaagatgttgttcatcccctcaaagtttctctcgaggatctttacaatggaacttccaagaaactatctctttcacgcaatgtaatttgctccaagtgtaaaggcaagggttcaaagtctggtgcttcaatgaaatgtgctggctgtcaaggttccggaatgaaagtttctatcagacatcttggaccatcaatgatccagcaaatgcagcataccttgtaacgaatagcaagggtactggcgaaaccattaacgacaaggatcgatgcacacagtgcaagggtgcgaaagttgtgcaggagaagaaggtactggaagtacacgttgagaagggcatgcagaatggacagaagattacattccctggagaggctgatgaagctcctgacacagttaccggtgatattgtgtttgtgttgcaacaaaaggagcatcctaagtttaagcgaaagggtgaagacatatttgttgagcacacattgagcttgacagaggccctatgtggatttcagtttatcctaactcatttggataacagacagcttctcatcaaatctcaacccggagaggttgtcaagccagattcattcaaggcaataaatgatgaaggcatgccaatgtaccagaggccgtttatgagggggaagctgtacatccacttcaccgtagaattcccagaatcgctgttgcctgagcagtgcaaggcgttggaggcggtgctgccaccgaagccttcaatgcagatgacagatatggaactggacgaatgtgaagagacgacccttcatgatgtcaacatcgaagaggagatgagaaggaagcagcaacaagcagctcaggaagcttacgatgaagacgaagacatgcatggtggagcccaaagagtataatgtgcacaacagtaagccagaatatgctcta

SEQ ID NO: 8230 - DNA, 1669 bp, Phalaenopsis aphrodite
aacgagagagaaatactagggttagggtttcggttccgaagcgggtgattgcggtcggcaagaagttgattgcttcctctggttttagttggactcacagagagaaggaagatgttcggaagggctccgaagaagagcgacaacacgaggtattatgagattctcggcgtgtcgaaaagcgcgtctcaggatgatctcaagaaggcgtatcggaaggccgctatcaaaaatcaccccgataagggaggggatccggagaagtttaaggagcttgcacaagcctatgaagttttgagcgatcctgagaagagggatatatacgatcagtatggcgaagatgcactcaaggaaggaatgggtgggggcggtgctggccatgatccatttgacatcttccagtctttctttggtggaaatccttttggaggtggcgggagcagtcgtggtcgcaggcagcggaggggagaggatgttgtccacccactcaaagtcacattggaagatctgtacaatggtacttcgaagaaactttctctttcccggaatgttctttgctcgaaatgcaaagggaagggatcgaaatcgggcgcttcaatgaagtgttctggttgtcagggtacaggtatgaaggtctcgattcgccagttgggtccctctatgatacaacaaatgcagcatccttgcaatgagtgcaaaggaactggggagaccatcaatgataaagatcgctgcccacagtgcaagggagagaaggttacccaggaaaagaaggttcttgatgttctagttgagaagggtatgcagaatgggcaagaaatcacctccccggtgaggctgatgaggcgcctgattgtatcactggcgacatcgtatttgtcctgcaacaaaaggaccactctaagttcaaaagaaagggcgacgatctctttgtggagcacacactctccctaaccgaagctctttgtggcttccagttcatattaacccatctcgatggccggcagcttctcatcaaatcaaaccccggcgaagtcgtcaaacctgaccaattcaaggccatcaacgacgagggcatgccgatgtaccagaggccgttcatgaggggcaagatttacatccatttcaccgtcgagttccctgattctttgagtttggatcagtgcaaggctctcgaggcaatccttccctcacggggtcgtactcagctgacggacatggagctcgacgagtgcgaggagacaaccttgcacgacgtgaacatcgaggaggagatgaggaggaagcagcagagccaagctcaggaggcctacgatgaggacgaagacatgccaggcggtgctcagagagtgcagtgtgctcagcagtaaggtatatacttatattataccagtaaaagcgttatcagctgtgttgaatcttatcaaacgtatggttctctgttatcttattacaagcctgatactagcataaaactggattgtttgcatgccttaggtgactggttatatgaaatcttttgctcatcaagaaaatatttgaattttattcggcctgaaataattctgtttaatttgagatttatttaatattattgcatagaaatgcttggattttagccttgcgctgaaattaaaatcatttccaacaagtagttgtctcttttatcaaa

SEQ ID NO: 8231 - DNA, 1484 bp, Triphysaria pusilla
gaaccattttgatctggaataagtgatttttggaagtgatctaagatgtttggaagggctccgacgaaaagtgataacaccaagtactatgaagttctcggcgtccccaaaacggcgtcgccggacgatctgaagaaggcgtacaagaaagcagctatcaaaaatcacccggacaagggcggcgatcccgagaagttcaaggagcttgctcatgcttatgaggtattaagcgaccctgaaaagcgagaaatatatgaccaatacggtgaagatgcactcaaggagggaatgggtgggggtggcggtgggcacgacccctttgacatcttctcatctttctttggtgggggatttggaggtggtggtagtagtaggggacgaagacagagaaggggagaggatgtggtacacccactaaaggtgtctcttgaagatttgtatcttgggactactaagaagctctctttatctcgcaatgtgctttgcgtgaagtgtaatggtaaaggatcaaaatctggagcatctatgacttgctcaggatgccaaggttctggtatgaaggtcacaatgaggcagcttggcccaggcatgattcagcaaatgcagcagcattgtaatgactgcagaggaacaggggagaccatcgataacaaagatagatgccctcaatgcaagggcgcaaaggtcgttcctgaaaagaaagccctggaagtccatgttgagaagggcatgcagaacgggcaaaagataacattccccggggaagctgatgaggcgcctgatacggttactggggacatagtgtttgtgctgcagcagaaggagcatcctaagtttaagaggaagggcgacgacctttttgtcgagcatccgctgacattaactgaggctctctgtggcttccagtttattctctcccatctggatggcaggcatctccttatcaaatctctacctggagaggttgtgaagcctgattcattcaaggctatcaacgatgaagggatgcccatgtatcagaggccatttatgaagggtaaactgtacatacatttcaatgtcgagttcccagattctttgaatcccgatcaaatcgatgccttggccaaaatccttcctgcaaagcctgaatcgcagctgacggagatggagctggacgagtgtgaggagacaaccctgcacgatgttaatattgaggaagagatgagaaggaaacaggctcagcagcgtcaggaagcttatgatcaggatgaagagatgcacggtggtggggcacaaagggtgcaatgcgctcaacagtgaagagttagtgttgcgaattttgggacataacacgcataatctgcctgagttgaggcaattcttgtttgtggctgaaatagcactttaaaactttggattttctaactcttttgctctatcagactatcatctacttatggtgaatttgatatatctcgtgtttggtgaatatatcatggatg

SEQ ID NO: 8232 - DNA, 1661 bp, Gossypium hirsutum
aacatttcaacttcagatctggaccgtccattttcaccccatataactcgatctctagccacccatttccccctctctctttctgcctcactcgccgtctcgcctctcgcttattggttcaagatctggttttgatctgatcagatcgtataaaaatatcaaaacatgtttgggagagcaccgaagaaaagcgataattccaaatactatgagattttgggagtatcgaaaaacgcttcccaagatgatctaaagaaagcttatagaaaagccgctattaagaatcatcccgataaaggcggcgatcctgaaaagtttaaagagttggctcaagcttatgaggtgctgagtgacccggagaagcgtgagatttatgatcagtatggtgaggacgcccttaaagaagggatgggcagcggtggcggtggccatgaccctttcgatatcttccagtctttctttggtggcaatccttttggtgctggtggaagcagccggggcagaagacaaagaaggggggaggatgtaatccatcccctcaaggtatcattggaagatctctacaatggaacatcgaaaaagctttctctttcacgaaacgtaatctgctccaagtgcaagggtaaagggtctaaatctggtgcatcaatgaaatgttccggttgtcaaggttcaggaatgaaagtctccatccggcacctcggtccttccatgatccaacaaatgcagcatccttgcaatgagtgcaagggtactggtgaaaccatcaacgataaggatcgttgcccacaatgcaaaggtgataaggttgtgcaagagaagaaagtcttggaggttattgttgagaagggtatgcagaatggacaaaggattactttcccaggagaagctgatgaagcgcccgatacggttactggggacattgtattcgtcctgcaacagaaagatcatcctaaatttaaacgaaagggtgatgacttatttgtagagcatacattggcacttactgaggccctttgtggctttcagttcatactgactcacttagatggcagacaacttctcattaaaacccaacctggggaagtcgttaagcctgatcaattcaaagcaataaacgatgaaggaatgccgatttatcagaggccatttatgagaggtaaacttttcattcacttcactgttgacttccctgactcgttgaccccagaccaatgcaaggcactggaggctgtgcttcctcccaaggcatcggttcagctgactgacatggagctggatgagtgcgaggaaacaaccatgcatgatgttaacattgaggaagagatgcgtaggaaacaggctcaagctcaacaagaagcttatgaggaagatgaggacatgcatggtggtgcgcagagagtacaatgcgctcagcaatgataaaaaagccgaatgtccgagacacagacggtggtttttggcgatggaatgtactgtggttaaaaaaaaaaaaagaacatttgagagtaagattctcaaacattgttgtgttttggtagtcctttattttttgtttttaatagtgcaagtattttagtaattgcaatggtgttatatgttctgaaacctgatactaagtatgcaacgatttagatttggaacttgaccttattgttgtg

SEQ ID NO: 8233 - DNA, 1592 bp, Populus trichocarpa
gcatcttcttcgcgtgtccagagccttctacacacagagatacaggcagctctgtaaaagtaaacgccaagagctcttgatcgttcgtgggttttcgttatttgggtgtttgattgtttgatttggagagagaagagagaagatgtttgggagagcaccaaagaagagtgataacacaaggtactatgagatactaggggtgtcaaagaatgctagtcaagatgatttgaagaaggcttataggaaagctgccatcaagaatcaccctgataaaggtggtgatcctgagaagtttaaagagctggctcaggcgtatgaggttctgagtgatcctgaaaagcgcgaaatttatgatcagtatggggaagaggcactaaaggaagggatgggcggtggcggtgctggccataaccctttcgatatttttgagtctttcttcggtgggaatcctttcggtggtggtggtagccgaggaaggaggcagagacggggagaggatgtggttcatccattgaaggtgtcattggaggatttgtaccttggcacgtcaaagaagctttccttaacccggaatgtgatttgttctaagtgcaatggaaaaggatcgaaatctggagagtcgatgaagtgtactggctgccagggaagtggcatgaaagtctcaataaggcaacttggcccttcaatgattcaacagatgcagcatccttgcaatgaatgcaagggaacgggtgagaccattagtgataaggatcgttgcccacagtgcaagggggagaagattgtgccggagaagaaggttttggaagttatagtggagaagggcatgcagaatggacagaaaattaccttccctggtgaagctgatgaagcgccggatacagtcactggtgatattgtcttcgtccttcagcagaaggaacatccaaaattcaagagaaagggggatgatctttttgtggaacacactctgcctctcactgaggctctctgtggcttccaatttgtattgacacaccttgatggcaggcagcttcttatcaaatctaaccctggtgaagctgtcaaacctgattcattcaaggcaatcaacgatgagggtatgccgatgtaccaaaggccattcatgaaagggaagttgtatatccacttcactgtggatttccctgattctctgactcctgatcaggttaaagcaatagagaccattctgccgaggccatcaagccagttgacagatatggagctggacgagtgtgaggagactacactgcacgatgttaacattgaagaggaaatgaggaggaagcagcaggctcgtgaggaagcttatgatgaggatgaggaaatgcctcatggcggtcagagagtccaatgcgcccagcagtgagggaactgaactgaatagtgtaggaatggaaaccaaagggcttgcagtaactttgttttggaataggcacggaggacattatctatccttttgaacttgtgaaacatctgatgatttcgaaaaatgtttcaggatcggccttccttttggcactatatgttactcttgacagtgaaatataaatgtcaagtgttttgtcgtc

SEQ ID NO: 8234 - DNA, 1674 bp, Gossypium hirsutum
cacccttctccttctcatcatcaacctctcctaacatttcaacttcagatctggaccgtccattttcaccccatataactcgatctctggccacccattaccccctctctctttctgcctcactcgccgtctcgcctctcgcttattggttcaagatctggttttgatctgatcagatcggataaaaatatcaaaacatgtttgggagagcaccgaagaaaagcgataataccaaatactatgagattttgggagtatcgaaaaacgcttctcaagatgatctaaagaaagcttatagaaaagccgctattaagaatcatcccgataaaggcggcgatcctgaaaagtttaaagagttggctcaagcttatgaggtgctgagtgacccggagaagcgtgagatttatgatcagtatggtgaggacgcccttaaagaagggatgggcagcggtggcggtggccatgaccctttcgatatcttccagtcattctttggtggcaatccttttggtgctggtggaagcagccgaggcagaagacaaagaaggggggaggatgtaatccatcccctcaaggtatcattggaagatctctacaatggaacatcgaaaaagctttctctttcacgaaacgtaatatgctccaagtgcaagggcaaagggtctaaatcaggtgcatcaatgaaatgtaccggttgtcaaggttcaggaatgaaagtctccattcggcacctcggtccttccatgatccaacaaatgcagcatccttgcaatgagtgcaagggtactggtgaaaccatcaacgataaggatcgttgcccacaatgcaaaggtgataaggttgtgcaagagaagaaagtcttggaggttattgttgagaagggtatgcagaatggacaaaggattactttcccaggagaagctgatgaagcgcccgatacggttactggggacattgtattcgtcctgcaacagaaagatcatcctaaatttaaacgaaagggtgatgacttatttgtagagcatacattggcacttactgaggccctttgtggctttcagttcatactgactcacttagatggcagacaacttctcattaaaacccaacctggggaagtcgttaagcctgatcaattcaaagcaataaacgatgaaggaatgccgatttatcagaggccatttatgagaggtaaactgtacattcagttcactgttgacttccctgactcgttgaccccggaccagtgcaaggcactagaggctgtgcttcctcccaaggcatcggttcagctgactgacatggagctggatgagtgcgaggaaacaaccctgcatgatgttaacattgaggaagtgatgcgtaggaaacagactcaagctcaacaagaagcttatgatgaagatgaggacatgcatggtggtgcgcagagagtacaatgcgctcagcaatgataaaaaaaagccgaatgtccgagacacagacggtggtttttggcgatggaatgtactgtggttaaaaaaaaaagaaagaacatttgagagtaagattctcaaaacattgttgtgttttggtagtcctttattttttgtttttaatagtgcaagtattttagtaattgaaatggtgttatatgctttgaaacctgatgctttctaagtatgcaaagattta

SEQ ID NO: 8235 - DNA, 1646 bp, Gossypium hirsutum
acgccattttgtatttattcttttcttcttttcctggttcagggctttctgttgtgttattattctctctctcccccgaaataaagtgaataagaaagttgttttgatacactacactgctagaaaaccaaaaaaaaaagataaaaaaagatgtttggaagagcacccaagaagagtgataatacgaggtactatgagattctgggtgtttccaagaatgcttcccacgatgatttaaagaaagcctataaaaaagccgccattaaaaaccatccagacaaaggtggtgatcctgaaaagtttaaagagttagctcaagcttatgaggttttgagtgatcctgagaaacgtgagatatatgatcagtacggtgaggatgctctcaaggaaggaatgggtggtggagccgcggctcatgacccctttgatatattttcatccttcttcggtggtagtccctttggaggtgctagcagtcgaggaaggagacagagacggggagaggatgtagttcatcccctgaaggtgtctctggaggatctttaccttgggacctcaaagaagctttcactttcccgcaatgtgatatgctccaagtgcagtggcaagggttcgaaatctggagcttcaatgcaatgccctggttgccagggttctggtatgaagatttcagtcaggcaccttggtccttccatgattcagcaaatgcaacatccttgcaatgaatgcaagggtacgggtgagacgataaatgacaaggaccgctgccctcagtgtaaaggtgagaaggttgttcaggagaagaaagtgctggaagtcattgtagaaaagggtatgcagaacggacagaagattacgttcccaggcgaagctgatgaggctcctgataccattacaggggacatagtctttgtccttcagcagaaagaccatccaaaattcaagagaaagggagaagacctgtttgtggaacatacattggctctaactgaagctttgtgtggcttccagtttgtggttacccatcttgatggtcgacaacttctaatcaagtcgattcctggggaggttgttaagcctgattcatttaaggcaatcaatgatgaggggatgcccctgtaccagaggccattcatcaagggcaaaatgtacattcacttcaccgttgaattccctgattctctgaaccctgatcagattatggcacttgaggctattctgccgccaaaaccaacatctcatttgactgatatggagctcgatgagtgcgaggagaccacgctacacgatgtgaacattgaagaggagatgaggaggaagcagcaggcagctcaggaagcctatgatgaagatgaggatacgcatggtggtgcccagagggtgcaatgtgctcaacagtaatgaattgaagctgagtttgagtagtattcatattcctaggtttatggaagctgatcttcatagtaacataactgggactgtatggttttttttgcaagtctgctctgttgcagtccggaagtgttctttgtttaccagacatttttatagaaaatgtcgatttctctgtaggctatttatttatttttaattaatgttttctctctatcctttctcagccaaccttttttcctttgcgcccccat

SEQ ID NO: 8236 - DNA, 1501 bp, Platanus occidentalis
gaatcgaactggtttttagggttctttgatctcgagagaagatgtttggccgtgcgcctaagaaaagcgacaatactaggtactatgagatcctcggagtttcgagaatgcttcccaggatgatttgaagaaggcttataagaaagagggcaatcaagaatcatcctgacaagggaggagaccctgagaagttcaaggagttggcccaggcttatgaggttctgagtgacccagagaaacgtgaaatctatgatcagtatggagaggatgcgctcaaggaaggaatgggtggaggagcaggcggccatgacccgtttgacatattccagtccttctttggtggcagcccatttggaggtggtggaagcagcaggggccgaaggcagagaagaggagaggatgtgatccatcccctcaaagtctctctggaggatctttacagtggtacatcgaagaagctttccctttctagaaatataatctgctccaagtgtaagggcaaaggatcaaaatctggtgcttcgatgacctgttcgggttgccaaggatctggcatgaaggtttcaattaggcaccttggcccctctatgatccagcagatgcagcacgcctgcaatgagtgtaagggcactggagagaccatcaatgacaaggaccgctgccctcaatgcaaaggtgagaaggttgttcaggagaagaaggtgctggacgttgtcgtcgagaagggtatgcaaaattcacagaagataactttccctggggaagcagatgaagcgcctgacacagtcacaggggatatagtctttgttctacagcagaaggagcaccccaagttcaagagaaagggggatgatctctttgtggagcacactttatctctcactgaggctctttgtggattccagttcatattgacccacttggataataggcagcttctcatcaaatctaacccaggagaagttgtcaaacctgatcaattcaaggcgatcaatgatgaaggaatgccaatgtaccagaggccattcataaagggtaagctgtacattcatttcacagtggagttccccgagtccatgaccgccgagcagtgcaaggcgctggaggcggtgctaccgccgaggacatcgatgcagctgacagacatggagctggatgagtgtgaggagactactctccacgatgtcaacattgaggaggagatgcgaaggaagcaggcccaggctcaagaggcctacgaagaagatgatgatctccatggtggagcacagagggtgcagtgtgctcagcaatgatgaatgaataatgagtaggtgaagggaaaggattctgaggtgattttcatagaaggtagtaaaaaaaattggaaatgacaaacaatgcaatcctatgggaacattttttttcttcttccagaattatggatcttattggactatttgtaacttgtggcgtctctgtcgtaagtattattattgttaactttttgaaaaaatgagga

SEQ ID NO: 8237 - DNA, 1651 bp, Juglans hindsii x Juglans regia
  misc_feature (100)..(100): n is a, c, g, or t
  misc_feature (133)..(134): n is a, c, g, or t
  misc_feature (1630)..(1630): n is a, c, g, or t
gggggtctctcgccgtcttgcttgcttctgtggttcttctcttcgaccccttaaggtacaaatcgtgcagctctcgatcgaaagaagagaagatgtttgnggagagcaccgaagaagagcgacaacacgaagnnctacgagatcctgggagtgtcaaacagcgcttcgcaggatgatctaaagaaggcttataggaaagcggccattaagaaccatccggacaagggtggtgacccagaaaagtttaaagagttggcccaagcttatgaagttctgagtgacccagagaagcgtgagatctatgatcagtatggagaggatgccctcaaggaaggaatgggtggtggtggtggtggccacgatccgtttgacatattccagtccttctttggtggcaacccttttggtggtggtggaagcagcagaggccgaaggcagaggaggggcgaggatgtggtccatcccctcaaggtttctttggaggacctatacaatgggacatccaagaagctgtccctctctcgtaatgcaatctgctccaagtgcaagggtaaaggttccaagtcgggtgcttcaatgaaatgttctggttgtcaaggttctggaatcaaagtctccatcaggcaccttggcccctctatgatccagcaaatgcagcatgcttgcaatgagtgtaagggtacgggtgaaaccatcaatgacaaggaccgctgcccacagtgcaagggagagaaggttgtccaggagaagaaagttttggaggttattgtggagaagggtatgcagaatgggcagaagattacattccctggagaagctgatgaagcacccgatactgttacaggggacattgttttcgttctacaacagaaagaacaccccaaatttaagcggaagggtgatgacttatttgttgaacacaccttgtcccttacagaggcactttgtggcttccaatttatattgatgcatttggatggtagacagctccttattaaatctgaacctggagaagtagttaagcctgaccaatacaagggtataaatgatgagggaatgccgatgtaccagaggtcgttcatgaaaggtaaattgtacattcactttgcagtcgaattcccagacacccttagcccagagcagtgcaagacactagaggcggtgctgcctccaaggagttcggtgcagctgacggatatggagctggatgaatgcgaagagactacactgcatgatgtgaacttagaggaagaaatgcgtcgcaagcaagcacaggcccaagaggcatatgatgaggatgaggacatgcctggtggtgctcagagggtccaatgtgctcaacaatgatgaatgaatgagctgacccaaaaaacaggaatgatttggatggagaacctggaattacttaaaataagtattaacatcattgccttctgttacagggagtatttagttagattttggattgtttttggattgttgccatgttatcaaacatgtactgtgtgggagatctaatgtttgaattctagtttacgttaaaaaccatgcttgtttgttggaggtgtatatctgtgtcatctggatggttattttgccatccggatgatgtatttcagggaggctatangaacccattttaagctcgata

SEQ ID NO: 8238 - DNA, 2734 bp, Zea mays
gagctcaagccgcaacaacaaatttcggtgctcccaagcttcataaaggctatcttcggcgtcgttgggatccatggtggcacagaatcgagttgatgttgtagctggcggctagggtttgaagtggagaagaggtccggctggtggcatcctatcgtctattgagggttgggtccggtggcatcatacttgatgacaattgaaagtaattttaatcaacttgtcatgagtagtgagtcttttataaaaaataagctgaaataagcaccctttgatgagcttataggattatcataatctcaaatgctaaattatataattttattagataagttgcttgtttgtttccccactagcttatttacattggattatataatctacataaattataatctcaaacaaaaagtccttaatcagagatcagcgaggtctcacgagtgagaaggcgagagcttgtccaaacgagcattttcgggcgtgtgaacacccatttcagcaaagccgtcgttgtccagttcagcgaagcgcattctgcggctttggcgtgacccattctgctagctcagcactgagaatacgcgtccgctgcagcgttggcgtacaggccggactacattagccaacgcgtatcggcagtggcaaaccctcttcgcttctaactccgctgggccaccagctttgaccgccgcctcccttcccctccgctactgctcctccccaccccactcccccgcaggagcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggcggtggaggatcccatgttgatccatttgacatcttctcatcattttttggaccctcttttggaggaggtggtggaagcagcaggggaagaaggcaaaggaggggagaagatgtagttcacccacttaaagtttctctggaagatctttacaatggcacctcaaagaagctctctctttcgcgcaatgtcatctgctccaagtgcaagggcaagggctcgaagtctggtgcctcaatgaggtgccctggttgccagggctcaggcatgaaagtcactattcgtcagctgggcccttccatgatacagcagatgcagcagccttgcaatgagtgcaaggggactggagagagcatcaatgagaaggaccgctgtccagggtgcaagggtgagaaggtcattcaagagaagaaggttcttgaggttcatgttgagaaggggatgcaacacaaccagaagatcaccttccctggtgaagctgatgaagcgcctgatactgtcactggagacattgtattcgtcctccagcagaaggatcactccaaattcaaaagaaagggtgaagatctcttctatgagcacaccttgtctctgaccgaagcactatgtgggttccaatttgttcttacacatctggacaacaggcagcttctcatcaaatcagaccctggtgaagttgttaaacctgaccaattcaaggcgattaatgatgaggggatgccaatttaccagaggcctttcatgaaggggaagctgtacatccatttcacggtggagttccctgactcgttggcaccagagcagtgcaaggctctcgagacagtacttccaccaaggccttcatccaagctgacagacatggagatagatgaatgcgaggagacgactatgcatgatgtgaacaacatcgaggaagagatgcgcaggaagcaagctcacgctgcccaggaggcgtacgaggaggacgacgagatgccgggcggagcccagagagtgcagtgcgcgcaacagtaagcagactatcatcaaggcaattgggaggggtggtgcccttaaagcatgggagtgatctctggttttgctgtcgccgagctgggaaataggaagctgaatcgacctcgcaagcggggaatgtatccttttttgctgcaacataaaaaatgctacccaggcatagctgggtaccttttaacttctgtttgtgggatttgctagagtgatggtttcgatatatagggggacttgaatgtctggaatgctacggtataacgcacatttgggtgcaatgtctgttgcattgctgtctgaatgacatcgttggtacatttattttcatgtaacgcctgtagtttgctaatcaacaagcttggaatggcctgattgatgatgcctgataatttgtcctttacaggttataaaggtgctgctaagaaacaatagtcatttgtggagcgtaacataacggtgagcagtctagccttgttggatcgtgacatggaacttgaggccaagtttgcagtagttgccgacgctgcagacgtagtagcgcacgcctttatagtcgagcgggacgacggcgggcgggacgcggaagttgttgtaggggtcgtcggtggtgcagtcctcgtactccctcctggacacctgcaccacgtcgtagaacccaatctggaac

SEQ ID NO: 8239 - DNA, 1712 bp, Pennisetum glaucum
caccagctttgaccgcctcctccgcgtcccctccgctcctgctcctccccatccccactcccccgcaggagcggcggcggccggcggctaggttcactcctcacctcggcgagcggcggcggcaaaggcaaaggcaagatgttcgggcgcgcgccgaagaagagcgacaacaccaagtactacgagatcctcggggtgccaaagtccgcgtcccaggacgacctcaagaaggcctaccgaaaggccgccatcaagaaccaccccgacaagggcggcgaccccgagaagttcaaggagcttgcacaagcttatgaggttttaagtgacccagagaagcgtgagatttatgatcagtatggtgaggatgccctcaaggaaggaatgggtggaggaggagcccatgtcgatccatttgacatattctcatcattctttggaccctcttttggaggaggtggtggcagcagcagaggcagaaggcaaaggaggggggaagatgtagtgcatccacttaaagtttctctggaagatctttacaatggtacctcaaagaagctctccctctcgcgcaatgttatctgctcaaagtgcaagggcaagggttccaagtctggtgcttcaatgaggtgcccaggttgccagggttcaggtatgaaagtcaccatccgccagcttgggccttccatgatacagcagatgcagacggcttgcaatgagtgcaaggggactggagagagcatcaatgagaaggatcgctgcccaggttgcaagggtgagaaggttgttcaggagaagaaggttctggaagttcacgttgagaaggggatgcaacacaatcagaagatcaccttccccggtgaagctgatgaagcgcctgatactgtcactggagacattgtattcgtcctccagcagaaggatcactccaagttcaagagaaagggtgatgaccttttttatgagcacacattgtctctgactgaggctctctgtgggttccaatttgttctcacacatctggacaacaggcagcttctcatcaagtcaaaccctggtgaagtcgttaagcctgaccaattcaaggcgataaacgacgaggggatgccgatgtaccagaggcctttcatgaaggggaagctctacattcacttcactgtggaattccctgactcgctggcgccagagcagtgcaaggctcttgaggtggtgcttccaccaaagcctacatccaagctgacagacatggagatagacgagtgcgaggagaccaacatgcacgacgtgaacaacattgaggaagagatgcgcaggaagcaagctcatgctgctcaggaggcgtacgatgaggacgatgagatgcctggaggtgcccaaagagtgcagtgtgcacaacagtaaggagcctgcaaggtctgctacaacttttagacccaatgttatctctgtggttttggttttgtcgacgaaattatgaaacacggaagttgctgattctgattctacccctgtaagtgggggaaatgtatccttttttgctgtataactgaaaaaaatgctacccaggcgtagcttgctacttgtaactgttttgtgagactttgtagagtgctttctctataggcaacttgatggttgctgatggtacagaactgagcgcaatgactcgattatctgacggcactgccgttctgcatcgaaatatttttattgaa

SEQ ID NO: 8240 - DNA, 1633 bp, Malus domestica
tccctcgccgtctctcgttcttctctgctccctctgacgacatatctccaattaatcgaatctcaaaatcgattaaggggaataagtgagaatgtttgggagagctccaaagaaaagcgataacagcaagtactatgagatccttggagtttcaaagaccgcttcgcaggacgatctgaagaaggcttacagaaaagccgccatcaagaaccaccctgataagggcggcgatcccgaaaagtttaaggagttggctcaagcatacgaggttctgagtgatccggagaaacgtgagatctatgaccaatatggcgaggatgccctcaaggaaggaatgggtggcggaggtggcggccatgacccatttgatattttccaatccttctttggtggaaacccattcggtggtggtggaagcagcagaggccgaaggcagagaaggggagaggatgtaatccatccccttaaggtttctttggaagatctctacaatgggacatccaaaaagctttctctctctcgcaacaaaatctgctccaagtgcaagggtaaagggtcaaagtcaggtgcttcaatgacatgtcctggctgccaaggttctggaatgaaagtgtctattagacatcttggcccctcgatgatccagcaaatgcaacatccttgcaatgagtgcaagggtactggcgagagcattaatgacaaggatcgctgcacacaatgtaagggtgagaaggttgttcaggaaaagaaagtcttggaagtaattgtagagaagggcatgcaaaatgggcagaggataacattccctggtgaagctgatgaagcgccggacaccgttacaggtgatattgtttttgtcctacaacaaaaagagcaccctaagtttaagagaaagggtgatgaccttttctttgaacatacattgtcacttatggaatcactctgtggctttcaattcatattaacgcatttggatggaagacaactcctcattaaatctcatcccggagaagttgtaaagcctgatcaattcaaggctataaacgatgagggcatgccaatgtaccagaggccattcatgaagggtaagttatatattcatttcacagtggagttccccgactcactgaacccagaacagtgcaaggccctggaggctgtccttccccccaggacttcggcacaacttaccgacatggagttggatgaatgtgaggagaccacgctgcatgatgtaaacatagaggaggaaatgcgtcgaaagcaagcacatgcgcaagaggcatatgacgaggatgaggacatgcatggtggtgcccaaagggtccaatgtgctcagcaatgattagattaagcaagctttatgaagttatttgagaaaaataaaagttatcggcaccgtggtctgttggtctagcttcccagtgtttatttctggtttggtgtgtgaatccgaaacttcttcggaacaatagctgttaaggagatgcttattctacttaaacgtggtttggtctgttggtctgttgttgaatgctaagaatttgttctgctgcttttggatgctggtaagagtacaactgctaccttaaaatggcgaatttgcacaccgtaacatagcatcaatttgaaa

SEQ ID NO: 8241 - DNA, 1654 bp, Catharanthus roseus
ctcgcctgctgctcgctctccaactccaagtcaacaacagactcccaatccctagcttctagggttttcactgattttgatagagttgtgaaagcagtagatcgaagatgtttgggagaggaccaaagaaaagcgataatactaagtattatgagattttgggggtacccaagaatgcatcgcaagatgatctgaagaaggcttatcgtaaagctgccattaaaaaccatcctgataagggaggtgatcctgaaaagtttaaagagcttgctcaggcttatgaggttctgagtgatcctgagaagcgtgatatttatgatcagtatggagaggatgcattaaaggaaggaatgggtggtggaggtggtatgcatgaccccttcgacatcttccagtctttctttggtggtagcccctttggaggtggaggaagcagtagaggacggagacagagaaggggtgaagatgttatacatcctcttaaggtttctctggaggatctttataatggaacctccaagaagctctcactctcgcgtaatgtattgtgtcaaaggtgtaagggtaaagggtcaaaatctggtgcttccatgaaatgttctggatgtcaagggtctggaatgaaagtttctattaggcagcttggcccgtctatgatacagcaaatgcaacatccatgcaatgagtgcaagggtactggtgaaaccataactgataaggatcggtgcccacaatgcaagggtgaaaaggttgtgcaagagaagaaggtcctagaagtgattgtggagaagggcatgcaaaatgggcaaaagataacattccctggcgaggctgatgaggcacctgatactattactggagacatagtttttatcttgcaacagaaagagcaccctaagttcaagcgaaagggtgatgacctcttctatgaacacacattgtctttgacagaggccctctgtggcttccagttcatcttgactcacctagataacaggcagctccttattaaatcccagcctggagaagtaatcaagcctgatcaattcaaggccataaatgatgaaggaatggtgatataccagaggccattcatgagaggcaaattgtatattcatttcaatgtggaattccctgattccctggcccctgagcaatgcaaggcgctggaagctgtattgcctccaagacctgcaaagcaaataactgaaatggagttggatgagtgtgaggagaccacacttcatgacgttaacatcgaggatgaaatgcgaaggaagaatcagcaggcacaacaagaagcatatgatgaggacgaagatatgcatggtggtgctcagagagtgcagtgtgctcaacaatgagttgattgtggtatatgggagataggagccacatctaggaggtgccatgctgtcctctgttctgctacgatatatagactggtagtttaattatttggaatatttgttttcttttaaaagctaatattctcttccaggatttatagtttgaccattttgacagtatacttaaggtataatatgcaattatgtgtttattttctccctttccatgagatttagtatatatgccagatcttatatgtgcaaaagtatattatcctttctttaacgaagtggattggtgactg

SEQ ID NO: 8242 - DNA, 2124 bp, Cirsium arvense
agcaccgaagaagagcgataacactaagtactatgagatccttggagtcccgaagaatgcttcacaggacgatctaaagaaggcttataggaaagctgccattaagaatcatccggataaaggtggagatcctgagaagtttaaagagctggcccaagcatatgaggtactgagtgatccagagaagcgtgagatatatgatcagtatggtgaggatgccttaaaggaaggaatgggtggtggaggaggtggccatgacccctttgacatcttccaatccttctttggtggcaatccatttggaggtggtggcggtagcagcaggggccgaaggcaacgaaggggagaggatgtcattcatcctctaaaagtttctctcgaggatctatataatggaacttccaaaaaactgtctctttcacgcaatgtaatatgctccaagtgtaagggcaaggggtcaaagtcaggtgcttcaatgaaatgtgctggctgtcaaggttctgggatgaaagtttctatcaggcatcttgggccatctatgatccagcaaatgcagcatccttgtaatgaatgcaagggtactggggaaaccatcaatgataaggatcgctgcccacaatgcaagggtgagaaagtggtgcaagagaagaaggttcttgaagtccatgtagagaagggcatgcagaatgggcagaagatcacattccctggagaggctgatgaagctcctgacacagttactggggatatcgtatttgtcttgcaacaaaaggagcaccctaagtttaagcgaaagggtgacgacatatttgttgaacacacattgagcttaactgaagcactctgtgggttccagtttattttaacccatttggatagtagacagcttctgatcaaatctcaacctggagaagttgttaagcctgatcaattcaaggccataaacgatgaaggaatgcccatgtatcagagaccatttatgagggggaagttgtacatccacttcactgtggaattccccgactcattgtccccagagcagtgcaaggcactggagggtgtgctgccggctaggccttcaatgcagatgacagacatggagctggacgaatgcgaagagacaactctgcatgatgtcaacattgaagaggagatgcgaaggaagcagcaagcagcccaagaagcctacgatgaagatgaagatatgcacggtggagcacaaagggttcaatgtgcacaacaatgattgaagaaagcatgggttgctcgtctataggtggggtcttggcaagacaataatatgatatatcagctgtaattttgttccttatactatctacttctactactagtactatgtgaaatcgtctcgtctgttttgtgatgaaccttttgaagatgtatggatgatatttactcatttgaagctggtcttgagagcttttatctgttttaggtttttgttgcttgtttgaaaggagaaaacatttccttgatattctttaataagttatataacttgggttcttttttcaatcaaaccatatataatctccttatgatctaataacatattacaaccaaaccaaaacaatacatttgtgtgattatgaatgaataaatacacgatacttaaattatttatctagatatattatgcacgctattagagaaattgaacgtaaaagtactagctttcattgtgcttaatttccaggacaagtagtttcggtggtgcattggttgttgatgcaacgaaccgaagtggaacatggttgacaatcaccttgtatttcaggattgcatgaaatcgggacggtggtgggcgctggtggttgcatgtttgcagtatcatcggtagtgttattcaaagaggatactggcgtttgtttacttaactggttcaaattttgatctgcaggtggaggctgagatgatcccagatttggtgctggcgttgagttatgtgcttttgcatctctaagatcaggtggattcctgcaatctgatgaacctattgcaaacaagaaaaaaacaatcagataagcacagagaataatcataccatcaaactttctttccatcttaattattttgtttgagatacttccaatattgagatag

SEQ ID NO: 8243 - DNA, 1499 bp, Cirsium arvense
tttcgatctcttttcagatctacttcctcgtagatttgtattgagtattgaagatcgagggagaacaacaggatgttcggaagagcaccgaagaagagcgataataccaagtactatgggatcctgggggtcccccaagatgcctcccaagatgatctcaagaaggcttatcggaaagctgccattaagaatcaccctgacaagggtggagatcctgagaagtttaaagagcttgcccaagcatatgaggtattgagtgacccagagaagcgtgagatatatgatcagtatggtgaggatgccttgaaggaaggaatgggcggtggaggtggtggccatgacccctttgacatcttccaatccttctttggtggcagtgcttttggaggtggtggtggtagcagcaggggtcgaaggcaacgaaggggagaagatgtcgttcatcctctcaaagtttctcttgaggatctatataatggaacttctaaaaaactatctctttcacgtaatgtattatgctctaagtgtaagggcaagggttcaaagtcaggtgcttcaacgacttgtggtggctgtcaaggttctgggatgaaagtttcaatcagacatcttgggccatctatgatccagcaaatgcagcatccttgtaatgaatgcaagggtactggagaaaccatcaatgataaggatcggtgcccacagtgtaagggtgagaaagtggtgcaggagaagaagatgcttgaagtccatgtagagaaggggatgcagaatgggcagaagatcacattccctggagaggctgatgaagctcctgacacagttactggtgatattgtatttgtgttgcaacaaaaagagcaccctaagtttaagcgaaagggtgatgacatatttgttgaacacacattgagcttaactgaagcactctgtgggttccagtttattttaacccatttggatagcagacagattctcatcaaatctcaacctggagaggttgttaagcctgatcaattcaaggccataaatgatgaaggaatgccaatgtaccagaggccgttcatgagggggaagttgtacatccacttcacggtggaattccctgattcattgaccccagagcagtgcaaggctctggagggtgtgctaccagcaaggccttcaatgcagatgacagatatggagctggatgaatgtgaggagacaactctgcatgatgtcaacattgaagaggagatgcgaaggaaacagcatgcagctcaagaagcttacgatgaagatgaagacatgcatggtggtgcacagagggtacaatgtgcacaacaatgatttgtttgatggaagacaataattgatatcaggataatagtgcttaaagtttgtaatggtaatttcttatactcattcggaaaactggctaattcttcagtcttatatgcgtgtttgtgttgataacttggatacatgatccagtttgcttccaaaaagtatgtcaactt

SEQ ID NO: 8244 - DNA, 1544 bp, Curcuma longa
cctcgtcgatcgaggctgcgattcgtcagagtagtgacgggatcccgtgattccaccttgcatctgtgggctaccgatcgatcgggagaagcgctgcaaagatgtttgggagggtgccgaagaagagcgacaacacccggtactacgagatcttgggggtgcagaagagcgcatctcaggatgatatgaagaaggcctaccggaaggccgccataaaaaaccaccccgacaaaggaggcgacccagaaaagttcaaggaattggcccaggcttatgaagttttgagtgatcctgagaaacgggagatctatgatcaatacggtgaagatgccctgaaggagggaatgggtggtggaggcggcggacatgatccgtttgatatattccagtccttctttggcggtagcccctttggaggtggaggaagtagcagaggacgaaggcagaggaaaggggaggatgtgattcatcctctcaaggtatccttggaagatctctacaatggaatttcaaagaaattatcactctcacggaatgtgatctgccggaagtgcaatggcaaaggttcgaaatctggtgcttccatgacatgctctgggtgccgcggctcaggtatgaaggtcagtattcgtcaactggggcccggcatgattcagcaaatgcagcatgtttgcaatgattgcaaaggaactggtgagaagatcaatgagaaggatcgctgctctaactgcaaaggtgagaaagttgctcctgagaagaaagtgctggatgtgatagttgagaagggaatgcaaaatggacagaaaatttccttccctggcgaggctgatgaagcgcctgatactgtcaccggagacattgtgtttgttctccagcaaaaggaacatcccaaattcaagcgcaagggtgaagatctcttttacgagcattccttgtcactcaccgaggctctctgtggctttcagtttgttttgaatcacctcgacggcaggcagctactcatcaaatcaaatcctggggaagtcatcaagcctgatcaatacaaggcgataaacgatgagggaatgcccatctaccagaggcccttcatgaaggggaagctctacatccactttgcagtggacttccctgattcactggcacgggatcaatgcagagctctcgaggcagtcctccctccaaggtctgcgtctcagttgacggacatggagctagacgaatgcgaggagacgacattgcatgatgttaacatcgaggaggagatgcggaggaagcaaacccaagcacaagaggcctacgaagaggatgaagatgatttccatggtggcgctcagagagtgcagtgtgcgcagcaataagctggataaacatctatcatttggtttgtgtatcgagttatcgcaatctcaattcttagttgcattaagcatggataatttcgcagcagcatcataatcttgtcttttctatgtagttctacagcaaatcgatggattaagcaaactagatatttgttatgaattatattacatgtcttctaggca

SEQ ID NO: 8245 - DNA, 1743 bp, Eucalyptus grandis
ctttcatttacctcgcaatttcccccacccgccaacaaatcttgaccgtccatcgcctccccccttattaatcccagatcccccagctctctccttctctctctctctctctctctctagagccgtgtctgcgctcgacctccttcaaggccaggcctttcccctccgatccgtccagcttccccaagggttttccagtgaggcgggaagatgttcggaagagcgccgaagaagagcgataacaccaagtactacgatgtcctcggggtctccaagaacgcttcccaggatgatctgaagaaggcttaccggaaggccgctatcaagaaccaccccgacaagggcggtgacccggaaaagtttaaggaattggcacaagcctatgaagtcctgagtgaccctgaaaaacgagagatttatgatcaatatggtgaggatgctctcaaggaaggaatgggtggaggaggcggaggccatgatccgtttgacattttccaatctttctttggtggaagtcctttcggtggtggtggaagcagcagaggccgaaggcagagaagaggcgaggatgtcatccatcctctcaaggtgtctctcgaagatctctataatggtacatccaagaagttggcactatctcgcaacgtcatttgttccaagtgcaaaggtaaagggtccaagtctggtgcttcaatcaaatgtgtgggttgtcagggttctggaatgaaagtttccattagacaccttggcccctctatgatccagcagatgcaacatccatgcaatgagtgtaagggtactggggagactataaatgacaaggatcgctgcccacagtgcaagggtgagaaggttgttcaggagaaaaaggttctggaggtaatagtggaaaagggtatgcaaaatggacagaagataaaattccctggggaagctgatgaagctcctgacaccgtaaccggtgacattgtgtttgtcttgcaacaaaaggagcatcccaagtataagaggaagggagatgacttgttctatgaacatacattgtcccttacggaatcactttgcggcttccaatttgcattgagtcatttggatggcaggcagcttcttattaaatcccaacctggagaggtcattaagcctgaccaattcaaggcgataaatgatgaagggatgcctatctacccgaggccattcatgaagggcaaactctacatccacttcacggtggagttcccagacaccctgagccctgagcaatgcaaggccctggaaacaattctgccaccaaggtcatcagcgcagctcaccgatatggaattggatgagtgcgaggaaacgacccttcacgatgttaacatcgaggaggagatgcggcggaagcaggcgcaggcccaggaggcatacgaggaggacgaggacatgcacggtggtgcccagagggtgcagtgcgcccaacaataatggatgtgctgatcgaatgaaataacgttagacgcggcgatggattggctagcatctgaacgttgtggttatgcaaccctgtggagaccgacgtatctttgaaattgtgtttccgttgttctagcacctagattgtagtctcctttttgagagtttgcattgatattgaaagaacgtgatgaagaatttagtatgtggacctgcacgacttaagattatgttattgcatcgtgtatttggtatgcactcaggacctgtcgcctccccttcatttacgta

SEQ ID NO: 8246 - DNA, 1461 bp, Saccharum officinarum
ctcccggcacgacaccacgcttcccgtcggatcaaacagctagggtttcggagatgttcgggcgcgcgccgaagaagagcgacaacacgcggtactacgagatcctcggggtctccaaggacgcctcccaggatgacctcaagaaggcctaccgcaaggccgccatcaagaaccaccccgacaagggcggcgaccctgagaagttcaaggagctagctcaggcttatgaggtcctcagtgaccctgaaaagcgggagatttatgatcagtatggtgaggatgccctcaaggagggaatgggaggtggtggagggatgcacgatccctttgacatattccagtcattctttggtggtggcagcccttttggaggtggtggcagcagtaggggcagaaggcagcggaggggagaggatgtggttcatcctctgaaggtttctctggaggatttgtacaatggtacatcaaagaagctctcgctgtcccgcaatgtcctctgctccaagtgcaatggtaagggttcaaagtctggagcttcgtcgaggtgtgctggttgccaaggttctggctttaaggtccaaatccggcagttgggacctggaatgattcagcaaatgcagcatccttgcaatgagtgcaagggttctggagagaccatcaacgacaaggatagatgcccacaatgcaagggtgataaagttgtgcaggagaagaaggttcttgaagtggtagttgagaaaggtatgcagaatgggcagaagatcacattccctggtgaagctgatgaagcgcctgacactgtcactggagatatcatctttgttctccagcagaaggagcatcccaagttcaagaggaagggcgatgacctcttctacgagcacacactgaccttgactgaatctctgtgtggcttccagtttgttctcactcacttggataacaggcagctgctgatcaaatcaaatcctggtgaagttgtgaagcctgattctttcaaggcgatcaatgacgaaggcatgcccatgtaccagaggcccttcatgaagggcaagctgtacatccacttctcggtggatttcccggactcgttgagcccagagcagtgcaaggccctggaggccgtgctcccgcccaagccggtgtcgcagtacactgacatggagctggacgagtgcgaggagacgatgccgtatgacgtgaacatcgaagaggagatgcggaggcggcagcagcagcaccaggaggcctacgacgaggacgaggatatgccgggcggggcgcagagggtgcagtgcgcccagcagtagtcagctcgtggctgctattagtagtagcaatgataaagtttgacggtggcggcaaatttgttgtttcgctttgtgcgactactgttgggccaagttttcccgcgcgtattaatgtgatgatacttcggttacaagaatgcagtattcaatc

SEQ ID NO: 8247 - DNA, 1570 bp, Solanum lycopersicum
ccacgaaatctcactcaccaagccctttctctctgttttcctcttcatttccctaaaaacaccgtcaagaacctctcttctcctcttctcgccgcaactttcaatcgtttctattgacgtagttcaacagatcgaaagatgtttggaagagcaccgaagaagagcgataatacaaagtattatgagatcttaggagttcctaaggctgcttctcaggaagatctcaaaaaggcttatcgtaaagctgctatcaaaaatcatcctgataagggaggcgatcctgagaagtttaaagagcttgctcaagcttatgaggtcttgagtgacccagagaagcgtgagatatatgatcagtatggagaggatgctctaaaggaaggaatgggtggtggaggtggtggacatgacccatttgatatatttcaatcattcttcggtggtggtggaaacccctttggtggtggtggaagcagcagagctcgtagacaaagaagaggagaggatgttatccacccgctcaaggtttctttagaggatctttacaatgggacatcaaagaagctttcactatctcgcaatgtgttgtgctcaaagtgcaagggtaaagggtccaagtcaggtgcttcaatgaaatgttctggctgtcaagggtctggaatgaaagtttctatcagacagctcggtccatccatgatccagcagatgcagcacccttgcaatgagtgtaagggtactggtgagatgatcagtgacaaagataggtgccctcagtgtaagggtgagaaggttgtgcaggagaagaaggtgttggaagttcacgtggagaagggtatgcagaatgggcagaaagtaacatttccaggcgaggcagatgaagcgccagataccatcactggagacattgtttttgtcttgcaacaaaaggaacatcctaagttcaagcgaaagggagatgatctttttgttgagcacacattgaccttgactgaggccctatgtggtttccagtttgtcttgactcacctagacaacagacagctgctcattaagtcccaacctggcgaagttgtcaagcctgatcagtttaaggctatcaacgatgaaggaatgccgatgtaccaaaggccgttcatgagaggtaaaatgtacattcacttcactgttgatttccccgagtcattaacagcagagcagtgcaagaaccttgaggctgtgctgcctccaaaacccaaattgcaagtatctgatatggaattagacgagtgtgaggagactactttgcacgatgtgaacattgaggatgagatgcgaaggaagcagcaagctgcccaagaggcatacgacgaagatgatgatatgcctggtggtgcacagagagtccaatgtgcacagcagtaatttggcatttgctatcttgtgataagtgggtaggttactagtaaaaggatatggatattttttcttatgcagaccgacactaagtgtgcttacatgtttacgcaatttgaatttgttttgatctgttatgtcattcaataaccctttttaattccaagtccaatttgaaact

SEQ ID NO: 8248 - DNA, 1641 bp, Populus trichocarpa
tcagaaacaatattataggaatactcaataacaacaagaataatatatttctactatctacccctcccaccaatcaaatctccaccgtccattctttctttcccttaaatacacagatctgacatacgctcaacccctctctctgtctcgccgtctctcttgttgctctccgtgataaaataatctaaccatctgattttaattgatataaaaaaatgtttgggagagcaccaaagaaaagcgacaacaccaagtactatgaggttcttggagtctcaaagagtgcttcacaggatgatctaaagaaggcttataggaaagcagctatcaagaaccatcctgacaagggcggtgatcctgaaaagttcaaggagttggcacaagcatatgaggttctgagtgaccctgagaaacgtgagatatatgatcagtatggagaggatgccctcaaggaaggaatgggcggcggcggcagcggcgcccatgatccatttgatatcttccaatccttctttggtggtggtaatccgttcggtggtggtggtagcagcagaggccgaaggcaaaggaggggcgaggatgtgatccatccccttaaagtttcttttgaagacatttataatggcacatccaagaagctttctctttcacgcaatgtaatctgctccaagtgcaagggtaaaggttctaagtccggagcatcatcaaaatgtgctggttgccaaggttctggaatgaaggtctccataagacaccttggtccttctatgattcagcaaatgcagcatccctgcaatgaatgcaagggtacgggcgagacaattaatgataaggaccgttgccctcaatgcaagggtgaaaaggttgcccaggagaaaaaagttttggaagtagttgttgagaagggcatgcaaaatgggcagaggataacgttccctggagaagctgacgaggcacctgacactgttacaggggacatcgtcttcgtcctccagcaaaaggatcaccctaagtttaagagaaagggtgatgacctatttgttgagcacaccctatctcttaccgaggcactctgtggcttccatttcgtcttgacccatttggatggaaggcagctcctgataaaatctcaacctggggaagtagtcaagcctgatcaattcaaggctataaatgatgaaggaatgccaatgtaccaaaggccatttatgagagggaaactctacattcatttcagtgttgatttcccagattccctgtctactgatcagtgcaaggccttggaggctgtgcttcctccacgagcctctgttcagctgactgacatggagcttgatgaatgcgaggaaactactttacatgatgtgaacatcgaggaggagatgaggaggaaacagcaacaacaggcccaagaagcgtatgatgaagatgatgaaatgcctggtggtgcccagagggtgcaatgtgctcagcaataatcactgaaatagggatgacagtgatttaagagaactgaatgtgatttgacaacaaattatttagacaattatttagactacctagtttcttgtatgaatatttatgttcgcagagactgataattgcttagtgtttgaacctttgaaagatctccaagaacag

SEQ ID NO: 8249 - DNA, 1639 bp, Capsicum annuum
gcacgaggatttacccagcacctccaagtcaagtgctctctcttttccctcttcttgccccgcaactttcaatcgttgaagcgatcgaaagatgtttggaagagcaccgaagaagagtgataatacgaagtattatgatatcttaggagtacagaaaagtgcttcacaagatgatctcaaaaaggcttatcgtaaagccgccatcaaaaatcatcctgataaaggaggcgatcctgaaaagtttaaagagattgcccaagcttatgatgtcttgagtgaccccgagaagcgtgaaatatatgatcagtatggggaggatgctcttaaggaaggaatgggtggtggaggtggtggacatgacccatttgatatatttcaatcattctttggtggtggtggaagcccctttggtggtggtggaagcagcagaggcagaagacaaagaagaggagaggatgttatccaccctctcaaggtctctttggaggatctttacaatgggacatcaaagaagctttcactatctcgcaatgtgttgtgctcaaagtgcaagggtaaagggtccaagtcaggtgcttcaatgaagtgttctggctgtcaagggtctggaatgaaagtttctatcagacagcttggtccatccatgatccagcagatgcagcacccttgcaatgagtgtaagggtaccggtgagacaatcagtgacaaagataggtgcccacagtgtaagggtgagaaggttgtgcaggagaagaaggtgttggaagttcacgtggagaagggtatgcagaacgggcagaaggtaacattcccaggcgaggcagatgaagcgccagaaactatcactggagacatagtttttgtcttgcaacagaaggaacatcctaaattcaagagaaagggagatgatctttttgttgagcatacattgaccttgactgaggccctatgtggtttccagttcgtcttgactcacctagacaacagacagctgctcattaagtcccaacctggcgaagttgtcaagcctgatcagtttaaggctatcaacgatgaaggaatgccgatgtaccaaaggccttttatgagaggtaaactgtacattcacttcactgttgatttcccagagtcattaacaccagagcagtgcaagaaccttgaggccgtgcttcctcccaaacccaaacagcaagtgtctgacatggaattagacgagtgcgaggagactactttgcatgatgtgaacattgaggatgagatgcgaaggaagcagcaagctgcccaagaggcatatgacgaagatgatgatatgcatggtggtggtgcacagagagtccaatgtgcacagcagtaatttggtagtgttctggtatttgtgctgtcttgtgatagagggtagattactaaagggtttggttgtttttcttatgcaaacttgacactacgagcagaattttactgctcgactattgtaagtgtgcttacatgtttacgcaattcgttttattttattcaataattcttcttacgtcgaagtcgcatttgaaactaacgtgcgtctcatatagttctaacgattttgggattataatttgtttcactagggtgagtctttattcacaatcaacgttatttgtaa

SEQ ID NO: 8250 - DNA, 1693 bp, Cucurbita pepo
cgtctcgagcgacccctttggtttctctgctcgcaggtcgatctctctacccgctctttcacttgaagatcgtccctttcgctcttgtgagggtttgttgagatccgatcggtgaggcaaaaatgtttggaaggcccaagaagagcgacaacaccaaatactatgagattctcggagtctcgaagaatgcgtcgcaagacgacctaaagaaggcttatagaaaagccgctatcaagaaccatcctgataagggtggtgaccccgaaaattcaaggaattagcacaagcctatgaggtactgagtgatccagagaaacgtgagatatatgaccaatatggcgaggatgccctcaaggaaggaatgggtggtggcggtggtcatgatccatttgacatattccagtctttctttggtggaagcccatttggcggtggcggaagcagcagaggacgaaggcaaagaaggggagaggatgttatccatcccctcaaggtctccttggaagatctctacaatgggacttcaaagaagctctctctttcacgcaacgtaatttgctcaaagtgcaagggtaagggctcgaaatctggtgcttcaatgaattgccctggctgtcaaggatccggtatgaaagtttccatcagacacctcggcccctctatgatacaacaaatgcagcatccttgtaatgaatgcaaaggaactggtgagacgatcaatgataaagatcgttgctcacagtgcaagggtgaaaaggttgttcaggagaagaaagttttggaagtagttgttgagaagggtatgcaaaatggacaaaagattacatttcctggtgaagcagatgaagcgcccgacactcttactggagatatcgtttttgttctacaacaaaagagcacccgaagtttaagagaaagggcgatgacctcttcgtggagcataccttgtctctcgtcgagtccctttgcggtttccagtttattctaactcatttggacggccgccagctactcatcaaatcccttcctggtgaagtagtaaagcccgatcaattcaaggctgtaaatgatgaaggtatgccaatgtaccagaggccattcatgaagggtaaactttacatccacttcagtgtggagttcccagactctttgaaccctgaacagtgcaaggccctggagggggtgctaccacccaggtcttctgtgcagctctcagacatggagttggatgaatgtgaagagaccactctccacgacgtcaacatcgaagaggagatgcgcaggaagcaagtacaagaggcttacgacgaagacgatgatatgcccggcggtgcccagagagtccagtgcgctcaacaatgattttgaatggtgctccacagacagctacatcaaaattttgggatacccaaatggaggaaagggatcgagcagcagccagcagcagcagcagctccaggcagtcatatccaatttttctaaaaaataaatagatgactttgattatattaatttagtcggggtggtaggataacgaagcaagtttccgggtttatgtttttgttctccttactatgtgctttctagcttaccatgaactcaaacaattatgtatttcatttgcagataaaataggattggattgggaaacacaaacatctctctctgctttatgttttttttttctttattt
